United States Patent 7,365,185 (GENOMIC PLANT SEQUENCES AND USES THEREOF) - sequence listing, part 97

SEQ ID NO: 83261 - DNA, 15198 bp, Oryza sativa
  unsure (1)..(15198): unsure at all n locations
caatagtatctttcctggtatctctgaaaatcacatcgattctatttttcgtcctttcaatactatctttgaaaattccttgattccattcttcatcctttcaagattatcttcgaaaatttcagtaaaactcatgggtaccaatttcatttttcgaccattttgtctaaatgtgtatgtattagcaacaaaattatgcgaaccattatatcatatagccatggttgaccaaacaacaaagaacattcttgcatagggacaagatcaaaattggcagtatcatggtaatttccaatcaaaaagtttattctcacaactctatttaccttgaccttaccacaagagttgaaccatttgatgtaatatggatgaggatgcggttgtgtaggcaattcaagtttctcaaccaaatctaaactcacaaagttattacaactctcactatcgattatagtacgacatgctctatccttaaccacaaactttgtttcaaataattcgtggtactgccattgctccgctttctccatttgagaacttagtacttgttgcaccaaagtactgtcatcacgtccaccttgttggtatcgctgattttgagcgcgactcatacctgtcattaagaatacaaaaacaacaacaaacaatgaaggttatccctaataatctgctacgcggtgtagtggtgccccttaacaactcagccaaacggagcaccttaccaagctcttacaagtgtcttaccagcaatgctaaggacggtacaaccggtggctagttcgtgacaccttgaaggacgtgatgtggcgattgcaaggatcagcggtgctgaccagaagtatatatgtgtagcttgggaggcacaatatatagtagcaaaggaacgcaattgtactaatcagaaaatgcaaagttgaataatagttcaaagtactagtcaatgtgctggcctagtctagactcaactctagctcaagcaagcacccgacaaaactaatgactagatatgaatcaatgcacaactctgcactctgaaaacatactcaaaggatgatttttttttttctttctaggtacggcttttttaagcacctttctgcccttttttttgtgcggctttctgccttttctttgcacctttctgccttttctttctttttttattttttttacttttttttaacaagaactgaaccactgacttcaaacaaggactcaaatgtaaatatgaatattatagggactcaaatgcaaagtgcaaaactaaaattgggtcacctcaaaaatggattgctcatatcatgtaggttccgtttttataaaaatatctcaaattggctaaaggaatttcagtgtaacaatacttgattgaggaaaatacggagagaggtgctagaggaactcagtcacggtatggatgactcgaccgaacagaccaaaaagccaaacaaaattggttccacccttatccacaactctatatatctctccctctccctgtatatgctattttctaggagatatttaatagatctgatactcgtgcgcgcccgaggggccctaatacgcgactagtcgcgcggccctccagacgcgcgatcagccgatcagtactactagtatagttcagtactagtactacaacagaactactagtagtactactacactactattactactactattgtcattatactaccactagtattactactataatatatatatatttatatgtatatattttttatgtataaaaaaatatatacatatacaaactttgtatacgatgtgtacaaactttgtatacgatgtatacaaactttatatacgtatgtattaaaaaaatacaataaaaactagaaaatacatcacttatacaaacttcgcatacgcgtatacaaactttgcatatgtacgaatacaaactttgcatacatacgaatacaaactttatattcatgcatctttgaaaaaacagggaaaagaaccgaacagaagagaaaccggaaaaaaaaagaaaaaccaaaccgaaaagaaacgagaaaaactcactactccctcctctcgcgcggcgcgtccgccgcccctctccgcgcgcgacatgtgtccagtcgcgcggggaggggtgcacgcgactgatcgcccaatagctttttcggtgcgcgcccacaagcacggcaacacataaaccctcctttcccctctgcgcgccaaaagcacggcaacacagaagcaatagcaataaatcaactctctaaccgctcgataaaattttttggaaactacgaaaacggaaacccaacgacgagacgattcaatttttcaaggtcctggcaacaaccaaccagatgaaaaactggacctaaaacaactcagacagacttgagtgatgaaccctaaacctaagtgatgaacagatgcaatactcaaaactaaaaattaaatctaaaattaaaccagcactcgacacgacgatgcaacatagaattcaacaaagcaaaatctaatagaacaatgcaacggctcaaattgtccaggtaaagaataaatatttttatgtggcaattttctggttatgggaacataaattaactaacgggcaactgcgctctgataccaactaatgagggagttaggtcccgatcttccgataggtactgataaacagtcgatttgggcggagttgcgacacaactcgatccggcttctgaacgaacacgctactgagccccgcaatcgcagcaccacgtctcctctggttatcaaccgtgccgaaacccgattgacctcgccgagatggctaatccctgcatgcgaatcgaagaatacaagcaagaacaagatagattgcaaccaaattgcatatgaatgattaagcacacgaatttggggttacacaaaccgatctatcggcgaaactgttcctgacagattaatttaagcaaaacctgactctaaacgatgacggctactaaataaaaaagattagggacgtcctacggttgccctagggcgtagacccccttgggctaagcctacgacacaattacaaggccgaaaacccaaatcagattcggactggatgagatacgtggcttgttttgcagatttctggcagctcggtaggaattttgacatgggaccaaaaccatatgaaagtagactccataatctttctaacaagtactcatgggcccaaaaattacttctagatcagcggctaggtccattttaagttgatgctctcaggagggccgaatccgaatccaaaacatgtataattttatctcgtcttctatgggccaaaagtgacatgatgaggtagaagtagacttggagaaggttttggtttggtccccaatcaacttctttaatcatccatgcattagttacgctcggtctcttttcctttgcctaagcaagtacgtctgcaaacgaaaacacacaaaagtcattgtgtagcaacgtttgttcaaatatataacaagtaaatataatgtagaacatatgaatctttatttgattaatacataaggtagttatggttatatccgagttagatatgtcctcgtcaatcaatctgtacaccaaacaaatataccaaaataatatacagagacaagcactgacctgatcgtttctttatctcttatgttcctgcgcgtgtgttgctattgtgccgtgcgaagaaacaaaacaaagtcaactcttgatctgcctgatcgtgtgaatattgcaagcttgtgatgagattagatagcgtcgccgaatggcgaaacgataccgaagcaggactgactggccgccgccaccgaatagatcaattcggcgtgcagctgacaaaaatgcacagtagattgatttcggttgaatcgcaggaccgaaattgttttcaccagtggagtcgccaagatatgttgacgcttttttttgctaatacaatatgacctaatgatttgtggtgtattcaatagagtcgtcaaaatcgctagatcaaaatctgctagtgaaaccgatttcgagattaaatcgctttcgtggaatcacatgactaatttacaagcaaattagtaaagaagataatatcgtacttacgtgacgatgaacgactagtttccgagcaaactagcaaaggataagcttctcgctttcgtggacaagcacgatcgtttttcagcataaaacagcaaagattaactatattatagggttgctagaactcagccatgaaaacaaaatagaaaagaactaagaagtaaaagagatgaatattagattgaaattgttcgggttcccttctattctaccgtggaccaatatatatagctaattgccatgatcttttggcatttctactcggtcccacgcaatatgcaacgatggtttaccggaatatttgaaacaattcgatgtaacaaaatctttatcttctaacttgataaatatcgcacgcggcttggctcggtcgccggagccctgctctcaacgcagatgccacgcgatggttggatccagcgaataccatcacatccacgcaagcagcactcccatcacagccacacgtctgagcccctggctcgctcgatgacgatgtagactctttggctcagtaaatacgacacctgactttccatctgcaggagcaacgaaggattcccttgccacttaatcacccaattagggataatcacctgcctccgtgattaacgtaatgtgaccacgccctgtatagcttctgtagcctgcataaaaaccaaatatacatatgcatatatatgtaatcagcttgcacaggccacaatattataaactacatcggtctatattcatttagtcaatactatcacatatgaccgatgcatcacaatttcctacacctgtaaacggagtagattttccaagtgaatcatttgacagttgtatcatcaattctaaaccaatctgtccttcacacatgcactaactataagccaaattatcatacaaacaagtttaatagtataagcaaattcaaaacttgccccccgaggagagattataaccaagctgataccacaatcatgagtacaaaccgatccatcaacgaataaagtcaagggcacaatttcaaccgagccgattgaatcatcacgatgttccacaataaaatcggctatagcttgtcccttgattgccttgggcgattcatacctgaggtcaaattttgtcaaagcatatatccactttccaactcttcctttgagaactggagctaatagcatatatttgatcacatcggctttgcatacaacaatgcattcattggataacaaataatgccttaacttggtgcaaaagaagtataaacacaaacataatttttccactagagactaacttgtttctgtatccaatagcctatggcttaaatagaaaatagctctctccttgccctctagttcttgaatcaaaactgagccgattgacttctcatcggctgatagatataacctgaaaggcactctcttttgtggaggaattaaaactggacgagaactcaaatatgccttaatgttgtccaaagctttttgctgctccgccccccaagtnnnnnnnnnnnnnnnnnnnnacgtttacaaaggtgtaaaaggttctaaccttccagacaagttagatataaaccttcgaacaaaattaatcttgccgatcaacgattgtagttgcatcttatattccggaggttaaatcttcttgatggcattaatactcctttgagggacctcaattcctctctcatgaacaagaaaacacaaaaattgtccaaccgatacaccaaaagcacactttgttggattcatctttaaaccatactttctggttctctcaaaaactttcctcaaatcggctatatggtcctccacctgctttgatttaaaaaccacatcatcgatatagacctctaccaacaagccaatcagatcatggattatgtaattcatggccctctgatatgtagcttcagcactcttcaaaccaaaagtcatcacaacccactcaaataagccgattgcaccaggacatctgaaagcagtcttgtgaatgtcttcttctgccataaaaatttgattgtaaccagcattgccatccataaaacttataatcttatgtcctgaagcagcatcaaccaattgatcggcgatcggcattgggtactcatccttaggtgtagccttatttagatctcgaaaatcaatgcacaccctaaatttgccgttcttcttgataaccggaactatattagaaacccactcggcatatcggcacggccgaataaaaccagcatcatataatcgagtaatttcagccttgatagcatcatacatttgagccttacatactatatattcttatttctacataatattagtaaacaattatgaaatcaaatataacattttgaaattaacatatcatatttaacaaactagatgatgggacgaccacatgacatcaaagagtatacataaaaccaacaaaaacataccattggaaattaaacataataattattttttacatgtcatgaagttttctctcctatctagatctaggcaaatagataagagcaatgtatataattttattccattatattacattataaaatcactagaagatgagagaaccccatagcatcaagaaaccacataaatccaacacacatatcaaagcaaaatacaaaaaaaaaaaagagaacacaatcatgggagctagcttttcccctcactattttacatgcatagatccatcctaaaaggaggtttaaattaccaaaaaactatgtatatagagtgcaaaggcatagatctaatcactgtagaaaaatccctcgaaaatttgaagttcaaaacctacccctatattttggtgcctttaagatagtgaaaatcgtcagatatgaatagaagctcggggaggaacaagactatatagccggcctgatttttgcatgcgacgaaaaatggtcgcctgcgaagatttttgcaaacggcaccaaatgggcacctacgaagttccatcttcgcaggcggaccacataattagaccacctagaataatcgcaggcggtcccttatgtggtccgcctgcgaagatggagctttacaggcggctcgcttggtccgcctacaaagatctatcttcgcaggcggaacaaaaccatggccccggtatcatttatcctaggtggtgctccggtttttaggtgcctacccatctgcaaaaataaatggccaacgtcgctaaagaccatttttctagtagtattgataccataaaatataatttcgtttccaaatatcctaaaggcgtatttgtctttctcaaccctaacgacatacgcatatccagtacaattgttcgattaaaatatacctgttgcgatcagtgcatttgattccatattccctcccacacgattattaaagacatctccccagtactatatatggtgcttgcagtactatatagcatccataaaatataaaatccgctctaaccaaccaccatcccctcacacaacacgctagctctaataatctcatttgcaccacagaataggacatataaatgttatagttaattaatcacacagcaacataccctgtaactagctagctattaaacagacattcctctgaccatgtgcatccatatatactatagtattttgcatgactactaaactgattagcttagctatagctcacttgcagacaacccttcagtacacttcaagctgttggactcactgaacagacttgtccaggagcgcgcatccagctctcgatcaaaacaagcacagttaagtgcatctctgtactaatgatactcgcatctgcagcggccagcacacagaagctagcttgcacacttaatttgagtactcctttaatttattgagtatactctttacagacctatcctgatcatttgccgggtttctagagaagtgtaaaagttaattgactgcagccattcatgaaagcctgtaggtttcaaaccatgcatatgcatgcgctgccccttcacgatttctgaaaacttctgtaacactgagaaatcagcgggttgccaatgccgtggcctcctggtgcaggaggccacagctggtgcacacaaggatgttcttaaattcatctatgaccgtgtttagatctaagggtgaaaagtttcagtgtgtcacatcggatatatgaacacatatttaaaatattaaacgtagactaataacaaaacaaattacagattccacctgtaaattgcgagatgaatttattaagcctaattaattcgtcattagcaaatgtttactgtagcacctcgttgtcaaattatggagcaattaggcttaaatgatttgtctcgtaatttacacgcaatgtgtctaattagttttatctttttgtgtatatttaatatttcatgcatgtgtctaaacattcgatatgacaggatgaaaagtttttgcgtaggaactaaaccgggcctctaaatgtagtcacagttgacatctagctagtatatttctgatcgcccgtatgttgcttgtgcgtgctgtactgcactttcctggatgcaatcactgtcttgtttgttaaattctctgcagatcacagggaaacttagcctgttctcatatgcaatggaaaagttaaggctagctagggatggggcttgtgtctgtactcaaggctgcgcaaagaagggaacaaactgagcgcagaacccgattgaaactgtatattctatcagatgatgaatacaagagctatatatatatatatgaatgtcttctggtatacatgttttttgttgggaagagaaaatgaaaacaaagagtagcatggagaaatgagaagggaatatgtactgtagagaatggaatccgtgcaagtactgctagctgcaggaatgcatcagaggaaatatatactagagagcatgttctgcatcatatgcatgtgcatggtttaactgctggaatgtgtcagtactgagagcttaatttgtagacaggggagggaagatgacatcttcatcctcacttgccaagcactacagtcaccttgtgtctgtacatgcagatagctctaccttcctcatagttgaaagctgatcagcatgacatgttaaaaacacagagataaacacgaggaaaacaacaataaggatgaaccaggctatgcatgttatactagctaaccagaccaattcagtcaggtataagatacacaggcttgatttactccttacggatggaaatatttgtatttacttgctggttgaatattaaatatttatttttttaatgatcattgagatcctcttcagaaactacaaagtaccatattttctcaaacaaatttaagatactttctaatattttggatacccaagggtactaaggacatattatcactaaaaaaaatgtggtaccgtgaatgttaagaaacttcttagatattatactagtataaatctcacctggcaggggaaaaaatacacatgttttccatgatattgaaaataaactaccaatacgaaagttcagatatatacgcgacatagttaatactgtaattgaatattgatcttttgatagatttccgttgttatagaagctgaggtcatatgagttttaatgaagtgattattaattgttcgatattcatatacttgcacgttgaatagaggatacggtgaaagagcactaattaatttaaactgacaccagcaataaaaataaatagataatggctgagaatactttgccaacatgcacaataagaaccagataatattggccacgataaaacacatgcaatctaaagtttatgctatcagctgatatcagttgaaagatatttctgtcaatgataataaatatttatttaaccggtctactacataaaattttataactacaattcaacacattgtgacagagtatgacaaatttttgattttttttcatgtggtatctttgaagaaatatacactatttccacagatcatctatggggggtaagagaattagcataggatataaaacaagaatacaactatatttgtttagcgtaatctaatttgacattgtttgagatcagccgcaagatgttttgaataactggcaattcagttcattcaattagtgtaatatataaggttaaccagagaaagtttggaactacattatgtgataattttcgtgcatcaatgcaaggttttaaattggaattcagtaccttcttacacagcatataacaagtcactttagttctttttttcattacagttccctttcaagagaaaaatgatttcttcaaatcattccaaggaaataagcagaattaacatataggataaaacaaggataaattcagatagtgcaaaccaacatttcaatgaaacacgagtggtgaataaatacaaattaaacatttgtaatcaagttgagatacaacagtggatatgaaatctactgttcttttggggcttccccgagtctaagctcaagatctagttcttcaaccgaggagctacgataaagttttagtatcttttcatgatgttggtcatcaccaccatcttgctgttgatgattactggttgaagaagttagaatcagggggtttacctccaaatcgattcttcttttcttgtgacttgcttcaacagtcttttcatcatccgcgcggtcgttatcgtacataaagtcccttcttgatcggcaccccaaaacagtagttatcttcaattcatttttcccaacacgcaggtcaagattagaactcaccgtgtcatgatcctgtgccaatcgaacagcaccaagaaacaacgtctccctcttaccatgttctctaccagccgacggcgacttcgatgagacaagaggggcgttcaggacttgtttgcccaaggcagttctagcagctgcaacttgaagcaaggatctagcagggtacgcgacaacatcacatatggaattagggttagtgtcagcagcgagaatactgccacttctagggtttgggctgtaggcgtgctgcagggtgccaatttggggagggcatggttgtatcatgtagttttggtttggcggcatgccgtggctttcgccgccggtgccgtcctccacaaccccagagagcttgagccttgcccggtccctccggtggacgttcatgtgcccgcccagcgcctgcgccgaccggaactcacggccgcagaagctgcaggagtaggacctcggcggccagatgcagcccccgagatgccctgcggagtcttccgcgaaggcacgttcctcccatgactcgtagtaggaggtggagctgccgccggcgccgatggtgatgtgaggggtggggaagagaggcgccttctgatctcccagcttcctcctggccaagatccagtaccttgctggatccatcaaatgacactaactaacttttacagctctagctcttgcaggtgccaaagatgatggaaagagggctagatagagaagaggtgaaacatctgaacccaggattgaggaagacagcagtacatgtgaggatctagctatgagagggccggagcagaaggggggaagaagagctgcaagctagccggggaagttagaaagaggcttgatttgcttgtctttatggatgcaactgactcatattctgatcgtctgtagtactattaattagttcctccaaccaataatagtacccaatagggccccatcattttcttctcagtttcttacacaagtgtgactttcctggatgcaatcactgtcttgttgttaaatgctctgcagatcacagggaaactttgcctggtctcgttaagcaatggaaaagttaaggctagggatggggcttgtgtctgtcctcaaggctgcgcaaggaagggaacaaactgagcgcagagcccgactgaaactgtatattctatcagatgataaatacaagaaccaaaaaagaaatataggaatgtcttctggtatacatatttttttatttgggaagagaaaatgaaaacaaagagtagcatggagaaatgagaagggaatatgtactgtagagaatggaatccatgcaagtactgctagctgcaggaatgcatcagaggaaatatatactagagagcgtgttctggcatcatatgcatgtgcatggtttaattttaattccactgctggattgtgtcagtactaagagcttaatttgtagataggtgagggaagatgacatcttcatcctcacttcccaagcactacagtcaccttgtgtctgtacatgcagatagctctaccttcctcatagttgaaacctgatcagcacgacatgttacaaacacagagacaaacacgtggaaaaccacaataaggacgaaccaggctatgcatgttatactagctaacctgaccaattcagtcaggtaataagattcacagggttcatttactctttgccacttaccataccatatgtgagtacgggtggaaatatttgtatttatttgcacgttgattaaatatttatttatttaatgatcatttagatcttcttcagaaagtacaatgtactatattttctcatacaaatttaagatacttttctaatattttggatacccgagggtatactaaggacatattatcataaaaatatatgtggtaccgtggatggtaagaaacttcttatatattatgctggtaaatctcagctggcaggggaaaaatagacatgttttccatgatattgaaaattaactaccaatatgaaaagttcagatatatatgacatagttactgtaaattaattatattgatctttggatagatatccgttgttatagaagctgagcacatatgagttttaatgaactgattatccgttgttattaattgtttgatattcatatacttgcacgcgttgaatagacgacacggtgaaagagcactaatataattaatttaaactgacaccagcaataaaaagaaatggataatggctgagaatactttgccaacatgcataataagaaccagataatataatattgaccacgatataacacatgtgccatctaaagtttatgctatcaaccctactggagaactaatctttgttggcttagccgaaaaccacaattaatagccccggttccaaaaagaacccagactaaaaatcatctttagccccggttgaaaagcccatagctattttatgatctttagtctggttggtactaaagatcgtttttagtcctggttaaaaaagtgtatgccccctattctttttattcccggttggaaataccaactgggactaaaaatcggtgcatagtatataatccctagcacttatcctctagcaatcacctcttctttatcctcctcttttttcttatcctctccctttcctctctctattcttatcctctcaagcaagcaggccagagggcgagcgagtaggacgggcgggcggcggcgggcggccggcgcctctgccagagaggaggcggcagcgacatcgcaaaattgtttttgttcttttttttgagaatttgtgattcattgcatggatctgagatgtataatctgtgatgtatttgatttgtgtgtgatgtgaatatgtgaagtatttgtgatgttttttttagaatttgtgatgtatttggatatgatcaatttagagatttagagatgatacttttttctgcgatgatcgatttggggatgatttggggaagtagtgaaatgaatattcaaagttaaaacaatgaaaaaaagaaaaaaaatctaccaactggagctggcctggctccatctttagttccggttggtaacaccaatcgggcctaaaaatggatatttttaatcatggttattttaactaggactaaagatgggtatctgtagtcctgtattcgtagtcccggttgcataaccgggactatagggggttataaaccggggttaaaaaccctttgtccagcagtacagctgggagatatttctgtaactttagttttatatcatttgcacgataaaattaaccgctctactagataaaattttataactacaattcaacacattgtgacagagtatgacaaattattgatttttttcatgtagttatctttgacaaaatatacactattcccacatatcatctactggggaaagagaattaacaaaggatataaacacgaatacaactatatttgtttagcgtaatctaatttgacattgttcgagattagccacaagatgttttgattaactggcaaattcagttcattcaattagtgtaatatataaggttaaccagagaaagttttgcaactaaattatgtgataatttttgtgcatcaatcgcatgtaaggttttaaattggaatttatcactttagttctttttttcattacagttccctttcaagagaaaatgatttcttcaaatcattccaaggaaatagctagcagaattaacatataggataaaacaaggatatattcagatagtgcaaaccaacatttctatgaaacacgatgtcatgtgggaattgcagtatgcgcgaagctgcaacaggaagtcagtgacaaaaacatggtaaggaatagtaatgtcagtctttgagtttttctgtaacacctgcctcatacatctgcacgggtgttgaggatgatgaactttcttgttcgttccttatcatgttgcgcgtctccctatatgttccacctgcacgagattcttgtatggtctgcaggagaatggttagttcatggcagttgtacaaatgataccccgtacttggcaacgggattttatttgtacaaccgggaaaaaagtatatcaaagatccatctgctccatgcttcaaaatatgcccttgcactagataagcctcatcaatacgcggacgagcggctgagataaaagcaatttggtcgctaacgaccccaagcccttttgctatccgagtaatcagagaagtgcactcaacaggagcagagaactttatactttctaaccattgccttatcatacatttcacaggagaaattttgatttttctaaccatggcaaacatgataattaattcatctcccctaatgggtctcatatcacttctaggaaa

SEQ ID NO: 83262 - DNA, 5436 bp, Oryza sativa
aaaccaagaagtgtacttaagcctttccatgtaagtgtgtactccttatggaaaaaacgaaaggaaatttcatcttctatttctttcatagtgcacagaaattgcaaagtaagcaaacgagaaccaagctcatctaccacaataaatctctgccaaccaaccgctttccaaatagaacgaaattcaacttcaatacctatctttttcagcagctccggtgagtattctcgcgtgtgagcatactcccggtcgctcagcatgtagtaggcttgtctcttccgatcactgacaaggtcgaggtcggtgtcgttcaggagtcgtcgcggagcttcggcgtcttccatcaaaacatctgctgatgaatgagtactagactcgtcatgacgacttgatgaagagccggaccccttgaacagacgagacagtcgcctcctcattctgcacaatggagcaagaacggagtaactcggcgggggttagagatgacaagaatttcacacgccggttagtttcaccaaagcaacttgtatacatgcaactaaatattttaatttgagggaaacaatcaaaacttgaatgaacttgagagcaaactttggagagggaatgaaaatgtgttgaaatggggtggagttccctctcccggctggctggcttttatagggtacccataacagtcagaaatgacatgtgggacccactagccgttaccttgccaaaagtagcaggtaaccgttgcctggccggttgttcggccgaacccctggtgggcccaaccggccccactttcggccgttggattccaatgatcagtgtggtcttggcatagcgaatattcgttgaaaattttatttcggtttgctctaaaagattcatttgaagaatttcctcaaaattcaaaaatcctaaatgcaattttgaagttcaaatatatgatgatgcaaaaattcaaattgttgaaagcaaatatgcggatacataccaatttacctgttggcgaaggtcgcgtcatttaaagtccgacttgcgagaccgtacctccttctgaatcagttagcggattttccacccgtctccggaggtgatggagtgggcgtctttggcttcttcctccacaccttctttggttttggtgcggatggcggcttcttctgagccggctgctctagtttcttggccagtatgggtggttctaccggcatcttccaataacggttcttaggcatagttgtttccttctccatgaaattctgcataaatttcaccaggctgtccattttgggtggctccacttcgacctcttggatattctgtgggttcggcccatactttattctgaccatggagtattgttccgtcctcggttgaaactcaaacttctcttccttgccgttgacgtggaacgggcgccccaggatgagcggcgtctcttttcccgtgtccatgtccagcaccacgaagtcaaccgggataaagaaatcccgtgtcttgactgacacatcctccgctatccctgccgggtaacggactgacgaatcagccagttgaaggcgcatcggtgttggtgccaacactgtgaagttgagtctatcgaagacgtctttcggcatgatgctgacactggctcccaggtcgtataaggcctggtcgaattgttgtgccccgatctagcaagtgatcgtaggacacccctgatttttcttcttctccgggagcttgtggagtatcacgttgctgcattgcttgaccacctctgttgttgggagcggtctcttgttgttgactatgtccttgagataacgggtgtatgttggtacttgcatagcatccaacaacgacacgttgatatggatcttctggattacttcaacaaaacgagcgaattgctcgtccactgacggtttcctacaccgttggggaaacggcagcaaccgtgtgtcgcagtattcctgcggcacggtcttctctggctgaacctctttgtcagccgagtcactagatggcgcttgttttgatatcccgttagttcctacagggttaggatatagcggatcacgagtggacttacatcctctcgtcgtgatcgccttgactttacctcctcacgagtcgggtcgccccagaatcctcccagtttcatttgcagggtttaaggatgccaactgagctagctgggtttctatcattttattgaagctcagctggttttgaaaagcagaagcgaagccatctaacttgacattaatgttttctaggatcttatcattggccgcaagctttttgcttaatgcatcggtggttttagcttgcgcaaaaacgagatccttcaaggagggctgttagaaaaattaccgttgttgttacctccttgataatataggcgtggttggttccacccctaacctccttgtgaacgatacccattgttgttgcccatgtacatcgcctcctcacgggtttccgggtagtcattcccagaatgacctgtgttgccgcagacctcacatgtgacgtgagagtccaaggccttgacggtgccttgtggccgtttctcgtggtcgtccaagcatttcatgaggaggtccagcttggcagcaagtaactccgactccttgacggtgtgcatgcctcgctgacgcatctgaagtcgttcctcgttccaacccatattggagaccatcttctctattagttcaacggctccttgaaccattttagagaagaaggctcctccagctgccgcgtcgaggtgatagcgggacatcggggtgagtccattgtaaaagttctgcaggatcagctagtcgtccatcccatgatgaggacaggcggccacttactcctgtagacgctcccatgcttcaagaatagactcatctcttgtctgctggaaactggaaatccttccatgaagggcattggttttgcccatcgggaagaatttcgagagaaatgccctagagcatttgtcccaggtgttgacagcagcacggttggcatagaaccactgcttcgctctctcaagaagggagaacagaaatagtcgtagcctgatggtgtcgggactgacgcccttgatggtgtacatgctacagatcttcaggaactgttgcagatgagcattggcatcctcattaggcttgccacaaaacgggctagcctgcgccatcgtgatgaggctagagttcaagtcgaaatccacgtcgcctatgttcacctgtggcccaatgaccacattgtcagcagagggagcagcgaactcgtggagagtcttgttagccatagtcttgaacgtcggtggcgctggtacggttggtttctttgtcggtagagttttctgcggagcaactacttgaggcctgacgctccggaagaaagcgtcagaaatgcttgttggtatttcttaacgacattactagaaatataatccccggcaacggcgccagaaatgcttgttggtatttcttaacgacattactagaaatataattcccagtaatggcgtagaaatacttctggtatattatggttacagagttcatccgcaagcgcacggatataccattgtagcatttcacccgagagtattccaagggtatcgtatttattttatcccgtgggaatatcatgtagagagaacattgactaataatttatatatgactggtgataatcatattctaagcaggggttaagataatccaagggtagagtgacacacaagcgttaactactcattctcatactttataatctaagctaagtggaaagaaaataggaagaaaatctattcctatacttctaatatacatagtatacatacattctagttaaccgacattctatccgatgccctcctggtacttcgagaagccacccctgactgccgagttccttacgacagcccgtcatgaccatacaatcggggctaaatacgaaggaataccctccccatggaattaacttaggattatataccggcgcggaggaatacccgtactgagctgtcaccatcagtggcccacctctcatccgcaatatataaccccaaataatgatatcccgtaatctagacaatacgtctaaactaccagatactactctaatatcatcgttatgacatagagtaattgcataagcaaacattatatccacaccaaagcatctcccagataagctagccgtatatttagtataacatgaacataatgtaaagtaggtgctcatattctcggaaagtatttcaataccataaatgtatttagaagagtattctaataaaagtacaaagcttacaaaagagaagagaaaagctaatagaaacatacccaaactcttccgaaggcttccgaactcctgatttctactctattcctattccaccagctagatagtactaaactaaacttgagacaaatgagagagctattgcttgaggtgtgtgagtgaagtgagaaggtgatgtccttttataggcaccatccggaatctgaatttcttcattctcaacggatggcggctcgggaactttttcatcaatcgagtcggtggaagtggaaggttcagattgtgactcgattgttgaaggttcctctattatggacacggatgcctctagctggggttcatcgcattgcgtcatgatggaagtattttctagaatgcgatctagaattacttttccttctgacggtgttttatgcatgaatgatcctccagcaattatatccagataaaatgcagactccttatccagacctgtataaaatgttgcaaaagcacatactcgggtaaggacatggttggtccggactgcactaaattagtgaatctggaccaggctgcaccgattgattcgctttcaatctgccggaaactgagaatttcttctcgaagggcagtaatacgagtatctgggaagaaggcaagacaaaatttgtctcgcagcttttcccaactactgtttacacatccaatggtagaggtgtaccattgcttcgctctgtcttgaagggagaacggaaacaatttccactgtacggtttcttgcttcatgccacgaatcttaaggcatgagcagacttagcttaaagtcccacatatgatggttgtggttttctagatcaaggctagaaaaagttttttcactaaccatacgattagttcggagcgaatttcatagctagttgtataaattggctccgatgaaggaggtgtaaattggctccgatgaaggaggtggttcatagaattcgctcttaggagcagacagctcgaaaagagattgctccatggtcgagaagaatttaaaaggaatacttctctggatagcaagggtaaaggtagaataaaaaaaatgaaaagagatacgaggatgaactgggttcgaaaatgataagcaacaattccccggcaatggtgccagatattcttgtt

SEQ ID NO: 83263 - DNA, 1408 bp, Oryza sativa
aatcatgcacaaaaaaaatcaggtccagagatggatagcaccagtagctataccgtgttactctaaaatacagaataaaataattttatctcctggatgtaaatctatatttttgtttcataacaccacatttttcacaattacaaagagggtcgcctcaagcaatcgaaacatcaatggtcactacatgcatcgctagaaagaacatcatcttgatgtaaactgctggacctgaatagattggcctctctaacagcaccaggatcagctccaacatcatcttaagctagaaataacttcgatttctgaaagctcaggaagacattagcatgaggcatgtttgcatggttccaactcctaaactcctgagaaaccaaatgccttaaaaaaatttctcctttagccacatcaaaaatctttcaagcaaattacgtccaaataaaaagaagtaacagaaccggccatagaatttatgcattgcatcattattagtaattacaaagtcatcagcacacttcaatattcaaaatgccagagaaaacacatctttactggattcatccaatagcactttttcatggatattatgaagctatcgtttcattgtctggagctccaaaattggttggtgcatacaaaggagatactccacttaatatcaagcaattgacaaaattaacatattttcaaaattatggcacctcacaaaagggaaaattgaccttctgctgcagcctacataacacatatcagcagcacaacaattgcagttcaaagagtctacactgatgaataaaaattgatttggttgatagaaagaaccacccaagtactcaatacaaatagaaaattgcaataattgttcagtatttacagcgaaacctaaatctacaggaaataacagcctcaatctgccatggagaaacttttccaatatatttccactaagttaggcactcaggctagcaaaatgaatacaagattccaactaatcaatttctgaaataacatggtgtctagaaatgctaatcctaattttagtgctgttctacttaccctggagagatcttggtcgatgtcaacgattatcatgaccatgttggtggatggggacaaggctctttgaggcggcttcctcctttcattggcaatgcaaaaacagttctgcaccctccaaatcctactctgagtgggcctcacaccgccggcggaattccattagtatataatataattcaatctgcattcaacaaagaccaagagggattgagccctcccaagtatttgcaataaaaatggaagataactgcatgaataattgtcactctaatatcaatttacaagttcacattatacctctttgtcgacaaggccgaggaactcttgatgctccttgctaacagactgc

SEQ ID NO: 83264 - DNA, 9471 bp, Oryza sativa
agtttgaactgaatttgaacttgtttttgttagattttgattctaggtatatagcatccatacatataattagttaggtatgtaatcatggattgtgaaataaagttaaatttgagttgttttgttgataggtataggtatgaatcgagttattataactaggtatatactcacaatttgaaaattttgaaaaatttgagtgattttgtgtatttgataccatggtgcccgggcaccatggtgccccatatgagtgtcctatatatatatatatatatatatatatatgtatatcgggagatactatactacaacaggggtgtagtatagctaaaacacacccacactcctgtcctccagccagtccgcacccccccccccccctaagccccaagccccttgtcgcatccatattctgagtaatatttttactggacagtacctacacaacatatatagatgtctaaccacttctccattcagttacaatcaatcccgatcctatttttttggatctgagagacagaggcggtcgctttggcggctcggtggagcagttgagcgtcggcaacggcaacagcctcgactaggtgcggcggcggcgacggagaggatggagcggcgtcctccatatcactctcccggcgccgacgcccgcctcaccggatgtggccacttgcttcttttcaacacgaagagaaacgggagaaggagaagaaagggatgccagtgatgttgcaacgtctcctctgtgcacctggcatcaaccccatcgatctagtcatctcctttctcctgttccgctttgttttctttctgtctttgctctgacacaccctttgattttgtaggattttcaatgtagtcaggcccgctgctagaggctattgttttcatgatgcatttagacggccagtggtgctccccttcaaccaagtgatcgtcagcgagaggagccggccgcggtggccggggcgacgactggtgctgcaccactctcccaagctgaggccaacaagaagagcaagcagcgtatcccggctccaattggagagattcaaaatgtaaattacagtgcatcaattatttgttgggatgaagacatctgttttgtctttcgttttcattgattcgcaggtatccttgtcagagcagaacaacacctacaacatgcacatactctggtgtttttctgcatctgctatttttgccaacgagatcatcgactccccaccctccaggtacaaatttgatccttggatataattgactagtgaatgctagaatctagatcattctgaatttatgattgttcttttcactaagatcattaggtccatttttattcttttttttgaacattatccatttttattcttgaaatcgcttttcatctgaaaagatggcaggttttatgtagtttacaacttgtatgttattaatctgagatatctggatattttagcctgaagcatcccaattacctattctacatttttcggccaactgcattcttaatttttcttttttgcacaatgtcatcgattgcatatcgggtctaggcgagcccaggaaccacagttaaggaaacaaaatgtgacctccatgcttgtctgaataaaaaaagaactgttggctaaaagtaggcataaaggaacctaaactggtagctcaattttttatgaagcattttatttcttctttggcgaaccatatctcatttagagtcatttatgagtgtaaattaaagacttctcttatgatgtaatcgcttttgtctatatccaggtggctgtgggattctctctggatattcgtgggtgatggatatatgtcgatgggagacctaaggaatctatagtgctttgtcggctcaacatcgatatgtggcactagcatcgtcttgcttgttggattcgtgcatgtaatagtaatttagttactaagagacatatgttgagaactatcggtgcaatagtaacttggttactaagagaattttttggcaatatcaatatgttatgttgagattggtgtaatataaatttatttactaagagaaatcttgtgacgatgttaatacgctatttttaagtaatttatttactgcgagaaagtatgataaccaattaagtgtagtattattttaagtaatttatttactaagagaatgaatgagaacaacctgacagtaattcatttactgagagaagtaaccaattgagaagggctgaaaacaacctgggagtaatccaattactgagataaggaatgaattggattccgagtaatttatttactaataaaagatattaacagggagtaatttagttactacgtgtgcaagagaaatgtgcgggttacagttggaatggactatttactaataataagatattatctgcgagtaatttatttactgaaagacaaaaatggtgagagagagaaaaaggtgcgggagacggtgggagagccccctggtgagggtggggggtgggggtgggtgctgtgaagggagtagtttagttattgcgcaccccatacgcggtttagcgcatccctatgtatatctgtatatacatatatatatatatatatatatatatatatatatatatatatatatatatatatatatatatatatatatatatatatatatttgcttgtcacattttcttacctcttcaaaatctgcttgcgtttccggcatcttattgctagctacatgataaaattaataagatctgatcgtcaggtgtgtttgaaatggtatttgttctctttttatattaatcaaaaattcaaaatctttgccacctatattgtccttggactacatgcacactatgctcgctctgagtgaaatatatatatgtgatcatagcaatgtcgatgatgttcaacacaaatatatatatgtgattatagcaatgtcgttgatgttcaacaaaaaaaaaagcaatgtcgatgaactgtgatctcatcttaattaatcatttagtgacctgtcctttatgtaggacattccaggacatcgtcttcccgaatcaagatgcattgacagagggatttgaattaatgatgagagttaattgattacatgatagaaaggtctgtaactagtactgatcgagctcaggatacccttaatcaaatacatgcttagtagagttattttcttacctctttaaaggtaataataatgcatgcaagggaccacatcgatcgatctcctagtattagtttgtgatatatctcggtggaacgcaaattactagcattgtagagaaaggcaatatatatttgtcccacgataaccctcatacaagctaaggtagtatttggttacaagaatgggatgagatgggacgaacccacttttaaaagtgcttagtttaggggtgagtgggatgggttggtccttggagaggaatattcctctcagatccgggatcaaccgatccggccaaatcttgcggacgaactcgtcccacctgggactagcggatggcgtgacgacgccctgctcgccctcgggagatggtgggctcgagcgaaggcagacggatcgagcgacggcggcggtgggggcctcggcgacggtggatcccgtggtggggagggcggatccggcgatggggacggctgcggcaaccgtgctcctccacccggacgaccgcgatggtggccacggccggggccaaggtcgaggccgacagcgccctcctcggcgcggcagaggtggggcctgacggcgatgcggccatgggaggcgaaggagaaggagagggagccagggaaggagaggaggaggcacttgctggcagtagcggagagggaggtgagggcagaggcggaggcggccatagttgctctgcccgcttgcccgctcgtgccgctcctccaccttcttgtcgtcaggttgtagtcgcgcaccttcgcccggctgaccgtcgtcggtggttgcaaacggtgtccatcccatccctctctcatcccttcaaccaaacaaaaaactgggatcgtcctattctacaaaccaaacacgcgagtggaatcatcctaaccctaaaatcagaggtggtttcatccattccacatagtcccaaaaccaaacacatgctaagtgctcctagctagcaagtggcactctaataaatctctactattataaaaattaaaaatgtttttgtaggtattttggtacatcatccatgtttgagttggtttttaagttcgttcattttttgaaatgcagttctgtgtttgagttcgattttaaactcgtttccttttggaaatacagaaggagtcgtatataaaatctctttaaaaaaactcacatgctaacttaagataaaagtcgtacttctaattgcagctcatgattttctaaaaagaaacatttaagcgaattcccacagtgaattttaccctatctaaatcatataacaataataagattaaagtagcattcacccgttgcaacgcacgggtatattttctagttaaataaatatcttagtcattaattttcaattaactcggtgtacccgtttgtttcgaccatgagattagattcctacctctccttcccaatttacgatggctctcatgcatggtttggtcccaccaaaataattaattaggatttctcacaaagaaaatcaacgaacaaaattttagatgcaaagccacgggaacaaaatgcaacacacctctcagctcgccttttttaccactatcaaacaagatggacctacacatcgtcttttcgatatgtgcccagaaacaagctagaagaaagacacttacatctctttattattagatctctaaacataccgtgccacttctctcgatctttctttaagcgtgcaacttttatactactccatggtagtggtgcttatcttctgatctgttgtaactagcttcaacaaagtgatatatcaaagctccatggcttttggataatatatttgtaggatcgaatagcagtaactaagccaattagagagaggggtgaatggttgcagtaccaaaaaatcgaaacttttagcggaattaaaagttaccctcgaatccgatgtagatcggtctgatcggagttgatccgctagtctgacaacgcctatgtcgtgcggtctgaccggtgttgatctcccagtcgaaccgccctgcaatcgcctctacctcctgtcgccgccgccggttagaccaccgtgttcctgtcggtctgaccgtctgcgaatccgagcaaacacaaattgaagatgtctcaaagtagattaaaactttattacttctctctgtgtttacaaagtgcaacaacaacattcctcataaaaatctcgactaaactcaaaacactaacttttttctcttaactcaactctctaaaaaacgataacacccctccctttctatatatacctgacgtaagtagcctaaagccacaatccaaccttgtacagtaagtcttaatctcctaagaaaccttcccatacaagaaacaaactttacaaactccaattgtaccaaatttggactccctccaaatttgactacgcatcccatacgcacacaatactccatcgtatgtcatatggaatcttcaccaaccgcgtgcattaatctttagcctaagcatcccgcatgatatcatgatcgtgtggacatcatcttctcccaagttggcttccaatccatcatcgggaacattctcccgaggcatcaagaccacttatgcatacatcaaccaagaaaccatatatgagcatagttctcatcaacttaacttattgttagcaaacaacaatattacatacgcatagtattcatctagaagtcataaacatatatgaattatccacggatatccaacgaaacaacccgaaaccaaaaccgacacagagtcggctggtcagaccacgggttgactggcctgactgctcactatactccgtctgattggccttacccagccggtctgaccgcaaccgtcagacttatcaaacctatccatcacctgtaaaatccaatcatctccaaaaccacttcaccaataatctccaaatatcaaaactaataatctcagatgccaattgtttattatagaataagaatgaaataccctttgattttacaatatatactaacattgtaggtttttgggtgctgtcagttgaatttttagcacttagtccgaggtgcctcgaccccgcgtgctttgccgccggaaatttgtttattgatatttttaggaaagtaactaactctgtcagttagttgctaattaatcgttttcaagggggtaatgcatgaaaaaagaaacataatataaacgtaggtactcacatgtacacgtgtacttactcatatgcatgtatacatgtacaccctacctctataagcatctctgagagactgcaccggtatattttgagtttaacaaaattatcaccggcgcatcgctgtcgacggaaacatcatctaccattgaaaggataattacccatgttaagtgtagctatgggtaccatcctcccgctcctttacttctgtccctgtattagttgaaataacatttaaattatacatataatttttattcaatcacattgttatattttgtacaattaaatcaaatcaataacttaagaacaatgttgactatttttttttaccagaaacagtgagagacccccacaatatggactatattttcatttataaaaagtaattgttttgggccgtagtttgaccctttgcatatataatggacaaaaaaaagaaaacatatgttataaaatcatatatcacatcatgcataactaaattagttctacaatgttttaaaaaaaattcaacattaatattatttaccattaaattaataatttaagatctatattaattatatttttaacatgtcaaataaaattgtattttagtttgtatttttattctttgcacgtaatcctaaccgaccttgaaattttgaaaaagataacaatatagagtatatatatcagtatatatccattatcagttcacaaatatgtacaactgaattagatttataatatcaacaagaaacatgtcatatctttgggctttgcgtggcattcaagaattttgaaaaatcatgaaaagaaaataatgatatgagtaatagaatcacataaatatgcttactatgtagggttcagtatgtttgtgccacatcagttcacaaatatgttcacaaatatgcacgactcaattagatttacaatatcagtcatatctttgggctttgcataccgttcgggacttatgaaaaatcatgagaaaaacttaatgacatgaattatatcgtccaataaatatgtttagcatttagggtccagtctattcagatcatatggggataacctaaaatattgattctattaccatcatgtatagattctacattttgcaaactgcaccctaaataataagtaaaagaatggagagagtacatgccatgtttttttccctttgatttttattaaataagcatggtatacgggtatatcatactaagtttagttaattaggtaacataaatcatagtaaacttttatatgaaaaataatacaataaaaatatacttcaaaattggcataacaaaagtgtactttagtccatggtgcctaaatatttataaattatctacacatactaattatatttatatagctctgttgttatttcaaagtaaattcatttttagcagaaaataaggaatcatatgaaaaacagagggggtgtacacgtaaatagaaatctgtctttaattagaaatagtcgtattatccatatttttaacagaaaatatatttaattaatatgttctaaaatccataaatacatctacaatatacaagaaaaaatgttacgtaaagtttataaactccataagtaagacatgctaaatatttaaaaaaagaaacacacatagtaaataattgttcataaactaaagaccatgcagataataatttcatatgaaccaactccattgttgccattcaatattttctcataaattaaagaccgcatggtttaagttatttacgtcggtggaggccctaatgtcgtcaagttcaagcaagacatcaataacaacggtcaaaaagacggcgcctccatctctctgttggcgcaaaaaaagttaaaaaaaaaactagaactgcatgatctaagaacatcaatcaactaattcaacatcgatggcttagatcatgtttttccgcactaagcaaagatgaccatgtatgggctaaataattgagattatgtaaattaaaactccaacaggaatgtctcatgtatctctttattgtaacagtatggttatgaccacttttttcttattcaatgtaatgtacctgtttggtgagaaaagaagatacttcctctgttttacaatgtaagtcattctagcactttccacattcatattgatgttaatgaatctaaataaatatatatgtctagattcattaacatcaatataaatgttggaattgctagaatgacttacattgtgaaacggagggaatatataggatcacaaacaagctcagaacgaacacattaatttgattatcaaaaccagagatcgagtcacgtggaaccgtcaaatgtagagagccaacgaactgtgtagcatcgcggttgcggcttagcaacaaccatgcataaagtccttggaattgttggaaatgttggtaataaattggtcgacttgatactgtttattctagtaaacgttgaatatattgtcaaattttaaatttattgcatcttaattacaaattccaatataaatccctagcatgatgtgtcttgtttgaactcatattcactattataaattgacatacaatactaaaatcgttttcacaagcggtataaagtgatttttgcatgcagccatcccaaatgcatgcgccaaaaggactgtgaaaaatcagatttttgcatgcggccagtgcaaccacatgcaaaaatctcattaattttcgcatacggtcacctatacaaccgaatgaaaaaaaaatttggctcaaataaaaatctaaaaagcccaagcgaactctagcatgtcatcgtcatcggctggatccgcgtgaggtggtgcccaagccggacgtccttcacaccggatccgcctcccgccatcatcgtcggcgccggatccacgccgggcgtcgccgcccactcccgcgcggtcagtgaggagaggaagagaggagaggagaaaagagagacagagaggaagagacataaggagagggacagaggagaggaggtgaaaaaaaatttaaagtggtgagagggaaatgagagagggggagaaaatatatgtgaagaacatgcatggggtattttcgacacttaagaggcctacatgtgaaaatctattttatgcgc

SEQ ID NO: 83265 - DNA, 4129 bp, Oryza sativa
ccccccccccccccggtgcccttttgctgtcgggcctaatgggccgcgccctagcgcccccgctgccccttgttttgccagcccaatgccgcacggtagtgggccgaatcctttagatttcggcccaccacccaatttaccatttaaatttagtttttaattttattttcagcagcaattacattttagtccctatgttttctataatttagtggaaacagttcatcagctcttcatattattatgtaatggtccaatagactacttatgttatgtgttaattaacataggtgtttattcaaataccctatttcactaaatttatttgttgtcttaataacatgccttttgcatattatttcaagacacgctctactttctcgttttattaatttacaaaattctataaattttgtactttgatttagcaaattctcttaattatgtacaacataattaatggaggatttaatgcatgttccacttcacattttgacttggaaattaatcacatgtcgatggaatcctatactttggtcatatcgaccataacttaggcagcgagtatctcgcccattatcaagtggtctacattttgagatgattacccgatggagtcctacaaattgatcgcactggtcataacctaggcagcgagcatttcacccatctcacagaggtctacatctcacgatgattacccacatgtgttattttccgagaatatgtttcgaaaaatgagattatttgaaatttggttgaacacaaggtagtggagtcctaaacaatggctgcggtatattcaccagaatatatttgcctggagaccatgttttaggcagcaagtataacttgcccactattaagagatctactctactgtttaattacttggagattatccacattgtgccacctaatttcgaattctaactcaaaattgtcaggtctattacctgcatttttcgaaagattacaaaatatgaagttttacattacgcattgagattacaaccttaatatcatgtttttattaatttacctctgtaaattgataatgttaaccatgattgtagggacatggcaacaaaagagttcgacgaactcgccctcgattggactaactatcctatctgggcttctgatattaaaatcaattttgcctctcgggggattttaaatacaattgaggaacccaatgatggggacccggaaattgagcccaggaagctcaatacagccctttttcttttgagactctacattcacaaggatctcaaacatgaatacatgttagagacgagccctctcaacctttggaaagctctaaaagagcgttatgaccagcaaaaggaactcatttggcctgaggctaattatgagtgggttcatttacgcctacaggactttaaaactgtggcagaatacaaccatgttgttcataacatttgttccaggttgaagttttgcaaacaagagccaacggaggcagagaagatagagaaaactctatcaactatgcttccggaggacaggatactgactcaacagtatcgcgctaacattttccagaaacattatctgcttatacatacattgactcaggcagaaagacaccatgagctttctttaaagaatgcccaacagcgcccaccgggctctactccactgcctgaggtgcacttcaatgtacagaataatgctgagaataagaaaggattcaagggaaattcttcgaataatcctaagaatctgactggaaagcgcaaacgcaacaacgacaggcgcaaattcaagggtcgaaagaaaggaaaagggaagggtaaggcaccacaacctcgtagcaatggcaacaagcattgcaacaggtgtggatctgacactcatgtcgctaaagactgccgcatcccgaaacatcttgttctcttgtaccaaaaatccctcaaggacaaaaagtcttctgagaacccaagatttgaagcctacttcaatcttacacatgaagagcgccctaaggttgcaagttctcaccaggctcctgttgaaccagagagcaacctcaatgttctcccataagatgtcgctccactctctgcgatggacgatatgttcatcgaatactgctcaacggacccacttggagatttgcaatgatctcggtgcgtcacacttggagatgaagctgctcttatctcagtgtgattgaaacagtatattgatatcctataagtttgccaaacaatattggttgtaataagtagataagtacgaactcccttatattgtaaggttgtatggcttgctagtcattagagtatgtactattaacatatgtaaacgtcatcctatgtatttgatgttttaattattgtatgtatgtatatatattggataaagaattcttaatcaagcaattcttctttcattatagatgtctaaggatatcgctccgattggagaggaattatgtcttgtggacagtggtaccacaaactctatacttagagagattaaatactttcaaactctcaaaaagagagaaggcaaagttttgactatcgctgggcgcgatactgtgatagttggctcaggacgagcaattattacactcccaatgggtacacaaattaaaattgaaatgctttattgtatcctgattcaacccgtaccctactaagttatagagatatccgtcaaaatgggtttcacattgaaacccatatggataatcgagaagaatttcttctcttaaccaaacaaaacggatatggcaaacgcatttgcgagaaaattccatcactcacatcgggattgtactatacatacattaagcccattgcacatgttgcgtacaaagtaatttttcaaaatgttgatgcattccacacttggcatgatcgacttggccaccccggtatcgggatgatgagaaaaattattggcaactctgttggtcatcatttgatcactgacaaatttcccaaatcctctgatttcgtatgcactgcatgtgctactgggaaactgattttgagaccatcttatctcaaaattagagccgaaccacttaaattctttgaacgcattcaaggagatatttgtggccctattgtgccaagacctgtaccgttcaggtactttatggttttgattgacgcatctactagatggtctcatgtgtggcttctatcgacacgaaaccatgtctttgccaaattaatgtctcaaattataaggctgaaggcaaattaccctgaacataggattcaatcaatccgtatggacaatgctgccgaatttacatcccatgctttcgatgattattgtatggcattgggaattcaggttcagcactctgttccatatgaccacacacaaaatggtttggctgaatcattgatcaaaagaattaagcttattgctcgaccattattgatgaattgcaaattaccttcgtcgtgttggggtcatgcagttctgcacgctgctgaccttgtccaactacgaccaattgcatatcatgaaacttccccaatgcatttagtacgtggaaatcctccaagtatttcccatttgctgtatacataccgatctcaccaccacagcgtaccgctatgggcccacacaggaatgtggggatctatgtgggattcaaatctccgtcgatcataaagtatttagaacccaacaggtgatctatttactgcccggttcgctgactctatctttgacgaggaacatttcccggcattagggggagacttcaagtgccagaaagaatgccaggaaattgattgggatgcccaaggtattcccgccttagacccacgtactactgaaactgaacttcaagttcagaaaattatacatttgtaaagacttgcaaataacctgccagatgcatttaccaattaaaaaggtgtgactaaatctttcattcccgctcagaatgcgccagaaagagtggaggtaccaaataaaaccactcaacttccactcactaaaaagagaggaagaagtatggccactcagcgagaaacaattgctaataagcaaacaaacatggtaaatgcaaaccaacctttagtttgtacacaccaaattgataatatatatcaagcagatcgtg

SEQ ID NO: 83266 - DNA, 6929 bp, Oryza sativa
atgaaggttcctgatggaatcgacatcccgaatcagaaggtaaatcgtaacatgtattgtgttaagttgcagaagtcactttatggcttaaaacaatcgggcaggatgtggtacaaccgattaagtgaattcctttcactaaagggatacactaaaaatgatgattgcccgtgcgtctttatcaaaaagtcctccacaggattttgtattatctcggtatatgtcgatgatctcaacatcattggcaacacacaagatattaatgaagcacgtcatcatttaaagacggaatttgagatgaaggatttgggtcaaaccaaattttgcttaggtctacaacttgagcatttaccttctggaatccttgtgcaccaaagtgcatatacccagaaaattttggagatatttaatatggacaagtcatatccttccaaaacccctatcgtggttcgatctttagacgtggagaaagatccatttagaccaaaggaagatggagaggatgtacttggtcctgattttccatatcttagtgctattggcgcacttatgtaccttgcaaatagtacgaggccagatattgctttctcggtaaatctattagcaagatacagcgctgctcctaccaaacgccattggactggagttaagaatgtcttttgatatcttaatggcacaagagatcttggacttttctttaaaaagaaccaggattcaactttaattgggtatactgatgttggctatctatctgatccccacaatgctagatcacaaataggatttgtatttttacaaggtggaactgctatttcatagaagtcttctaaatagactctggtagccacttccacaaatcattctgaaataattgcattatatgaggcatcacatgaatatgtatggcttcgcagaatggttaaccacatattaacatcttgtggtattggttcattggaatcacctaccattatctatgaagataatgccacttgtgttgttcagatggaaactggttatattaagagcaacatcactaagcatattgctcctaaattattttatcctcatgagcttcagcaacatggagagataaacatcttgcaaactaagtcatgtaataatcttgctgatttattcacaaaatctctaccatactccacattctttaaatgtgtcgaaggaattggtatgagacaactcaaaaatttgcaggattcatggggagtatcttcctctagaaaataacctattttcgtcatattatactctttttcctttgtatgagttttaccctttaggttttctcatccaaagtttttaacgaggtaatatcaacataagttatatgtcttatcatttggcttttccccactggggtttttactaaatgataactgtagacattatactattttggatcatactatgagctttactcatagatctaaaatagtcaataatatatatcacggttctctccttatttttcccactgggttttcgaggggttttacgtgatgtatttaactataattatttctaagattatctttacagatatctggaacagtgaaacagcaatgatcaaagctagattcgataagggggagtgttatgaaacaacagggtgatcttatccatataaaaggatggatcgcaaccgaaggcaaccgcgccttccctaggtgctccttggcaatggacgcgatggttcccaaccatcgcgtctctggttgccaccccttccccatctatatattgtaccgcattgatcaataaagattccgctcattcattctctacattcttgtgtgcaattctctctctcactcactccctctcgctcaatcaattctatacactttcaacagatttaatgttctgcttgaaaacataaaggttggatactctctattacatcccattgattttctttttaagaaaacggattaaaatgaggtctctacgtctactgagcggatgtacacagccaactgtaaatcccattattaaaattattgagagaccgaagtgcattgcttttggtgtagtggtagtgttactggtatccgcagggctaaaatttgaagtcatctaatgacgcacccgcagctgcagttcgatcagttggtattcggcaaggtttatttatttattgttcattgcatctatctgtttgtatatgtgtgcatctttcgttaaaaaagctataggaaaaaaaagagaaaaattgtttacagtagcattcagatgtcatattttaatttcagagcacggaaaaatgttggttcaactgttagcgctgaaagtatattttcttactccttttagcatttcattgaatccaccattatccccctccccatcatttcttcctcttccccctcccgcccggcctccccttcttccatattcaaagtaagggatggtagaaggggaggttgctatcagggagggaagcaaggacggcgctgcaaccaaggcaaccatgaacaagtttatgtgtaaggggaagaaagaatgggtcgagggataatggtggtatttcgtacatgcatgctgtgtgttttttttaaagaaaaatgaaagctaaagaaaactatttgaaatttgggtaatggaatacttaatagccgaaaggagataactctccttgctcagaagtaaatctggatcaatcggtgttatatataaaactaaataccagatgaaaatccagatttaccgaaacaatttttcatagaaggaaacaaaatgccggatgaatatggatgaatggatcaatttttttggctctgtcaaacgtacatatggtgctgaaggttcccactaataacacacgtggatccttcgttacctttggatgtgccggttatcagttcacatccacgagtgtatagttgttgcatattagaaaaggaaaacttttacgttaccttttgccatcgatgatttttactgtcattgagaaagaatctagacagtccatcctttccgatctgaggtctgaaaacgcttagtacctggtggtaaagtccctcatgagcaatgtgtgtggatcaatggagaggcaccacagctgtgagggcaaagaatggaatttcgtttcgcccatacatttggatcataccaatctgcaagcatcgattccatgatgcccctcctacacacatcatctttctcctaccgctggccgctctccaatacaccatcaatctctttcggcgccaccacctccaagatatcggtgccacccttacggctatggcgggattcccgttctcttccactaccacctccaggaggacatccttccattcatataatataagagattatcaagaatatatcgtgcgtaagctattcgctcatcaatttgtaaattataagtaccgatcctaacccttacagatcaatagttagatgtagttggtacctcctcaaggataataaaaatatctttgttatcggtttgcaatagtagagtttaattatgtaatagctattcttagctggttacaaggcttgtagtattcaaggggtttttttggtttttgttttcttgttttctctgtaaataactcttttatttttaatatataactactgggcaaagccctggtagtaatttacataaaaaatgtaatagctaatctatagcacgattatcccttaatctatatagcccatataattggaacgaaaaacttaatatacattaagacaaatagtctagaaaatagtagcttttggattaatctcatgcttagatctcaatcatccatttgtcatatgcctttacaactcactaagtgtagttattattattataaagctcaatgcaaccatgacactaaaagagtaacaaatatgagatctctcttgcttgatacataactaatgtacaattacaatttcacaacaagtactatatagagctcaaaataaaatattgtccatttaggcactacaagtacatgatttataaattattttcttcgagttttctttgaattatttctaaattctctacttcaatatgcgggatattagctagtgtatattgtgtttgagacattttagcctattttttaaaaatgatggtattgaatactctttgtgatagacgacatggttttcgaaatacaactttgaccactaattattttttgttctaaaatatttagaagagctattaaaataagatagtaaaacatactaaggatccttaaacttgttgttagatgtcatccagatcactgaactcggatatgtattaaaatacccaaaactctaatactgctattgaggtccaaaaccgtgtttttgaccatttgaacaccaatgtggcacagcaacatcgactctgctggcatggggctcacagggcagcaaatgtcctcactttggacgatgtattttgtgcatgtgctgatgtgcttctcaactctttctcattctcatccacagttttcttgcccaaggaggatgccctagtgtttaaggaccaacagcaggtctctgtgtgttggcctgccacattggcactaggatggtcaactgagcttttcgacctttgattgtaaatttagcaagttcagggggtctaaatatgcttttttagagttttgagatgatctgaagataagtttcagaaccattggagtatttaactcttatgataaatcagttgtgcttattttataccgatagttccatatttatccgatttctttgtaagaataatacttcgtagtcaaatcaattgtgcttacggttgataaccatcagagttgttgtgtgaggattgtctgatgcttggtgacagagtataatagatcgtggacgtcattggtcatccttgaacaaatatatacttacatctcgtgaaagataactagcgatatcgaagagcacatcatagctagataggaagggcgcatgtttgttgaactgtggtggtatgagtgtgaagctgttcattaactatgtaaatcaacctcactctctaaaacaaaaataaaaatcttagagcaccataccacttatgaaaacctcaaattgaaattaaaatgaaaatatgtcgatcacaaacctaacagctgcaatattgtgggtttgtacaagcttgtgaccaaaaacacgctatctgagtgtaaacaatttccaatgcctcaaaaaggtagcagatctattggaccagagaaagagaccagtaccaaccactctgccattttatccatttttagtacccattccaggatcctaatgttgttcaaagataataaaaacacgtggtcaacaactgatttgggtaaattttagctccaacctttcttcaaagaaaaaaaaaacacaatagctccaaggtttctagagagcagagactgtatacgaaatactaacactgtattcaccataataatgtaataccaacaatttatctaaaagtttcacatacatttattcgattatgtaagtaatttctagcctaaacactaacttgggatacacacaactatgtgtattttatagtaatgttgtgcaagagaagcaaaatttaatatgcatgcatggatcagaattgatttcaagtcctttctttacagtgatttcaaggtaggacatgagcccaatatggtcaatgattctgttcttataatacacatgggacatgggttaatttaagccaatattctagaaaaaagagttgatacatcccaagttacatggcagtgtgtgatcgatcaaaatgtgatattcttaatgtattgcattgctatgtccacatcaaaatgtgagtaatctccgcgagaaatgggcctactcttttgactgtttttttttttaagagatcaaaggaagagtcctcgcaaaaaaaaaagtgatcaaattaagaaagagaagtaaaaaaaaactactatagtaggacacacagtagcttgtgtgtttgcttacacactgatatatatttaaaaagaatatgttgtactaaaatcctaaataaacattgctggcaaaaggggaaaacggaacagttgactgcaccatccatacatacatagtttggtcgatagattctgaagaaaaattgtctttcctaaataaattgagaatattcttcagatggactcatgaacagtgcatatgaaattaataacagtacttgctagaaaccccataaaatggatatacatttacgcggtcccggtttcagaattacactatataaaaaaaatcattatcagtcatcattcagttggacaactgctctctaagtagttgtgcatcaaagcaaattcgaccgattaaacacaaaacattgatgcataatatttgtctcggaaatgcacgacccgagtctgtttcaatgggccatgctgttgaacataggccaattcaagtccacatcactgttctggcacattgtgcattatatcatgttcatatgctgctcttgtttggtcttaattcctcaattgtacacgcacacaatggccttgtccaagcactcaagtaactagaggccacgcacatgattgttagtagtacatacaagtggctacttgtaggatcattgattattaattagctagtgtacatgctgagaaatgtggagcaatatatttatatatatttcagaatatatatatatatatatatatatatatatatatatatatatatatatatatacatatatacatacatatacatatacacatatatatatatacatacatacatacatatacatatacacatatatatatatatatacatacacacatatatatatatatatatatgtatatacatacatatacacatacatacatatacatacatatacacatacatatacacatacatacatatacatatatatatatatacacacatatatatatatatatatatacata

SEQ ID NO: 83267 - DNA, 10373 bp, Oryza sativa
  unsure (1)..(10373): unsure at all n locations
tatatatacacacaagacttgcatgtaaatccagtggagtagttgttaatttaggcacttttagtgactttaatttgcaaaggcaaattaagttggtctatctgttctgttttctccatgtttttttttttgattttgtgagttagtaaggggttaattgttggagcccaattaatacaacctaattttaattagggtgggggacaatgcatccaaaatccccccttgcatgtgagggagggggtcatgctgggtcatggcatatttagtggtcatgtgcatgttgggtgtgtatgggttgtatagtgcatgcagttgcctgtggttgcttaacttgcttgcttcatagcttctcttgaccgaccttgcttgcatcttagctgtccatttattttcttttcttttcttttattttattgagggagaggatatcagaagagtgctcagtccagagcttgcatttcactattgcagcgcagcagcacttgcatttgcttgaatgatccatccatctccgaagccaaatcgatcggttcattcatgcaagccggtgctttgcagctttaaggaaagtaaggtcatttgccagcccatcatatatgcctcctctacactgtcactactacactttactactctacagactacagttgtcacttgtcagtggacacactggctgcatattgccttaggttaggtttaccctccacatgcgcacacaccctacctttgagattctttccttgctccttaattctaccggctgctgctttcaagggtccagcgagtgatattccattccttcttttttacctatcgtaggacatcgacatgtttttaattattcttttttaaattcaatttatgaaaaatatagctacattaaagtacttttcatataaaattcactgatactattttcacaaaacaaatcttattagtttttcatatattagtgatttaggattttaagttttggctactcactcgtacagaaagagcaatcccttcctattcatcactaccggtttaacgtgagccaacccttactgcaggttcatggcattggagggaattttcctgccaataagccatgaaccggcaatgatgctaaacatccctactggtccagtgaccgacgggcaatgagctagcagggatttcaatggtctggactgttttttaagacattgggtggtccggacttgaacttttatttgaataactcgtacaagatgcaagacggtgcgaagttctattgatacagtagaagaaaaattacaagattacaaccccgtaagatcgtaaccaggaaaaagaaaaaaatataccaccactcacacatcaacagcttcaacacacagaacaaggagaggcctagcaccggaccagccacccgctaagcgtgaccgaccgctgctaggccaacaaagaaaacggctgagatcgcccaaaacccaacccttactatcaacacaaagccctgctctatccaaatcttcaggagttaaggagagagggcgaaagagaagaatggaacacctctccccctaggccctctgacgtggccaacttgtagagactagaacgccgccacaagagaatgaaatctagagtgagcttgcaccgattggttggggggttttggctagggcatgcctaaacgacgtctccaaggagagaagcaatggaaaacaccgccgctgccgtccgtgaaggtctcaaagagaaccgaggctgggctttcacctggcatccacacatgaaggatgagacggcacgacaatgccctcaggaggggaatgacgcttcgagcatcatcgctgccggcccggccgaggccgggctaggttctcacccgccgctcaccacctacgagtccacggcgggtgccccgatgctccaccaccgtccaacctctgccgacatgtgcgaccactgcaccagtgccctccaccggctggccttcgtgcgctgtagatcgcactgcaccccaccgccgatacttctcccaccgtgccccccctcatcactgcccgccccgcctcctcgcaccgtgccaggctcctcccgcgccgccatgcctnacccgccccggctagcctcatccaatgcccgccgcgcctcatcgcgccaagccggcctcccaccaccggccacgcctcctcgcgccatgccgatctccgccaccaccggtcgtgcctctacgcgccgagctagcctctgagcactcctcccgccactgacgcgccggccaaatgcggtcatctgccacacctccctggctagccgcccgtggtcgtccatgcctcctctgccgaaatgcccgccgcacgcgtcctgtccaccggcaaccgccgctgtagagtagacatcatcaccgtcgcggaggagtcaccatgacgccactgccaccacgaccagaaccaccgccgccccactcaatcccgccacaagccatcaccccaccgccaccgtgccggcctccacctgccgtgtaccgccgccaccatgccggcctctgccggctgcgaaccgccgccaccgtgccggccttacctcctcacgcgcgccgcgccgcgccgccctgccactgtcgcgccagctgttgccgccgccatcgcatgggctccgcgtgcgcctccatcgatcgcggattcgggcctcgcccgccgccgcaccaccatgcgccgccctcactgtcgccaccagcaagcgtcgtagccagcagctcctccttccccatcgccggtcacctccttcctggcccactgcgtcctcctcccgtgtgccagctatgcgggggagcacaggggaggccagatcaggtgtgaagcatcggatccggcgctgggggagccagatccggtttcgctctgtgccggcgagcccaccgccgcgacctctgccccgccgccaactccgcctccttcgcccctccactgccactacatcctctgccccgccgccgcctcctccaccctgcctccttcaccttgccagccggccgagcaggccggcgccaccttcttcgcgccccatgccgcgtcggtgccccaaccttagcgccgctcttggggaagaagaagagcgcccggccgccgctgtccttgctgtcgtatggctttgccgacggccgctcgggcggcggcgaggcggaggggaagagcgagggtagcggcggtggtggggttgtgtcgctgtccggtcgcccttggggtgggagcgacgctccggacttgaacttgaaccggcagtgacgtactataggtactgcaaaatgcgtacatcctaaactggcatctgtttgtaaaatagatggagtatcttgcatgcacaattagttatgtctcaatctccttatgaaatcatcggagttaatttgtggaggttaggcacagaaggtgccaatcggattcgatgattaaaaaaacatactctatatacctggcctagctgatctttttgtacaagtgtaaatcccacaatgcatcaaaggatgtgccacgtcttcaaaatagtattaaccattggatgctaacagtgaaatgacatacaccgttggatgaacatagattacaaaacacaggtgttagcaaatcttcacgagacttctagattccaaatccaaataagagaaatcggtgaggagagaccgggtccaaatgtcaatgcaattttttaatttgatccttctataaaattcattttacatataagccctcaatttgatatatctttgatttctcgaaatggttgcattgtactgccttcccaatatgtaagatgtttaggattcaacatgggtattaaaaaataggtaaaattaaatgacagaagattacgattgattgaaatgagcaagtcactagagaattaacaggttgaatgttgtgattggttatttagttaacattttatgattttcttttacaatttttgacaatgtatattaggttggttagagtcacgcgaatgcgtgacttcatagcctagttaatatggtgaatgtcaattaattaatcgttgtgtagattaatttacataggagcaaataaatatgtgtgcacggtacagaggactggaatgaaatctacctctggataggttgaccttatctatatggaaatgctaattatccatcacaaatttactctctctctcatgatcctttttggaactttatgtgcatatgatgctccaaaatcaaaacatttagcattattgtacttcttttagaaacctggtgctcataagatggtcaaatcaaaacattagcattattgtacaagttgaaggttagtacattagaagttttcaagattaaatacatccgaaccctcgcaatactagtgcgtttgtctgaattaatgatcttaaccgagatcgcttgatgtctatgagcctcataggtggccatattccctaataagccggaataaaaattaatttacaagtaaaacttttacacatttattcgtatcgacttaaaagtcaacacttaaaaaatcgcgttgaaaatatcttaaaatcaacttcaagttcaaaaatttaaattttggtgttttcttttggcttattaggccaaccgatagggctctattatttttgtttccttgaagttattgagtgcatgcaattaaacgttttaaaacatttatcacttatacacacaaatatattttgatttatcatatggtactgatattagtaggctggtatataaagtacttcaatatatattattctatatattttttattttttctagcgattatatgagagatgtactctcgaaaattaagaaatgtaatgagcaagcagtacatgtattgaacacaacattgacgtccagtggcgcaagtaggagaattttgataatttgacactttctttgccactttgctttaattgacacttttgaaatgatacgtgggatcatccgactgaatgaaagtggatcattccttctaagatcatggaccatcattgagctaacccgaatttgaatgtgtattaaaatcctatccaggaccagccagagtatacaaacgacaaattcatacacagatccacgtcttataaaaataataaataattcttacaaatgcagcggaaataagcaaaacttctaatagacacaaccaaaatgtagcttcctccataatccacaggcatcctaaacatccggaacaagctcaatcctcaaaaaaactcaccatctgaaccaatctctgcctctggggtggggaaaaatatcgtacccaacaagtcataccaaagggaaggtatgatgtaagatattcacaaaggaatggctcattggatatttgcagtaaaagcagcatttataaatcataatttgaataagtaaaatagtatatgtaattaaccaatattaaatcatcactgcccaatgctaaaaccccgttgcaacaggcccaaccaaaccacatgaactacacaaattcaaaaagtcatattattatagtggaactaatcacagtgagctggttgaccgcccaataactgcaggcacagctattccaataactgcgggcacatctattcgaatagttttaactctgatcagaggtgtacaaatttacccacaagacacaattccacacatattaccatgccccaaagtaccaccacgatactgcaaagggggaaatcgtgacaaaacccgttatataaccctccctaaccgaacatacccacctcaggtttcaccccctccttgtgccaagttgggcagttccctctcgtgcctaggtaaatccagaaacaacatagactaatatccaggtccgaactgcaccatcgcctctacccttgccatggtatgtcagctaagttaagttatactctagatttagcctgaagcccatgctggcctatggtaagtacgagtatatcttcctgggattctcgagaaccggtccttaattatcatggacacgactttcgaaaccatacacccacaacccaccattatagcatattttagtttaattaaaccataactatggtagtccatcataatataattaaggactaaattataatgaatcccattgcgagctaattgatataagcatggctaataagcattcctaaaccaatcatctagtcaattgtagcccaagttatcaatggcataagatattcagcaggctaagtacaataggcatccatcccacatgacattctaaaataatgatcaatcttgtatgtatgaactgcgttgctcttgatctgacgaaacctcggcaaccattttgaaataaactggatcactagaactgacggaatctaaatgacaaacaaagcatacatgaaatacaagcaataaggctactgaaacagcaaaagaaaccatttttaatggatttcatacattttaccggattcacttcaacttgaatgggttaaaacggagctcagattatttagttatgaattttacaatatgagctacgttattactaataaccgaaaaaccttattcatttattacatattaatgcccataaataaatagatcaatggaaatatacctccggtaagcaagcctcgcgaattagcgactcaacgagccaatacttcgtgacacgggaccatccaaacggtcaaccgaaccggtgaacagaaccggcggctcagaacgactatggctaaactggtaaactagacacggtttacggcaaagactcgatatggcaaacaataggccagtaggagtttagggatgcacctacggctttgtgactcagctaccgagcattcagtagagacagtgacttggtttgacgagacgcagcagtggcacgacgagacgcggcagcggctcagctcggctagggcagcacacggcagcggctcggcatgcagctgggccggcgtacggcagcggctagggcagcggcggcgcatggtggcggcggctgtggcacagcgaggcggtggctgcggcgcgtggcagagcagtgcggcggcagcggcgcggtgcagggcagcggcacggcaaggcacggccggcagcggcggacgcgacggcaatgctagggttttgcgggataaacaattagggttacgacgataacgctaggaaaaataaaacctaaactaggagatcacaggaaaattcctcaccaaaccgagacgatcggcgaggaggagacgacgacggtggtctggcagcaacacatgaaaacaacggtgacgctagatgagaaacaaatggaatagattaaatagataaattgatggttgcagcggtaaacacaccaatagagagggagatcggaataccggcgacacaacggcgatgacggcaatggcgggaggcggccggcggcggctagggcacgggaggtggtggcggcttgggtttgggcacaaataaatttgtgaagaaaattagggggatataatagcttatatagagtagaattaagagggaggtggggccggctaggggcgcgacaacaggagaggaggggaggctgactcgggttaaggggggcggccaagagggagagggggaatggagttggattaggattaggactttcccaactcggaaaagaaatgtggtgctattttaggaaaagaacggaaacggaaccggaaactgactcggactcggctcgttatacaaaacggaaccgcggacggaaagagaatactggactgggcatggttcacaaccaaaggcgggagaggaaaattattgttaattcaactcctcacaaaataaattaacatttattccgatgctctgaatattcaaagagaattcaaaaaaattctccctgatatttccgattattaaatacattgttaattagggttttctcctggttaaccaaagtaatttctatagataatttattggtaaattagaaactatagaaaaggggaaactccgagtgtgacattaaattatcaaatctcttgatagttaaaaagaacggaatagtaatttgtatttctaatatatagataggaagcattagttaaactaatgcaatattaaatgtttcggctaccataaaacttacattatgaatttgctctgctcctctgaatggaccaaactgagaactttttcaaacaggtcagaagctagtagtacacattattttatcaaagacagagtcccttactctatgccactaagtttgttatagttcaattctctatgccactaagtttgttctaattcaacgatttgctactgatattatccttttctagaatatactagtaactttatcaatatatattctaagatataccattaggctagtccttttaaaaaaaaaccccaaagtactattagagatatgaggttcaaaaaattataaaaaaaaactacgagacctccttacataacgtgataattttttatataagtttcaagatttttctggtatatttaatttttttagaaaaaatatttttatgtggtatatgggagataatttacttacacaaaatataatagcataaaaaaatcttatgtagcgtatgaaaaacatttaaaaaacaacacaaaaaagtattttatataacatatagctgataaattatattttaaaaaatataaatgcaaaaaacttaaaacttatatacaaatgtccatgttgtttaaggagaccacatgaaaattttcatattttttgaaaaactctaatgagataaattgaccttgtatgtccataaggttatttttggcactgttcaaaagaaggcccggcccaatgacttgttatagaataattgataaagtcgtcggtatattatagaaagagaaaatatcggtggtaaattattaaactcggacaaattcagttatatataatgtattctctcattacaattagacaaaattatattattttctttctggatcaggctatgattacattgaacaacaatatataaagattagaacaaaatccacaaattacaactatgtggccaaaactataactgccacaagtttaggtgggtatttcacaaaacatttgtaatagcaaacaattttatcaagaaactacaacttcatcccctacgtcactgctacaagtttaggtgagtatttcacaaaacatccataatagcaaacaattttatcaagaaactgcaacttttatcccctacatgtctctgacatatgggcccaacttgtaacatcatcactattgcgtatgtgtatgactagtgggccaagacctgtcattgaagcgaagttgttgttttatgataaaagcatacactatcattgcacttctatgaaatgtagctaaaattgaagcatactggtagttatgaaagaaatgttcttttttaaaaaaataatctaaagataaatttagaatgacatatcttggcatcaaattaagttaattagctactcgataaatctggggatgcaatacaacaatattaaaatttctaatttttaccgaaatacatcgtaaagcaagcattaagattaatgaagtttaggatcacatgtaactaatgcacagttggacatatgttagtatgtattagaatttagaactgagtaaataaaatgattcatggtagtacaaagaatggcttaggagtactacaatcatagcgtaattaaggtttaggccctctttggagcatatgataggaaaaacacacgaacatgaaaagcacataatcaaagtggcgtgttttttttcaatcatatagaaatcaaaatcacctgaaattgaaccaaaagaaagttttaaggagatccaacctcttgcatattttcatttttaattttaaccttttttttattttaaagataaactctccctaaacttatttttaaatctgaaccttttggccacgctagtcaaactgatgtggaaaaacaatgctgctatgacagcctggctgacagtagcattgttatttggccacgccgctctggcttgcgtggcaatgttattttaccactctagctggatggcatggtaaaacaaagctgccacgcccattgtagatggtgtggtagtgttgtttcgcaagcggggtgacatgacaaaaaaggttcaaattttagaaataagtttcagaagattttatttttaaaatttaaaatttaaaaggtttttaaaataggaaaaattcccatattttcctatggaattggacagtacgtaggagggcaatcttatgattttttttaatctttttctatgaaccaaagaggtctttatggaaaaaaatcctccaaaaatcttttgcttatcctccaccctgaagggggcttagaattaaaaaaaataacattttgtaatacacaaccaaggaactgtatgtagccatgcaaa

SEQ ID NO: 83268 - DNA, 12120 bp, Oryza sativa
atttctcttctttacttcagttatgtgtggggcgaggtgagcgaatgcgtgaaaaaaaaaattttcatgccataggacgattctccatttgactcagcttttctgctaaaggaattgtcaacatgcaaaagattaatttagtattaagtattaaaaatatgaaaaatgattttatttgttttttagatggatttctatatagctttttttttaaaaaaacaccgtttaaggtaaacgaggaagttggaaaagccaactgcaggctagaacgcaccctcagtcaataaaaagaaagaactcattaatttggtctgtggatccatgtttaattctgtgacatttgacaaggtaggcaaacacatgatgactcgcaattttggaactaccgaaagtatacttgagtatcagtactagtactgtatttcagtcagttgtcgacaacagatttttggtaagagatgttcaacggatttcttttttcctattggaaacacatgtgagcaatgatcttgacacgctgttgagagtattaattgtcaggtagtgctaattgtttttactccatgttgttgttgttgttgctacacagtgtgattattcttatactagtataaaattgacacaatgtggcactagtaatagtagtagcttgtcttctcctattaattttcccctagttttatcttgtgtttgtccatctttctttcagtagcagtcagttcagtttcctggctggccctgaacccaagaaaatgaacagtaagctaaatagaaaaaaataatcaatccactcccagtgaatgaatcatcagatgctgctgagcctaactctaactgtagttgttctagcgattctagcactagtacactagtgcaatttacccttcactttcaccttatcaaggaaaatacttaaaaagcgatgttaaagggaaaaagaggaaaaatctctgttaactacattgaacagccttgaaattttttgtaaagctgcaataaaggctttggatgaaaggagagatattttagcagcgattttatcatgctgcatttagtagcagcagattatttgttatttgaaaactcaaaattccaaccaagagattgatttgtacttatccataatctggtattaaaccccacctttaatcaggtgattagaattgccttgatgagcatggatattgtcactgcatttaccttcagacttttttccccttgaaaactcaaaatcccaaccaagagttcaatatgtacctatccataatttggtagtagtaaacccacttttaatcaggtgattaggatttaccaggtgcacacatactgtcgcagggactagttagttaatgggaggtgaaagaaagaacatgagtgagagagagagagagagagagagagaggggggggggggggaatgctgctactctagtagtaggagtagctaacaaccaagaagatgccatgtccttgttgcaggggcagtggtggtaaggtaagaaatgcagcagtataagcagtaagcactccactcactcaccaaaagcagaaaaagaaagaaagaaagaaagaaagaaaagggacaaggagattaactaagacacaccccacctacacactcttcttcctcctcttccttcttcttcttcctcttcttctcctccatttccatttctccacccaccaccaaacatctccggatccttcgctccatcctcctcctaagaagagcccaagaagccagcaagatccaaagatcaagagcagcatttgtagctgcaactgctggtgctggtgctgttgctgttagatcgaggaggattcaacaagtgtgttggtggtggtggaagttgttacagaattgcgggtgagagaagtttcttcaccgcacctcaccaaaatctccatccatccgtctgaatcccaactccacctgcaactgcaactgcacggcgagattgcagtacaacccaagaaaccatgatgaagtggcagcatcagtagcagtagcagcagcaggaggaggaggaggaagagggctcctctttaatccttgcttcactcatcttcatcagaatcctccttattggctccgcctcgcattctgtgctgcatcggctgttgtatggtcggtggcgaagatgacgatggagcacggcgaggattgctgcgtcaaggtggccgtccatgtccgcccgctcatcggcgacgagaagcttcagggctgtaaggactgcgtctccgtcgtctccggcaagccgcaggtattccttctcttctctttttatcactcactcatttggcttcttttttcttgtttatacgtcccaattcagagagactagattgactctcatcctgtcaattgtttctggatttctcttttattttattttttttgggggggacgtgatttcctgggaaaatccaaacaatatgataagttctctgcattgttcttttaagattacctgaaatttttaattaaattcagagattggagacatattttgtccaagtcaagaaagaaaaatctctgactctgtttttctctgttgagtacaagaacagaggagctcagaagaggacttgttgtttcccccaattttggtcctctaattcagaaaaaaaaacttgtcaaaattcatggagaatctagcttgcttccttgttttagctccctatgaaatgatagagatgcccatctgttcgctttccctttctcttagttttgttttcttttccttttgatcatcattaaatgaggctctagagtcttccttctccttttttcttcttcagaataaaattgtatatatttttttcactgtcggcagcgccaaatgttcctcattttttggtgtgaagttgcgtccaatgttgatgacgctaatgctataccctttcttttatctggggctggaattctgtcagcatcacgcaattatcacccaggttttctttctccagttttgtccatccaacactcatccttgttggattcttcccttcccttccttttctttcttccatcaagatttattaagtcattttctcagacaaaacgcagcaagattaattaggttccttaattaatctaatcctccattacacaaactcgaatgatgagatctggcttaggtatcatattcttttggtaagatggtttgctctccataagactgttgtttgttgatctttcttgggttccccaccaatttcatttctttgggagatgatgaaaagttactttctttcattctcccaaatcaatctttttaccggtggtggcggtggtgatgatgggggtgaaaaaaaagggcatatctttctttgttttgttgttgctgatgggttttgttgttgcaggttcagatcgggagccattccttcaccttcgaccatgtgtacggcagctccggcacgccgtcggcggccatgttcgaggagtgcgtggcgccgctcgtcgacggcctcttccagggctacaacgccaccgtgctcgcatacggccaggtccgccattgccattgccatccaatcatatgcttccatctccatccccatgtgccaccatggaccaccatgttggggaagatgcaaaagccagcaccacatcatgtgctcctgctcctgctcctcctgctgctgcctgctaatccccttttcttttcttttccttttcttttcacacttgcttattagttgcttttcttctccagctgtttctgcctcatgatgctagatcattttcttgttttttcacatcctctgtgaacaaaaaaaggaaaagaagagaagagattggaaaaatgctgattgatttggtggttgtttcatctcttcctttttacagactgggtcagggaagacctacaccatggggacggcctgcaaggagggctcacacattgggattatcccgcgtgccatggccacgctgttcgacaagatcgacaagctcaagaaccaagtagagttccagctgcgcgtttcgtttattgaggtaaattacctgttcctggatgaatcaaacatttgtgggattgtagagaatccaattgtgctcgttctcttgatagattctgaaagaagaggtgagggatttgcttgatcctgctactgctgctgttggcaaacttgagaatggaaatggacatgcaaccaagttgtcggttccaggtaaaccccctgttcagatccgggaggcgtcgaacggggtcataacgttagcaggatcgaccgaagtgcatgtcactacccagaaagaaatgacggcatgccttgagcaaggatctctgagtcgtgcaactggaagtaccaacatgaacaaccaatcaaggttagcaaacattatcctaatcattcgtcctttaccttttttagaggaggaagcaggtccattgatcaaccataattgatgacaagaaactagcatcattatggtcagaaactggcaatctttgcaggatacagctgtttgtgatgatttcttgcttctatgtttagtgtaggacctttttgcaggattagtcaatgtattgtcctaccctcaaaagagaaaccaattatttgtctagtttcaagtaattaattctctgctcaagtgctttaggacacattcaatcagattggttacctgatattccgttactaaattctacaaactttaatgaactttatgcttttggtttcggcatgtaatagtcgttcccatgccatcttcacaatcacattggagcagatgcgcaaagcagatcccatcatgactttagatggaatgcctattgaagagatgaatgaagactatctctgtgccaaactccacttagtagatcttgctggatcagaacgtgctaaaagaactggttctgatggccttcggtttaaggaaggtacttggcatgttgcttgttctatctgaatccctaatcaaacatccatcttgtcttgaaacaagatactccgtataatttatttatgtatcatgtcatcaggtgttcatatcaacagaggacttcttgctcttggcaatgtcatcagtgctctcggtgatgagaaaaagaggaaagaaggcgctcatgttccttaccgggacagcaaactcactcgccttctgcaggtattattcttctgacccaagtgcacaggcctttgtacagaagcattgaattcatagctctgttcaagaagtagggccagctcacatttaagcatatataatacttgaatctttgcatttagtttctttcattttactaactaatctgttttatatctattttattattataggactctctaggtggaaacagcaagactgtaatgataggtaattcatttggttggagattgtttaatcatatttttatatgatttaggattttttctaaataatgcttgtcaaagttccagaattggggtttaaaataaaaaaaaataaaacgatgatctattcattttatcttcggtaaaaaaaaatgcatcttgtcatatgatttaatttgttttcataaataagaaaactcggatgtaccttgattttcactaactgttttggttgatattactattacatgcaactgacatggatctatatttttctcctgcagcctgtattagtccagcagatatcaatgctgaagaaacactgaacactttgaaatatgctaaccgcgctcgtaacatccagaataagccaattgtaagttcattaaaatggtctcgtcagaaaagtatctgacatttatctgcgttatgtttctttaattaattggtttggttccgtcaaggtgattatttgacatccctatatttactttcctattttcaggtaaatagaaatcctgttgctgatgagatgaaaaggatgcgccagcaaattgaatacttgcaagcagaactcgtttcagctcgaggaggagttgtcttagatgatgttcaggtaaattcttttctcgtctatcctcagtgtccttgaccatcttgttctataaggcacactcactcacaataacagtatgagtataataacaagtggttccattttcagggtctcagggaaaggatctcaatgcttgaacagaaaaatgaagacctttgcagggaactgtatgaccttcgcaaccatggttacactgatccttgtgaacctgaactgcaagtatgttgatgagttcttctgcaagctttcggagattttacatttgaaaacaagcatacaatttactcttctacggcttctttcatgatagattcccttttctctcaaaggaaataaaagaggggacataacatgacattgtctactatggattgttttcatgcaattgcgcttgaaatggtatatgataaaccatgcatataactatttttatctctttcagaaaattggaactggttacactaaaggtgaagggctcaaaagaagcttgcaaagtacagaaccatttgatgtccccatgactgactcagtaagaggtaatctattagcaccttcattatttcatctcgttggcattcagaaattttattcagtcccatcttaagccatgactaagcagtgaacatggtggactactattttcattttatttttccttgataatttccttattctgcgataattctggacctccagcaggcagccctaaagatattgatgatgaagtggccaaagaatgggaacacacaatgctgcaggatagcatgggcaaagagttgaatgaattaaacagacaactggagcaaaaggaggtaatacagaaaacgtttaaataaatcaatgtgttttaatcttctaggggtgattaaacaaatacacgagctaatgttcgttcctggatgatatatgattgtacatatctcaatcaagcttcttgtgcaacttcatttttctggatactcaattcatctccatatgttgtatcatggtgacagttaaacgtgttgtcaaagaagttacaaggatcattggttgtaccatttttaatttcaatatgatggaagtgtggatatgaacattatttttaatggttcactgaatgtacatgcagtgacatgctactcttgttaatctgctcatgcttgccaagacctaccttaaattttctcaatttctttgcagtctgagatgaaaatgtatggatctgacactgttgcacttaaacaacactttggaaagaaacttttggagcttgaagaagagaaaagagctgtacaggtttgttttaaaaaaaaatcttcccattagcatattcactcatccaacagttgtgttttcctaacctttgctaacgagaaagttctgaacaatttcagcaagaaagggacagattgttagctgaagttgaaagtctaaatgctgatggacaaacacacaagttgcgagatgcccagctgcaaaaattaaaaacccttgaagcacaggtgaataaacctttataatttgtttgaatgcagttcgtgttgttcagtacatgttggtcatacaagacttggacctgcagattctagacctcaagaaaaagcaggagaaccaagttcaacttctgaaggaaaagcaaaagagtgatgaagctgctaagaagttgcaggaagaaattcattctataaaggcacagaaggttgtcttccctttctcatcatgtcaagttctaatgcatcacattttacactatcgtaagtcataacaattttgccaaccttgttccattatcaggttcaactacaacataaaatcaaacaagaagcggaacaattccggcaatggaaggctacccgtgaaaaggaactcctgcaggtatgaataatttaatatgcagttaaagcaaataactgcaaaattgctatgtcattaaattaaattcatatagaacaaggaacgggtaaaaatgatgtgaccgtatctacttagagattcatctctaacccctttttatgtaatgtttctgttgtactatttttgtggtaagcattatgagaagtaaacctcacttactgtttcctgaatgcagttgaggaaagaggggcggcgaaatgagtatgaacgccacaaacttcaagcacttaatcagcggcagaagttggtaagcttcttatgtagaattgtatttcaaagaaaagaaagtgtcaatgtgaaagtttggaaaaattataagtttattgtaggcattatccaaactatcattatttggactatcttaaaatactaagcttcactttatgtgtaactagctgccctgacatagttttcgtcaaagttcatatcttacttagctatataattacgtgtaagtttttccctcatattatcatgtctatttataaaatattaaatatcaaagttttgcatctttatgcaggttttgcagaggaagactgaagaagctgcgatggctaccaaaaggctgaaagagttactagaggctcggaaatcatcaggacgtgacaactcaggtatctctctccgcattgcgaccatttttcgcattataattaatactcccaatctaacagctcttccttctttttctttttttttttttttgctttcttccaaacacatcaggcatgaatggtacttctcctggctctcatgtaagttattttccatacttaaagaaaaagatcagttgcttatttggaaatatccttgagaatacttttttttgtaatgcagatgactgagaaatcattgcaaaaatggctagagcaagatttggaagtcatggtgcatgttcatgaagttcgaaacgaatatgaaaagcaaagtcaattgtatgtgattcattttatttccttcccaaatgtaaattatagagatcattcctcatgtaatgcatgattatgatgactaatttaaatggttttaaaggcgtgctgcacttggtgaggagcttgccattttaaaacaagaagatgtcatgtctggtgcagctagtccgcccagagggaagaatggaaactctaggtaactgttatccccatagttctattttgtagttcaggtacctttaagctggacagtatctttaatccatatattatcacaaactgtttaagaaatataagagcaccgtttaatatgtccttgtctgtaatctggttgttatatttgggtccgtattttatatttctcatattttctcaaaatgtgcaatcagcacatccaaatatttatgcttgtattgctgcattttgtttctcagggcaaatactttgtcaccaaatgcaagacaagctaggatagcatcacttgaaagcatggtgacaatatcttcaaatactctcgttgctatggcttctcaactctcagaagctgaagaaagagagcgtgcattctctgggcgtggtcggtggaatcagttgcgttcaatggcagaggcaaagagtttactgcagtatatatttaacgttgctgcagatgcaaggttggtatttattcttttggcttcattatttaatagtatggtagcatccatccttgtaggacttctcaatttgcagaacctggaaacaaattatttttactaaagagctaaaaatctcactttttctttctaaatagttgaaaatctgtaagtgttattttgctaagaatatggcactgattcgaataaaagagtgtggtactgatttgaaaataggaataacaaaaaaaaaattctgaactcaaagggcaactttatttcttcctgaaagcatgacaacaatgtgaatggaagaacaatgcaaagccgtttttatgatactctgtaaaaatgatcatttgtacaaaagtatggaactaaccttcactggtgaaatatcagatgccaagtaagggagaaagagatggagatcaaggaaatgaaggagcaaatgacagagcttgtgaccatccttcgacacagcgaatcacgtagaagggaaacggaaaagcagcttaagcaaagagagcaggcagctgtaactgccactacatctccagtatggtttctatgagctcacagcaattacccctcagtagaaaaaaatgttgaatgatgaaaggattacctaaacatctaaaacaaatatctggtggtgaggagggtatttaacatctccattacccatgttcaaattctctcgtacgccctgcttgaaagggcgaaaagaagaaaacatatcatagggtatagtagatggaactgacaaaaaaacattgagtcacttgaatccctaactgatagtcacaagagtacaagatattcaacaaatatcgtgatagttcttaatggaaattttatgcatcttacagggaaacggaaatggttcagtgaagcactctgctgatgactccaacacaccattgtcaccagttgcggtgcctgcacagaagcagctgaagtactctgctggaattgtaaatagccccagcaaaggggttcctgcattcaacaaacaacatcttaaggtatctctacccccctgaaatactctttgttctatctccctctctcgtatttaaaattggtgacgtacaatgcagatggttcctatggcacagttgcctgttggcaagaaggtttcaatagcagggcaatcaggaaaactttggagatggaaaagaagccaccaccagtggctactgcagttcaagtggaagtggcaaaagccctggaaattgtccgagatgattcgacacagtgacgaaacgatgacaaggactcgacccagaccccagcttcttcctcatagacctcaaagagtgatgtgaaaaaggcttttcttttcttttttttcttcgtctccacatggactgacacggtttacacagctaactacctccacaagggtaacaatgcagctaaaagctccaggagatctccttcgtgcttcgattttacttagccacgggatcgaaaaaaaaaaagtatatgttcatagggtgactgtctttggatgtaaatttcttgtgcctatatagtgagtgtgaatgttagagatgaaaatttagcgagtgagcgagggagggagtggccgttcttcgcgaaagcactgactgagcacaatgcttcatgtttcagcactcatcaactggtgagatgtcatacttgttgtccttctgcatataaggaaaaatctgtcgaaggatggcgtcttgtaaagtcctttctggtgtgcttttgtgatcttgcatgggtatagttgcaagaatgatgatgaaagttgagattttgggtgcttgggcagtgcttattttcttgtccttttttcttttttgttgatacaacactaagattacattggtttggtttgtgttaggagtctattgatgtactacagcaacttgtgcccctatattttggccaattgtgtattctgtgctgttgatgctttgactaaatagagagcagtttgtgtcgacgtctatctaaagactctgaacttcgatggcaaacagccaacagcgactgttgcttagaatttcagcatctacagcaacgttttgtgtttttcattggtaacatgtgccaacctgttcaagtgtgcataactatttattaaaacatactagaaaccgctactttatgtttgatccgcattttcgctgcgaatagtgagctaacaatgttcatatgtttttgacaatagtataataaaacacagacacggggtcgattgagctaacgatgtaaaactaagctagtctgtttctgccaatcttagctattttcttgttgcagtcgactgatacagtcatttgtcggtaataacgtgaaaagatgccaatttctgaggaattattctaacacaaaattattgtgtcataatccgttgtagtctagctggttaggatactcggctctcacccgagagacccgggttcgagtcccggcaacggaatttatgcgttttggcccaacataaagaatcactgttgccttcacaagactcaaatccttgtctgatttcaaagaattgtccaagtttttgtttttctggttcagagttcagagggcaatttcagcatccatgtttgtcattcaagttccgaacccgcgtgctatctttgctcgggcgtttgggtgaaatagggctttcgtgctatcacacattcacactccatcaaaccaaatgcacagaaaaattata

SEQ ID NO: 83269 - DNA, 752 bp, Oryza sativa
  unsure (1)..(752): unsure at all n locations
gtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagtcgtttttgctcacgaatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagnnnnnnnnnnnnnnnnnnnnnnnnnnnnnnnnnnnnnnnnnnnnnnnnnnnnnnnnnnnatataacatgatactgtactatacagcattgtggattagggagttatttaattaannnnnnnnnnnnnnnnnnnnnnnnnnnnnnnnnagggtcggcacgtatcaaacaatnncccctag

SEQ ID NO: 83270 - DNA, 8385 bp, Oryza sativa
cgaaagatatagaagaatttaagatgcatatagaagaactgctgaaactaggagcaataagagagagtagaagtccacataggtctgcagcatttatagtaagaaatcatgcggaagaagttagaggaaaatctaggatggtcataaattataaaaggctaaatgataatactatagaagatgcctataatatcccaaataagcaagaatggattaataggatacaaggtagcaaatatttctcgaaatttgacttaaaagctgggttttggcaagtaaaaatggcagaagagtctatagaatggactgcattcacatgtccccagggacactatgaatggctagtaatgccactaggattaaaaaatgcacctgccctatttcaaagaaaaatgcaaaacatttttaacgataatcaagaatttgtgttagtatatatagatgacttgttaatattttcaaaaacttataagcatcatattgctcacctagaattattttttagaaaggttgagcaaaatggtttaatcctatcaaaaaaagaagatggagatatgcaaagaaaaagttaacttccttggacatgaaataggagaaggcaaaattcatttgcaagaacatattgctaagaaaattttacaatttcctgatgctatgaatgacaaaaagaaattacagcaattcctaggacttgtaaattatgctagaaatcacatcaacaatttagcaaagctagcaggacctttatatgctaaattaagaaaaaatggtcagaaatattttaattctgaagacattaaattagtaagattaataaaagaaaaagtgaaagaactaaaacctctagaattaccattagaagaaagttactttatcattgaaaccgatgcatcacaacaaggttggggtgctatattaaagcaaagacctactaaattttccgctaaatcagaagaaaaaatatgtaggtatgcttctggaagttataaattaaaaactgtcaataatacagatagagagatcatggcaattatcaatgcaattaatgcctttaggttatacctagggtttaaagaattcacggttagaactgattgtgaagccatctgtagatattataaccagcttaatagcaagaaaagctcaactagaagatggattttatttgaagatattattacaggaaatggttatagagttatatttgaacatattaaggggaaagataatagtttacctgacatgctttctcgtttaaccatatttcaggtatgaaaagatcaatgaattacgccggagtcgagtgcttcacatttggagatgacaacaaactcagaatattcccaccaaattcatataaatttaagccaaaggaccatataatcctagatgaagttcaagagtgcatcttggataatttctggtaccaatacaataataaaagggaagaaaaagggtatttgttatcaatattgaatagcctctctgaatattttcacctaataaatgggtcattaatgcctgccaatgaagatcatgaagtaatccaacaaaagcctatatatgtagtatttgatggaaagctccctggggtctacatttcttttgaagaaattgtggctcaaaaatagatgctaaattaatgggaggaatatcttggaagaaatataaggatattgatgaagcattaagccaagctagaaaaatattaggaataaattattatctagagcctgctgcaaaagaatatattcaaaaatgcaaaaaagctaaaggaaagaagacttcagaaatacccattaagatgactataaaagaagaagggttttttaaaaaacccacatacaaggaatgcttaacaaaaggagtggatccattagatggggaatatattgattggaagataatagaaaaatttgaagaagcctccccacagttaaagaaggaattgaaggaagaaatacttaaagaattaaaacaagaaatggatcagaaatttgagcaaataaaaaaggcagtagatgagaaattagaagtttctttttctgatttggacacaatggatcttggtggccatgggcaaccagatgaataaattaatataagctaaatatgtttttcaatatatattgataatagaatatcaacaatttgggcgtggaagaagaataaaagaatgaagaataaaagaataaaagaaattcagaagattacccaagaaagaatccagaaggacaccctataaaggataaggggacaatatagggtgcggtgaatgacatatcactgtgaagagtaaaactttcggtggaaaggcctcgactttagccagctcccgtgaagatacagtagcgaagagataagcaggaggcacaggcgacgccatccctggcctctataaaaggagacgttggccttcactccggagacacacaacaacaacgaagacaccattcagagcaaagcttccaagcgcgctctcaccctccattccaccgttcttagtagtagtgacttagcctacctggggggggggtgggggggtgggggtggggggggggggtggggggggggggggggggggggggacctaccttcgggtttcccgaaagggaaaaccgtatgtaagcttatctgtttaatatgaagtaattttccttaagtattcctgcacgtttgttctagacaagtgtttatgctaaggaccctataggagaaacctcttcggtttgttctcgtttttagcctgcatcttgcataggtgtctggagaatcggtatccgtagagaagtgttcccttcgggtggaactgcctggggagacgataaactcttagctagaacaagtgtgacttggaatatcttgttaagttgcttctaaaaagatagataggtgaggcatacggtgagtaccgagtaggactttacatcatccgaagcaagcttctgaggctgtctaaataggattcgccaccctgcaaagatcctaaagttaaaatatctctcgaagtgaacagtattgaacagtaatttaaacagtaaactgaatagtgtttttgaatagtaatcagccgaataaacagtaaactgaatagtattcagccgaataaatagtgttttgaacaatgtatattgtctgaagcataggtttgtctgaagcataggtgtggtgtatattatctgaagcataggtgtggtgtatattgtctgaagcataggtgtggtgtattttgtctgaagcataagtgtggaatatatatggggctgggagtggtcgtcgtgttcaaacgctaacagtatctgtttggtcaagtgctaacagattctagcttgtgatgcacgagcagttcgaagcatcagttttcagccattttaatttgcccgatccgcccaccatgacatcattgattcatcatttaattttcacgcaacaatggccctaagcagaatcggttgtagtcttgtggagaaaactaatactagaatatatcatttgtacgtataatttttttttagattatttaacagaggctaagaatgagggaaagagtctctttcagtcatctcgttgatcaaattttaaaatttaaattgtttcacttcattactacagatccggccaacgttgatgaactatctgtgatgaataccagcaacctgtcacggaggccgtcacctctaacgggtagcaataaacccagttaaagttaggctaaacagaatgacccgtcacatataggagttatatataatttaactatttgccaccattgacgggcaacgcggcgccgtcgacccctgctctccccgcgtcggcagaggcaggaagggtagtgcaagatgtgaactgactggaactaggaagaggttagtttagctatgattgcctttcttttagctattgcacaatgtattgcttacgctaaccaatttttttgctggaagagaaacaagaagacaaaaacaaatgtgggaaggaagaaagcaaagggtgccattgatgcccaagccgctgcagttgatcttcaagcgaatacacaccaggaacaagagcagctgcagcgaaagaagcagctgcagaatcacaagtgcatgcagcataaactcgcagtcctggaccaatcgctaggaaaggcttaattgtgttgtttttcattttttttttcacttaactttggttcctgcctcgcttacacccatcaaaaacaacacgaagttggcagtaggggtatactggtcatttcaggttcccattccatgctggcaagcccatgtgggcagtgtacaatgtgaaaagtggcaaaaaattagaaaatcttctctcttcaatggcatattgttaactgcaaacctaacaggggcatttgaacaattgccaaatgtaaaagtggtaaatagttaaattccccgagttatatataatgaaccatcatctgtgataggtcatatgacatagcccgtcaaagttgtcaagtatcatcttacaaactgaccaatgtgggtgggtatctttatataccagagctcactcactatgagctatcctaaccatttgtatcgtttacattttaagttggggacttgagggaatctttgctataaaattggagggaaaatttttgtcatccgatcctaaccctatatattgcactaaaattttgggatgcgtattatttgaattattcttgatattttagtattgcagatggatcgaaaatggatgcactactggtggagaaagcatctttaatctcggtttgcaactcctttagttctgggttacaaaccgggacgcccaatccgggactaaagataccctgttaaaataaccggtactaaagattcacctttattccctaaagatggcagcgctacatggctggcactaccctctctagttcctaaaggttttattttctttttcttcattgttctttgcatattgatttcacgtcaaactgaccaacatcacaaaatcaaagattgacatcccaaattcacgtataattgaattcacatattattgacaccataaattcacaaaaattcttcactgctgaggaccattgcctgccaccgcctacctccttccctctcgcctgatccggcagaggagagggcaccgtcaccgcctgccgccgcccatcgcttgctgccgcccgccgcctccccccttcgtgtgacaccgcctgcctcctctcctccgccggaaccggcggaggggagggcaccgccgctgcccgttgcccaccgcctgccgcctcccccttcgtgcgctgccaacgcccactgcccgccggctcctgcccgccactgccaccactgcctcagtcgaacggattgagaggggaaggggaggatgagagggggaggaggaggagtggaggagtactgagataaatccggcgtgcgagggaggagataaggacgatgggatcgaggcatgtggctctaatattgtcccggttggtataaacaatcgaaactaaaggtagtggggacctgacagctttttgaaccgggactaaaaatcataaagtccccttacacttttaaaccgggactagagagtatttttagtctcggttcttattggaaccgggattattgtgatttttggccaacctagcaaagatgtattctctagtagtgtacagtagtattcgcttgagtacagaaatggagttgctcagttttcgaatggtgcagaggatgacaagtctagagtctagacggagcaaccaatatatggtttgtccagactgtttggaaaaatgtttgctgaaagagtgcaattatattttcacttgatacgatctggaagggttatacttcttgaaccaaacatggtgaggaataacctaccggtactacactaatgaatggacataacgagaagcaagatgaagacgacagattcgtcttaagcccccgtcacagatgataggttttttttagtgattcccctaccaaacttctgactagccaaaatgcttggattcccgtacattggaattagtgctgcataaatacttatattatgtaccaaatttgaatctgaaaatgcttatatttgagaacatatgaagtaccttttaagtgaacataaatgtatcaaattaaaaagttgaaatattcatattttcataattcaaagttgaagtatgttgttaatttaaattcacataatatgaaagtataaaatcttgcacggtaattggattcagaaatgttgtcattaaatgctaaaagtgtttatttattattcgagctatagttttgtataaactcaattctgaacgtacgtggtgaatttaaaattaagaaatttgaaatgaacaattaatattcatattcattattattttcaaggaaaagtcaatttcttcttccgtactcaacgccaatatcatctaattttttttagataatggaataaatatcccggcctttactcaaaagagttacaactaattattacatagaaacgtttaacgaacatagtgtaaatctaattgaatagaacataccgcaaggaacaataaagaatccagcctaacataaggagattacaattattgaagtctatttgtaaatctccaaccataattggcaaaaagttgcataaccgtagtctccaacttccgacatgcaactttcagaaactcttcatcatcttcacacctttatagttatgcccaaaaccgaagccaatgggttgctctgaaaatgacctgcatataggaaaatgatggtgatttgtcaaaaactatatcattcctactcagccatattgcccaacaaatggcagaagctccaacaagtatcaatttactcattttcttatgaactcccaaaagccacccatcaaaaatatgatatacgctaactgaaagattaaaaccaaaagaaaactgaactgctctccacagaataattgtgatccttcaactcttaaaaccacatatataaaccttacactcaacctatccaatggcagttttgactcagatgacatgcgatccgatccattgtgtttatatggctcacttgtcacacacagtgggagagagatgaacaggctatagatgacatgcagatagtgtgaaatccagatagtgtgacaagcatcaccatcttagatctttcaaaacgccatatgttgcgccaaaacttctccatgacaagtggacccagtgacaccttgaacccccaatgtatgcaaaataggttttttctagggttttagaattcagggatgaaagaggtattcaatgataatcatagtcaaatatatcatatgaacacgtattccaagcattaaatattcgagatggctaattctcgcgcacgagcgagatcagcaagtcgcgagcatttttacgagacacgggagtagttacacctaattaactcggttagttttacataatgacactaattaagataagatttttctttttccgaagattttttttactaatatattgaaaaattttaagttagatttgaaaactttctacttaagatataaactttaaagtcaaattttgaaatatttcaactcaaactttgaaaattttcaactcgaaatttaaatttgcaagataaattttgaaaactttcaattcagatttgaaatatttcaactcgagatttgaaagctttcaactcaaactttgaaaattttcaactctaaatttaaatttgtaagataaattttgaaaactttcaactcagatttgaaatctttccactcgagatttgaaaactttaaactcgagatttgaaaactttcaagtcgtgatttgaaaactttcaactcagatttgaaaactttcaactcgagatttaaaaactttcaagtcgtgatttgaaaactttcaactagagatttgaaaattttcaaatcaagatttaaaaactttcaacacaaaataaacagaaaaaagagcgaaaagagaaaagaaaggtaaaaacaattgtgcaaaaaaaatcgcggcgtgggggagagcctgtcagctggtgcccgcgtgaattaggcgcccccctaaatattccattttttatactttgcaaaagaaaacgaaattcatcacattaggatagaatgattttcctatgtatcattgctgcttattagttggttttctcagccattcatagacctatattatgtattctcccgtataactccagtcttcttttaatcgtcactctccagtcatcttttaatcgtcactgtttttgcttgtttagtaggatatataaagcataacgacaatgaataggcacctttacaatgaattgtaaaatatgtgtcattaaatgaaaagttgctaactcagccttgatctattttggatctttagggctgcaggaattc

SEQ ID NO: 83271 - DNA, 56178 bp, Oryza sativa
  unsure (1)..(56178): unsure at all n locations
tctcaanttagatcgcnctnnnnnnnnnnnnnnnnnnnnnnnnnnnnnnnnnnnnnnnnncagttagtgtcatacaatctggatggcatgtgagtttttcttttcacttttgatgattttgtaggcattttctgccaaacacctttgcactgtatttttacccttatctatactatacaccaggtcgatcctgaccgcgagagcgacacccagacacgattggtgacttattggacggtgggtttcgcaggatagaaatttgtgaccttctaattggaaagtattttgtattggagtacctcttggtagctagtctacatattgacagcagaaaatctcctgtaaacaggccgatgactaccacaagaccggctgcatgaacatgctctgcccaggctttgtgctgctgagcagaactacctctcctgggatggtacttacaacaggatctattcctctgaatatgaccaaggtgatcaatgctgttcatcacattgcactgaacctttttaatgttaagaaaggtgaattacatccccgcgtcctacgtatatattctaggggcctgttcagtttgttgccaaaatcaaccttaccatttgttggtaaagccaaattttagcaatgccaacattttggtaagttagaaatgtaaagataatgtttagtttgttaccttatcaaatattggcataattttgtgaggagaagtttctaaaatcttgccaaattctatgggcattaccaatatttggtagcaaaccaaatgaagccaaattttggcaacttgccaaataatggaatggttcaaaatgacaacaatctgaacagcccctaggatgcacacaatcaagtattgcattgaattgaactcatcacctgcagaagtacatctcaagtagcgtaaatgtttcttagatatactaccaccaaatagagggaaaaaaattgaaggtgaaaatgatgataaataatataaccctaagattttacagcgaggatagttttattttaatttttgaggctttagagtgtgctatgtggttctctactatttaattcccgttgcaatgcatggacattcagctagtattatgaaaaaaaatatacgtggtttctgatgatacatatttttgcaacatgtgtggtctaggatatccaaaccgggaactggcaggtggtggtcggtgacgaggtcgtgggctacttccccaaggagatcatcaacgggatgagcggcgggacggaggtgcagatgggagggatcgtgtacgcgtcgccggggcagaagagcccacccatgggcaacggcatccagcccgtgcacggcggcaactaccgcgccgccaggttcacgtgggtggcggcccaaggcgccaggatcgccaactggacggtggcgagagatgtcgccgacatcaacatctacgacgccacggtcacctcgagctcgggaacaggcccggagggagctgtgttcgaatatggcggtcctggaggccagccgtgagtgagtgacttcagcgtggcctctgtctttgatagtgtcctcaccttatttggaggatgatcatgggtgtatttggttagaggaaattgatatcagccgtaatcttagcattttccttcccatgatgattttttttaagataatggaataaatcccggctttcccgtgacgatgactgtccatgggaactgggggttagtagggaatgcaacatttctgggagtggatgtgtcaaaatggttcaatgaatggggttaataatccaggattgatgcctgtttaaaggaatcttttttataatagactatattttcagtatttccttaacgagttatagtcaattattacaccaattcgctcagaagcgttcacacaccaatgagtccaaaaaacacaccaatgtaacataaagaaaatacaaactaataaacaccaacacaaaataaaagacccgcaattattgaatcttattcgtgaacctatactcgaagttgtgaaaatctgcactcgagtttacgacatgcaccatttattagtttgatgtattcatcgaacctttgtagttgagcccaacaccggagacaacacgttaccttaaaaagtatttgcatataagattttgatggtgatttatcgaagaccacatcatttttattaagtcatagagctcaacatattactgatgctcttacaagaataagtttcttagtttttttttatcaatacacacaagccaaatcccaaaaatatgagatataatatgtggagggtataatataaaagcaatatgtaccgctctccagagaaatttgggaaattagcaatccaagaataaatgatatattgtcttatttttcattaaaaaacaatatctcctactaccatttcaatccctcctaaccaaattatcaatgctaaatattcatggaatattggcttcaccgtaatcctgtactcataatacaaccatataagacacgtcccaaaaagatgaaggatacaaaatggacttattctagctatataagacatggcccaaagatatgaacgaggcataatagccttaattccaaggaggagcgtggtaggcttgtcgtgccttcaggccgacccggaacgactcgagttttattaggccgtgtctgggcagttggtgtagcccgtgggcgagcacgacatgacccggcgtgtcggtcgagccatgccagcccgactgatctcgggccatgcctggtcatgcttgggccaggccagttgacccatttagccatctatactaccaccccaccacacaagtatattttcaacaggtgtgttcgatataggtatcagctcaacccctggggttaatgtctgggccaaagaccctgatgctcagataagtttcttaaagatatttttgtaaaatatttctagaaatatctagaatgttaaatatccaaattagactatatataaaatgactgttcatacatttgagccattctgaacttaatagttttattatgaaccggctattggggttactctctagaccaaagagcctgacgctcagataagtgttcttaatatttttgtaaaatatttttaaaatatatagaatgtaaaaaatttagaatgtaaaatatccagattagactacagatagaaagactgttcatacatttgagccgctctgaaccgaacggttttattatgagccggtatagattagactataactataagaccgttgatacatttgagccgctaatgggcctgctggaggtccactctgtgtcaaaggccgacaacatcagctttaattgcaaaaggaaaaagtgcaccgaaggtccctcaacttgtcatcgggataaaaaacgttctcgaactgtaaaaccagatatacggggtcccataactatacaaaaccgttcactttaggtccctcagtgattttgaccccggttttatctgacgtggcggctgcgtcagcgtgggacccatgtgggccccacatgtcagggaaaccacgtcaccaccccctctctttttcacctcttctctcccttcctctctcctttttcctctgcgcgtggatgtcggcaacgtcttcgacgcggcggggagaagggcccgcgtggccggaggctgacggggaaggagcgcggcggagaggagggccgatgcgacgggcggcgccgccaatggctgtcgtcgcgtggggaggagcgcggcggtcgtctgccttccctcctcctccgcgtgccgtgcggcgccattgccgtggccgacgggacgtcgtcggggtgaggtggcgatgcacggtggtgcgggcggcacggcagagggaagggcctgcgtagagtggccgacgcacggtggcgcgggcagcgcgacgttccctccctctcgatcttggtcacgaaccgcgtcacgtcgccggcgtcgtcctggatgccgttggcgagcacctcccctgaggcacaaaatcaacaaacagatcaacaaattggggaaaatgtggagggtattgaaggtgaggtgagacgtacgagccatgggatggcgaagagcgcggttttgttgccggtgaggaggttacgggcgttgaggatgatatcgggaagctgcaggaggttacgggcaccaccgatgcccggagccgagttgaggcccatggcgttgagggtgagctcgcactgggcgagcgcctaagggtgggagatgatgtgggttaagaagtccctgcggatgcccgaaagtgcgaggaggcagtggtggacagggaaaggaggaggtccggcatggcgacgttgacgacgaggacgagggcctgtccgttcgcgggatgatgggctcgaagtggcgacgtcgatgacgagggcgagggcctccacgcatacctcctccacctcccacgccggccgcagccgcgcgctgccatcgccgacggcagcgacttgatggcggcggtgtcgagtcgaagatggccacagccgcgcgccgccattgccgaccgcacgaaggggacagggaggttggcgagctcgcgccgctacccgggagccgccgtcgccggccgcaccaccctccggccgcgcgcgtcgccacccgtgcgagagcagacaacgagaggaaggaaggaatgaaggaaaaaaagaaagagaagaggagggaaagagagtggtgctggcgtggcaccatgacatgtggggcccacgtgggtcccacggtgactcagccgccacgtggggcaaaaccggggttaaaactgccgagggatcttgtttgcactggttttgtaagttagaggatgcgttatatccggttttgcggttggggaacgattttgtaactcgataacaagttgagggaccttcggtgtactttttccattgcaaaaaggaaaaagtacaccgaaggtttctcaacttgtcattacaaaatcgtcccttaaccgcaaaaccagatatatgaccgtaaaatctaaacagagaggcctctccgtttaggcttaacgcgcgatgcccgtgccagccgtccattggcgcgcgggcgacgtggcgtgcatccggcgcgcgcgcttgtcccgaccgcgtgttgcttatccaaaccgagctgctccgctcgttccgaccgagaaagagagagagagagagagttgttttactatttaaaaattgtgggtggcgagagagagagagagaggcggaggcggcgacaatctccggcgaaatcgtcggcggaggcggtggagatgtcgctgcggcggcagtgtgggagggggaaggtgcggttgtttcgtcccgtcgcgccgacggcggaatcggcggtggaggcagcggaatctgcgtggaggcggcgttttttctctccacatcgtgcttgcagttgcggggggaagtgaaggctgcggcttaggtggttttctctccaccaaatctggcgcccgtgcggtaagttgcagcgtgcagagaggtggttgcggttttttttcagccggagagtggagtgatttttgtgtgtgatttttgtgctaggagaggtggagagattaggcagttttcactgtgcaaatttgtgtgccgggagaggtggagagattgtgcagttttcactgcgcatatgtgcgattttttgtgctccacaaacctctcggtttgttttctcccctataatagctctatcccctcatttcccctctctctctctctctccctcatccaggtgttagttcgtcctctccgtggagctcctctgcgtcctctcggcgagtgcaaagtttgtggtggtggatctccggcttgatttgaaggtatttcaatttttctctccatttggcattttgtacatggcttgggctgttggataattcatgattcaaattccatgttgtgtagcctcagtataataaaaagttggtgtacttctgctgccatttactaggatttttgtgtgccccttgatagctttaggtttccatgcttcatgtacaatgtaaatttgggtagctagataggtttcgagtcgtaacaagcaacatgtatcaaatcgattgacattgatttgcagagatcgaggtacattcagagaatagaggctgcaggtagcaggggggagagcatgcatgtcagcatgtatatgcatgcatgctactgatcagtggtgacaggcagatgagtgctgaccgatcgattgatcccttgattggctaatctatgtcgtcttggattggctaatccaatgtgattttcagttaccatgttgctaataatctgaagctctccctagtcattgatgttattaccttttttttttttgcaaatattgtggcatgtctagtaacattttcctctagtagcaaataatggtcgtctcaaaatgttccttaagtaacacatttgatttattgaattacatctagtctagttaaaacttactttttcccgtggcatgtgagtaacattttgagaacaatgaaattaagtttgcaatttttttgtacttcctactagttgttaagttacttccaaaatgtactgacttacttctaaacacataaatgttactttctactagttgtttagttgtaattggttagattttggtgaaactaatagtcaaaatgattttccaggaatagctaggaagaaatcccatgtaacgaaaggcgcgttggacaaactagagtcaagtcagaaaaaaaggagtgtatcgcaacgcaggaagaagagagatcatggtggagatgatgcaacgcaacctcctccaaaaaggagtagaacaaaggtattgaacaaccatctatctttctacccccgaacctgtgttttgccttttttatcactgcactacacttttttcgatgatgctgcactagacttttatttgtatttttctagaagtaacttaacatgttctagaagtaacttaatatgttgtgaaaagtaacttaacatgttctagaagtaacttacagtactttgaaatggtatttagatgttgaatatggacttggacatgtgtattttgattttgatgttgaatacagtgctacaccttattgaagttttattttttcttggaagcaacttgcatgttcctgtgtagaagtaatttgtacataactcttggtcatgatctagtatatgttgtacacaactcttggtcatgatctagtatatggccaatcttcttttaagcattttgcattatatgccaccggcaattgtgatgcttagcatttgggaaaactagcataatagctgccttcatagctaagtcttgataagttattatgtttggaacaactatacaaaggtttttgtcttttcattccttaggaacccacaacctaactgaatataaaaaaaaagtaagttagttactgtttggaagtaagtccatacagttgcaaagtaagtaggttcagctttttgttgctgaaagtaattcagtattgttatcaagtaattcagcacatattatcattctggaagtaagttagtatagtttggaagtaactcacacattactaggaagtaagttgacacacttgtagagtaactaggtacagttttgtgttgctgaaagtaaattagttctggttttgaagtaattcagcacatattgtgattctgaaagtaagttagtgcatttttggaagtaactcacacattaataggaagtaactttgcataaaacaaataccaagagaagtacctaaatagattgcccatatctgtttatcctaatgaatggtgcacaaggcatgttatacatgtttgtcatgtatgtgtagtcaaacgagatgtaatctttgtagtccttgtacgcttttcttgctgctccatcaacccggaatatgttctgcaccctgtcttccttatcaatttgtgggaaagtaattcagtacagtttggaagtaagttagtatagtttggaagtaagtcagtatagttttgaagttagtaacatgcaacaggacaataactttttagacagttacagttagatgcctctaagaagcaatttttctcattttttgacaccagtggctatacttatggtttttttttcacatattgtttttgatgcagtactagaagagaaagagaggcaactaggaggaatgcatcatgttgtgtacacataccaggtataaaatggatacagaagtttttcactgaaattacagttaaaattgcccaacaatgtaattaatggatacaaaagttgtaactatgaaattttaattcaagattattttggaagcaacttgcatgttcctagaaagtaacttattgaagtgttagaactaagttttctattaagtttgctctgagaggcaactggggggatgcatcatgctgtgtaactagggaatgtaaattcaagtttttctggaagtaactttcatgttcccaggaagtaacttattgagttgatagaagtaacgttctgttcaaatttctttgagaggcaactaggggggaatgtatcatgtttctaggaagtaacttatcgaagtgttagaagtaactttctgttaaaaatgcactgagactttatgttaaaattgctataagatttcaacaccggtactcatgcctatgtaactacgaaatgtaaattcaagtttatttggaagtaacttgcatgtttctaggaagtaactttatgttaaaattactctgagatttttaaacaacagcactcatgcctatgtaactaggaaatgtaaattcaagtttattggaaagtaacttgcatatctaggaagtaacttatcgaagtgttagaagtaacccttttgaaattgcactgagaattgaacaccagtactaatgccttttttcctctattttttttcagcagcacttgaaaagaaatttattcgatatacgaaggaagtcagaaagggagacagattcatagtattcgtatctcggggaagacaggattcatagaattcatttctcacagaagacaaaaagaacctaaaaattctctaggttagtttgtatgttttttgtcgatagatctgaaaagacagtattggctatgtagttacctgtgatctgctcttcttttctctctcttcgtgcttcctcctcctcctcttcgtgcttcctcgttttctttttctgatttttgtgccgcggcggttgagttctggattgacactcttcgttcttctctctcgttttttttctgatttttgtgcagccacagctacgttcgggatcgacgctggtccggatttgttagattggagggggggtgaggcgcgtagcgcgcttcctttaggtgggcccacgctagctgtcccacgccaagcacggtgtgcgtggcacgacgcgcgcgcggctttcctttttttgtcagaggcgcgcgcgctaaaaaggaaaccgtgttttccttttttttttgtcaggagcgtcgcgcgttagcgctatcgcgatagcgatctcgttgtagtctcgtccatatatgacatttcttaacttagaaaacagttcactttagatccctctatgattttaaccccgattttatctgacgtgccggttgagccagcgtgagaccttacgtgggccccacatatcaagtcaccaccctctctctttttcccctcttctctcccttcctttctcctttttcttctgggcgtggatggcggcagcgtcttcgacacggcagggaggagggccggcgtggccagcggctgacagggaaggagcgcggcggagaggacgaccgatgcgacgggcgccgccgccaatggctgccgttgcacggggaggagcgcgtcggttgtttgccttccctcctactccgcgtgccgtgcggcgccattgccgtggccacgcgtcatcgtcggggtgaggtggcaacgcccggtggtgcaggcggtgcggcggaggggagggccagcgagggaggagcgccgcggagaggagggccgagggctgatgcagcggaagtggcatcaccgacgcggcggggaagagggttggcacggccgacggggaaggagtggtggagaggagatcgaccggtcggttccccacctggcgaacgctagcacgagtacgaggagcaggagcatgcacaggcgatgcacgtgtagaggagcaggtcggtcatgttcggtcatgttcgtgctggtgcaggcactggtctaccacatcctccgtagctcgtcgagcgtcttctccaaggacagcaagctcggcggggcggcgacgcggcggcggagacacgggagaaggggagggcggcggcagggcgaggtggcgtcgacaggcgagcgcggtggcggaggccggagaggcggcgacggtggcaggcgagcacggctgcggatggggagcagcggcgccgacgacttcgcgccgctcagcctcatcgtcgtcggcggctccaggcgcgggcggaggactcctctgataggcgatggcgaccgcgatcaccgcgccgccggcttctcgtcgctcgtccgctgggccgcggcgccgcactcgcgccggccgcacgcatgtcgtcgtcctctgtgactgtgagtagtagtaataccacccacagcgtcacggagctctccatttcttcttcttatccactgtctatgcgacgggcagcggccggacggaccgaggtggcgagcatcgacgacgacgaggcgtgcgagctggtgagcggcgcggaccttgtcatcggtggcgacgtcgacaacgagggcgaaggcgtccgcgcgtacctcctccgtctcccccgccggctgcagccgcgcgccgccatcgccgaccgcacgagggggatgaggacagttacaaatgcctcagatttgtgatggattaattgtaagaagctgtgcactttattgaaaaaagctcaagaaccaacctagctcgatccaaaataaataaataatactaataactcaacctaaaagttaatttcctctactaattagcaaactacgagctgcaaactatccatcagaaacggcagctggaactgccaacgccggtggagagttcatcccagccgctgtaatcgctcgccgtcagccgatgcctgggcgtggtcgcttgacctgttgaagaggaaaaattatgattaaccacgattcacgcgccaagaagaggatgaacagggagaggtgttgcacaccgtcgtcgtcgtctccgcacagttggatgtgcgtggcgttgcacgtcgggcaggcgaggttgacgcgcagccaccgccggacgcaccgccggtggaagtggtggccgcactccagcgtctccggcagctccccacctcctcgcacgatgtcgtaggcggagccgcacatgccgcagcagaggtcgccgccatccctggcggggacggcgacttgcgcacgacgccgcgtgtagtcgccttggcctccgaccgccgcgcctgcttcctgagcgcggacgaggggcgtcgccgcggcggccggcggacgcagaggaggactcgccgccgccttcagcttcctccgatacagccagtacacgagcggggccagcagcccgacaaccacgacaacggcgcagacggtgccggcgatggcgccggcgctgatcggagctcctccggcagttccgtcagccgcgtcgctcgggaccgcacggtggaagccgcggatatcgctcatctcgaatgcacaggagaacgcacacacagatacgcagatacccatgttatagccgcgacggaagaccgccgttgaggcgtgcacaattgcggcaatgaccgttggaaggaggcgggagtcgccattgctgctgctgctgcgcacaatgttagaataagtgtcgaatatactagtcctatttgattacagttggacttgaagttgtaataggtgttaggggtggagttagagtcggagtctgtaacccggcaactctcttaaatagagagggggacaccacaatgtaaccatgacgactacaatgtagcatagacacgcagggagatgatggcggcgtggccatggactcgtagcggctaggagctatattggttggggaggagcgcccataatcagagccccggggatataggcttcggctgaacctcgttaacaaatatcgtatgttcctgtgtcgtcatctggcatgtcttgggtgatcaatgactgaagcgatcaggagggttagtcgtctttccgctatatcgactaacttttataacaagtggtatcagagcagaaggtttcagcattggatcaagaagacatgtggagaaggaaacacgaggtgggatcgcgcatcgataggagatcgtcagtcgtggcgatgagatcaatggcgacaacgaggacgttgtggaggcgacgacctcactcgcgatcagaccgacgatggtggagcgtgaccggaagacgaggccgggcgtggccgaaggcgttcagagagattagaggggtagcaccatggacggcgcgtccgacgcacgcggcgaacgcggatccgcggcggcagggaggccattgacggaagggcaaagctggcgagcgtggcgcggcgcggcggacgtgcagggccgatgacgacggggtcgtggacggtgaacatgagggctgcgactgctgtgcgtgcaggggcacggacgtcgtgtatggaggcatgacttgtgcacacctacacatgcataggtgtggtttccaagagcagaaccaagacggatacggtgcggagacgtcaacttaagcagggagaggtggcagtgggctccatcgtggaggagtagctacggactctagcgaagaagtttctctaatccgagcggtggcagtttcggtttcggtgtctgatgcaggcggcggcgacgactcagaggaggcgtaggctgcggcttgtagcaggaggaagcggagaccgagatcaagtcggggtttggtttttggctcgtaggaaggcaggcatgtgtaagaagtgcatggaccggtgttaacctccacaaagtcaggcggtggaccaagaaaaaaggagagagtagtagtcttttgctggtcacgttaattatgatagggttacatgtgtatgcaagcatatgttggctgccatagtacgtgcatgcattatactactgtgcaacattggtttacgtatggcagggagcccggaagaccaataagctagctgtgtggtggtgctaattaacgtgggtcatcaagctgcgcgtggagatcaaagcgtgcaaggctaccgggagtctaggacgcattggttgacgtaattaaggtggtggtgattcagtagagagatgcacaggcgcagaggcaattggtgtggtgctgccctaagacggaacttgtatggtctacggtgacttaggagatggtacatcatgtggcattcggtccagagaggatcgaggctggttaaactgggccggcagggtggttagaccgacggactggttagactgcggagcttggagggttagaccgggttcaacggaccggtggttcgttgcagaaacttgtgagcggattcagaagaagggaaaaaaggttatacggtctagatagtttgcaagtgacaatggcgaatagactggcggcgacaggtcggtcaggtcgcatatggaattatctggcagacatgatatatatgggactcgacgaggagttgagatatatggagttagaccagaactgaagggaaaaaaaagattctgggcaacatcgggtcaaatatcgttgatggggtcgacgatactgtttggcagtacatgatatatccaagatatgcaggttggcatgatggggatatatgaaatctgcatcactgacgaggaaaagcaagtgctatggtgttaatttcttcaagtgattcaaggcaacggtgaattttctcaaagtatcataggttcagtctacggatgcgggaaagcgaggatgttggatttattagcttggttcataagacaacaaggaagaaatggttctcttcaagtctggtgagtttgatttatctatttggtgatgacgcatgttatctggccatggattagatcaagtcaaatttaagatggaagatggaggtgaacatggtcttcggggagtctatgatgtgacagctaggaagaaatctaatttcgcttggcaagacgactgagatgataggtgagaaggtggagcactgttgcaggtagattcaagaggaagaaattacagggatagcggagtctcttcaaggcggcgggtctagcggaggctcgtcaggcggctcgtggtgaagctgcaaaaggaaacaacccaagtctggaggacagatggatcggcatggtgattctactacttctgggtggcgtatattcgccaaggtgaagtttgttagaatatgtgtcgaatatactagtcctatttggttacagttggacttggagttgtaataggtgttagtgggtggagttagagtcggattctgtaacccggcaactctcttaaatagagagggggacaccacaatgtaaccatgacgactacaatgtagcatagacacgcagggagatgatggcggcgtggccatggactcgtagcggctaggagctatattggttggggaggagcgcccataatcagagccccggggatgtaggcttcggctgaacctcgttaacaaatatcgtgtgttcctgtgtcgtcatctgacatgtcttggatgatcaatgactgaagcgatcgagagggttagtcgtctttccgctatatcgactaacttttataactaacaacaattacggcaagaagccgttgtgagggccgagtctgcgggccgcgccgcccctggggggccatcttccgccgatgaggcgatgagcccttcgccgcgcccgcgtggcgtcacgttcgcgcgtcgacgccactggacgccggcagcttttctgccctcgcgccgcttctcaatttgtcgcgcctccgtcctccttgagccttctagcacgttcccaaagaagctccctgctcgccggccgctttatctcgtctctcgccgtagcgccctcgccgccaccgccgcgtagcttcgtcgcgcggctgttcccggtgaccattggtgtccgtgcccacgcggcgcatcgcgagtgcgtaccggttcggccaaacccgaacttccctcgaccggcgagattagccgccgtcgttcccctcccggaaaatccgctccgttggttcgattcactgttacctcctctaggcgccgccgcgccggtggtcatcttctctctccgtctcgcactcgttcgccggaatgctccgctcgccttcagccgtcgatctctgttgcgaagcctacatcgcattcacgtggacgacgcttcggcttgttcggtcccgcaggcgaccagtcaaacgacgcctctcccccgcgaaaaacctatcgcgcgatcgatcgccctagaggatttcctcccatgcagtttcctttttttttacaccactttacttttctattttagtaagtttatacatctaaagtttatatatatctaaattttatacatctaatgtttatacatataaagtttatagacccaaagtttatacgtcaaaagtttatatactcgattcaaatttaaatttgaattcaaatatttttatatatagtatttctgtacatataagtttatacgtgtgaagtttacagtataaagtctatacataagtatagagtctatccacataaataagagtattagatttttttttcctatttttaattttttttctaacttgtgtttttttatttctaaaaatttatggtgtagtaggaagagaagaagggaagagaaacgtgttaggggagggatgtgggctttcccgatcacgcgccctcggcgtaggcgatcgatcgtgcattaggaagacccctccctcggccctcgtgctcccggccatttgggccgttttgtcgcctctatctactttaagtcgactttgtatgacatccctaattccaaataccagaaatcttcacccctaaaatgtataaaaccgtgcaatttaggtctcatggcagtatggatctataattttactgatgtggcaccctagtcaacaaaataaaaaataaaaaaaatatgtcacccacatgtagcatcttttctttctcctctcctctttctcttctcttctcttctcttttctttcttctcttctcttctcttcttcagtgagctgggaagctagggcggcgcggcagaggcggccggcgagcctggaataggggaggtggccagtgagccctactcaagcccatggagagccaccaatgccgtctccggcgtgctcatggagatcctggccacacgggtgatcagcgccgtcgtcatgctccgcgagttcgccgcatcggcctcgcccgcacttattaatatgtgaccccagtggtacactgttgaattgatctgccgtgttgcttgtcatgtatccatcgagcgatgcctagtgctctctactagtagtattatattactagtattattaggagtaaattagtaatttactaatacaataattcaagagttattttgtcatttatattttttccagctaaatcgatatatgatcattcatttgcattgacattgatcatattccataaaaaagccaaaaaaaaaagaaggaaaaatgtttagtcactgctaaatgaaaattataccctcccccactttttttgttgacaataatgaatctccacatttttactactgctaactggtagtataaataaacctgaacccttcgatcaaataagatcaatgatttatattgttttctattacccgcagaaagcatcgtagtgggctcatatcgataatggtgtccatggtatcatatgcacgatcgtcatcaagtcattttgtgtttcataaagcaatgctcttattatagtttttaggataactttttctttttttaccaattcgtcagaacatctggtagttaaattgattagagaaatcgtacaagactaaaaagaacgagaagctgagtgccaataagccattacactgttttcctcctttttttggtagctcctgaaaacaatcaattgcagcacttattcacaggatgttgtataaattacatctctcgggtactatatatatcttccaatactagttgatgagcgcgattctgctcaggcagagctctccaatagttgagaatctgaaaatggaaagcaacagagtgcagactctggaagattgcgagacctttgtaaaacaggctgcccctcttctgatgctactctcttgcatgtattaacctctggtttatggaaccaacagcaaattcttcatcctcctgggtacaaatctcacttgagtcactctcacctgcttcttggcagagctggtcatccgatgccatcagaatgttccttcgagcacgatctctgtcccgaggatacgtgcagtacaggaaggtgtatgtcaggcaacagatggccatgggcacggcgatctccgtgtacactgccttggccaatgcagccgcattttctctgtccgtttcgacgcttgcgtcagaggagaccggcttgtagccgaacacttgctctgctagaacaccgacgatcggtggcgcgaatgaagcgaacaccgcttcaaagcatttgtcgagagcgtagaccgttgttctcgccttctccggtacaatctccgcgaagattgggctgcattgcaaaatgtaaattgtaagacatatcagcattgcattggagattcagatatgaaattgtttcagtgtcgagcatggtacttgtttgtggatgacgcgttccaggagatggcgaaccccatgatgaagaacacggcggcgtgcgcgacgccggtggacgggtcgttcggcagcgcgaggagcaggacggcggcgagcgggagcgccgacgccgagctgatctgcgccagcgcgatccttccggtgttcgggaaccgcctggagacggggtccccgacgaggccgccgaagagcgcgccgagcgcggtggcgaggaggtagagccccgtgatgacgctggtctcccagtgcgtgaagccgacgagctcgagccacatggcggagaagttgagcgccgaccagggtatcgacccggcgatcccctgcgcgacgatgatctggaacgtgggcacgccgatgacgccgcgggcgtcgcggagcagctcccgggcctcctcggcggcggaggcggcggtcttggacttggcgcgcgggtcggcggcgaagcaccacatgaggatgcccagcacggcgctgacgagggcgacggcgtggaacgccaggcgccagccggcgacgccgaggaaggtgaccggcgcgagcagcacgccgaaggatccccccatgatggagccgaggttgcaggtcatctgcagccacccgaacgcggcgccgcgggtgtggtcgtccgtgtagtcggcgaccagcgagctgatcgccgggagcaccagcgccagcccgacgccgttgagcccccgcgagatcgccatctgcgcgcgccacggaattttttcagttcatccagttccctctctcccttacaggtgggacccacagcgtcagtggaagaaaaaactgaggctgacagtctcatctttttacttaaacctatctttgtaagtcaaaatttaattttttaatttctaatttaaagttgactttatcgtattttatttttcggcctttatttcttatcgctaagaacacttacataaaagttttatttgtaaattatttttcgtttgtaaatatatgtccatagtatgccaaacgatggagctttcttcctgtttgtctggtttttcttatcgaaatggagttttttcgaagataaaaattgggatggaaatggaatattcggataatcaaattatataggagtaggtgcgtgtaaaacggggaaggtggagtgggtcccgcagtcagcgagaggggaggaggtgacctggaggaaggagccggagacggcgacgaggagcgtggcggcggcccagaggaaggcgccgacggcgatgacgcgggcgcggtcgtggcgcgcggaggcgtaggcggcgagcgggtacgacgccgcctggacgatcgcgcggcacagggtgagcgagcccagcgccgtcggcgacacccccagctccgccccgacctcccggtacaccgccgggagcagcacctcgtcggccttctccagcaccgacgccaggttcaccagaaccagcgtccaccgccgccgcgcctccgcctcccttcccatcgccgtcgccggtagctcctctcctctcctctccttctcgctttgcttaaatgtggggagcagaagcggaacggagtcgctggagcatgcgtgtcgttgtgaatttggggtttggatggggatgttgacctgggcgagcaagagcaggagcagccgagctggagctgacagcgagatccgccgcgagtgttggggattttttttcaccacgagagcttttgctgctttccgtcttaagatggttcgttggcaactgggactgcatctctgattctgaatggactggagttatgtcaccttgttttcgtataaaccgctaaaaaaagaggagattgaggagtctacttcaatgcatagcaaaattagcgattgccgcttttggggatttgttaggagtgtagcgtggctcggccccttcccgttgtttggagtcttgttttagccgccgtagttttataagctttagctttttattttaccttttctcttttcccctagcatcataagctggtctggctgattgtgttgtgtagatataacatttttcttctaatatattgacgtgtaattcttttacacgttcgaaaaaaaaacatggcaaagttagcacctgattaggatgtgctcgaactggatcactggaacacaaatctagattacttagagatggcaccaatcgagccttttggcaaaatcaaccatggcatttgatgtccgctctctatctcgccatgtaacgggacaggcacagcccatgtggaaagcgtggttgagggttaagttacttgacagagacatcaaacattgtggcttgcgaggcagcaggaagagaaaacagttgagaaattaaaaatcggcttaagcatcagcggcacaaccacatttccccttcctacatggaaattaaaatttgcagctggaattaaatggagggagagagcaagttgcccaggtgctgagcaatgtttaacatgctttggcttctattcatgtcaatcagggcgaaacataaagcaccatgtcaaccctgtcctagtaaaagggatttgtatgtgtgtgaaactaaacacacacatcaattggtggcaaaacagaaaagtacttcaaatttaaaagaataaaaatgaaaggcgcccaccgtggggctcgaacccacgaccacaaggttaagagccttgcgctctaccgactgagctagacgggccaggatggtaaatgttacattttcattgttgtatcctttacgttcattcctaccggcacaaatgttaacactagatagatatttaaccattttcacttttatatgttacgtttaacaagatatcactaaacctatgtattataaacacataaaatccatataacataaatatgtaatactaagttcgttgcattttaaatacagtcatgggtttttatgtcaaacgtttgacagtccatcttatttacaaattttataaaaaaaaataaaaataattagtcatatataaagtaatattcatgttttattatctaacaacaataaaaaaaattaattatattttttttaaaaaaaacggatgatcaacgttagatatagactgtaaaactatggtctgttgacaacttgacataggtaagtgaactgttaacaacgttcagtccaaactccaaatgaagacaagggtcgcgactctccaacatcctctctcctggtgaagtggtaattgccccggcacacgccgcttctccggttctcttcccccactccatactgctgctcttccccggctgcgttggggtttcaggttgccctcctcctcctctgcattctcgttctcatccctcccatttgattctaggcgatttcttttttcgaatttatatgtactattttttgggatttctcgggtatattctatagattttcatttttttaatcttctagagtttgaaatagagccttctccttccgatccgccattatccaaacaaacaaacggttggaggggaatatgcagccaatccccatggggtttatttgtttttcccatgtgaaagttcccccccaaaagaaaaaaaaaatccccatttgcctcggtgtgtgctgtggcattgcccgtgcacgcgaggtgttcgacgtattgccctcgtgcggaccgcaccgtttccttgtggggtttgtttggatcctgatgcgttcgttccccgtgatgatgtagcgctaacgctcgcgtgatgtctcggtgtctttcttgctgtatgcaaaggtttgacctcggcgggcgcgccatggcggaggacgaggcaacggcggcgcgcgccaggcagcagaggcagccgccgtcgtgggcggacatcccgcgggacctggccgtccaggtgctccgcttcctcccggcccaagtggacagagcctgcttcgccgccgtgtgtccgcagtggcgcggcgccgcgcggaacgccctcctgccggcgcccctgccgctgctcgcgctcccggacggcgccttctactgcctcccctacggcaagcccttccgtttccctcgtgccggctgcgccggctacaagaccgccgcctgcggccgctggctcgtcttcccgcacgacgacggctgcttcttggtcgaccccttcgccggcgccaccgtgacgctccccgccctgtcccgtgtccggctccgacccccaaatgcggttgctagttatgtaaatgttgggatcgcagggcgtaatgcacatgtcagcatgttctaccctcacgctacttggatgcatatcaagacttcggacaagatgcccataaacaagctactcctgtgctcgcagaacctcgtcgccgcgttcatcggcagctcactcgccaatgctggacgcaacagccagattctagtgtgccagccaggggcgtcctcatggtcggtacgagcttatgacaagtgcaagctgtttgaagacatggcattctaccgggggaagctgtacgccctcgctcatgatgagaacctccttgtcgtcaacatcagccaggatccaaacaccggcgatccacagatctcccaaattgggcaggtcatcaagggcgatcccacctggtcttcagttctgattacggatgacgacgacacaagcacaacggacaaaaagaagctctacctagttgaatcatgtggtgtattgctgatggtacgcaggaaggtttgctgcagagtggtaggcaagaccgtcgtgcctggacagaacgagtttgaggtgttcaaggctgatttggagaactcacggtgggtgaatgtgacaacccttggggttgatcagatggttttccttggacggccatgctctaaggcagtgtccgcgtctcagtacgggatgccaaatgaccaaatcttcttccttgatgatgttatggagaataacaaggagtattcctatgaggaggagaccacttctgtcaatgtctacgacatgaggagcgccgaggtctcttcccctctgccgatggcctggaagcatgagatgatttctgcaacatggctgttcccttgggattgaagcgaaggtgtgttgccatgcaatctcgcagtgattattagttgtcctggaccattgtaggttgattgatttactgatgttaacttcatccgaattcgtcaggcctcagccttagtgtggtgactaagttcttttggggaaacctcaattatctgactgtagtttggtccatgtctaagtattttggagttgatgacacaatgctaatgttgtgaacttataatgaatcttttgtcaccagctgggcttatttgaattgtgtatgtttttatcagttcttcattgtgcaggtcatatttgaatagtgggccgttcaatcatggttaccacttatcagtagtaaccattgatgttctccgtatcacgttacaggatgcttttatttttgagctatctgttgctactgagaaagggtccctgccatcttaccgtaccctggtttgttcttgcctcctggttcatccctgaggccatgttcgtgaacattgcttgcttctgctggcaatttctcatggatatccttgtcgattttgaccgaaacccatgctgattatcgcattctggcaccaaatcagtcgctggagcaaggcaccaaactgatggcaggtttctgttttgtgggttgaattggaagtaaatcttgaagggaaagcttgtttcccaatgttttttttgccgcagtaactactgtttcccagtgtatacaagacataatgttttcttaaattaagtaggttgtctcatactctcatataaggatttcttaaattaagtaggttttctcttgggggttcagtgagctgtcatgatgccatggtgttaaaggacagcctgcattgtgtgtgtgtgtgtgtgtgtttgggggttacagcaacacattcgtatatatgctgtgacagatttgttaaaggaaaattataaagcagtgttcttccaaatcatgccaatcactaaggtcccaaacatataatcaattaatcaacattcttacctgtacatgttagctgttgaagaaaactattcaccttcagaaaatcagtacttccagagattcctgtaaaaaatactactggtattactgtaggttcataccgacctggagatctgataaatcacattgtttgtctgtagtctgtttagttcatttggcagctgcactttgttcagttcgtagtgcattagtgttttgtcaccgtagtcagcatccaagccttcctcctcatactcggcccttttcttctctaacaaaaactggataaacttttggataaaagtgacacacttttcaaaccactaaacggtgtgtttcatgcgaaaactttctatatgaaagttgttctaaaatataagattaatccatacttcaagtttgtaataatcaaaactcaattaatcacacattgttaccaccccgttttgcgtgaaacacttaatctttatcttcatcttcattttcaggagattcaaacactattgtatcaatcaccgaaacatcttccccgtgttagtaacattcttatcttactaaaccatccatgttaatcagggccatgaaccatgaatgtcaactgtcaagtactcaagtcctcaaactcaatttatagaaacaaaaactattagaaaagagagagagaacgacgccaatcagggctgtgaactatgaatgtcatgtactcaagtcctcaaactcaatttatttatagacaagaaaaatggtcgacgcgtctcctcctcctcctctcgcccccttgccgggtgccgctccggcccaggtgcccacccctcctccgccgtccagcccggccccggtgtcctcccccgctagcacaggttccttcctcggctctcctccctttccggagagagtcagcctcggctccctctccggcgactgctcggatggggattcgccagatctgcttcgccctcaattcctcccggcagatctggtcagtgaggcagcggatgcgcgtccccccgtggtgccagccaagatccagcaagttcccccctccacaggttcttcaggttttcaggcagccccgattttgctgcgcagggtgggtgaaggatttactcctcctgtgccctccggcttgaaggtaaagggagttactcctcagggtagcttcgttcaagcagcaagaggaatgacttcgccctcgcagcttcccaaagcaatcccggtaaatcttcagtctgagactgccacccgtcttcaagtttggcagacagtgaagccaaagcattggtggaggaagagacctgcccaacggccttcggcattcatgcgccttcaatccgctgctcctcctcagcttccctttgcattcactgatcgccaccaacctttcccctcgtagcccaagcaccttcaggaccaccgagttgctttaaagagcctcttcaacctttgaagagcggggtgtcactgcttccgttgtctagctcaggaccaccgagttgcttcctgtagagacccccttaggtgcattctctgtggcggttctggccacaaagcccgctggtgcccgggagacagacaatggcataggggggtccagcctcctcgccccactcctgctcctccgctagccagtcggcttgttttccctccgctcccggcaatgacgcgcccaggggaaccagccaacaggccggacagcatccagcgcgtcctgcccaggacatcggccatccgtgaggacgaaagtttcctttctcactccgcagcggtggtacaggttacaggcaatctcccagtgacgaacatgcgacagatcaacaggttgctggcgtccaggttttaggttcctcatgaggacctcaatgttgtcgtcttcccaaaaggaggctacctggtcacctgcacctctcggtcgctcagggacatgatggttgcggcaagcccttttgctgtggaggacattgacctctcggtgctcccgtggtcgagacgcgtccaggcagagctggtcaaatggcgcttcagcattcgtgtctgctttgaaggcatccccagccacgctaggtcggcagagacagttacaggtctgcttgatgaaggttgcttgatctaggaccttgatgagccaagaacggagaacgagacagcttgcctctgcgcctggctgtgggtggacgatccagactccatcccaaggaggtgcacttcgagcttgaagaaccgctgtccccacgctccccagactcacgctgggacctggacggagaggctcggcagaggacttcccctcccaagctgctggcctacccggtgctcgtgcatctcgatcaggtgctcaacttcaacccaccgccaactgagccaacttggatgnnnnnnnnnnnnnnnnnnnncagcggaatcatctcccctgtcttgatgacagaagaaatcccaaagcgtcatgattttatctggagcctcagcgtcaaggatggcactcttgcccctcagcctccggcttcccctagcccgggcccaggcagagatcgctcgcgctcacgttcccgctctccgccagcgagggagcgccgccgccccttgggttgggatgtccctcctgctcgcagctcagctttccccaggcgctcctcttccaggtcttcgaagaacataggtgggtcctacgggggtggtcaccgcagggcagcttgctctccggtgagggccgctcgctcaaggtctccgtgtggaaggtcatcccccccgccatcgctgtcggttcctgcagcgatgaaggatggcggctcccagctgtctcgccccccttctacacccccataggacccgatcacccaggccacccctcttcaggccaaccagtacgtgatggaggctgaccctatgctggaggagctggtagctgcccaggcgtcccagtccgccgtgctgatgtaggtctctcgggctgcccaatctcaaccttcccagttgcctctgatgatctccccagacaagcttgcagatttcctgtcccaggccttcgcagtggtgcagcctcctctgctcaaaactcccacgcgccaggtctccaagggaaagctcttgaagaagagcccgactcgtcttagccaggcgggccgcaagagtgctcggttggccaagaaggcagccgctcgttcctctccggccaagcaaggtgacctcgctcatgagctgctgatgaagaaggctggcctgctccctgaggacggcaagaagactgaggatgcaatggccaaatacgtcaagcttttcaagcagcctctctctcaggaggtcatggatgccttctctgctctggtggctggctgcgccattggtgacagcaagaagaagacttagttggcttcgtcgcttctcgatgtgttgttcccttttgctgtcatgagtctctgtagtagtgaaatgggttgtttgcttctcctgaggggtttagagtagtttagtttcttttggagctcctgtagctctagttggctttgttcttctatgctgtgcctcatgctccccctgtacctagttagacctcgatctagtaaggatggtccttcagtcatgtatccaggtcatgtctctacagaaaatgaagtgctcagttgcctctaccggccaagctctacctcatctcttcctgcgactgtgttttgcttctctactatgcttcaagcctcaccattcctacaggttgtgctcctccatccgcttgggatactgcaggtgcccatcccgttaaatgtctacaaatgattgtgccattttgagttggaatgttagaggcttaaactccacagcccatcagcaggttgtcagaaaccttgtcatggacataaactgctcctgtgtatgccttcaagaaactaaattagagttctttgatcaagcaatagtcaacagggttctaggtccttcgtttgcagataatttctgtttcccgccggctacaggtacaagaggaggtatcctgctggcagtgtctgactcaaaatactcgattgaaagtgtgcaaacaggtgtttactcgatcatggcaaatttaaaagaaaaagaagatggctcggcttggagcataacaggggtgtatggaccacaaccatacaatgaaaaaagagattttctggaggaactaaagcaaacaaagaacacagtaaatcaaaagtggatgatcttaggtgatttcaacctcattgtccaggactccgacaaaaataacagcaatcttaacaggggcatgatgcagtcctttagggcggctttaaacacgttggaagttattgaaataaaactaaatggccgtcgctacacctggtccagcgaaacagaaataccaaccttaacaaaaattgacagggtgttttgctcacatgagtgggaagaaaggttcccaaattgcttgctttcagctatctctacgatggtctcagatcattgtcctctgctgctaactgcaaacccttcggggcctaaatgcaaccttctcaggtttgaaaaatactggataaggctcccaggattcctagaaactgtgtagtctgcctggtcaaaacggtccactcgcctgatgccctgaaaagaattcatatcaagttagcccgaacggcgaaagcactaagaaactggagcagatgcagagttaggagtctaaagttgagaatggagatagcttctgagctgatccttagactagacttagcacaggaagagcggaacctctcagctcaggagatccttttcagaagatcccttaagcagaagctcttaggtctagcagccctagacagggtgcgacttcgtcaaagatccagacaagtatggatcaaagcaagtgacgcaaacactcggttctttcaaatcaaagctagcgcgagaagaaggaaaaacttcatacaacacctcctgacagactccgggatggttcactctcatgaagaaaaaggacaagaacttttcaatgtttacaagcagcactccgctgtgatcaatccctccttacaggaacacaaccttgacctcgctgatctagaagcacctttctcagttgaagaaatcaaaagtgcaatttttcaatcccgttcagacaactccccgggtctagatggcttcacaggtgctttttttaaaaaaatattgggacatcattcatgaagatatcacacaggcaataaatcaggtggcaaatcactcctctcaaagtctatggcttttgattttagcctacattgctttgcttccaaaaaaaagagaatgctcttcgtgtcagtgaattcagactcataagcctcatccatgcatttgggaaactcttttcaaagctccttgcaaacaaattagctccgaaacttcaacagcttgtgtcccacaatcaaagcgctttcataaaaggaagaaacatacaggacaacttcctcttcgtcaacaacttggtcaaagagctccattcttccaagaccccggcaattctcctcaaattagacattgccaaagccttcgactcagtcagctggccttaccttcttgacaggcttaggacgctggggttcggtagcagatggctaggttggatctgctccattcttggttcttcttcttctaaggtcctcctaaatggaagagcaggtagcagtttcatgcatggcaagggcctacggcagggtgacccgttatctccgattctcttcattctagccatagacccgcttcaaaaccttcttgtggctgcacaggatgaaggcttgctgcagccccttcataggagaactgcccgctttaacatggctctatatgcaaatgatgctgtcattttcaccaggctggtcaaggatgagatacaggcagtgcaggctatccttcttcactttggacgagcaacgggaatgatcactaacctaacaaaaagtgaggtttacgccatcagatgcaaagatctagacctccaggatattctttcccccttcccagcccagttgaaagaattcccgtgctcctaccttggcctacctctgcacatcagaaagcttcggaggcttgatgttcaacccctaattgacagatttgctgctcgccttcctacctggaaaggaaaacttctcaacaaaacaggtagagcggttctaatcaagtctaccctctcagctttgccaacctatcacctcacggtgttccccctcaagaaatgggtagagaaaaagatagacaagattcgcagggctttcttatggacaggttctgagcaggctaatggaggtcactgtctagtcaactggaagagggtttgcagatcaaaagatttaattagggggactcgacattactaatttggaactttttggtcgtgcactcagactgaggtggttatggtatgattggacagctcaggacaaactgtggcagggctcaaaccttccctgtgatgaaacagataagcaactcttcagggcctccaccatcatctccttaggaaatggtaacaaagccaaattctggcatgaacgatggctggaaggtaaagctcctaaagatattgccccatccttatttcagatcgcatccaggaaaaacaggacggttgcccaggaacttggcgataatcgctggcttcgtcagatgcggagaatgaacagcacggtccaagtcagggagttcatcattctttggcactctctgcagcaaattcatttgcaggatggcattgaggattccatatcatggagatggaccccaaatggatgctattcggctagctcggcttacaggatccagtttctaggaagtatacaggacaacagatcaactttcgtttggaaggccaaaacggaaaataaatgcaaattctttggctggctgatgattcacagaaaaatcctcactgctgataaacttcaactaaggggctgggataacagtgagatctgtcccctctgcggcattgaaccagaaacggctaatcacctactcatggattgtgccttcgcaagacaagtttggagctccatgtggaacaagcttggcctacacatgccttcaccctctctttttccggggcgtttgctagattggtgggaggcttgcaggaaggagctagttaaggaacaaagacgtaattttgatggccttttcatctacactgcctggggcatttggctgcaaagaaatggaaggattttcaatgacatttacaactcggtagctcaggtcgttaatttcatcattgctttgtgcaaagagtttgatgaagcccttagttcctagatgagttttctacgccttctacttcttgttgcagttcactttctcaagattggggtttcccatctgtttttaatctcgcaagctgtacgcttgccctcagcttgcatggctggcttgtaaaacgacctccttttctgctcctccttttatgaaattggcagagctcctgccgtcttcccctcaaaaaaaatttatttatagacaaaaaaaacgtattagaaaacagagaaaaaacaacgcccaccgtggggctcgaacccacgaccacaaggttaagagccttgcgctctaccgactgagctagacgggcctacacaactgagcaactataaattctaaccagtaatatttctgaatcttacaaaactgctgtatgattccatcaaattataggctcaaacagttaaaacagtagacaatagaactggtgaccaaagatcacatgccatttcaacctagagtctcccttctcctggcccacaaaaatcttgctaatcactaaggtccgtcacataaaaccaattaaccaactaaccaacattatttcctatatacgttagctattgaggaagctatcatctttaaagaatttgtgctgtcagagatttctgtagataaaaaaaaactgctggtatgattatcctgtagagtatgaacacagacctgaagatctgctaaatcacattgtcgtttgcctgtattctcacacttctcacgtctaggtcatttgtcagccgcgctttgttcaattcggaactgcattaatggtttctcatcatcgtcagcatccaccccttcctccccatactcaatattgatcaccgacacaccttccccattgtaataatcactggtccgatgagatctgtccggttcaatccgctgcagctctgaagttatcagcgaatccattcttgccctctccctgtctcgaggatatgtttggtacaacagggagtagatgaagcaacagagtagcatcgggatggctattgccgtgtaaagagccttggctagggcagcggcattttccttgtccctctcaacactgcttatgccaactccataagtgattgggttgtagccgtatgcatgctctgctagatacccgacaactggtggagcgaatgaagcaaataaagattcaagggaacgatcgagtgcataaatactagtccttgatctctcaggaacaatctctgcaaatatagggctacaggcaaaaacaaattagtcaaatcagtaggaataatcacaaacacatatagtcaaatcagtaggaatttggaagtttactgctattattctcatgacatgatatataatatgattcctccttttcaaaaaacttatgctatgccttttggctctaatcaagaaattatgaaaaggctggtacatcatccagaacacataaattttgtaacatatctttagttttccatctcaagattatattttaccttcggaaagaactactatttttccaaaattccaaaatggattacggttttgcacaaaacatgactttagagtactgaaattttagtttctttgacaaattctttcaatatcaaagaaagcaacgaactggtacatgttgcttacttgtttgtagcaggagcattccaggagatgcaaaatcccacaatgaacatgactgaaccatgcaaaaaacctgtagatgggtcttcaggcaagcctagcagtaaaagagccgcaagaggaattgcagaagcggagcttatctgagatatgactattctaccaaaatttggatagtgcttagcaagataatcccccatttttccaccaaacagtcctcccagtgagcttgctactgcagatgtgaccatgagaattccagttcccttatgcgtaaaacccatcaactccagccacattggagcaaatgataaggcagaccatggaaatgaacctgtaattccctgcgctacaatgatttgaaaagatggtattttcacaacagccttagcttccaccaccaaatccttcatttctctccaagcagacttgcggacatgctgctttttgtttccaaaattgatataatgaggatccaccgcgaataggcgaaccaatataccaactgtgacactgatgagagcaacaacatgaaaggcaatgcgccaaccagcaatgcccatgaatgtagtagatgctagcatgatggagaacaaccctcctatcagagaccccaaatttccagtaagttgaagccatccaaatgctgatccccgtgaattgtcatcggagtagtctgccaccaaagattgaatagcaggggttacaagtgctagcccaataccattcattcctcttgctacagctacctacacaaaataattgtcatttcaagtaagataaggtcatgccaactcttaattctataggcagaatagttttctctatttaactgctgtaacttgccaacattattggttacaccagcctattctaatatcagatctcacctagtaacataacaagaaaaataaacagacaggaaattcatgcctgaaaattaaagctggattcaaatagaggtctgcatcgtatgattcgtcactatatccacggaatcagctcagatcggtgtgcccaatacatgaatgtatttatagcacacaagcttagaatagcacggtcaaatactcacatgttgaataatcaacaaaaatggccagctgagactactgaatcctagaggtacaaaatgcgtccatccttcgatccgaaatgcgatctggagttctgaacagcagaattggacaaattttgctatgaacgggcctagatcttcggcaaggtaaagtgaaacagactggaatatttggtaacaactaaaaagcaggaatcgagatattccgaggggaattggaatcagacctgcgcgaagttgtcggagacggcgacgaggaaggtcgcggcggcccagaggaaggccccgagcgcgacgacgcgggcgcggtcgtagcggacggcggcgtaggcggcgagcgggtagcaggcggcctgcaccgaggagcggcacagcgtgagggcgccgagcgccgcgggcgtggcgcgcagcgcctccccgacctcccggtacaccgccgggaggagcgcctcgtcggcgcgctccatgatggccgccaggttgaccagcaccagcgtccgcctcgccgcctcctccatcgccggcggcgcggcgcggcgcggcgtggcgcggcctcgcctcccgatctcggaaccctcgccgcgttgatgtttgagttggatcttcttgcagcggtagtcttgctggtagagggaaattggtaacggccaacgggcagaagatgctactcttgcaaataggacctttgctcgatgagcaattttaaaaaaatcaagtacaagaaatttttaagacaaatttaagcaaataattctgtccaatgtaatatacgaaataatgtttatatgcttgaagttttaaattttactaaaggcatgactagtattatgcccatgttttacaaggaaccatgctcatatagttagggattaactggttgggtggattaaaaataaagcacgagcatttgactttcttcgtatgatgagaaagggatgaaaagatgacgactgcacttttatcatgacaaaaagaagccattgtcactcacatttagggtctttttatttggtgaaatgaaaatttttgggtatcacatcggacgtttgaccgtatgctggaaggtgttttcggacataaatgaaaaaaactaatttaataacttgtctggaaaccgcgagacgaatcttttgagcctaattaagccgtcattagcacatgtgggttactgtagcacttatggttaatcatggactaattagactcaaaagattcgtctcgcgatttatatgcaaactgtacaatcagtttttctttttatctatatttaatgctctatacatgtgtccaaagattcgatatgatgttttcgtgaaaagtttttggaaactaaacagtgacttagggaatactccctccgtcccaatatattagaacctaggatgggattagacctatcctaaaactatgaatctggacatctttgaaaaaaattacgtaagcatatgttggagtgaataattttttaaaaaaatcttcatctatctaaatagtctagattctcacaaaatttgtattatagaatttaaaaattaaactgaagctagaagatacaagaaaatccagtagtttttctatattctcaacagctaactgtgacaatctggagtttcgtcttatggcgctgcgtacactcatggaacacaaaaaccgtgaaaagcagggtgccgtgcgcaagaatccaacagccgaagctccggagatctccatgcagggaggaggaggaggatattggcgaggtgcggcggaatatcccgccgcgtaggcgacggacgtacgtcgtcaagccaaagtctcaagccggcacaccgaagccgagtcaaagtggcgtacgtgggccgcgtcgctgcgaggccatcgcgacccactcaccacgaaaaagaagaggtcaccagcccacgtctatcaactaaaggaaaaagtccagtttgactccttcaaagtacgccgaatctaattcataccctttaaccagaacaccgggtagaatgactccctcaactattaaaaccggtataatttggctccctcaacggttttggagggcggtttcgctgacgtggcactttgactcggtccaaccggctgactcagccatatgggacccacatgtcaatgtcacattttcctcttctttctttctcgttttcccctctttttctccatggcgctgcgcggtgactagcggcgacgtcttctctgtacccgtgctgctaccgctggtggagtatgccgagcgcgccacacgggacggcgtatccgtgaactttaacgcaccgcagttcatcggtgatggcggggaggaggtaacattcgtgtcggagcgaggcggcgcggcggggctgttcctgtgtcagccggggtccgagtgggtcgagccgcacctggcggtagggcgtttgggcgcaccgcgccaccgcttcatctccaagtcggcccatcgccgttccccctctaggtcctgccaccgccactccgatcaaggccggggcaatgccacgcgtcaggagatccaaccaccgcttcgcctcaaggccacggtgttgattcgccttggcccatgtcattgctccacttaaagaaatttgcatatgtgccatccttaaaaactggcttcgctagaatgccatcgttaaaatgggattcgcccgaatgccaccctcaagctgtgggcattcgccacaatgtcatttccgctatttcttgcactttcggcccctgtcgccaccgccgtcgccgcctccttccgcgcgcttgcgccgctaggcccgcttccctccctagcgccggcgcgccgacgtcgccccctctcggttccctgcgggtggagagagaagagaggagaggatgagagaagaaagaagatgaagcccggggcaaaaaggtccgagaaaaaatgaaatggatggaaaataatttacaagtgcaagaaatagcgaaaatggcattgtagcgaatgcccacagcttaagggtggcattcgagcaaatcccattttgatgatggcattctagcgaagccagtttttaaggatggcacatatgcaaatttctcctccgctttcgacgcaggtcgccaccgccaccacctacgagggagatcgacattgcatcgcgaatgagtggtgaaagcctaaaagggggagatgggattcaataggcgaggcgcgcaccgagggggttcttctgcttccttgtctcacggcggtgatcctccatctctagtcgaacaccgtggtcgccttcatcaccgtctcccgtgacaacaatcctgtggtgtccgtctcgtgtggcggcgctcggcgtactccaccagtggcaacggcacgagcgcagagaagacatcgccgccagccatcgcgtagcgccatggagaaagattgggggaaacgagaaaagaaagagagaagaggaaaatgtgacattgacatgtggggtccatatgctgagtcagccggttggaccgggtcaaagcgctacgtcagcaaaaccgcccttcaaaactgccgagagagtcaaattataccagttttaatagttgagggagtcattctacccggttttctggttaaggggtacgaattagattcggcatacttttaagggagttaaagtggactttttcctcaactaaaccagcccactcatgcagcgccgcatgcatccgcgcccgcgacagcgcaaggagccaaggccttcacagttcagcaccgcgcgcggggcacggctgcacgacgcgctgctgtgctgagcaccgcgtgcagtggtggggcgggcgcgtcacgccaggtgcgccgcccgcacggcttgtctgttgtgtgtttccggctccaccgatcgagcgtctcggcgtcggcgtcggcgtcggcgtaggctgtggctgtgccgccgcgcgcggacgacacggctttcctgcttcgttttgcgggcggatgacggcatacatgctcctgtacacacccgaatcatatcccacggcgttgtacgatctgagatcgcaacagtagcctgtgcccagtagccaccgaatagaagttactatgccaccacgccacgaactgatcatatcgaaattgaacaattatatttacattttaattcaaaatattgtgaccaaaaaagaaaaagaaaagaaagaagattgccccttcgttttttagggagctgggttgcgtgatcccatcctgatctttgccaaatgacacgctccaaagagcaaaaggtcgccttctttacgtcgagtcgtgtctgtccgtttcagacaaagaaatctccggcgaactcatccacatccagcttggctggatggttttgctagcaaaagaggagcatcccgaggacagcatcagcaacaaccgtccatgcaattggtcatcatcatcgaaaggcccggccggtgctgtccacggcttggcacttgggcttttaacctctttgcaaggggaacaagctgggatctgtcatatgttggtgtctgacgtgagtgaggtacaaaggcctcctatgcttgtagtaccctctagctaccctattccttttttcttgctcttgttttttcaacttttttctagtgtccactgctacgtactagttgtagtatgattgtatctttcatgcatagatagatagccatggtacagtacaacttgtttaccgtctattatatcataatattgaggatgcgttgattgatttgttcattattcctcttatgatcggaaattaattacacctttgctattcatcaagtgactaaaatttgtgcaaattacaaattatacctaaccctggtcattagatcaaaatataatggtcagagcatcatcttcaatcttgaattgtggtttactatttctctttggacaagaagagaggagaggttgggagatggcggactgatagattagacggttgcggcaatgaaacctctgatagactacctatggactaaagtttttgtgttggggaaggtttaagacataggaaacggtgagagggcttcaaagggatggcttgggtggtgaaagactggtggtaggcaaaaaaaaaaaaacgtgaaggtggtgagtggatggaggagggtatcggacggtgtcatgccaggactgatgcagaggcgcaatgacagcgagacaatatggtggcaatggtagaggatgagaaaacagtcgacgattagagtgtagcatgataaatctaggtagtcctaataaggtggaggtggagggaggccgacagatgacgtgtatggtggtgacgttgtgtgagtaatgagaggtgttaatcagtgcacgttagaaggaaagaaatgtaaattatagagtagtacgaagcttgactgcttgaggtattcctagacattcaaaaagaattaactgaaatttaaagagaaatcgaccgttgactgatgaaatagcaagtccaattaattacgtgtagcattagaggactgctcgtggtttaatttgctacttctctttcgacaattgatggcttagacttggacgtcgattgatgcttagacaagcacaatgtacattaacggtgactatccccgtatagtaggagtatatagtacgatctggatcgaatctttgggtgttctcttttgagcccaatcaggtaaagcagctagcacacacttgcgcctttgtacgtcacaaaactaagagcgctagctagtgagctacggtgtagctagtcatggtgatatgtgactagctagtgtcgttgtgagaaggtgactcgatggatcagctgggtcgatctcatgcctctctcatgaatgtacgtgcattgcttgaatattcttcttgtacaaactggaattaatactgcttcaaagttcaaattaaccggtcgagttaccccggccacttcaatctaatggataatggcccgttcgaatgagccaaaatgctcagctaatcggtggcacctgaatcaggatagatcattagcgcatgaataattaagtactacatattacaaattagaaaaatgacttttataaaaaaaacttattcatatattttttttttcataaaacacaccatttaatagtttggaagtcgtgctaacggaaaacgagaaatttatcatttggtgttgctagaaagaactcaaccatttggtgtttttttaaaactgttaaaattttcctcagtcttttgacctatgtatcacttatgttgtgttgtggcgtccaattagctggaaaaataaaaatggcttaacatgttatctttctactaatgtgcttctttctcctccatatagttgtctaaaaaaatcaactttttcatatattttttcatctcaacaaactctgatgagcttggttcttcttcctcctaacagagagcgtgtttacacacaatggatggcttgatgacaatatgagaagtgaggtttgtggtgagttcgtatggaaggacaatctgggtcagcaccctcgcggggcatggcaccatcttaacgtcctcatctctttcacctatgtgtttctaccgtcacttcatccacgagctcctccgctgcaagctccgcttacacaaccgcctcctacctaagttggcctttaatttgtcgaacaagcggagctttgtctttgccacgtgacacctatcctctatgaaatcaattggctaagctcatgaaagatatgtagtggggggtgagctcaaggaagatggtagcggggtgagctcaagaggatgggaggatggcagtggacatgccaatccactgctgcttgtagctctatgttcactgaccgcaactacgagaatccatccaaaatttgtatgagtgatgcccgatagagacagagttggtttgtttgatagtcataatagccctccagccgtcagctctccaccacctgtgtcatcctcctgccatcgtctctccgccacccatgcgttcccctactctcggctctgtgttgtagtcttcttgacacgtcctcacgtcctcgctcttctccgtttgccactagattgacacaactgcacttctgtactgtgtcatcctcctgctattttctttatctctctcacgatgacttgctggcctaggtgtaggagctcgacagcggcatccttagggagcctaccagtggtggcctgtcattgcattaggaaaagagagaagaaagaagagagagaaagaggggcggaggaagaagatcgatggccgaagtagacattgacaaagttaatctctgttttatgtcactgtactacgtaccatgttataattgagaggtaaattgaagagttcaaaagttaaaaagaagggtttgataaatgattttaaatttgagagttcgtgctctagacaaacactacactaggttatcaattggacttatccctcgattggctgatttacaggcatgcgttagcttgtcagacagtagtgatcgacgcgaggatatcagattggcctacccacctacctattccctccataaaaaaactaatttctgcgtacaaatatggacttcacattcatcccggaattttttttttggaataaagtatttagttgtgcatgcgtgtgcatgccaccagtctccagctagcttgcccgtagaggttttcgccgtgcacgggcgagcgacggtcatcggccaaggcagcgagagtgaacgatcgatgcgcacgcgcggtgtctcgtggccggtcgtacgtacgtgcgtgtagccatctactaccatactgactagtgtacgcgcgcgtcggcatctcgatcgttaacccgccagtgggatgtggccctgtgcgggggcgatagctagatcggtccatatctctcgcctgcttgccggcctctcctacgactcgtcggtccctcagagtcacttgacaggcatggccgtggcgtgcagggtgcgcgcatcgctgcgccgctactggctggctgcagccagcaatcatcatgccgtggcgtattgggggtgtgcgtgcctgcctgcgctgcgctgagcccctcctgctgacccacccactctagctccgcggattagctaggaggcgatcgattgtcacctttatactacaacgttgaaatattttgattgttcttgcagtatctggtaatcgacgtacagtacgtggtttacagcttttacagcgcacaaaaagatcagtgctactccctccatttaaaaatataagtatctttttagtctatcacaatcttcgatatattactttaaccaacaatatcataaaaataacatgttttaaataaaaaattatatattaagatagattgtttaatgataaatctattaacatcaatttacatggttattttttttatttttttctattaatagtgaaagttaaaaatactccctccatctatttttgataggcatatttctaaattaaaaaaaaatatttttgatagttatatttcaattcaataacatatcgtcttaatgactttcttggatttaatgtatgactatccatttttccatacaagattggttacatgggcatctagaaatataaatattaatgaattgcttgtttacgagaaatgactagtagcatgtttaaatggatgataagtagaattacttatccttgctctgtgtaccaagataaaatatgactatcaaaaagtagatagaggaagtatttaattttgatactatgctaaaaatgcttatattttggtacgaagggagtatcatttaaacatggaaaagctccgtacctccagacgtgaaaaagctacacacctctgcatgtgcggtttgtttgttgacgctgtgtgctccattttgttgcagagcctgcgctcgctgcgttcgcctggctcgatgggcgcttcgacgaccgccctttgcctgcatccctccactttgtccccctcccccctccgaaagcccactgcatgcttagctcgatctccgcttcaattcacggcttttaccttttgtgttcttgtacgcgctttacggcttttgttgacttccacatatcgggacattcacaagacaatacatgcaccagcagcaatgcattgcatttgcatggtggaacatggctttaaaatcactgcaccactaactatctagtcgttggctaactttcaacctctattttattatacaacatggctttaaaatcactgcaccactaactatctattcgttggctaactttcaacctctattttattacttgagcttgacttttatttacgcatgtattattgttggtacggagacaactagataatcagtgaaaagtcacatatataaatcacacaacacaaatatatggaccctgagaagggtgggcatcggggtgagtcgaggctgataaatttggttttactgatggttaccgtacttccttcgtgactcttaggaaaaatcatgactcatgcagcgccatgtcccagccattctctcggtctcaaccctaagccagcaatcgtggcaaaatagagcttatccttgttctcaagatctttgaatccttattaggatatcgtcaggtcatacgtgttgcaaccaatggaattaaaaaaaatgacgcttgacttgaaggctaccttgcacattgttgctatggatggatgaatggtgacgagtggcaatgtgggagcaagaactagaggaggatggacgacggcggtaggttggaggtcatgactgtgaggaagttgattttgtggcgtgcatggatttaggtatagggataaggattttgagtgctaggcagggtttacctatcctttttaagtagaaaattgttccccaccagtttatcaaaaaccgatcaaaaattggtgactttccgtcaacgccatatagaaactggctaaaactgatcgattttcacaaaccgacacttcacattttaacgaaaaccaaccgatttttcacgaaaactgatcattttttgaaccctgatgctagcgtgttgccgtttgttgttgggcctggtgggtattttgctactctcaaaataaacaaacatagtatgggagatgtgatgcatgtgtgtatagttccatgctttttgtagtttctcggtcctaaggatcactcaatgatgaaattaataacctgattgttacctctagaagaattatgagatcaatgggtgtacaaataccctagagaggcggggtccttgttagggcaagagcaacgcgagacacgcgtgtctctgccctcctgaaactgtaaaatcgaagtcagagtgacaagctctacagcacatgcgcaaggggattgtggcttcggtgcggcgcgaggggatgaggaatcagagccacgagctccacaatgcaagcgcctctacgttttctgggcccggcgtcgtctcgtgatggcgaaaaacgcgtctccttgcgtaggggctagaggctcagcagagatgcgcatttagtcaacacttaggcgaatatctgagctggtgaacgaaggaacttgccacatcctcagcaccataaaggcccttaggtccatggccccaatgggtaaattgcctctctttgtattaggcggaggcattcttctcacacgctctgagggtagtagtactgcaaggcacgctatgcatgcctctggcctatttgtgcgatgaaattggcccaaaagccatgcaccccacattgctcgtgacccaacaaaaagaatcctcgaaccaacaaatccttgaccccacatccacctaccccttcgagcttatcctcacgcaccaatgaaaaaaaatccggcgcttctccttcccatcccccgcgctgcttctccctcccccccatccactgcacgcttctccccccaaatccgtcgcgccgcttctccttgccacccactgcgccgcttctcccccaaatccatcgtgccatttcttccccaatccgcctcgctcctcctctcttggccaacgacgaggagacggaccatcgagggctcggaggatgcatggtggcagcgcgcggatccgtagtggagcagtgacaacgtcctcatgctcgtctccgggaagcgctgagcggagtagtgatggagcaactcgtggtcgtcgtccttctcgctttgagaggcagccccagtggtggatatctgtgtcaccggctggtggtacttcaaaccaccgggggcggtgtccaccatgccgtctcctccacccccccccccccaaaaaaatcccctacgccacttctcctccgtcgcgccgtttctccatcctccccatccaccggcgcatcgatgcagacagagccagataggagtgaggattccagtgcgggagtgaggatgcagagcgagggagcgaacgattggagcgatgacctccacagcgcaggtttcctgcgtcgcgtgccctcccactactacgaaaaccatctttcgtggcggccattttgagtcttcgctggtggcatttggcaccgccacaaagcaaaggataatgaaaatgtagcatcttcgctgacggcgctaaaccgctagaggagataacttttcgctggcggccagctaaagacagccgctagcgaaaatcgtcttcactggaggctgacgtatgtgggccgccagagaaaatagtcttcgctggcggctaccttatttgctccactaggaaaaaatagtctttgctggcggcttcattacatgggccaccagtgaaaatgattttccataaaaaaataatccccaaaatctcttttcgccaaaaaaaaagaaaataaatcagattttcgcagcatgtacagattcaaatccacatccaaaattttgagcatcgatttaaatcctcatccagagttcattagattcagttaacatggaagtgaacacagcatacaagcattttgaacataaaaaaaaagaaaaacagcatcaacagaagagaggaaggaggtcgttgtcgccgtcgccgaccgagcagcaccggatgtgtgagccccattgccgagcatcactgcctccgagctccttctgccgcaccaagccccccgtcgccgctgcagtcgcatcgctgtcgccacgcccccgcctcccttcgcagtcaccgttgcccccccatggctcctcccgtcgccgtcgccgtgcccccacctcccgtcgcagtcactgtcgcgccccacgacggctcctcccgtcgccgtcgccacgcccccccccccccgacgaccgtctctcgtcgccaccgcgcacagctgccggagccaccgccgccgacgctgcctaggaggagaggacgccgacgccgtggatctgtagaagggaggaggaaaggagaggtgggtgctagagaagatctggatctggatctggagggggaggaggagagttggagatatttttattctggagaggtgggtggataagagcaggtacaatagcaggctataagccagctataaacatattttaaagagataaaaaaagagagagaagagcagcgggctatagatctgtagccagctgcagcatggactccaagacgtaatgtgtgtatgacaggtgggaccaggtattaagagcatgtttggtacaattccaacttctaaatttagttataggagttgagtctggagtggagttgtggagccgactaaacccagctccacaactctaatacaatttgtgagagagctccacccaactccacttccagttttggtggagctgaaactgtttggctgagctccaactccaggaggggtggagctggagctggagctgtgccaaataggccctaatagtatagtaagcaactattgtatgaattggctattacatttgctatatatgatttgaagctagtagtggactatactattaagactatactattaaacttgctctaaggagcatgggcggtgcgtgattttttgttaatagatggtggttccttctagatttttcctgacggttgcttaagtgggccgctagcaaaaaaaaataattgtatcttccctgccggactatataacccaaccgccggcgaaaattatccatcttcgctggtggcacatctaagtgaccgctagcgaaaataaatacatcttcgctggcggccggtataacgttgtcgccacgtatgcgcaggtccgacgtgacgcgggaggctgataactcgccacgtccttacaatgtgaaaggccagatgagaaaagcccccgtatctaatcttgggtgcttggcccgaaattatatgcgctgacgtcgtacgtgtagctagcatgatcatccatgtagccatatactactcctactcctaggtcgaaggtggcacagacagccatgcattcatgcatgccatatactcctaccataggcaattgagactgagaggtcacccctcacatgacatgagtattggaaatgctagtagcatcatcagcatggacgcacaggagaggagagagtgatatgatcgagcagaagagagaccagaccaagccagccatcattgcaaagcagcagattgttcgctgccatgggctaccatgcttatgaatgatgcctttgggccttttggctctcgctgctgccattgcatgccaaccccaacaaggactcacatgtctcgactctcaactctctctctctctctctctctctctctctctctctctctctctctctccatgaaaaacattttaggcagagagggaacatcagaacactactaatctgaatgactgtgtaataatcatgatctcacttttgctgtatccatgatttgcatatcagcgaaaaggagaaaaataaagaggtttggcattcagttaataatgcccactttttacatcgaggttttatagcctttcttctgtgcaagcatttatacggtaatcactagcatcacagaggcgcatgccttaatcatccccagatcattcgttcagaaaaagatgcacttttttagaacggaaagattgatgaaaaagatggttgcgtacgtgtagacggtcaacgtttcagtctagtctctcgcacgaacagtgccagattccgtagcatatatatatgtccacatcgaaatatcaaatgcagagagatcacatccaatagtcgctaaaacgagaaatttgatcattacagtttctcacggaatctctcctttgatgatacctacatccggtgacaccaacatcagtaattggtgtttgccggacttctccgttcttgaggaagatgtttttagtctaattaccacaaagagatttataaatatctttaggtacgaagaattacttttactccgtagtataatagtgcagaactggagttgcagttgcatgactttaattatcagagatcaaatattggtatctgtaaacgtacgtttggtttaaaggatggaatatttcgagttggatctggtttaaaggatggaatatatcgagttggatccgtatttgatttgaggatatataggtggaatgaaatgatcactgaaagagaatttctttttaagaaccaggttagacatattaaaaaaccgatccactaatccaacccatattaatttactctatcgcttaacacatgtgagacatccttaaaagggtaaaagagtagaacaccaacaatttcatctcatgtcaaatggacggattggatcgaccatcccatcttaaaaatataaataactcatctcaccttgtcttcaaaacacatacttagtgttattcgctttaataaaaaattgataaatctagggatttgctttggcctcctctctttaagcatgtcataggcaaattaaaaaaaaacaacaacataatttaacagaattcacattagttttaactagctactccctttgtccaatcttaaaatataacaacttttatggttcaaattttaccaaaaatatagtaatttccgcctatcccctcatcttaaccatcacaaccaaggtaattgatattgcgatataagatagtatcaatttttcatgatagtatcataagttcgagatcctaccaaattttaaattttcatatttttatatagcatttgtagtatatatgttgtataaattgaagcctataatattgttttagataaatctaatgaacattttgaaacttgaatgaacttattcacattatttacagttcactctattttaattttgtaagatcatagggatcgagatactatatgtgtgatccggtagcattaaaagtacgtcttgtagatatagacgtttttctaatactgtaaatgcattttaaatatctttacaatattgtagagcattaaaatgcctcatacgtaactgttggtaaattgtctttagaaacaagaggcgttttaaaaagaatatctctataccgtttagtattctttttataaaaaaaatagaggcactttctagatgtattaaattatgctacaactatagcaaattaacaaggtaaatcaatgtagaaaacgattaaaaaaagctaatttgctattgccgattcttgaacccaagacatcgatcaatacatcatttttatactctcatatcattagttgtaaatatgtgtcttgcattagttaactctagttacttagtgtacattaatattaaaaaaattgcctccacacaagtttaaatgcctttacacatgagatagattttaaagcaccaaaaaaatacctctacaatataagattaacagaatgtgctaaatatctctagagcgtctctacagtaaaagtatggtttaagaagcaatttgaaaaatggctttagaaaagtgtcccaatgtaagtttttttttgaagtataggatagtatggaatagatggtaagatcaaacactatcaaattaggatactaagtgagatctatatcgcttcgatttagtaagattatggtattgtaggatattaagatacatatccaaagtgtggatattttaggggaaaaagagtaactcttatagagcaggagttgatgtacaattatgtttacaatagaatccaatacaagtacacgactcttgtttcaaataatagttaatctttctcagcgcaattacgtgaaaatgtgcgctatttttgataaaaaaaataaagtaaatttcacaaagctacaaatacttgaaccaaattgtcgcaaaactacataaatatgtatcacaaaactataaatttagcaccaaaattttcacggatttaatgcatcgtatcataaaactacaaatttaacaatgaagttattaaagaactatatattttagaatttagaaccataacactgttatgtatctaaaattacaaaagttgtagttttgtgataaaattgttgttaaatctgtagttttgtaaatttgtaaattcgtgataaattcgatattaaatctataatttcatgatacactttcttaaatttgtagtttgatgataattcaataaaagtctctatagttttttttaaatctatctattatatactaaaagtccattaatcttcctacaaacactcccaagctgccacgtggcactcctacaaacgctcctaggtcgccatgtggcatagtctaatctcaccgtcgattttcatttaaattggtggacccgttattttataccgttagattagatttatacataacgtcgattttcgtttaaattagtggacccactattttataccaacagattagatctatatatatattacctttctccgtacggtttgccgaaggaatagaacgtacgtacgtacatacgacaaccaaaataaaacatacatgattagtactatcaaaaagcaaatatctacaatataaagttgaaatatattggcccacaaatatacacatgcagctgaactaattttaatgttgattttcacttaaattgagatggattcatattttatctatatgtgttattgattttcaaattagtggacctgttattttatactattaaatatgtaacacctttctcatgtacataatatttgccggaagaaaaaaatgcatgtacttactataaagatagagctaaagtaaaacataagtacttagtaccatctgaaaaaatcgatggcctttaaaatagaactatctacaatataaagatgaaatatattgcatgtagtgttaaactagatctataatataaatatcaaatcaaccatctataaatgttcatcttttaaaattattttaaaattatatatctaatttgtgatcctacaaacacttctaagtcgccatatggagctcttacaaatgctcctaggccgccacgtggtactgtgtagtctcaccctcgattttcgtttaaattggtgcacctgtttagaccattagatcagatgtatacatagtacctattaaaaaaagtaggattgaaaaggaaataaagtttcggtagtactgtccgcagcaagaaaaaatattatatactaatagtctactaaactacctaaaaaattctaagttgctatgcggtgctcctacaaatgctcttagatcgtcatgtggcactatataatctcactatcaatttttatttaaattggtggatcacgtggcatacaaatggctaagttgaggtggcccaagtatgttatagtactctatgagaatgttatagtaaattaggaattaaaattgtgctttatgctgatcttgaggggacacagctacatcgatgaggtacccaactttcaaggtaatagatcacctattagtgaggcattcatgtttaacttaaaggttgttatcctattagttggtagaaagtgatacttttagaatatttatatatggatttggaaataagtgagacatgaagacttagctaagtagtgcattaatgatatattaggcttattttatttgcacatatgcaatttcatctattaataggtaatgaacttttataatagtgataatgagttgttacgataaatggagaatttctatgtgatcggaacaaagtgttttttttactaaaagtccattaaatttcatacaaatactcttaagccgccacatgtcactcctacaaatgcttctataccgtcacgtgacactttcctttaaatcggtagacccaatattttaaattattagattattaattttcaccattaaattttatcttccaaaaaaaaaatctgtacgttcccccctccgaacacaagttcacgtaatacgttttaaaacgaaaaaaaatgcgcacatgtatgtacgtactccctctctccccgtctaaccctccctttccatctttccaattttctggctaacaaccaaatgcatagtataaaaattaattagatagctaaataatctcttggtacatatatttttatataaaaattataatatgtaacttggatgtatatacccttaatttccaggggcgaactcaaaaataaaattatcaagacattacttggatatataccctttgttttcagtggtgaacccataaaaagattatcaggacactacacacacaaattatttaattattgattgatatattaattaatatgacatgaattatctattattatatattaaaagtccattagatgtcctacaaattctttcaagctaccacatagcttcctataaacattcctaaatcaccatatgacgctctaatatatcttaatataaaaatttttgagaaaaaacaatcatcttacccaaaccagtagaccttattttaaaatgttagatctatatcttaataataaaacttatggatcgactaggccgtcaaaatccgtatgtacaatgcacatatccacttccctccttacatatgagacgaacccaccggctctcgcctccttgttttcccttacggcaattaaattaaccaccggataaaagaaaatcctaaaaattatccctaaagaaatccaccttaatcttttaataaaaatggtggactcagtacttaataattttttaataaaaatggtggactcattactttatactattagacatctaacgacttctactaacttaattatatctctcaacatatataccatatatacgaggtctatttacctatacaaatatgtaaagctaaatcaatctacaaacgtacagataaatccgttaatccgtatatgaatgaagttctttttaattactatgtccatcctatattgaatcctaaaattttataggaattaaggaagaatgaaaaaaatatactaagattcccctctctaaataagactcattaaatatgaggtatgtgcagagttagaagatagttagagtactgttggataaaaattgaataatggatggttggatgggacgagtagtattaaaatcctttatatcttaggataaaatttgaatccttcaatttatggatggaggtagtacaagcaaatagacatatgtaattatgtctttaattagataaagaagtcacattaccgtattttttaatatgaaatttcttaacttaatatatcctaaaatctattaatacatctttagtatacaagaaaaagtattacttaaaagtttaaattaagatgctaaatttttttaaaaaagaaacacatgtagtataaatgatagtttcatatgaaccggatccattgttgcgacattttttcttataaatttaagacgacatgattcaagtaattttagtttacaatttgtaacaactcgttctccagaacaacacatcccagcccattcaaccggcacgtccacttacaaataccacccacacttacactttcgttctcgctttatgtaaaatagtcaacacgaaaatgatatggttagaagggcagtgccttacaagttggttgcactcttgcttaactagcaatacggtagtactgaagtgcacacaacgcttatagacaacacatatcatattctttcaataaaacataggccatatcctaatcgaattaggatgtcacagacacccctcaaaggacctgacgtccccgtcggtccaacatgtgtatagacaaatgtcacagacaccccccttaaaggacctgacatccccgtcggtccaacatgcgtatagacaaatgtccagaaacatgtcccttttagcacacgtccgtacgtccaatgatcgaaactaactttcaaaacattcccaaacaaattattgatatatacatatttagaagagaaattttttgaaaaagaaatcatatatacataaacattcataacaaaattttaaacactactaaataagatgcccaaattttaaacactactaaataagatgcccgcgcatcagcgcggctacctttctagtttactttaaaaatagtgtatttgtcactgggcacatattattcaatcagtaacctacacatagtgaaaaataatatactattatgtagtatgtaaagaatacacatgcaaacaaactgctactactccctatttgcatctatactcgtcacgagtggagaaaatcacgaagaaagatcagatttttgctccctgaatgctaccccatgcattttttaagtggctttgtgtgtggatgctaagctcgaggagatacggttgttggacagtgctggtagtctaatatccaccgtttttatattccaatactatattagtattatattacatccatgtgaaagtaggtagccgtctaaaccttgaaagatctaaaaggccaaaagagatctttctgacaaaagacgctcctttttgttccgtgcttcagctgctcatgcatgtggccaatgaaccctacattagtatatgccccagagattaacagccgatgtaacaaatcttctctttgccattttacgctgtcaaatctcaccgctaatcgcgctagccaatgggttagctgacggtgattattctatatatatatggtcaggtaaaaatcttgggattatctttctactagaagaagcatggacaggttgaaatggaattaagcaggagagcaactactctgatcagtgatctctctaatctatctctctctctgactcttatctacacctaccagcttgcgtgtgacgaaagcaagtaggacaggtgaaacactagcacaaggacaagcgcacgagctgctgctaatggagacatacatgcaacttcattaatatgaaactgtcccctacatgaatgtgattaattaactgtaataagcagtgatatactatgatagtatgatcttgttgtttggtttgatcgatctacacaaagagcatatgcaaataggggaattaaacacccaaaggagtagtagagattaataagatattaaagaaccaaatgaaattaagctactagctaaatgagctttactactacaagccaatctgctcttggaatataatgaagcgagtgaattgacctactccgatgtacaaatccacgagtccacggattgcgttctcatcgccgccgtcgccgccgccgacgaaggtgtcggcgctgcggcgacggtgaccgacgtgctctccgcattgtgctccagttgaggcgctgcgtgggccgccgcgccggcgccggacgagaaggtcgtcttcttgccgccgccgccgacgctccgggtcatggacgcgcccccgaccacgccggacagctcgtcgccgccgtggccgtggccgcggcttcgttgttgctggtgcatgtgcgacccgtcggcgcccatgatgccatgcgtgaggccgaggaagccggccgccggatcctgcagcctctgcggcggcggccgcggggctaggtcgctgccgggagcgtcgaacatggtgtgcgcggtgtacttgacgtcgtcgctggcgccgagctgggcgccgccgaggtggctctggaaggagaggtaactgccgccgtgatcctgcatccctaggagagaggacgacggcgccgacgcgaggtggtacctgtcgccgggtgccgccaccgccgccgtggttgcggcggcggtggaggttgcaatggcaatgttggacggcgacggcgaggacgtggagggcgaggggaaaggcgggaacggggaagggtggtgcttctgcgcgaacgggcggaggaggtaggccgggagcgaggacgggttcccgccgccggcggcggtagcggcggagcggagggaggagggggcggggaaaaggtggtcgaaccgcgagcgcgcgggtggcccggcgaagggcggcgaggggatgccggtgaactcctgcaccatggcgcggaagttggaggtgtcggtggtcagcaccgtcgtcggcgcgcgccgcgacgcccgcgtccgctttctcgacccccctcgccggcggcgcgccgaccccctgtccctgctgcgccaccacctgctcggcagagacctgcacaccgtgcggcgacgacgacgacggcggcgaggacgacgctccccccgctccannnnnnnnnnnnnnnnnnnnnnnnnnnnnnnnnnnnnacccaggggcacg

SEQ ID NO: 83272 - DNA, 8566 bp, Oryza sativa
  unsure (1)..(8566): unsure at all n locations
aaattatagcagcatctaaatatcaatcggttttattaaatttaacactgaatgtattttaatatgtttgtttttttaaaatactattatttttctatacatttgatcaaatttaaagaagtttgactaaaaaaagtcaaacgacttataatataaaacacaggcagtatgtccctgcttagatcccactccaaaactttccaccctgtcacatcgaacatctgaacacctgcatgacgtattaaatataggctaaaaaataactaattatacaaattgcgactaatttgtgagacgaacattttaagcctaattgctccatgatttgacaatgtagtgctacattaaacatttgctaatggcggattaattaggcttaatatattcgtctcgcggtttactgtcggattctgtaattagtttttttattagtgccaaacaacccatgcgacactttatataatacccgatatgacacgacaaaatttacacaccgggatctaaacaccccatatgtaatactactaccctgcttctagcttaattacgattgcagttctagcttaattacgattgcaggcagctgaggatgccctgcgcttgtgagctgatcaggacaatcaatcaatcatgtctactcaatggtcacactataacacacagcataactcaatttggagctagagagatgatccatgcaaaatagaggcctgtgcacatgatccaattcttctagggaatctttgcctagcttatcaatcgatcgagttggtagctttgcttttaggtcgcatgcatcaatgcatgtggccggatcgatcgaacacgaggaagctggaaagctaacctacatgctgaagaaaggaatggaagcaacctttttctgcacgagggagctcttgctagctttcttatcgatctgtcccttgattttcagcgtgtcggcgtcgtgtcaccacgtgccatgtcgatccatccatggcttttgtgtctcggagacgattgatgctatttatttgttatactagtaatcactggcatatatatatatatatatatatatatatatatagtaaatttgtttggtgctccatggtgcccgggcaccattattgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattatgaaataaagttaaatttgagttgttttgttgataagtataggtatgaatcaaattattataactaggtatatattcacaatttgaaaattttgaaaaatttgagtaattttgtgcattagataccatggtgcccgggcaccatggtgccccatatgagtgtcctagttagtaaagtatacctagttactttactaactaggacacttatatatatatatatatatatatatatatatatatatatatctgtgtgtgtgtctgtgtgtgtgtgtatacatgctggcttctatgtgaaggtttattttttttagatactggaaatagattacatctccggcttatgtcataagacacacagccataagtttaatagtaataataaaatgtaagataaaagtaaatcaaaatgagaaataaggtgataggataaatccccaactcccatttattattgactagcgttaaaccacataaaatattttagctagcaattcttatggaactacaccacccatagtggaataagagacccttggctaccaattccaagagtatagcaccattgcgcatagtatacttctcctcctgtggtagtattatagatcaaaagtggagccagtaggaagacatgaagataacctgcatagggttagataattgtttaccattaaaaactttatcattgcgacaacgccgaattgaccaatatacaacactagctccaattagaatcatcttcttaatggacctagatacccctctaagccaattaccgaaaatgtttttggcgttacggggtgggggatattaaaagcaaaaaacacacatctcccaacaaaccgagcgacatgacactaaaaaaaaagatgttggattgtctcttgtgcatagcagaaagaacaatgtttgtctcccccattttcttttagccaggttatctttctttagaattactttcttgtgaagaaaccacgtaaagaccttgatctttagtggaattttcaagtcccacagaattctctttttgatccgaacattacagttcatgatcgccgcatacatagatttgacggaaaattgaccattcttatggagcgaccatacaaagcagtccttttcatttgacagagttatattagctagcctgaggatcaaatcgttctactcgattagcttttggccaacaatagctgttctaaaagagatatttagcggcgttgtgctcatgacctctgccacagtagactgcttctttcgagccacattatataatgtagggtattgatctttgaaaacacgcgatcccaaccacgtgtcttcccaaaatcttttgtttgtcccattgccacatctaaaagaaccaaacctaagaaattggtctttgactttcattaaaccggcccagaactgagaaatacctatcttgctggacataccaggaagaggtttaccctttaagtatttatttcacaaaaggacttgccataggccttcaccattaaacaattggaaaagccattttcttaataagcagctattttttatatcaaggttatggacacctagtccgccttgatcttttggtcggcatatgttttcccacttagttagtctgtattttcttttccggtcatcattactaaaaaaacgtgacctaaagtaatcaaatctttgaagcacacttcgtggaatttcaaagaagaataacataaacaagggaaggctcgaaagaactgagtttagaagggccaatctcccaccatatgacaagtttttgcctttccatgtgctgagtttcctctcaaatctatcttcaactcctttccaatcaacattccggagtttccgataatgaataggaataccaagatatctaaacaggaatgatccagaattacaaccaaatagttgtctatgaaggtttattagtagtaattgttcattcggctttgggttgcatctgacctactgtgtggttctcaattaaaaaggcaagatcaatttcgttaggattgcacctttggctaaatattgctgtgtccagttgtgagttataacaccgctggagaaagggtttttaatcccgattcgtaaccccctatagtcccggttatacaatcaggactatgaagtaaccaggtttaaaaatctatctttagtccaactaaagatgaaagaggccaggtcccgattggaccctccttgcatattaatttcactccattcccaaatcatccccaaatcatctctaaatcatagatcaatcttcctcaaatcgtgaaatccctaaattatctccaaatcacatatcatacatcacaaattctcaatgatggttacatcacaaattctaaaaaagcatcacatattcacaccacaaaatctcaaaaaaaaatcacaaatcctaaaatccccgctggccgccggcgaccgccgcccccacccggtcgacggccgccgccgccgaccccgcgcccagccaccattttttttttgatatattttggggagtcagagaaaagtatcaccatattttttttaaaaaaaaataccaaatataaatttctagatgaatttcataaaaagaaataatttagcatttttcagcctgccaatnnnnnnnnnnnnnnnnnnnnnaattcacagaagatatatacacatttgctagtcacaatgactgcctcatcgaatttcatttatttgattgaagtttcttgaaaattcaaattcaccatttgaattttgctcacttttggagattttgtgatttccataatttctagccctgggaacatatatttccctggcaatccctagggcaacatagttatatactccctccgtattttaatgtatgacgtcgttgactttttaaccaatatttgaccattcgttctattcaaatttttgtgcaaatatgaaaatatttatgtcatgcttaaagaacatttgataatgaatcaagtcacaataaaataaatgataattatataaattttttgaataagacgaatggtcaaacgttgaaaaaaagtcaatgacgttatacattaaaatatggaggtagtatttgagaagaactaatagtgaataacattttgagcatgtagaggatgcgcacacaaaagttctacagcgagatattgaagacaagaagagaaacacacagaaacactaagaaactcaactacggaagatattgttgattataagtcctaacgtttattagcagctaaaaataatttgtaaatagaacttttataaatatctttatagtgactaataaaccaatgatgaaaaataaagtacaatcaaagtcaacgatttaagattgaaattttggctgtgggggtaaggtgaagagcaaacgatggagctcgtgtggcaacacttctttctacttggcaggaatggtgatttgttctcaaaattgtttggtatacaagtaaagatgaaaacaatgtatgcttttcagtccatttatatgccccgtattagagggttgctagggaatggagtcccgtcggatggatatgtactttaatgaacctcctccaatttccttttttccacccaactggactctcatccataaaaagaattgtgtaggatcaaaacaccataactaagccaactagagaggggtgaatgtccaaaaaccaaaacttttagcggaaataaaagttaccctcaaattcgatagatcgtggtccgacctaggtgtatgcgccggtctgaccgcctgatgaacgtcggtctgaccgagatcgaactccggtcgaaccgccgagatcgcctgccgctccctgtcgccgccgccggtctgaccgcaggtcacctgctggtctgaccgccccttgccgccggtcggaccgccggtgcgctgtcggttagaccgccgaaacccggtgaaacacaaatcgaagaactcttaaagtggatgacgactttattgattctctctgtgtttacaaagtgcaccaccagcactccttataaaaatctcgactaaactcgaaacctaactcaactatcaactcaattagtctcaaaagcgatacagggaagcctcacgcttcctctctatttataccccaaggtaggcagcctaaagccacgaaccaaactcatactagaagtcctaatcaccctagaaaactctctagtacaagaaacaaactttacataaccaatcatactaaatttggactcctttcaaattcgactattggattttatagattgaagtaaccatgaccccacattctttgcctagtgtggatgcacaacgattctagcatgacacgataacatcggggctagtggctaggacactaggaggaggcagagtagggcatgatcatagccgtagtagcagccgaggtgactcccaccacaacagctgcaaagaaaagaggatggagtcgagaagagaaaatgaagagaaaaggggacaggagatgctagaggcaagcgtcttcccagctggcaaagcggcgatgaagtgcgtggctccccttatcttgatatcatatatatgagataccaagacttgatacccacaagtatcaggtccggtacctgggtactatggtacatgcgtgtaccaatcttggctgacacctaggtaccaggggtatcaggcctaatattcatagacatcggatttaatactatgaatatcaaccatgataccatgggtatcatgcctgatacattatgggtattggtcgaggaagacaatgcacgatgtacctgtacacaaatgctaatgagcagcatgatggaatagtgaggagcttgccggatttggtgccaccgtgccataaacttgagatgaaggaaaccgacgtagtccagcgtcctcgttgccagtatcgaacgatgggtaggagtgtaggacctaggcctccagatccatcgcccatgccctactctgccatcacaatgccatccgacagattagctctccacaacaacattgatatcaccgtgcctccgtatgcgcatgctcaaggtgagagagtgaatggggagcaagaggtggtgtagtttggaggtgagggagagaagggaagcatcgttaacgccgacaggtttcgccgtcactagctgcaccgctattagctcatcattgtgtcctacgttaggctcaagagacatactagggtgatgagtggatgatactacctctatttttgtttgtatgacgctggttagttaaagttaaactaaccagcgtcatataaaaaaaactggagggagtagttgatagagcagtagcacatgtgggatatgaacgtgattttcttactggtacatctactatcttttaaattatcccatccgaagttatttcgttgcttagtttttctgttcacattaagggctcggttttttaacttgccctaaagaatttatattaatttgttgtaagtgctcatattaaaggctcgattgtttaactttgccctgaaaacatatattaattccgaaaaaaattaagaaaacttggttctactttctctagctaacaggattgcaaattctttcctacttagcaaagaaacctaaatcccgaattttttacattttaatcattttgaaaaacttattttactaatagacctctgaaaaaacttatttcaagaatggtcatttttggtgagctagagatattggcgctgtcatccaacagggcaacgctaccacctctagtgtcgtccctgcgccaccgtggcaccgtgttggctagccgagctgacctggcacgaggttggagaaatatttttgacttatgtaagatagaggtatgactccgacttaaactatcggattataaattatataagtcaaaaagataacttaaaaatttaaaccattaaatctaagcctaaacaaaaagccctaaataattaccagtgttgaatcggaaaagcaaaggaagaaattatatgccccctttgcattatccgataagaattaagaaaggaagtagattaaaagatggagtagtagcaaagttcatttttatgttgaaagaatatttagaaaggctgctagtgtagtatgggccgcgggtcacgtggccgggctgtaccacaaggctgcttttacgagcggagtgggggctcgaggtgggcccgatcctagggcctttaccagccagttggcccaccaattattgaaagctcaaacttacaggagtactatacactgattaattacttaattaattgatgaattgtccatatggaatccaaaggaaacgtgtgttttgcaagtttgcaattaaggtacaaataatgtttgtatagtaatgtttgcaataaaaatcttcataccaatgaatattgtctaattgagcgtgttttaagagagtgtctttttttttaacgaatcgacgagcgccaatttcattgaacagagcaaagcaagagagtgtatttatgggtgtgtgcattcattcatatgtaataaaattaagaaatctagcatataaaacaccagatttcgagacaagcaaaatgttaaactctgtatggttatagcctaaacccatgaatgaaccaatgtcagcaatgattttattaagataaacagcattatatgcagggtagattttgttccctccaatcgacgtgccacagcaaagacacataatttggtggtcccagaaatcaaggggcacaataacttattatgttaatggcagattaatttgagtatacttattatgttgtacacgcacacacttaattagattgttgtcatctagtactagctacaacaactcgatcgatctcttacgaggtggatgagacatactgaagataaaaaaagaaaaatactactgtatatatagctagtagcggcgccagaaattattaaagagtaggactaaagtagaatttaaccagtgagttttttatttttttcttaaatttacaagctgatttaagataatttagtcatgattttttaaggtaggccaaaggttcaaacccttttagacatgcctccgtcccggtatacagtatacactcgacatattaaaatataacaattgttagctatatatatggataaagatacgttcaaatacatatagcaataaatcgttatattttaaaataaagatggtaaaaatgataaagtccattgacacgtacaggtaggaacaaccgtcagtacctctaatgattcacatctactactccgtccaaaaaaacgaattcctagctacctgtatgttcctaggtt

SEQ ID NO: 83273 - DNA, 19674 bp, Oryza sativa
ctttcttaaaacgctctcacgttgccacttggcgctctaaaaaattagagaaagtcctaaaaattctaagaaaaaagcaaaagatctagccattgattttcatttaaactgatggacccataattttacaccgttagattagattaatctttgggcccctctcctgccaaaaccttatccacgcacctgcgggcacatagctgccacctcccgtacgcccctatttcttttttttcctttttattggtggttattggttaagatatttaatggcctattttatatagaacttaattaaattctcacttctctttttctgacgtgaaggctgagagcggactatgcaccgcttgcatccatgcacttcgcatgcatttgtggtttctactttttgagttggtccttttaaaaataaataaacagtattttaagtggttatagcttttaaattatatataatcaatttgtgatcgatttgaaccattctatgtatttctttacttaaacgatttcaggcgcattgaactatatttcagagtaacagacaaaaattacatgttagtcccaagaccactaattaaagacgatcattaaaaattctcaaactttttttatggaactatatgtatcttttgacggaaaatgatgggggtaaaacatgcaaattttttaccgttggatatgctttaagatccatgcgtggaagagagaaaaaaaatcaaatggcacatggataccaaggatcacaccggcgatcgacgctgtacacgtgcgcaatcgatgcgcaaaacactagagcatgtgttcactaccaagctttgtaactttttctattttaccataataattacatctttcttgtactgcagttacatatgagttacaaatataattcaactgctattgtacgataattacatttgtcagatttttagggggattttctatcgaatgttagataggcggtctctatttctttttaaatctaaatgacaatgatagaccgttagaaatatatgcaatgccttcctctcatttgaaatatacacaatgcctttcttccaactgtaccaccacccctctcctcacctcctcttacctcccctttactccttatttttatagtagttgagataataattttaatttatcataataaatctcaaaaaagtaacttttaggttacccaaacaattattattcgttcacgccgttatatttattacaattaaatttctttgttatctctattttaatttataaagaaaataaatattattttggataggaccctatgcatcatatctaagggaaaaaagaacgacaacatatattgtaatatcatctatcgctgtacaaacatgcgtaactaaattagctgtacaatggttgaaacaaagtttacaccattgcattatttaccattaaattatcaatttatgatctatattgcttgtattttaatttgtaaaataaattatgctttaattcgtattttgaatctttgcctgaaatcccaacggacatgaaaattatgaaaaacatgacaatataaagtatatcactatataactttaaccagaataaattaaatttataatgacaacaagtaacatatcctatctttatctttagatttataaatatgcttaaagtatcagcacaatttaccaccatgtataaattctacattttggagactatattaactccctaaattataagtaaagaacataggagtacatgttttctctttgatttctattaaatatgtatggtatgtaggtattttatactaactttggttaattattgaacacaaatcatactaaacttatattagtgcccgaactaataagagaatagtagtgcatatcatgtcatttcctatgtgatttctattaaatatgcatggtatgtcatatatcctaaaatacataatgacgagtatagtagagcagaaaaaattttagcaactccaaaaacaagatatggtaaatattcaaaaaaataaaaacacacgcaccataaaaaccatagttccataggagccaacaccattgctgtgctatcatattttttctcatgaattcaagattgtatggttttaagtaattttagtttagaatttatatgttgcaagagtaatcaaaagaaatccatagccaacattcagagtaatcccatacaaattattggccaaaatagacttagaatagagttattgaatatttcaagaaaaatccacctacatagaatcattattttaagttaaaacaagtgcccatgcatattggagccacaatcgcatgtgcgtgggctaccttcctagtttagaaaatactccctatgtcccctaatataagagattttgacattttgcatgcactgtttgaccacttgtcttatttaaaaaatttgtacaaatataaaaaacgaaaagttgtacttaaagtactttggataataaagtaagtcacaaataaaataaataataatttcaatttttttaataagacaaatgatccaacagtgtcagcaaaatgtcaaaatcccttatattatgggacggagagtaagtggtataccaaaataaatttccttgctatataacaatttcaaacactagaataattttgattgctatcataatttcaaattaatttgtaatatatcaaaatttcaaactaatttgcaaaattgattagtactcattcatatatatatagacactactcgtacgtagaagaatgatgctcatatatctactacattaaaactacactacattaaaaatgaaatcgtcctcctttcttctagcacatttcttattatttggatctagttagcaaggtttaccaaactattttaattagggttatcatcacttcatgtttaacgataatcacgaggtatacaatagtttcaaacactgagaaaattaccgttcataagctgtgttcagtttctaaaattaggaaaaagtttaggaaaaattggtagtttgaaaaaaagttaaaaaaagttgagaatttatgtgtgtagaaaagttttggatgtgatatgatgtgatgtgatggaaagttgaaagttgagagaaagtttggtgtgaactaaatagggtcctaataatctacggccggcgtgttagtagtatagaagaacaacgtggtacgtgtcactgaccgtcatcaagcgacaaaagtgaagtgcagagtacgttgcttctgaaactagatcaatgattaaaaaaagctgaattattaatgtataggaaagggactgcagaacacctttgaagtcacagggctactgtttgtacggcaagaaccaggaccctttttgttaaggcacaaccatcaaaatttggcttgtgagcctgccacattaccattatgggccgggaattaacatggcaccacaatagtacagcccatactgagatttcagtctttgctactgttgccattaattggtggccttcatgtggagactgcagaggacaatatacattagctccctctcagctcaaactttttttatatatttgtttgatttatatacatggagtaaatttcacgagaccttttataatatgtagttttacaatcaaattgatacttaaacatatagttttgatactacctacatcttagaatataacatttttttagagttaaacattctattaaaaaaaggaaaaaaaattgggaaataccatcgcaaagatacgtgagttgcaaaataccatcgtacgtgagaatgacatgtggggcctagacccacatgtcaatgacacatacgatggtattttccaactccgtgatttttgtgatggtactaggtaaattggcccttaaaaaagtaagtggaattaaatatgtaaaggctgtgctaggttacgagtagaaaattgatgggggaatttgaactgtaaaagaattatgattgattaaaaagggaatatgtatacggagaaattattatattttcagactgagtgaatagtaaaaatcatgatagcaagttgactacactaccacactttaacgcttcccgatcgatataaaacaaaagatgacagagttaagttaagatatgttgcaaacttcatcggaataacaagtattccctccgtccaacaatataagggattttgagtttttaattgcaacgtttgaccactcgtcttattcaaatttttttacaaatataaaaaacaaaaagttgtgcttaaagtactgtagataataaaataagtcacaaataaaataaataataatttcaaaaaattttgaataagacgagtggttaaatattgcaagaaaaactcaaaatcccttatattatgggacggagggagtagcacgtttttttagtttgattagcttatacatgtgggctggaacctactccttcggtctcataataaataaacattgtattatataggagtctattgtaactcactgtactggactacactatatttgtttattttctaatttacagtactgcaatacactatatttgtttattttatttggaacgaagggagtagcatcatatcaagcgccaatgaataatgtaggtgtcggatcctacataatatcacacagtgcaactgcattttcttctcatgtcctatctagtgatgaggtttttaattacttcatgcggcaggccaccaaactgcctctgcacttgtactacagccaattactacactcttttgccagcaattcatagtagtatgaaataattatttgcttgtgatttatattaattggttcctgtgaaattttccgatccaaatgagtattaattattatatatgattaaagtgtaattttgggagcaaataagattcgctaaaattatagttaagataacattaattattcagataaatatagactaagccatatctgtgattaagatgtagagcctcatcggtttgtccatatatatcccctaataaaccaaaacgatttattagggaataaaaaataatttatagttaaacttttatatttattcatagcgacttaaaagccaacgctaaaaagaaattttgttgaaaatatcttaaaataaactttaaaattaagtccaaaaattgaaattttggcttttgctttggcatattaattaggccaactgatggggctcgtagattcaacatcggttttcgttagctcgtttttcaagcggttaaatggtatgtttcatgcgaaaaccttttatataaaaattactctaaagtattagaaaattttgattttaagtttataataattagaacttaattaatcatatgtgaataactttctttgttttttttatcctaactatatcttctagtagaaacgaacaccatctcaattgatcagccagccgttgaggtgtctgaagaaaaaggaacaagctagctagctacaaacaaatttagcagctgcagacacaaatggaagatgctgcatgatatatgcattcagctacacagttgtggcgccaaagaaacggctagtcgattcatcagtaatgtcaatcaaatgtgtcaagcaagcatgcatgtgggcacagggaattgcagtggcgatatgatggcccaactaaaaacagaacgacgctgctgaatttgcattaacagatggtaagctgcctcattagttgattagctatctaattagttacatcgtcgtcaattagttgcacatcaactcgtagaaatcttctcacctaatccatgcaatctaattagcctgtaaattaacggcacaccactcaaatttttttaaaaaatatacttttttcattggatttacgtaaaaatacacgtttagaaaaaaaattgtagaagtataccattacagaacgaaagtgtgaaatcatgtgttaccatgcaacttcgcgcggcgagtgcacgacttcgcgcagtgagggcacgagactgctcagtctttgcacgacgagtgtgtgagaccgcgacttcgcatccctaactaaagcgctcgcaagagtaatagattaattagcattattagcaattaattaattactgttatttctttaattattcaggagaccatgaattttttttatttttaagactttttatgttttaattttattaatagaccattaaaaaaatattttcaaatctaaaccttttggcgtggccaaataactctgtcacgccgcatgcagcgggcatgacagttttgtcctgccacgccagcgagagcggcgtggccaaataacgctatcatgccagcgatgccgccgtggccaaataacgtcgtcacgccagcgagtgcggcgtgatggccaaaagtttcagatcttgaaaataaattttagatgggtttatttttaaaattaaaattaaaaggttcaaaaaataaaataaaaaaatttgagaccatgttgttggttggccaagcagattgtgtggtctctcgcccaggcttcgggagaccgcggtgggtcccgcgatctcacggcatggccaccggtatcgtcacgccggtatcatttttacacaatggttaagtaatatcgtgtctttttcacactcccactttatgatgatggtatatttatgttaaaaatagttgcatcctggatatttctgaggaaaataaatgaaaagtgtattttcaaatttaaatccataccactcactacaagaatccgtttggttgccaagatatattttcttggtggttttcagactacccttagcggttgttggctgccaaaaaaaattacagattcttgtagtgactccacgtcaccacgtgcgtacatccttaattaccatctatcgatacttccacatagctagagagggagcatgctaatctatgtagtaagatatatctaagctaacatattttgataattaaatggataaatctgaactgaagaaagatgccctacttttctgagtcaaaattatgtgtcatgcatcacgactcatatgcatgtacaggcatgcatgtacatctctgaacagattaagctgtgcataatatattagtatgctgaacagtacaatataacgtggccaaattaactacctagctagtctatcttgttgatagaagacgttgatgcttaatcagcttttgatgccatgcatggtagtaaaagttggtaactggttctagtcgacatgagaccttaatagtgttgtctttgttattttagtcagttgtgttctaattttacgcgtgcatgcagtcctgcattgtggactctgtgatcgaagtacacatcatgaagtgaacattgcacctagtatgtaatgtcttagtacaaaaaaatcagttggttaattaccatcaaacatatatattagagtcatggattttacgcacttcaactctaaaacataacaattaattgaaaaacaacagtttgtgcaaattattaattacttggcttactgaatttgatgcccatatataaatattgcttttttttcattattaaaaaattaaaagaaatatagtatatgttcagtttagctgatttatttttaccaaagtttcaagttaaatcctctttggcccacaaattttactttggatctctcttttacatttactttaacacatttttgctgtcatctaagcccaagaataacctgaaatataaaataaaaggatgagaaaaggaggtctaaagtgaaactttagtaaaacaaacttaaatttacataaaaataaaataattatcttctactggaaattttatattcatgtacgacattcatctactggatcaatattgatcgagctagcgataaaaaggttggagacagtatcgtctttatggtaaattaaagattcattgtcgatcggtcaggaatttcaaaatttaccaattaattatttagtgacgattgcaatacaattttgaaataagttattaaaaaaatatggctaaaaacaaaaaggttcaagatgacaccagttttacggaaaaacgatgctagatccgattggaatttttcatcacccaaactgcctctataattattatgataaaaagtgtaaattaattggtagcaaatataattatcatgtttagaactgcaaactaatacaaatatctgaaatacaaattaatgaaagatggcattattcaggtaactgtacattcagccgttgaggtgtctgaagaaaaaggaacagatgtacatgcagctattagagacacaaaggacagctgctgcatgcatatattgagctagctagctcccgtgtcactcatccatggcgccaaagaaacggctagtcggtttcagtagtctctcattcatgtgggcacagggaattgcagtggtgatggcccaactaatgaaaacggtaccttcgctgaatttgcattaacagattataaagttgtcgtgttaatcttcctgattaattgactgcctatctaattagttacatcgtcgtcaattgcacatcaaaatcgtccaaatcttctcacctagttccatcaaaaatcttctcacctaatccgtgcaacccaattgaggggagaaccctaaaattttcatattctaatccgcaccgtttctctctgtttaaaggtttttcgctctagctttaggaagtttcactgttacttgtttattattgatttatcaataatgggtttgttttttttatagaatttttgttaattttttttaattagtgtgtacagtgcatacacgataaaactttgtgtgcatagaatatttttactatatgcaatcatgcatgtatctaggttaattatatgatgcgtctttttctagcacaagcatcttttggtaagcacactcatgcatgagcatcagcatatatcgaaaaaaaaaatctatactatatatgctgagtcacacattaagcgccatgcatatccacagagtcacatacatctgaagattaataaaagttgtgtattgagcacaacatatataatgtggctgggacgtacgaagttgatgcttaatcagtatatgatgccatgcatgcatggtaactggttgaaatcgacatgagagaccttaatagtatgtctttgtcatttggttaatagatgagccatcactaaataaaggaacgttgctcgtgcagtcctgattagggatgaaaacggagtccgctccggacaaaaacagatacggataccttttggatcggataattctcggatatttcggatacggatacgaatacggatattttctcccggatacgaatacgaatatagtatcagggtttccgtcggatacagataataattcggatatccggtgaacagtgctattcggatatccgcaggacccatgagacataccccatttctttctaactctataaccttcaatatacctttatagattttaatagtagtttatctcttaacactagtccatactattaatattatttaaattttaaaaaatatttataaattatacctcattttatataaaatgagctaattatatatgttgatatttatttctattagaagttgagttggttttcgtgttccgagaaaaatttgtttccgtattcgtgtctgatcatattcgattcttattcgtattcgagataatccgtatttttttccgtattcgagctatccgtattcgttttcgtatccggtaaaaaatatgaaaacgaatatggtatgagcaatatccgtccgtatccgctctgttttcatccctagtcctaatcaagtgtgtgtgaaactgttaattaactgtagtacaacacatcaagagaagtgaaccctgcacctagtatatatgtcaagtacaaaaaagatggagtaagttgttacaggcaaaaacagattagcgacgcatcaactctaacatgaactaaatgcatgcaatggttacttagtttaaacttgaatctgatagccatagacatatatattggatttattcatttccattgtctaaaaatgctgtattattatttatattttagacaatgaatatatatatccaatatatgtttctcgataatcaggacaaagttgtaaatttagggggcaaatgagattatctgaaatataaaataagatgacattattcaggtaatttttattttgaaacttcttaattttcttaccttttcgcgcttcactttgaatccattgtcctcaatattattgccatccatctctaggtaggctaggaacgacaataatgtggtggtcaaggctaggaggagatcattgtgatacaatgagtctaacattgacaaaaggagtaaatgggctccatttgggcatccaaagaggaaaatgtgggttagaggtttaacatgaaactttaataaagatgaggagtccaaattaagtccaaactaaaatttacacaaacaaaagaaattaactctcttttatggggcaagtcatggaaactcatagaagtgaaaaaaaaatccataatacaaagatgcctcgatcgataattaatcaggacaaaggtgtaaatttaggggcaacgattatctgaaatataaatattaagatgacattattcaggtaactgtacagtcggacagccgttgagatgtccgaagaaaaggaacaaattaaccagctataaacggtgaccaaaaagcttcagacacaaacgacggatccaagctcctggatgcgttcttgctgcaacgttatggcacaaagaaacggctattcgatcgatttcactagtgtcaactctcatgcatgtcatgtgggtgcagggaattatattgccgtgcgatgtcccaactaataaaacggtactccatctaacccagttttccatctaattaaaatcatccctaaataaaaaacaccaaactaaagacatcaaaatattcattattctgatattaatcctcatcgatctaggtgatctctcgcttcgtgtccaacagaaattaattcacacattaaataatacatgggttgcactaatagagattaattttgttgcctgaatgcattccacgatgtgcatttactcttttgtaaaaataaacaaagagacacttgatcatatgatgattatttttggaaaatccccaaaaaattaggtgatgatacaatgctgaatttgatgcatgttatgctggctatctaattagttacatcgtagtcaattgcgcatcgatcaatttatcaaaatcttctcgcctaatccatgcaatctaattagcctataaattaacagcccacaccactccatatacatcttaattaattacgagcaatattgatggccgctatttttttcattagattgaagacacaaaaatactctctgtcccacaaacatttcacacgtacttaaataaacaaaaatatattttattttctgttttttctaaataaataaaatgtattttcattttacaatgctaaattaaatactcatcgctctcacgcgtgtattttttatatttgttacatgtgggataagttaatttcccttgctctaggtggaaggagagagagtaccagacacagagactttatttatttataggcattacaatcaataaaactcgttcgcgtttaattagagcctagataatacaaacaaggcaacattgtcatttcccgtcactaacttttttaaagaacggctagaaataaagtctttccaagacggagggagatcatatcaccgcccttacctgcgcataggcacaattgcaccccagtaaattcactactacgacacaaaccagttttgaagacacaccatatttatatttacaggtagctagacttaaaaaattacgcctgtaaaaatatagaaggtctctcggcaaggttccttagcgaaaattgattttcagtactgatgggtctcttaaaagtaccactcacaaaaatcgacttttggaaagcaatcaaccaagaggacctcatgtgaaaactaatagatgcgcgggcggatccagtcggtggtgatggatccaggtgatggcaaacgaatccgaggcgacggcagctaagaagagggctgcgacgggtcttgggggcagtgtagcttggtgcaacggagctcagcagtggtggtggagctcgttgaggagaaggaggtggtgcttgttgagaaggaagtggatccgaggtggtggctattaacaagaggggcggtggcagtggaggacgtcggatctggcctcctacgcagtgcgaccaccatgacaccggtaactgctagctcctccactctccctcccttccctcttttggatcaaacgaggacaggcagaagaccgcaacaataaccgctgcgatgatgatgatttgtgaatgctatgtgatttgtgaatcgaatttgggaatttttgcggattgaatttggttgggggtttgattgagagttttgtggattggatttgattggaggatagattgaggctatcaccaagaggagcagcgacagtggcgctgaacgatattttcgcaggaagacaacataggctgcaggcagccggacacccgtatgtgaaaatacactattttcatagacttcaattcgtaggcagcatggctggctgcctacgaaaattattttagctacctgtgaaaatgtttttctaagtgattgtttctattattttaattcttgaagacaatttttttattaattattttttagtgtcaaaagttacaatggatggactgttagttagcatggaatttgctagatgaagaagcaagcggcagtacatcttgagcccaatataatgcgacaaacggttcatgaagatgttgatgcttaatcagtttttcactgtcatacatggtaaccggttctgatcggcatgagaccttaatattgtctttgtcatttggttaattagttgatgttctattgctaattaaaggaacgctgcgttgcgtgtgcagtcaattcattttgtgtgaactgtgaagtacgtgctgtgaaatacacatcaagaagtaaacactgcacctagtatatgtctagtacgcaaatcagttggttaccggcaaatggacatataagcagacattacatgcacatcaactctaaacacatgcatgggaactgaaagcaatggttacttgtgcaaatgataacttagtttctacttgaatttgatagtcataattaaaggtgagatatttttcagattagttaatttatctttacgcatcaaacaatatttgggattccaaaagtttctttgatggaagattgaacaaaagaatcaagcaataggaggcaaaaaacttgaaaagatcaaagtaaaagggttaagacaagaaatgtccaatacgtcacatagaaaggtaaattgcatttgtagcgcctgaactgttcagttttgtgtattgaagcacttgtacctgaattttttttatttgagaccctaaactaatccggagcgtaaatcaagtctttccgttatgcctttcccttaaattgcaaatgtgcatgtatgaagcaattcagaactaagtatttatatattgctgtaggtaatttgccattttcttggagcatgatttacaacaagcaaagaatctgaaattgattttatctgtgtttgaaaagttgtctggcttgaaaataaattttcacaaaagtgaattattttgctttggtcaggcagtggaatattatgctcagtattctaatatttttggttgtaagtttggctcttttcctgttaaatatctcggtatcccaatacattttagaaaactgagtaataatgattggaaagtcattgaacaaagaattgagaaaaaacttagtagttggaaaggtaaacatttatctgttggaggaagactggttttgattaactctgtactttcaagtttagctatgtttatgatatccttttttagataccgaaaggggttcttcaaaaaattgattattatagatcacgtttcttctggcaaggggataaccataaaaaaaagtacagacttactagatgggatatcatttatcaacctaaagatcagggaggtttaggggttcataatttggaaatacacaataagtgtcttttgagtaagtggttgtttaagttgattaatgagaaaggtgtatggcagaacttattgaagagaaagtatctttataaccagtctataacccaagttaataggaaacagggcgattctcatttttggtcaggtctcatcaaggtcaaaaatactttcttaaacatgggttcttggattgtgaataatggggaacagataaggttttgggaggataaatggctaggaaacctggcttttaaagacaaatatccatctttatactctattgtccgaaggaaaagttctactattgccaatgttatgagatctgttccacttaatgtttcctttaggagaggtttagttggtcagaatcttgaatattggcatgaattatgtgcttctattgtacatattcagttgaatcaatcctctaattgttttagatggaattatcaccagaatggtagattttcagttaggtcaatgtatctagctcttattaataatggttatattgagagaaataagattatttggaagcttaagatggcgcttaagattaagatctttatgtggtacttgctaaaaggagttgtgctaactaaggacaatttggcaagacgaaattggaatggcagtttaagatgttgtttctgaatgaaaaacgagaccattcaacatctttttatagattgtcattatgcgaaatttgtttggagagcagttcagttctcatttggtttataccttcctggaaccatatctaatatgtttgatagttggcttttgagggttgaaaagaagaagagtaaactcatacttgtagaagcatttgccatatgttggactctgtggttgagtaggaatgatatggtatttgacaaatcaccatctatctcatatttgcaggtaatttttagggcaacatattggctccggtgttgggcacagctgcaaaagtatgaagatgatggagagcttatgaaggttgcatgtcgtaggcttgagacgacagttatgcaacttttttgcaaactatgaatggggattcacaaatagacttgaataaatgtgtactccttatctcggtttggtcttttattttgttgggtgtgtttaatttcattttgaactacactcttcgtttgagtgatactttgtaataattagctgtagctttgatgagcaaaggccggaatgtttcattccattatcttaaaaaaaaggtaatttgccatgacataagtatttactagaatgcactggaacttttctcatgaatatcactatatcagtgtaccactcccaataattcctcttcacagcatggcacggctaatgatggaacttgattagtagtatatattattattttgcttgaaactaatctgtgtgtccatgccgtatagcctctttttggctagcatatactgatcatcaataagggttttttctcggtaataaaaacttttattgaactaaacgaaattcatcgagagagaaattaaattatattgagaaacatgatatgccttaaatgcaaatgcggtaaacatatatgtagcagttaattgttcatggagcgaatgttttgttaattgtttgatagatatgtagcagcaaaatttgattttgaaattgtgcctcttgtcagaatggtcggtttggaaccatttcttttactagtaatatgcatgtacatgataattaggaatgagcctggggatgattgaggatacaacgttggatccagaggttactttctacgtacgcatgcgctgtgcacggtgggaggaggggatgtaagaagaacgactccatttttaaggtacgtagtagagacaatgggattaatttcagcctttgccaattataataaaagttttaggatgaatgatcgtgaattacaaaatcacaatcttattaaaaagagaaagttacttagaatactaccttaagggcagagattatacaacaacttacaagttacatatagtccttatcttcctcaaacaaaaaacataatatcctaaagttacaagtatatagtgtttatcttcctcaaacaaaaaccataatctcctaaatcagtggttgatcattgcgtcgaacgaatttgcatatatcaccatggatgactaacgtcaaacaaagcggaagataacgttaaagagttactgagttgtaaatcagttattcacctagatcttgccaccgtcgtagccatcaaagccgatccgattccaaggacgcccaaccagcaagtaacctccaatgtgacctctccaacaagcacaacatctacgatgtcaccatcactattttgaacatctagaactaaattttcacccaaaagatccaccatgatgcacaaaagtgtgggagatgacgtcagcaacgctgcctataggaagatgtgtggcgcccacatgctgttagaataaatgggctaggcccgataataatactaccatgggaattaaacgaggagtatctcaacttaaatagggagttattggaggctccctgttgactggttgaggtggggatcggaaagccacacgcgcgcgcgcgtgccgatccggccggccggcccgggccgggccgggcccaacgggtggatatctctcctgtgctataaggaaagaggcaacccgattagatcctcttggttactttccaactggtgttcttcctcctcctcgcgcgcccgtgctgctactgttctgcttccccgcttctgatcgcttgcgcgcacaagagatcggaacgagcagggcctccgaaaccacaccttcgcctaagatctgcaccgagtaggcgggtgatcaggtttttggggagtgcttccgcacgattgctcctcgtcttcgaccgtacgtcttcaccatgtctgccgccaccactgccgcacctagagatggcacgccgggagccggatctagcgctgcgaacgacaacaccaacggaggcagttctgcctcacgatccagcggagggacattcacagggtataaccttctacgcttactgttatttcggtttttgatatctctgttagtcgcaattctattgcgtacgatgtatgatgatgatgcttattctaccttaagcatgctcctgtttatgtttgattttatcactagatcatcccacattgttcatgccatgattattgtcttaatattttggattaaaatatgccgatatatgactatatttctaacacatgcatctcccatgtcaatgctcctagcattgacagccttggcctcggatctatggcaatctgaactcaacctccatctcggtgttgaatgtcgccaacagttttcctaagaacaatggcaattaatggtggcagccggacccgaaccggtgggaggtggctagcgatgaggtgcccgaacctctgtggtcaagatccatatggtgctgatgctagaggagatattcaaaggtggaggaggagccacctccccatatttccctgcctccaatgcaccagagtaaccacgtcacctgactgtagataggtgcaaagacatgccgacttcccggcaccgccctccttgctcgccgcatggattgttggcagcttgctccggcataggggagaaggagggttgccatcgcctttgaatcacccacgctgtgtgacacggaaaccatgttcctatgccatttcttcttcttaaacttagtttgatcactttaagaattcatttcacgaaatcacgtacttgggtttgtgcagattatgaattatcacagaatcacacttccttcaattccctttgtcacctagtaataattacttattggactgaccctaccagtcagcagtcctaatgcatcttcctcaataatcatctctattgactgtacttgccacgcaagcacgtggtaagctgccacacctccattttgttcagctacatgttctttctacaagcagcaattaacgaatagtgatggcgatgagaggaagttaatggtagcatatgatggagaggaagacatagtaatactggacaaaagaaagagcacgtatgtatttattatgaacgcattctcaatagcggcagaaagatggaagtgcatattgtatgatcgaaaataaaaaccaagccaattagagtggggtgaatggttggaacataaaaaccaaaacttttagcagaaataaaagttactctcaaactggattaaaccgcacttgttataccgctggatcaatgccggtctgaccgccgccggttcgactgcctccttgccgccggtgtgaccacccaccgattagactgcacaatgaacttcggtcaaaccgtcggatctagaaaaacatgtatcaatgaagctcttgaaaatagatcaactttattatatcaatatgttttacaaagtgcatctaatgcattactctctcaactcccgaactagtattgaaacctcgaagcaaatcgtaacttttctcccccaaaatatctatctcttttagcctcgacccctcttctattttccataacgtggctacccctagccatgaatccaactagaactaggactcctaatcacataggaaacttaccaaaccaaagaaacaacatccccatgcaactccacactctaatcttttcaaacttggggcttcaatccaaatttgactcatctttctataagcacataacataacgtatatgccatatgaaaaccttcacctccacaagcattgttatctagcgtgagcatcccgcatgatattttgaccgtatgggcctcaacttctccgaagcctaatcccgatcgatcaccggctatactcctatggcttcaagcaacacttgcacataaacaacaaagaaacttcatatccaaatataagtttgcactaacttgactcacatcagcacagaatagtatcacatatgaatagaaaccatctagaaattccatgaaaataacccaaaactgactcccttccggagattgtcggtctgaccgtcgggctacccagtcagaccgccccaacaacaccggtctgaccaagcggcacccgcccggtcggaccggctacccaatgtcgactacactacgcaccgagcgaaaacactacttaccttggacaatttgttcatcacatagattaaatcaacaccttgatttcacacatatactagtcgtgtgtacatatgtgtatttcacataattgtaaaaacatagtgtagttttgtgatacatttgttacatcagaaatgatagttaaacacaaggacgtcatgtccttgaagggatgaaggtattgaatttcttcatatttctcatgaaaaatattaggtcttgtgatgaaaataacacaattgccaatgactatataacaaaaaagtagattttgagttatcttcgtaaactagttgggcatacgatggcttggtatataccaagagcacactagttggtatatatgcattttgtgtgtgtgtgtgtgtgtgtctgtctagttggtatatatgcattgtgtgtgtgtgtgtgtgtttgtttgtttgtttgtgtgtgtgtaggtacttctttatctacacacctatagttgacgtaacatataagtgt

SEQ ID NO: 83274 - DNA, 9555 bp, Oryza sativa
tatggattggtttaggttggtttttttaagtagtagtaagccagagggctgctgatatttatcaataactgaaggagttaacaaaaacgaaagggcaataagataaacaaaaagatagaggtgttgtaggactcacaactacttcctccgtttcacaatgttagactttctagcattgcccacattcatttagatattaatgaatctagacatatgtgtgtgtttagattcattaatatctatatgtatgtggacaatgctagaaagtcttacattgtgaaacaggggactatctatcaggttttcaagcaatgaatacttgcttattaaattttatactttgaccatttcttcttgcattagttttgtgcagcgtcataaatataaccatataacttttattcatgaaaatctaattaatcattcaaaggtaacttacggtcatataagatgacaataataattaaccgtgttaattatttgagaacagagggagtaggaattggatgattttactatgtttgagtgtactccctctgtcctaaaattaaccaaaatcgtactaggagtacaacgagattggtctattttgagacggagggagtagatggtaaactaagagctcggctccctgccggcacaacggaagctggctgaaggccaggccccagctgagcattattgagccagtaaaactattgtacaaaggcgtttcggatggcaatatatccctcagggcagtgaagcagcatgtggccacaactcgatcgtgacaaatcaacagagatgttcgtgctttcagataacactagatggggctttgccgcgtcgaagtattgatgggctagtccaaatagcttcatcgcttagaatcttctttttttaaaactcttagagtcagttttgaaatgccttatgggagcagtaagctacaaaggggatggccattgactaccggtggcactatctcaattcaactagttgataccccacgtgttgctgcaggatagctatatcgtgaatttggaagatgtaattctagaacttttgactattggtatagtatcattacacagaagggaacatatagttgtaaatttatcaaaattgcatgatcaaaatggttgaacgttcgatctttacattgtattgctatatgaatagaaatggcatgattccaattaagatactcccaattcgaagaaccatgaacggtaagcaaacgggacactatttttatgatgtagtaaattgacttaacatctcatttagatattttaaacaactaataaaatatttctttttgagagaaaacaaagagaaaatatggataatgctgcatgcatatgttggtatatgatcttaaaaaacaacaactattgggtgcatgaatctagtaatttcaagaaaaatgttcacctataagtaaatgggaggaactgtggagaacaaatttagtgattgtcggtatgaaaagcacaaagatatggcatagccttttaatcaaatgtagagagtcaaatgtgagagtggaccaatccctcaatacttaaagttataaaaaattgaagttaccatagttgtgatacattggcatatgaagcttggtgataaccgaaaaaaaatcagatataaaaagaagcaagatcatgatagagtaccaaaaatcaatcaccataggagataaacattcttgcaattggtaaaggtcatcgagtgttgtaatctgtaccaacaaattttcgatgtcatctatgacagtgacaagccaaatttcattggacaattgacatttcctccttagatgattgaggaagcacgttcaagcataaatattccaagaaaatccattggatcaacctagatatggctagtagatgcattagaaaaattaaagggaatgagaaagaggtagacacaaatgtagtggtgtgggctttcgggtgggagatgtattagtggttagtgataaagggagatgtaatgatgcatgaggtaattaagaggaagacaaaaggcattgttcctctcagatgccatcggatgagaagaacttgatctaacggttgatttgcatagacgcaagatgatctaatggtcaatataatcttgatgatgcggcctcacagaatttgagctttatagcataaatgacttgtagtgggtaccaactatataggaagaaatgataggtgacgtcaacgcaacatgtacaaaagttgatgatcaattgattcatgttagtacatacattattcctttttctcagccattgtgattttagttgagtgcaaatcagtacataaactatgttgcaaaacaaaagtgccatgctacgaaactcaacaggcaattaaaataatctaactatctggttctcgggcagtgagcagatattagcacgttatcactgtccagagagcttcaagatgatgcgttcttcctagctacgtaaaaacaaagtaaacttacgggcggttcagattgatgccattttcaaccataccattttttttggtaaagttatcaaaaatgtgtctatgtttagtttgttaccaaattttagtaaatacataagaaatcatgcaaaaattttgtcaatattatctacgtgcaaaaattttggccaaccccaaaatttggtaaggtttatttcggctacaatcttaacaagcccttattcttgtaggagcatactgctatatatttggctctatgattgagtagaaatgatattgtttttgacaaatcaccatatatatcttatatgcaggttcttttcagagcaacatattagctccaatcctaggtacaactataaaagtgtgatgaagactacaagcttttgaagtctgcatgtcgtaatcttgagacgacagttatgtagctttttgtcaactttggattgagattcacaaatagaattcaataattgtgtgctctttatcttggcgtttatgagtttgtgttcgctttatgtttggaagagtttttttaagttctctttgagttgcactcgttttaagtgatttcatgtaataattggctgtaactcgtttgagcagaggccgggatggatttctattccattatctaaaaaagttacgtaaatctggtaagcaacaatgttccacaactgcaacggcagctgtaactgcaaattattggtacactatttgcctccaactgtcagtcatacacaaaatcataaatagcttacttctcatagatttttttgtcttactaaacctgtgctcttactgtattctgtagtaattggcatgatggatttgtacaagagacaaaggcaaatacaaaaacacactttagagcagaagagtgacactaacttacctgagacaacgatgaggggaacggttcagaagttgacggtattgcctatatgctttaccatcttcagtctctcctgttcagaagtccatttatatgaatgttatatgacatggttgatattaagtgttttaccattaggcagcataaacaaccatgaccttgtgcataaatatatctctggcatggcgtgccaaaaattggcaaatgattctcagagttaaataaaatgtcaaaaaattcacaatgaatgaatattgtatttcaagcttagtctagatataaaatctatttttgatcttttaacctgaacaaagatatcaagttgcagaacagaactattacaacattcatgctatcattatgcttcaggaatctggactgattattgtaacaccaagcaaatcaaaatactcaattacctgcaatcatagtagcatatgtttttgcacaccataaaccaagctctagtcaagtcacaactaataacatctttttgttgtactgtatagacattgttcatatggtcattctccgggatttaaaactgtacgttatgtataatattatctcatatgtacacatcttgatctatcaaaaccttaaagttgagaattggatatcagactcaattttcgttgttccaggacataacagtacaatatatgtatacagtaaaattatttagaaaatgacaagccttctaaaaagaaaattatgactgcgcagcatggcagacgatataaatatgttaatgcagcatgacagacaatgacatggaaagtttgtgtgcttgactactatgaatcagagtgtgtcaaatgacttgaagcaacaaaattcagatgcttttatactaattgggcaatgaagggtaacattttgatcacggtggctgatatattccaatgttgtctgtaacaagtataatttgtctacagcttgcttcataacgggatgaccatcaacacaattctctaagtgataaaaattctgcattcttattttgggaacaatttttactgattttccatctcaacgctgactcagaaattcagcattgaaccttgaattgtttggtggttaaccaatccactggtaacaattatcaaaatccaaggtaactgaaacataacaagatcggcgaccccaacaccaaatatgtgaaagaagtgaccatagtcaataaatgaattgtcaatggtgttatgcagaagcctggcagagaggaccgttgcattcgccccaatcttcgctagcagcatggctgtctctacacaatgttccaactatttatcgccacttgactgggtctaatcacagaaacatataacaaacataacaagatttagtgactcatacagaaacagttcaactgttgtagaaccaatagctaaagatttgagctcgtggaatgagtatgacctgaccagggtgaaccttctcggacttgaagaaggccttcacgatgagctcctcgtcggaagatgcggtgtcaagcctaggcactggcaaagaagacgagaaggaggggcgggttggaggagccattgaagcccgggtcgtcggcaaggactcctccaaggatggcgggcggcggggacgtgaggccggggctatgtgtgaccggccgagggatcgagaacggttttggggggtgagtgtaacttttttcttataatagaaaagatgcccgtgcgttgtaacgggtaaagactctttttcagtgatatattaagagctaagtaataaattgaaatattgggatcactatacactataattgaaacagttaataaaaatcttaacattgggatcgctatagattataattaaaaaaagttaatgaaaatatttcctgggtttttggccaaaagccttcctcctaggctagcccgctaccttcctccatttggtctgcttctcttcgaccctaccatctttaacttcccgaatatgactaccatcttcaacctcccgaagataatcccgtgcccgtacgtttgccagagcaaatctcccccatcaaatccggccaaatctttcttgggtaaccaaaattgttcgagggtttttgatccactcgatctactctttccgttttccccaaaatcagagcgtaaaactcgggataaaaatgaccggggaagatcactgtcatcatcggcaactgcagaatagatattaaatccagcaattaaagctgaatcgaagggtaaatcattgagaaaatgatgagagaggagtggggaatcgatttttacaatcaaattggaggagaaaacacacgatcgatatggcggcggcgcggcactaggattcacctcaggaggtgtgcggcgaacagatgggattataaaatcggatgagacaaacaaaaagcgcatgggagaaaaaaccggcgataaaaaagattgacgaaaaaaactaaaagcacccgagagagacgcggtgaatagatcggattaaaaaaaaggtaaaaaaccaaaagccttagcgtgggtgcataaaaaactcttatgcgtgaaaaaaaaagaaaaaaataccggtgccaaaaaaaccaagtggattttttttaactgggaggattttttttctttttctatagaagtagaacaagagatgtttttttttactgactacgacggaagctttttttttttaatagctcgttaactgatgtttgaaacgcatgcgtccaaatgcgaaacggaaagggacgacgtaccaaaatcccatggcaaaaacaagttaaacttttataatagtagaagataaacccttgtaactttgcatattacaatgatatccatagcagcgatctctcaccgtagatctgtgatcgtacggctgccggagggggagaaagctgtgccatgtggcagggctttttgcacccgaatccttccagaattcggtattagagattccactatacatgtttttttttatttttaaaccttttgaatttttaattttaaaacaaacctttctaagaacttatttccaagatctaaatcttttaaattctatacggtctaacatgataaaactgtgatgccagctgtggatgatgtgcagttttgtattaccacgttaggcgggctggtataaccaaaagattcatatataaaaataagtttgggagtattcatttttaaaaaaattaaaaaggtcaaaaagtaaaatctccaacacagaccagatataaaactttagcatgccagtctgaccggaaaaaaattctatggcaccgggtgccacctagcaagtatggcacccctgttggatttaagacacgtggctatacgaatctcgaaaccgtccctctcgtcttcttcccctaccgtgaaatctatgaatctaccatacaacgatgaagtgagttataccttgtctcttcttccatgaagaattatcaggactttcatttgcaccaaattaaatcaccttacacatgcgagaagtgaattatctgaactttctttttacaccgttacttgattaatcggagattaaatgacttgttggatgtagtatattaagttcggttgattaaactaattacctagcgttttggttccatgtattttcatagttcattggaagtaatggaggaacaattaatctgttttggatgaacaaggccggctgatggactactactactagtatcgcctgtgttgtaggacgagagcaacgcgtaccctcgattctgtgccggtggattagatcattaattaattagataggaagaagagacggaggagcggttccatgcggggaaattaggagaagcgtttcgaagcctgattccttgccggtgattagaggaagggaaggtagaagatgaagttgtaccgagatttgtgcgcggccacgtgtcttgaatccaacagggatgccatagtgagttactctaaggaattctttttttaagcaacgcttgcacagtacacatgacacactcgcacaacctggagtgtgcgacacatgctcaagaaagagagccaacaataaacttgtgaacatctccaggaggccagtttgataagccaaactcattacttactctaacagtttcttcatccgcacttttcattctgactctacgacactaagacctatatgtcaccctctaccacccttcttcctcctctttcccattattctttctcttttctctctctcttttcaccccgatggcggatggtgacagcaacagcagatggctaggtggccggcagggatcctggtggccattgactccctcgatctcgcccaaaggcagcgcaaggaggagccagcggagggggctgaggacctcgtcgtaggatctccgagcaatggggacagacgaggcgagcactggaggcaacgcagacgacgattgcgacggatggcggtgcagaccacgatgacgatggcagccgcagcagtggctgcgtggatggcgggccagacggacttcagcgaggacaacagccgcaacagtggctgcgtggatggtgggctcaatgataaccgcagcgggcgagacgaccacgagaggcaacacaaacgacagttgcgtggatggcgggctcgaggaggcggcagctatagggcgaccatgaacgcctcgtacgagcagagaggggagggaaaggaggagggtgtgaaggtgggatccactagataacaaaccggtttagctagccagatttggcttgcgcgtacccatgtttggttagctgcatggtaagactgttggagtgcattttttttatcaaacttgtcaaattttagcttggtgagccattcggtaactctgttgaagatgctttcactagccttgtttacatattaagcattatcttgttgtaagttgctcacctgggtaaggccattaatcactgatatttcttatggatcttctttataaaaaaaaaagaggaaaagacgatggttgttggagcaatgcagaacaattcaatccaagaagaatcttcctctcattatctgaaaaaaaaggaccagtcttaaacgggccggtggatgatcgaccctacaagaaaatttctcaatccattcctatatggaaaaagtacattcggtccctcaacttgtcgtcgagttacaaatcgtcctctaaccgttcgcttttgatcctaaggtggttttaactctggttttatccaacgtgacggctgagtcagcatgggccctacttgtcaggtgcccacgtcatcaccctctctctcccttcctcctctcactctgctccggccccagcccttgacccgtcgctgcacccgggggtccgtgtccggcaggtccacagcgtggcccctgtcccgcggcggcaccttcaccgcccgcgtcggcccggccaatgtcgacgccggcgcagcctccgccgctgtcaccaccacgacggccgccgccacggcgaacagcaacagcagtgaaaccctcctccgtattgcaatgtggcgggagatcgattggcgggtagtactatgaggaatcagtgcgagtttggagggaaatttataggagccgaattgggacaagatgggtggcggccggcgtgtccgctctgctcaccatcgcctgtttggaatgagaaagttgatgcagatatgtaaatatgtttagaattctttttgcaggtggatgaattcatctcgatttatgcgaaattcactaaatatcctcctgttttcagaaataaaagaatggattcagcagagatcacagacgaagacagttgcaatttttgtcgtgtctgaaatggataatgtcgttccctcgaggaggacgtggtcgctcaacaccttgtagcacgcggcgaggacgcgctccgtcacctcggtgcacacctcgatgccgtgctcaccgtcgacgaggatctccggcccgacgatggggaccagcccgttctcctggcagatgatggtgtaccgcgcgacgccctgcgcgttggtgttggcgagctgcgacggcttggacgccggctgcggcgagcacggcgacgaagggcgtcccgtcgcgacgaggacgagctggggagaagagcggcggcggccacctccgcgctctcccgcgcgtggcggcaccgctgggagtcgctcccctccgtcgacctgacccacagccgaggcgtcgcggcgtccgacgtcgacgcggtcctcctccggcgctccgtccccgtctgcacct

SEQ ID NO: 83275 - DNA, 24352 bp, Oryza sativa
  unsure (1)..(24352): unsure at all n locations
cccattagtagtaccacaacaaaaagagggaggaaaggtttttatttattggtccccattcacaagggccaaggcctacgcaaacgcaaacccaagttgcccccgttttaagtggcttttttgtccggggaaggttcgggtgcgttggtgtacgagggggcgtgcagacagtcagcggcctgcagcgcgcatgattaggcgctgcggaaagtgccagnnngggtngggggggggggcaggcagcgatccagaggtttattcgggggtggtggaggtggactggtggtggccgtggctgtggctgcctcctgcacggcacggtgaaaggatcagcagcagcgtcgtctctgtcgatcgatcgatcgatcggcagacgatggatggcgctggggttgggttgggttgtgtgtgttgttgtgcgcgttccatctgcatgcactgcgtgcggtgcctgtgctgtgtgctttcgaggttcgtttgaataatggggtggtaaaaggcggaagagagtttcggggtttgggggtgtcgaccgacttgtttgttgccggtgtagggtcattgcctctcgacctatggaggtcaggtacggagtggtatgtttgtacgttacaacggtgtttatagcttcaaatcttacagaatctttaactaatggatacaacctgttttaaatgaaatgaaaaaaaagatgaatatgtcaaaaatcataaatctagagaaataaactgttctaaaatcgttttgatgcactctaattgagtgtaagtattatataacttactccctccgtcccgaaaaaacgaatctagtactagatttgacatattatagtacaatgaatctagacagaggtatatccagattcgtagtattaggatgtcacatttagtattagattggttttttatgggacggaggaagtaagtattatcaagtataagtgtgttataactgagtgtgagtgctatgtaacgagtgtaactgtaaattgaatatataagaatacaaatcttgatggatgatgatgcaacattctacagataaaaaagtgaaagataaaagcctaaaaatttgttgcaagcgaaaatagtaaaaccgttctttttattccgttggtatcgttggttttcttagggaagtgatgtgttatcggttttattaggaagagattggttttattaggaagagattggtttgtttatgtgaaaggggcgggatggaaggaggacgactatgcttttaaggtagcagataaatgaaacgcatttttactacgttacaccgttaaacgatgttttatccgtttgtgtatattgggtaagccaagaggtcagttgccatagttttgacattttttttgttctccatcgtaataaattataatttgcttctttttcattacctggcgcctccatacttccttggctatagctatgcatggccaccactatccaaccacagcaaactaaccagtatcctctttgcatccaccaccctccaccgatggcaaggtactccctccatcccataatataagggattttaagtttttgcttgtaacgtttgaccactcatcatatttaaaattttttgaaattattatttattttatttgtgacttactttattatctacagtactttaagcacaactttttgttttttatatttggaaaaagaatttaaataagacgagtggtcaaacgttgcaaacaaaaactcaaaatcccttatattgcagaacggagggagtacttattaccagttcctcaatcacatctagatatatgtaggtggctttaatagttttataatgatctcataataaaaaattgacaacataataattatggtgatataagtattgataggtccgaacagacataaacaaatcttgtcactcggtcacatgctagcttcaaacaacaccatcttaataatccaaaaactccggtcgaggtgtctgatcatttggcgggagtgttggagctgctcctaacttttggagaaagatttttatttttatttttttgagaagggtattttttaggggcatctatatctaaccggatacatgtggtatttttaaattaggaacttagactatcgaacagggaacttaaccctcaaataacccaatctgaaattcgctcctacggagatttaaattcaggacattgggtgctacttagatcagtgcaaccactaaactacatgccgtttcacgagaaagatttttatacattttaatgaactatcttgcgataataaatgatttatggattaaaaaaataattctttgtatcattaacatgggccagggcctagctacatcaatttcggtttcgtgtagagttcttctttctctagaaaagaatatccaggcagaggtatttccaacattactctacgcctatgttgattgcggtaattctaaaaaaaaaaaagttgatcgcggtcaacagacggcttcgcttgtggtcaccaatttactttttcttccttctggaaaatatcttcactagattctacggttggtgatctcagtcaccgagttttcttctttttgtttttttacattgcttttcgatcgcaagatatacatagctagtatgtacatgcatgtaagggccggacacagggtatagttactatccctatttttttaagatatgatactgttgattttttttaaattttgttagactattcatcttttgtaataattaggaaggtagcccacgcattcgcacgggcatgtgtcgtacgttaagtttgagatacttataaaagtgaaatattaacccgagaacacctcccatgatttctctataaattgttttcgtggcattaattgcttttataattttataacctactagctttatgttaaatcatatttaagtaatatctataagcaattatttattatcttcttcatcatttgaaaagaatatagtcttactttatttagaaaacatgtcaacgtaagtaaaagtaagttgttttttagttgcatatatattatcatagtttactaaaggatgaattggatgggacatgaagctccaataaatgtatgggtttatatagcctaatataattgatgtagtttgagagatgatctatttgtgaacatttcatgtagagtgagtgagaggctccacacaacctaatatgaatacgataacgacaaaatataattacgcaataatattttttaaatgtgatgtaccatgaatacacgcttgtttttttatatataagatcaactgatttaaaatgcataggagtattccatatatgtagcttatggttgttttaattatgtggttggtgacttacggacactctggagggtctttaattgatttttgttatgtacaatgatttagtataacacaatacatattttcaattaattttcatgtttatttagtgttcatgcaaacggtagggtataccttcaaatgatatattttaacttttatatagaaaaatatagctaatgaatgtttaattataaataaaataatagttatgattgttttatattatgttagttagaaaaaaaagaagaggtgataattgcattggagaggagagaatgcgagagccacagtggtattacgaaagacaggatgatgggaggagattattatttttaagatagatcgaatgtatcctataattttgagttatctatttttataaatacatttaatcttagatctaatttaaaatactttgggtgttgtattttctaattaaactacttagattattctaattttagtgtattttattaatcagaaggtataaaatctatttgataaaataataataatttaataatttattggttaaaaatattcggtctactttgaatttaaataatatataaaaaaaggagggtggacactggccttggaacacgtacgaaggaggtccgtttgtacaaaagtgtataggacggtgatttggttttattttttttaacataaatattattataaattatgatttccatctaactaaaatagcatgaaaatcatgaaaataggagagaaaagggacagaggggagggcgtacacaaaaggagatcacgtacatggaaatgtacgtatgatatcaggtccaccatataattgtaaatctaatagctgaaaatctaaaatagtggatccaccggttaattagattgccgcatgacggtttaggaatgtttttaggagtacacgtggtggtttgggagtatttgtcggaagacatggtcaatagtttttttttatgtacgtacatatgcatgttttctttttttttttccaaataatagtctcctatacatgcatatatacatacatatattttatccggatgaatagtatatatttatttttccctcttgcaaatacacatagattagaagagagggccgggattaattactttaatgatttgatctaatctattctacacctgtacatgcgtaaatcaattgttatatatttatgtgactacatatacaagggaaagtgatgttacgtgtgggaggaaggaggtggaggtggaaagattttgtagataaatctaacggcttgaaacaatgggtctaccgattttaatcaaaacgaatggacagatgttttatttttttcttagaatttataggaattttttttatttattagaatgccatgtggcgatttaagagtgtttgtataatgccatgtggcggtttgagaccgtttataggaataatagatagatagatagatagatagatagatattcaatcaaatagacaactacaaagtacagttatttttattttagttaactaaataattcacgacccggtgaacacaattgaggtgcaggagtgcttctctcttcattaattgttcttcgatttttcatttctattttgcggttttttctttctttccatttcaaatgtaaatgtacagttcatgaatactcccaccgtactataaaaaaaccaacttaatattgtatatggtatattatgttcagattcgttattttaaaatgtgtcacatccagttatttatttttttaagtagctttaacaattgaatttacgtacgtacgttaccgctaattggccggttaccgctaagatatggaatcttatctcaacccgatctgtcaattccatttcccatatatgcactgctcctctcatttggtcggcgacgtatgagatctaactttaaatccggttcaaaacatgcatccatcgtgctgtacgtaaatgaacttcaaatctttcaaaggatatgatatatattcgctgacctaacatgattactactctctccatcctatataaaaatacaaacttctgagttgttctttttaagtttactagaaaaaaatatctatgcgttataatgggtaagatattttttgaatgtatatgttatactcctttcttagttttgggccgaaagcctatccctttcttctttttcagccctagcccaatgtgctgcctccctccgctcggcctatctctctttggcccaacctacaggtggagccatgggactagctcacacgtgttcaacctccagaagatggtgccgatgatgccggagctaattctcccaatcaaatccgaccgaatttttcttgatcttgtataattggtttagggtttttgatccactcgatcttcttattttttttccccaaaatcaaggcgaaaacttggaataaaaataattgaggaagcttaccaaccggccatcatcggcagcggttaatggagattaaatctggccaattaaagcccaattaaagggggaaatcatggggaaaatgatgagggaggagtggagatcgatttttgcaatcaattagaggagaaaatgcatggagagacatatcgatgtggcggcggagctagggtttggcctggcgaaggaaaaaagatggtgacaaaaaacggaagcccttatcgtgtgcgagaaaaaaaaccgcaacgaaaaaaggacggcggaaaaaaccatatgaaaagaaaggaaaataaaattaaaaccaatttaaatacagatgacgtaccaaaattttggtgaaaatatttttaattttcataataaacatattcaatttttataatagtgtagatgtgacttatgtccagattcaaaattaggtgctgttttcttttttaatacatgaaaacactaaacatacattcgcttacctaagcatggggtaataaaatcatttggaccgcctcatcactgaataaatcacccaaggccttgtatcttctccggttatatatgcatctcattctgatcaatggtttaattttctgcaactccaacgtctttattcatatccactttcccgccaaccactcgatctgcgacaacggcagtttggtagcttctctgttctatcgatccgaactattccggagttggcaaaacaataggacagatgcaaccgagatggggacatttgtgcttcactgtatgtgatcttttgtactatagcttcacttccaatgcatactggactcgccacgtgctattgatatcggggaaaaaaatgttgcggtgatttcctcataaatgaacatttctcttcttttgagtactgaaaaaaaaaataagagaacattaccaaggaaatatagaaatgtaaatatgtaataattttcaaaagaaagaaaacattttgcaacctgaagcctggacgcctaaggacgggccgggagggaggcagcaacaacaccaagaagtaataaggagggtataggagagagggcaaaagcagggaggactgtgaggttcgggaagaggcatgtggaggaacaattgtggctgagagaagggatgatgcgatggatttagggtgcctagttttttatagtagacatgtttatgttttggatggcttatttacgtaggacgtgtttggttgcctgcatctaggttggcttgcatctaacgtacaacgagaggtgtgtttggttgcttgggcgcggttgagagcatgtacgcgcgggtgcaaaaagcatcgccgagccaggccaagaaggaatgtgggattcaagcttcgctcctcaacttggcctaagcgtgggtgccacgaggcatgtgtgggtgcaagggttgtgagtcagcttacctttcttgcctattctcgcacctcaatttctcttccactctcttttgagccgtcgtcgtctgcttcgccttgcgaagtaccgccaactctgagcatggcaggactcgagctaggccagctctaatggagtcccttccctgcacttaatagttgccacctctagccttcttcagccacctaatcaccaaatctggacgcatgcgacaagttgctggtgctagagggattgcttggtaacaaggattggtgcaagagttatatggctggggaggtggatggagctacgtggctaggaaggggggtggaggaggaagaagagggcaacatgatgggcaagaatgtcaagaaggttaagaccgacgccgatggtgaagaggatcaacgataagatccacatagattttttctttgtttctattttctgtcttgtcctaaccgggtttattaaggcagtaatcttgactgatggaagcggataagaagttttgattaaacactaattttgtgattgatttaggcattcactgttcttatttctcatttctacatgcaagagattttatgaaatttagtcaattgaatattaggtatgtattcattttcatccatgaatcataaggggtaatcttaacatacaagataagcggtaaccaaacttaaccatcatgcatccaatcaaaaaatctcttacatacagtatttgttgtatcactaaccaaacaacatcacatatcatccatgctttactgatacgagcaaccaaacaaccctttttgcacccacccatccagggcggggtcagcctagataacatgtacaagctagactagagtgttacgagcaaccaaacataccctcatatgttgtgggctatatgactatgcaatcaatttaccatagtggtcggttccttgttctgttataattttgacatcaaaattgaaaggagtagctatatttatggctttatttttttatcaaaaaatagtcaaattatttttatgttgtaaattacctacactttcatggtagttcactgtaaattttaaaacttacactacattgtaagttttaatatttatattgtaattttttaatacacaatgtaattaggattaaaactacttaattatattttaaaaaatgagattggagagatgaaagtatgattatatataggagagaacaatcacagagagaaaaattgactgaaatttagcgagcaaatgtggcgtaataattatagaaatcctgaatttgtataagtgggattgcaccacttaactcgacagtttttaaaactatatacgtagtgctataaaatttacaccatatgtttcagccaactagccaaaaacagaggtagaaattttacaaactggagcagataccaaatttgttcctttttggatggtataacttgtaggcgctgcaatcttcacataattgtgcgttgacgacgctctttgagctagcagtagacgtggccctcaccaaactttgtacaggtggctccctaccgaattttcttgtccccacgtgataattgcacggatcaaattgaaggccagcttctcaaagcgatcgctgattagggcacattcatatctccgatgttggccatgcatcatcatatcatagattaataactattgctaggttaaaacaagtaaatgtaagcttgtaggaagtaaataagctaagtactgtaacctccagcttaatttgcatgtactgttctatttagtacatgtttacctacattgcaggcaattaattaggcaaagtgttaatagcacctcccgaccaaacaatctgttggttttcaagtgcaatctacactgcgtacttgccaagttttgacgtactgtttgtaacggagagttttgtctcggtttaatttacaacaataactctatcctgtcctgctatataagatcagaaacaaacataaataatgatactgcattggccaacgatatgatctctgaacaactgaatgaagtgtactccaccaaccagtgaagttatatcagctatatatgctgattaattaaataactccctaatccacaatgctgtatagtacagtatcatgttatatctagctagtaattagatgggaccttgcaacctcctaatgaaagccatgcgatgcatggacccgtttaatcactagtgttctgtgttcaacctgttcatcagatatatgtgcattgtcagaagccgttgatgataaatattaatttgttctatgcatcataaggtgatagctaccttctaaccctctccactagcttggcaggaactgaaggccaggcccccccttttgtggcacaatatattgatggcatctcaatatttatgtttgttctttaacttttttagatcaaattttctgttaattgcgcctttgtaaaggtttgatttgattgcatccatcacgcaggagttaaagatggctttcaagacataaacatgtaaaccgctgatgtataccattactggttggcttctcttctgttgggtaaattgtttgcagtaggacttcgacagctatccatgatcatattctgcagcaaatcgctctcgccactgcagaaatttgttgaactggattgacatatagatacaatcgtttagtatggcattgtactagtgatgagaagataaagagagggcatattttactctacatgttttatatcataagatgttttgattttgttatatcaaatttcttttaactttgaccaaatctataaaaaaacagcaacatttttaacacaaaacaaatataatatcaaaatatattcaatattaaatttaataaaatcaatttgtattgtatatttataaattgctttatataatatgaaacagatggaacagtttgagaagccagaaatcgtactcatagctgctgggcctgctgggaaggcctttttcggttgcagcttataatatgtatacatataaccggaacaattaaaattattttagggaaaaactgtttgtccttctactcttttgtggtccaaaaggataggctaaagaaaaacagaaagcaacacaaaatccgctaaatcaattctaaaaataagtttcaaacttcagcaatggccgcaactggttttattaattgagaatactatataccttagtacctaaggtggttggatatatatattcacttgttttttcatgtacaatggactattatgagttgaagattgactactgcgttagaacaacccatttctttagttccaaacataaatagcgttttcattttttttatagaaacacctctggttgtgtttgcatcatttttttaatgatgaaagctttatcgatataagataattacatcacaatgatataattactccaagacaacttctagcctttcacgatttgcatgacttaacacccggatttactcattggtggtcaaatcctgatctccaaagttatgtatattcggttgttgtgtctgcccgttcatccatataacctgattaaaaagaagtaaaataattttcaaggaatatatgtccttatatatcttttatatattgataactcaacaattaaaatcgatacaaaataactcctcacatgttttgaacatgttttgagagtggtttttgttgatgtgactcattgatttggtctattgagactatagaattttttatatttttttctccttatcacttatatgtgggctacacgtctacatgtctattttaattgctccaatgatttgactggcgctaccacatggatgccatattagtgaaaacaactcttaaaacaataaaacaataagaaggccacaacgcgtgcgctgtctgccaccccggcttggctagaatgctgacttatcggttgggctacagcgaggagggggagggtaaaaaggaggtacccattgcatttttttatttttaactagatattcattgacacgtgggtcccgtaggtttttccgacattaagtgccacatcaatgtcatataagtgccacctcagtcaaaaccaccagctaaattgtcttagtatattatttgcattggttttaaaagttgagggacacgtcatatctgattttacggttagacgaatttaagactcagccacaaattagtgaacgaaaagtgaacttattcccagacattcatcgaacgcagcggaggaaatcacaccgtcacacgagcagatgggcctgtgcgttgatctgccgtgaaaaattttgcgccaggcaggctgatcaagtgccgggccggacgtttggggtcaggcccagtggtttaggctagcctaatactattagattgttttgtactgtcccggccggccatcagaattttgactaaggccgtgtttagttatttttcaaaaaaaaatttaagcatatggacacacatttaaaatattaaacgtaaactaataataaaataaattacatattctatatgtaatctaccagacgaatctattaagcctaattaatccgttattagcaaatatttactgtagcaccacattgtcaaatcatgacgtaattaggctcaacagattcatctcgcaatttatatgcaaactgtgcaattgatttttttcgttcatatttaatgctacatgcatgtgtccaaacatttaatgtgacggaatgtttgaaagtttaaagggaactaaacacagccttaaatctaacttatttacaatctatactgtgaatacatgatcaaccattaggtagttttactttccatgatatcgtacattttcacaagctacgtactttttgccatcagatatagtttgaccctcccgcacatatttatgtatttaaattaggccacctttacattggacattcctgtcattaataatacggacggtagattataaattattatggattttctaaactcctaaatggtacctttgttgtaaataaattcttcactattacttcttagacaagtttttaaaatcaacatataaactttttatatctaattctttcgttagttttcttgaaaaatcaactcagtattaattatccatcattcgtcatctatcgagacagtatagtacatggatttttcaaggttttcttcaacacaataaaatacaacgtactgtatgtctgaagttccacggaaatatataaataatacatgcatttttttattcaaattgtatgcatgtctagaatattgcaaaacgttttgtttgctttgtcttatattaattcctccacaattattataaggaataaaaaatcagtcatgtatgaaccatgcataattatgatgtgccacatttacaagtactagctagccatacgcactaaaaggattcacttgtcgatcaactaaaaatatcagtttgatcgagtccgtatgaaccatgcaattttgtgaggttgtacgtagcagtaattctcagttgtcatataggccctgtttaaatgtttagttccaaagtttttttttcaaactttcaactttccatcacatcaaagtacaaacctttcatacacacaacttttctatcacatcgtaccaatttcaaccaaacttctaaaattcagtgtgaactaaacacagccatataccacctttcaatcaaactacgtgtccccatcacgtgtcattttcgttccagcctaacattcgtgcgcatgtggaggtttttgtaatgattaagagaaccccccaaaggaattaatgtttgttctaacttaacactacaagcatataattacacatagataccaccctagatagattaattaggttatgaattaggcgcatcaatacgcattatattgcaaccggtaattagcgtgcacatcgtcgtcaagtataaatgcacgctttatatatttacatgtcttatatataggttagctagctagctagacgtcaatcatttttttttctcaagtagattttttcactggctattggctatagctcgtagccacctcccgagttggtcaagcggtcggctccgccatagaagttgctactatcctgacagttcagtagtattgtcagggaatgctgcacatttactcggggccgtcggctattaagtttccccgtcaggaaaagtccattttctggtagtgaaattcccactatcgacaacatatatatataaaaaagaaaaaaaagcacgaattacccccctctcccgaactatcgcgatcgaccgaattaccccatgaacctaaaaaccagacatcgttcaccctaaacttttaataccggacgaattacccctcgacccaatccaaaccggttttgccctacgtagcgtacgcgtggcaatccggacaacattttatttttaaaaaatggtgggacccacatgtcataccccctctttctctcttcctctatctctctctctctctctctcttggtcagtcactagacagcggcgcgcacgccggcatgcatggcacgacgtggggatgggcggtgggcaacggcgtgcgggggcgggccggcagtcggaatgcacggcgtcacacgggcaggtagaggggatgggggagggagaggtcggcggccatggtggagaggcggacgatggccggaagcgtcggcgaggggaggtagaggggatgggggagtggaggtggatgggaaggtggaggaaatggagggggcgggccggcggcggccatggcggagaggcgggcgacagcgctcgccgtcgtggcgctggcggagaggcggaggtccacgaggtgaaagccgcgcgccatcaccgaccgctcggtctgtctctgcctccgcttccgcctctatgagctctacctcagctgaccacctagacgagctccgctttcgctgcctccgcctggtccgtccccgccggcgactccgacttagagcagcagggagaagaggaccgccgtccatgccatgagcgccgccgtccacgccgaccgctagactgcccgccctcgttcccgtgccgccatgcgcgcgacgcgccatctcgtgtcgaccagagatccggtggcgggcgatgggagaagaggcgcaagtggcggggagatccgccgtgctcgccacccgcagtggccttccggccgctgccgcccgcgcccctgccaccaccgccgctcgccacgcccctgtcgcgcccgccacccgttgctcccgtacgagagagaggaagagggaagagagaagagagaggaagagagaaagaggggtatgacaggtgggtcctatatttttctaataaataaaatactggctggattgccacgcgtacgccacgtaggacaaaccggctctggattgagtcgaggggggtaacttatctagtattgagagttgagggtgaacgatgtctggttttcggatttatggggtaattcggtcgaccatgatagttcgggaggggggggataattcatactttttccaaaaaaaattatcaatcactatcaaacgctcttcgtcggctggattcaacctgttagatttatcactagggctaactttatcttcaaattttatcttaaccctccacatgtatatacgtgtgaaaagagaactagtagaagtggaccagcccctgacaccctaggctatggctcgaggcctggtatcaaaagcccatggaccgcaataatttttcgatcatatatggattagctttctatcagatcaccacaggtccgccctaacaggatgcttctgccttccttgattgatcatcttgttaatttgctcttcctactcgtgtcactactacagaaaagccttcggtgccggttggtttcccaaccgacattacagagacggcactgattacttggggtcaaaggtgccggttttaaaaccggcactttgaggcacacatgagccaaaaaaaaaagtcggctaagccatcaagccgatcccaaataatacccaaatcccaaaattacatcaaatccatgaatacatcaactaaattgcctcaaatccatgaacacatgaactatagtgaataatccccagaaaaacaacacatctaacatcaacaaatcacaaacaggaatcacatcaacatcaacaaatcacaaatcacaaagagggaggagaagagatggatccgtggtcgccgactccgtcgcacctctagccgcctccctcccggcggcgcatcccccgtgccttctggtgccgcatgtcgcctcccttccaccgccgcatccccctcccttccgccgccgcatgccgcctccagccacagccgttgctgggccgcccctccgggccgttgtggcaccatctaccctcctgagccgctgagagccccgccgcagccgccggaccaccaggccaccaccgcaaccgctgggccgccaggctaccgctgccgccacgctgggccttctccaccaccgccgttgcggtcggatggaatgtaggggagggcgccgccaccacctcgcctcctactgtctggctgcagccactgagccgctgccgcctgcccttcgtcgggtggagaaagagggagcgagagagagagagagctaagagaggggaggaggcagagagaagagaggataagggacaagggagatgagagaataagggagagagagagcggaggtaataaaaagatccgcggttttcttaataggcgtcgtttttataaacaaacgacacctataatataaatataggtgtcggttctttaaaaaaccgatgctggtattatatatagatgttggtttttagttaaaaccgacacctatctctttataaagatgctagttctagccgaggtgtcccgtggatgcgcgtttgggcaggaaaaacattataggtgtcggttttatctgtttcgacacctattgtgccgacttatatgtgtcttttttatagcgtgttcatgtgtgcctttttctaatgctccacccgatatattgatctagctactaaccaacaaccgaagtggaatccaactcctcgcctcgccccaattgcatcgcatgcacgcatcactcatcgatggcgatgggaggcactagcagctacgtacacttagctagctaccttctctcgatccctttcgcagctaatttggctgcaaaaaaaaaatatatattggcacaacatatctgagattccacttggccacttctggtgtggggctgactgtgatccaagctggccatgcaacgaccaatagcggtgtaggatcggatcgcttcgccatctgattaagattttttgtttctaatgagaaacttccctcaataataaggtaatgaagtagtctatatattattgtttgttttgcgattacgcgtaatgcgagtgtgacacactgttatctttttagttgtgatgatttagtttaagatttctgatcaaatcaggtacaagaaagcaaagggctcttccttttgttaatgattgatttgtggcttgggtggtagcacttacttttcgatgcgataggctacatagatgcacgcatgcattgctcgagttaacagagaggttgtactgaaggcggccggcctggaggaaggagaggtgtgagaggagaggagctagattttgctttgcaaagtacagactgctttccgctttctgtatagctcaagggcggtaccactaactacttctttagttaattgggctacagtctaatcgacaaaatgctgaatccactacaactaagcagacatattcaaatttcttttttgggaagagttgcacgttatatatgagttacagtgtttccttttcggtttgtttctttttctgtgtatctcagttatgagatggaaagtgtatccaatcgtgtaacctttgaaaatggacacaactacaaaatgagatggaaagtgttttagatatagaagtcggatttctatgcactattttaaagatggggatagaattggcgaaggaaattcttgaccgacctagtcttgtttctgaaaaagcgatgccgtttcgatatttctgaccctagccatatataaaatgaacttcctaatttctttcaactccgtgttgtaatcatcactaaatagctaaattggtaaatatgaataattccgacaatgctcgttctcggtcgcccggggggatgggaaaaaaaatcgatcgctcccctccccctacgtgcgcacccccactggacctatccacttttccctccccttgttccacaaaagatatttcacctagtgtgtttacaatgtttcactgtgtatatatctaatgttgcagtgaattaaaatattcttttacaacaaatcacccacatattttggaaaccctttattaagggaatttggtttattttttgttccaccaaaaatgttttacctattgtactcacaatgtttcactatgtatagatctaatgttgcagtgaactgaaatattccattgtaaaaaaaagcacaaatatatattttggaaacccctattaagggaattcgtttcattttttgttccacagaaaaatgtttcacctagtgtacttataatgtttcactatgtatggatcaaatgttgcaatgaactgaaacattctttcactatttgctgaaacattatttttatataaggtgaaacaacacccaatttaaacgagtgaaacattttcgatctacttagtgaaacaattctgatatacctggtggaacatcgtgcaacatttaaaaataattcaataataagctaattttttttgtcagaatatattcatgtgtggtcttgttttgaagatttaattgcaacgaatttaatggtgcaatcagatcatgatttggataagtaatttaagagaaaaatctgtttaaagtagttttgcatgtaaatcaggcgctgacgtcagcgcccaattttaacctcctcttatcgggcgcccgacccggagtcgcgtccgaataattcccaaacgattgaggaccgttctcgttaaaatgatatcatttatgcgattgttttcatccctagttataaacaattgacatgcatgtaaatatctaatagttcattgaaaatttatttaattggcttatttggtttcctacaatacaaaaatatgggcaatgccaaatcatggcactacttaaaaaatggtaaaaggtgctggttgggagccccacatggatgctggatttcccaaccggcgtctcaccggcggttctgatgagagaatcaaaaggtatggtaccgggacctttgatgttacacgaatgaaaaaaaaaggcggcttgatgcactagctaatcgagccgatgcatcgagctgctctctaccaaactcagaccaccatcgatgaaacaacatccacaaagcacacgacataaatcatcatcgatccatccaacaacacagtacaaatcacataaattttaatggatatccaacaatttcacacaacacaaattgctcactgggacatcgaggttgccgttgatggattcgtcgaatccgcaggagtcgctgccatcaagggcatggacgccacgacgccgcagcggtagagatgggaggaggagggtctgcgcctctgcggtggtggggtgggagagaaggagagacactgctaccgccggatccacccgcaggagaagccaccgccggatccacacgtgggagtcgccgtcgtcgcagccgtcccgtaggagccactgccatcgaggggatggacgccatgacattgcagcggcggagaggggaggagggcaggctgcggtggcagggtgggagagaggaggagagactgagagcgcggaagatgagggggctgcgagaaaggaggataaggatgaggaaggagctcggtcggctcggctcagtgctatcaagaatctcaatatgtgttggtttactaaaaaaaggcacatatagtacactataggtgccggttaaattaaaaaaagagtaaattgcactggcggttcttaaacttgtaacgaagtttcacttatatccacaaacatgagaaacacgcatcgagatccccaaatttggtttaatatattatcccggtctaaagcctcgtttgaccgtggccttgcctacgtggcatgctacgtggacgatgacatataatttctttactcccttcttcctttttttctcccttcttatccctttttctctccactttgcatccttcctctcccttctaccgctgacaggtggggcccacctgtcagtgcccggcgaggctggtgagggggcggggagaccggcggcggcaatggcgtcgtcgacgggaaggagaaggaggatgggaaggggaaggcccccggtccgaagtggccccgctgcagctgtcaagctcgtgcccgccccgctcgcgctgagctcaccgatacctccaccgcacacgtggccgcggtcggcgacccctccccaagggcacggctggcgacatcaccccccgcgcgcgcctcggccgcttccgcatgaatgacgcgccgccgcccaatgaagtgcgccatccccctccggcgctggttgcaaggccataccacccgctcctcaccatcgccgtcgtcttgggcggcggtgggagaggaaatagtgggagaagtcaaatgtcagcgcagcgggaggagaggagccgcggacagcggctgtctctccatctcctcccctgtcggcctctacccggggctcctctcctcctgccaatcggcgcccgcacgccgctcctctcctctcgccggccaatgctcgagcacgcgagctgctcctctcctcaccagccgccacccgcgcatgcgcgccgcacctctcctcccaccagctagcgcctgagcacgcgcgccgctcctctcctcgccggctgccgcccgcgcatgcgtcgttgccggaaacctcgtccaccacgcgaggtgaggaaggagagaaaagatggagagaaaaaaatagaaaaagaaaatttagccatgtcatcatccatgtgacatgccatataggcaagaccatggtcaaaccaggctttggatcgggatgatacattaaaccaagtttagagatcgcgatgcgcgttttgcaaattcgtggatctaagttaaacttcgttacaagtttaaggaccatagtgtaatttactcattaaaaaaacaggcatgggaattatatgaaccggttcttttaataaaccagtacctacaaggtgttataggtgccagttttaaatttttacccctctaaggcttagaatgacgggaaaaagctcatttgtgtctatgtcggttttagattaacccatgcttatgatgtgtcccctattacgtgttcggtagtagtgtggtactgtgggtatgttttggaaatatttttgttttataggtaaatcttggtaaaatgccaatatattggtaatgcaagatttggctttaaaccatattggccccaccaaatgctccctctcacgatgaaccttgtgtcatggaaaaactgaaaaataagttttacattcaattgcgtcagccaagatttatactcgacctttagctttgatattaagttgtatatactaattcaatgcaaaaatgtaatgcatgtttcatttgttgccaaaacaaaacttatcaaattttggtttgaccaaatttttgtaaagcaatgaaccaaaaccaaaccaaataattttggtaaggtcttaaaccaacacctccacatttttgaccttgttaacatttggattaccaacctttagatttaccaaaaatggtcttaatctgacaaatgtgtctaccaaaaatgttaaccctctttactaaacatttggattcatttatttcagcaacgaatcaaatatgcgcttaatctgacaaataaaagacagctaaattcgcgaaagggcctatagactagtggttacaagagcctcagtagcacctgaggtcctgggttcgactccccatgggagtgaatttttcaggatttaacggtgttgtgctttcagtggtaggcgatttaacggcattgtgctttcagtggtaggcgacgtgcccgtcgacagcgagacgcctatggtgacttcgtcaatctcttcaggatttatcggcctagttttcgaagatgctcataggtagggtttacgtgcgtgtgttcatagtgaaaaaaaaaagaagccttgaacaggagggttaatgcaggacaagagagcgtaagctccatcatttgtttgttggcttgtcagccacagctaaaatgttaataataaaacttaaattttaaattgattttgaggtgttcttattttaatttatttttcagcattgacttttaaatctaagaaaatagacataaaaggtttacccgtaaattagttttaatcatttcatttatttttccacaccttatcaaccgtagttctcaccgtagctttggctctcgctttacacagacacccgttgttttctttctaactaactatgtatatatatgagcttcggcatatcaattttccctatctccttttgcggacatggtttttcctttacacgccatgtccggtacatagtgttttttgggcttgtaaacttctgctctattaatatacttccctcgttttatattataagactttctagtattgtccacattcatatatgtgttaagaatctaaacatatatgtgtgcctagatttattaacatctatataaatatgagtaatgctaaaaagtcttataactttaaacggatgaagtacaagaggcaaagccattacctttttcaatttttttcccctgtcatcagctactatgtcagcctgatctaagaaaaaaaaacaatgtcagccaacacagcatcccaagtgtagtcgcctcactagcctggtcatcggcagatacacacaatcacactgtatcgagcgatattattgtacactacttactttgcaagtgtttcagaaagtgattgcttagttcctgatatcacatactactacaactgctactagctgacacgactccatgacaggagcaaaagtctgcgccaagaaccgaaacgtttcttcagagaactctcaattctgccttcattcgctttgcatttctacagtcttctgtggtagctagtctcagcagcgatcgattgcacgatatgactcggggtcttatcctactcttatcttgttatcttcttagctggtagatctatggatagagaagtagaattctagcatctcttcatctgaaaacgaaggcctgattacttatgtttaaggaaagattatgttttagaattataatctaattttaaatttgaaaatttgataaggctaattccaaatacttgttttcttaacaatcatgaaaagagaggcagacagaaaaacagacatctaaaaacaggggaaggtaggccgtgtttagatccaaagattttcttcaaacttccaacttttctatcgcatcaaaattttcctatacacacaaactttcaacttctccgtcacatcgttctaattttaaccgaacttctaattttgacggaaactaaacacagctgtaatgtataattgacagtgaaagttattcctcaggtagtcaggtacttggaacccaatgataacactggtattgaaggatggagattcatcaaaaaagtaatggaatttatgtgacaactacaggcattcattaagatgcaaaccgcacgaaagacaatctgtacgactaccttgatagcggtcagatagctgtacttgtggcttcaattttcctctccatcaaaggatgatgatgattcattcagatgatcaggtcttatcttttcatgtcacagtagtgatagttaatttgtcaccaattctgattgatgctgactagttaatgtggatggttaacacgaatcgtaaccaaaatctgactttttagtagacacaaatgaactttattttaccattccgtaaaacatccatgtatatttacttttttctttttaccgactcgcacggtcgcaccagacagtgcgaagttttattaagagagcaggaaatattttcaagattacaaccttgtgaggtcggtaccaggaaaacgaaaaaagtataccaccatccgcacaccgataactccaacaaacagacccaggagaaggctagcaccggaccggccgccgctaagcgtgaccgaccgccgctaggccaacaacggtacacagccgagatcgcccaaaacccgacccttacaaccaatacaaaactccgatatatccaaatctttgggattgagggagagagggtgagagaaaagaatggaaccgctctccccactaagccctccaacgtggccgacttgtagaagctagggcgccgccacaagaggatatgaatctagagtgagcttgcatcaattgcttgggaggtttcggcaaggggatgcctagacgtcgtatccaaggagagaagcgacgaaagtaccaccgccgccgtccgtcaaggtcccaaagagaaccaagactgggctttcacccagcagccccacttgagggggtgagacagcacgacaacgccctcagaaggggattgacgctcgaatgccatcattaccagtctagccaaggccggtctgggttttcaaccgctgtccaccgcatgtcgatctaccactgatgcaccattgctccactgccatctaaacctccgccggcacgtgggtaccactgcaccggcgccccctcgccggccagtctccgcacgctgccatcggtcggcctcgccaagctccgcctctatcggcctctcctcctgctgcgctggccaccgcctccacgccgactagcctcgtcgtgtcgcaccagctcctcgatcgcacctccacacacagcagccgcctccgctgtcatcggccgcgcctcaccggcctccgctgtcgccagccgctcctccgtgcgcgcgctgcctccgccaccgctcctcccaccgactgcccgccatcaccgtcgtcgccgcgagtctcctgggccacgccaccacctccgcgagcagcctccgccagccctcgtctcccgggccatgcttctgtacgcgcaatgtctccgccgtcaccggctggccagcctaccgccgtcgctcctccctccggctaccctcgatttgtcaccattgtcgccgcgagtctcccaggccagctgtcgc

SEQ ID NO: 83276 - DNA, 9416 bp, Oryza sativa
taggaagggttagagaagaagatgcgtatgacaaagtgggttccacttgtcagcctctaagggttgggagcatttttgtatagatgaaaatacagcacgtaaaaacctaatccaattgtgttcaagacgtatattgtcatggtttaaatttaacaaagtaccgatgacacccaacggatatcgcgaataatattggtattttttcaattgaggaaatttgcaatggcatagattcaattaaccattgtaatgttgcatttatgggtatcttccaaataattagtaattacccaatgaaagaggcacgatatatatatgaggtacacagcataatacactagcaaaattataaaaatagatgtcatgttcgtggtagacttggattactaagtcatagtagacttgaattatcaagtcggactgcatttatagctttcacttgcattattattaagtttgctgccaattagggccaaggttttgatgggcaggtcaccaaaattgaagttccaagaataaccgaataagcatatttcaaaagagaacattcttttcaatacccaacaaacaaaaaaaggtaaagcaaaagcatagaaaaagtagagcatacaccatccccatgatgagcaattcagcttcaaaaggtgggaatggtagagactagaggagagcagtggaggggctaaacgttgaccactagactgaagaagacaccgtcattaggtagccgctaattcactttcggtgtcagtgatgtaacgaattagtggccgaaatcagcatcacattatagacaacaacaaagttgatgccaaattttggaaactacgtccatatttgtaaataaaaataaataaagttgaatggataacatgcatcagatgcatatatggttagtgttggatggacaacatacatcggatacatatatggttggtcaaattgaaccaaattcttgttttgggttgcttgttttcttgtgacctggcccctacgtttatgatggattttcatatgtctaatgtatacgacaagaaatttgagatacgctctgttttggcattttatttgttcatattaattaactgatcatttgctaaactcttgatttcaacaagcaagattttggtgcgtggtttccttcaaaattctagcattcctatcttgatcggcagatcattgaatagacaatttatgcagatttatcctttttaattaggcttcagacacgaatgttatatgcatgttttactgattgagtcctacaaactaagaaatgtgccatacaggtaccagtaaaatttgtgaaatcaatgtcttgattattgtttttatatgaacaatagtcatatgatttgattatattggttttgatgatggtgatttattagatgatgtgattttgctctctataagagggtggccagatcatatagggagaatcattgttaaactgctggtatactagcggtcaggccggccggcccaacgaccaaactggcagactctgtgtcgaagttggttttaggttgattttttgatttacgatgattgcttcatgtttatgacctttagataatttttgtgctaatattgagtcaaggtgataaagaacttgtgcttagatatagttttttggtttgttcatgtgtaaggctgcgttcggtaggacatgttaccaactcctcctccttgttttcgcgcacacacttttcaagctactgaacagtgagtttttttacaaaaattttctataagaaagttgcttaaaaaatcatatcaatccattttttaaaaaatagcaaatacttaattaatcacatgctaatcgttgctccgttttttttgtgccggtgacgcagcctaagtggctcttgaggccttgagagagtattgatgatgacttgtgggaagttgatttccgaatgatcacgagatcatgcggggcatgtgtggtagctagagaacaatgcacgagattctaaaaatttcatatggatacaagagggattgtgtgagtatgaaaagtggattcaaatttaaatggagtccaaatttagtaagattagagtttaaattgtaataggataagatggatatttatatgggtgagtttcctaagggattaggactgcttatccacgttgggttcatagctttgtgcagccacctcaagatatagatagaggagaggtttagtttcttggtatcgattttgagagggaatagtttttgagaaaaattagggttcgatttgagttcaaaagttgagagagtagtgatttagttgcactttacaaacataattagactctataaagttgatctagttttaagtgcatctttaagttatgttttccgggatcttgacggcttgaccgatagtagtattatggtcagaccgttggtggccagacggttagaccggcgatgaaggctcggtcaaactggtggctaaggcaaccagtggcatatcaaaccggcggtagtagagaggcggttagaccagcgacataatgttgatcggactgatggcatttctgacagttagaccggcatagatactccggtcagacagaattttattaggtttgaaggttctttgtattctgaaaaaagatttcggtttttggtgttactatcattcacccccactggtagggtgtggtttttgtgttcgatctacaaaattttagttcataatttacatagattatgaactgaattagtttgttgtatggagagtatattttaaaaatattctgttgaggttgagccgatatatatgattttgcacatatatgccaataaaaggaaattaaggatggcgtctgcttggcttgacaaagacaagcattatgcaaaagcgtcacatatagagatgtatgcatgaacttttgttcaagttacacattaaatgtacagaaatccattttgtaggggtgaaaacggagcggacattatccgatccgatccgctccgaatccgtccgatgtgagaatatggtaagggttattatatccgggcggatgcggatgcagattttatcatgcggatgcgtatgtggatgtggtatgaacgatatctgacggatgcggattatgcgatattttaatcggattatccgatgtactgtttggcggataatccgcaaatctcaggccacacaacaactttcaagcccaactagctagcccaatagcccaacccggcctaacctaatcctctcctcctcccccagatccgctgctcggctgcaggctgctagcgtcgccgccagctgcaggctacaagcgccgccgccgccgctcttcctcgcagtgcaggctgcgtgtagcactactgcgtgctctactgctctatgcttgttgtatgcctatatggcttgcctcatgccgatgacttttatttttacattttaagcaacgcagtgaccagtgaactattaaacagaacacttatattatgtttttgatggatcatggatgtatcttggattattttgactagtgaactattgaactgaacacttatagttatactattactattgaattgaacgcagtgaactaatgatgttttgctattgtattgggcctaattgtattgccgccatcttattgtatggattgaatacaaacttgacatctgataactttttgtccgtttccgaaccgagtccgcaccgagtccgcaccgaatccgatgtccgaaataatccgctccgcatccgcatccgcacgtcatccgcacccgctccgcatccgcttaaaaaatatggtttaggatatggtatagttattatccgtccgaatccgctccgttttcacccctatcattttggtcttgggttggaataggtcttcggacttgggtacaggattcgcaaccgacacctgtcagactaagttcgtttgtgtgagatagagtgagaaagcacctcattttccgcgcgcacgcttcccaaactactaaacggtgcgttttttgtaaatattttctataggaaagttactttaaaaatcatattaatccatttttaaaaatttaaaatagttaatactcaattaatcatgcgctaatgggtcacctcgttttaagtatcttcctaatctcccccatcttcttctcctcaaacacaccctcagtccgcaatgataaaacgctttatatataggacataaagatgctggttgtgatcaagaattgacaggttgttacagagttgtttccgtccgtgtgtcatgtattatcaaacatgcaaaaaaaactattgtgagtccacttataaacataataaatttcatattttttttcttgatatatcattgaatattttcaatttccagaggttaattgttgcagactgtgagtctaaaactctgaagaatcagctgtcctgcaaccaaggcaactgaagacatgaagtaaagcgtagcaaaacaaaaacatcgtactctctccgtttctaaatatttgacgccgtttacttttttttaatatgtttgactgctcgtcttattaaaaaaattaagtaattattaattattttcctatcatttgatttattgttaaatataagtgtatacacactactagaaatcccaacattaacgaccagtagaaaattgtaatcctcgttatcctctgaatacgagtggtgaggagctgattttctaatctgacgaccactgaataactcgtcattaaaatttgctgctacacggtcgttaaaattgacgtgaaggaggcccatgactccacaaaaccaccaccatccatcccaagcaccagcagcccaacccactacacaagccgccgagggtttagggagacctccaatccgtgacggtagccgccgcctgccccaattgcgtcgctggctgcctacctcctgccgcgcctgcactgccggccgtcgcctccagttccacctgcgccatctagccgccaccaccacgtaagtgagcacaagtgaggctgggcgctgcaggggtgcacctcgccgtcgaggggatcagaggccggttggatcttttgatctgcccatgttgacccgatgaccccaacatcatctccacgtcaccatctattctcctcgctagtcgccgccctaattggtatgcttgaaaatctctactgatctgccctgattgatgattgatcaacatcccgaaccctgtatccaaaattagtaacttaatggatagtgtagatatatactgattgctttattttatctacagttactagattattgtctggtagcatcgtaattttttcggagacatcttgctgtactaaaggatttcaagagaatgttttttatgagaactcgagataattgaatagcaatggagaggcagcttgatctggcaagaactgacgggtgcagtactgcacaagacagtaacctcttttttatgcctttctccattcatcaaaattcatgttacatattggacgcaaataatgggagcatcattttgttctcaaattattctattggttatatattttgacagtttcagttcaaatctattttagtaggaaccaagatgaatacactccattggcctgactaaattatagtcaggtagtattccaagttttcattagttcctacaagatcagtcattgatgggcttgattttttgcccgcaaggccacaacaagttggatgcaacacaagagctatttccatatctgtaaagctattgctgacacactatctaaattggtacgagctactgtacattgtgggttaattactccttttatttatttgttagttttcttcaggttaattactccttttatatcattgcaaaatataaatgtagtaaagctctctaaatttacaggaatcatatgaaactagatggtgacaaagcattcctcattccttaaacaaaatttctggtaagttcagtttcttttcggaataagatattcatttatattactactacaaaacataagcaattatttgaacatcaccttttaggtttaaattttaccagtcttcatttatgcaaattattctattgcactttattttctccatggtcatgcaattattctatgaataatatcaaatgtgcacacaacatgtctgcaaatattggctcttctcaacattatatcaaattttttacactgaatggaatggaagtgatgtgtcattagaaagacatcataagagataaactcatgtgccttaatgaattttatgtatgaagtgccatagcttgttaaacagttaatatcatttttgtaagttgtataggatcaatggtgagacatatgagactggtgcatctgaagacaatacctgcgaatgttgatgggatcatcatcgtataacaaaggaatttgtccactgcacctccaagcacatacttatagatcgagtgtttaattttgatagacatcgagatgttggttctgtttgaatgacttaattatttagctggatgcggtgaacaaatttttattatgtattgcaatgaataaatgtggttgattgtctacgattggtcagaacataatgtaaatgttatatccatatggtgataaacatggatgttaattccaagagccggtgcagattgcaattatgtttctctactatcaacaatagtgtaccgtgttgtgtaccatgtggtgattaaaaattggatgttaacggaggtggttaaaaattaacaatggcgcaatactactgtcgtcaaataactaacgatgacacaatatcatggtcgttaattagaattaacgatggcaaaagaacacggtcgttaataagataacgatagcaaaaaaaaagcaccatcgttaatgaaataacgacgggtaaagatcgtttggtcgttaaaactattaacgacggagcctttaacaaccactgacgaccacaaacttagtggtcgttagtgacctttaacgaccacatttggacttttaacgaccaaatctcccatcgttaaaagtcgtttccctagtagtgacatatagttttatatatttaaaaaaattcgaataagacgaaccgtcaaacatgtgctaaaaatttaacggtgtaaaatattttaaaaacggagggagtatatatattcttccctaattcccatatgcagtagtcgtagcgcgtgggagggcctttctcaagtcaaaacttagatccaaagggatgaaaatcgatggatgctgctgcatccggggcggggttgaaagtctctggtagtggtagatatatatatcaaaagaagatgattaaaaagataataaataggtgatccaagtcgttggtcacagatctaccatgcatattcctaacgactgcttcagaccaagtcctaactacaactctgcttgtaatatttgctcagcactgactggactgactctggactagtcctgccactactctttttctgagctccaagtggacagtcagccggcttgatcagtggcatctgccaaatttccatgtatttccaattctacttacctagtagatgatataggatgatgatcgcgtatggtgatatgttgtagcttggtgcaaccactagtacagatccttccatctgtgatggcccataacaagactggaatttgcgggccgtcacaaggaagtaatctcaatcgggctgaagtttcgcccgattgagatatggtcgcacaggcatggtatatcggcataaaaataaagcccgtcacggatgacacttatctgtgacgggctatagttgaggcccgattgagatgagggttccatatctcaatcgggccctaaaaaaagcccgttacagatgagggtcatctgtgacgggctccaactagaggcccgattgagataagtttagtgcccgtcacagatgacacttttttttacggccttttattaaggcccgatagagattacttgtatgcccgtcacggttgattgttttagggccgttacagatatttgttgcacagtataaataccccccaccacctagtgtaattgtatcccactattcactattttggtgggaggctgtagggggcgattttttgtcctttttccaaggaaaacagaaattaaattcctgtaggtgatcaaaatggatcaatcaagtgagtaatattaatcattaattgagcaatttcatcacgtcttacttttgcaataatgatcttataatatgtgcctctaatttgtttttttttattttgtagcaattgatctaagttggatgtatgcgaaaaatttgaaacgtcattctacggagtacagaaagggcataataaattttatgaacgccgcggaggaggatcggataagaagaaacagtgattacatgtgttgtccttgtgcagattgcaagaatgagaatatgtttgatagcggagaatacgtacacggtcatctgatacaacgaggattcatggagggctatacatgttgggtgaagcatggagagcaagaatcaggaagtggagcagcagtagacagaagtggtgcgcataatcaggaaaatgaagatgagcatgacatgtttataccttctccattgggcggtgaaatggttgatgtggatcacgatctgctgcaagacatgttacgtgacattgaggacccagcccagaatgagagagatggaatgaagttcagcaggttggtaagtgattccgagacgcctctgtccgctggatgcaaagcaaaacacactaagttgtcagttaccttggacctaatgaagctgaaggcaagtagtggatggacagacaagagtttcacagatcttttaggaattttgaaggctatgcttcctgttgagaacacattgcccgagacgacatacgaagcaaagcaggttctgtgtccactggggttagaggtccgtaaaattcacgcttgtcccaacgactgcatattgtaccacaagcaatatgcggacttggatgcttgtcctgtctgcaaggtttctcgatacaagcgaaagaaaagtgctgacgaaggaaataagtcaaaagaggggtggtccggcaaaggttgtgtggtatctacttatcattgattgtttcaagagaatctttgccaacccgaacgaagcgaagttagtacgttggcacgccacggagagaaggaatgacggtatgcttagacacccagcggattcgattgaatggaggaatatcgatcgaaaacacaaagactttgctgccgaccctagaaacatgaggatatgtctgtgtacggatggcatgaatcctttcggtgacatgagtagtactcacagcacttcgccagttcttattgcgaactataacctcccaccatggttatgctttaaatggaaatatattatgttgtgcttgttaatctaaggtccaagcaacccggcaattatatggatgtattc

SEQ ID NO: 83277 - DNA, 4604 bp, Oryza sativa
  unsure (1)..(4604): unsure at all n locations
ggtgcatgagaactgctaccccctggcnnnnnnnnnnnnnnnnnnnnnnnnnnnnnnnnnnnnnnnnnnnnnnnnnnnnnncctgctgcagccacgaccattcaaggagcaaattaaagccagttaaaaatctctcatcaaacccagacaatgctgttctgtagaagcttcgatcagtttgcatgggctgctttatctgcaacattgcagctcgatacaaaggtacagtttgcagcttagagagttcgtgaacacaaaactattcatgacagaaaagtccacttgtacttggccttgacataccactagctggccaactagcttgtcaatatctcactttgattattaacgctctaccttgacctagtttctagaatatccttttcaggaatatatcatatcttagccaaatggacagatcattctcagggtataaaaagaaactaatgctgacaagaaaggaggcactttttatgaaagcttttggggtagataacatacaatgcacactggctagtaactggtgtgggtgtggtccaacaacacatcctggttttctctaacgatccattaaaaaaaaggtttatgtccatgacagctatcaacttcttgttgatggccaaagccatcaacctcatgttgatggccaaacttttgtggaggtgtaaattgtttatttattaattaatcatatagcaaatgacgaacatgagaaacggacttaacatgaagaacccttacgaagaaaaaccacaatcgtgtaggcagcatcagtaatacgaggagagttataggcaggggatggcagtgaggcagtgtctctatcttcctagatatgctatggtaatactcactctgattccaattatatgggtaattaaactaggaaaagaatcataattacgtctattgaaattgtgtacaaattgggacatgtaaaatcaacagtttgcaagcacttctgtctattagaattttgcatgtagtaagtataattcacggttcttctgttgtagatttgaaccgttattatcatcatcaagggtattagtagtatataaatatatgctactaccattctgtaatagttcacttatcaatcataaccaaaatttaaatttttaaacttaattatataggggtctttttaatcgtggttaatttttcagacttggctttaaaactgataatgactcaaacatacaagtttttttttagtctcttcatttctctatggcttattgagctcaactgatcacagctaacacaggcagcgaaagaactactatatcactatcaataacactgttttacgatatgtgcaacttatcacagaaagcacacgagaactgatgtttcatatcacaccagtaaaaacaggaaccagcttttaacaactggacttggtaaatctgtctcgcaagacaagacatgctgagagagaaggggttcctcttgaggatatctcctcaattttacgtgtcataaaagatcatgttaaaaacaaataacaaatatgagtgtcacatcacgcctgtccatagctgttcaaacttacaggttaatttgctgagtgctatatcgagtattttttaaactatttataacttcttaagtactcctgccatcctaaaaagagacaatctattattgatacatccgagtacaatgaatctagatataccctacgtccagattcattgtattaaaatatatcgcatcctagtactatgttgtctttttttttaaacgaagggagtaattgagtaagaagggaggggacgagagacatttgtgctgtaatattctgatgctcttcatttcatcatatatattcttgtacatagataatcagaagccatatacaattacacggtagcactcaaatccatccaccttcctgtgcacccacccaggtagcatagcaaccaccatagccaaaaaggacgagagagcacaaggcccaaacacagcaacactcttcatccccttctcatagccaccaccacccaacacaaagcgcctcccaaaaaaaccagaggacgcgcgcgcgcgcactgtcagtgtgtgcacacagaacagtgtacaggagagctacgataataactaaaagataatgctccctctctaattaatcacccctccccttaattacatatatttatatactactaatacccttgatgatgataataataataataataatctttctccgatcctaacccaaaacccctaggagcagagcagagcagtagcagagagagagagagagatagctgtcgggaaatgtgggttgaagccgtcggcgaaatcaccacttggggcgagcacgggagaggcgctcccactccaccagccgcagcaagaactccatcacctgcaagagaaaagaaaatgggagaaaaaaaaattttagccggagtagaaaacacacggtggtgctggtgcagtgcagaaacaagttggtggacgccgggccgcgccgccctcccgagtcgaccgaccggtcgacaccgacggcgccggctgtccgtcccccgcggcgcgcggtggtccccgggaacgaaagcttcgcgcgcattgacgtcgactaaagataataataatagccgcgacgcgcgcgccggaaaactacgcgcgcgcagcgccgcgccagtagaacataacagtgtagtgtactagtatttcctttcctttttcatctcttttactacgggtgcgtttagttcacgttaaaattgaaagttttaatgaaattagaatgatgcgatggaaaattggaagtttatgtgtgtagaaaagttttaatgtaatggaaaagttggaagtttgaagaaaaagttttaatgcgatagaaaagttggaagtgatttacaacgggccaaaccatataatttgggatttacaggatgtgtggattgagataaagcacgagctaagcccatattatcgtgaattggctgggtgggtagattgataataaaataggatcctataattgttacacacccaagaagaaacatgaggtgatcaggaggggatggaataaggacgactgcgtttttatttatttaaagtagaagagtttccttttctaaaaaaaaatctgaacatttttgtgtgatgtacgtgttgacagttttgagatgagaaatcagaaagaaaaattgaaagaaatgcaaggggggtggtcattacctcggctggctcctgcagggagtaagaggcgttggtgtccttggggtacttggacacgaggatgccgatgccctggcctctcttgcggagcaccttgaacgcgtcctcgtcggtccggtcgtcgccgatgtacaccggcagcacgttggtgcagtcggcgaaccctgcattatttttattattcgtttcacaacgagcacacaaaacaatcagtgccaagcccagggaagaagaaaacgacggcgacagattaagcctgaacaaaaaaaaagagaaaaaattccattacctagcgactcgaggaggaactcgagggccttgcccttgtcccacttgatggtgggccggatctcgaacacctacaggagaagcatccaatgatcggaggacaatgactcagtgatcgtctcacggccgcaacatatcaaagcttaataataataagcatatatctctacctagcaaagaatcgattgatggctacacatgtctgcagaaacaaaaaaaaaaagaaaaaagaaaagaaaagagagtgagatttgaaagaaaaaaaaaactcaccatcctcccctgcgtgagcttcagtttggggtagtccttgagctctgccttcactatgtcagccaatgtgctccagctctgcatgcatgaaatcggttaattgatcatctagttacagagagaaacaaattaaggagatcgaagaggctgatgattagttgatgtcttctttttctaatagtactaataataattattactgctgaatagtgacaattttaggatggggctcacacactaattaagacactaacacccaaagaaaaaacaggtgctagtagtagtagatgcagggaaggaagagaaagaaaaggaaaggaaacaattgtgttgtgccgcaccttttcatcgacacatctgaagtggacagacacacagaacttgttgttctccaccttggctccaggtatgcacttggtcctttctatcagagaatcgtgcacctaacaaattatacacaccacaattaaccaagtttaacatcagatcgaacccaaaaattaaaagaaaaaaagctaaacttctccttcagctatagtttgcataattgcgtcgcagcagtagtactatgttctaacctgttctatcatggggaggaactcgctagccggctgaaagagaacgcctttcgcctgagaatcacacagaggtgcaaaagcagagaaagataagttttgcttttcctcgctgtggttgacaagtgcggcagtggaggatgctcaccttggccttgttgtggcgggaggccttcgcggggcccttgatgtccatgccatggctnnnnnnnnnnnnnnnnnnnnnnnnnnnnnnnnnnnnnntcaagacggtntcaatgggttcaa

SEQ ID NO: 83278 - DNA, 10353 bp, Oryza sativa
attgaaatcatttagtatttacaaatgctgtttagatttgtcatattgacaaaatcaatttcaagctgttggaaacaaagttatatagacaaatgaccaaataaaagttgtagatcctgatgagaggatcaactttgttgtttaccatatttccatttgaaatcatttactatccgaaaatatattatgactaataaaatgaattattatacagcagttatatattttgtactcacaaatataaagacttatctggaaaaatggaaaaatagtcatcggtgatgggccttagttcaagcccgatagagattaatctatctctatcgggcattatctttgggcccgtcacagatgagtcatccgtgacgggcctgaatgtcatctcaattgagcattagtatggagcccgtcaccgatgagtcatctgtgacgggccctacggcaaagcccgattgagatgactcatcactctactatatctagatcgaaaatttttctaagtcccgctacagtttcccgcctccttagaaccctagcgccgccgccaactcctacttcgccgtcgtcgccaccgagcccgccaccgccgccaccgagcccgccgcctccaccgagcccagtgccgcctcccccgaccggcgatgccctccaccgagccaggcgccgccgtcaccgagcccgccgccaccgccgtcgtcctccctcgagcctccacaccgaccggaccggtgtcggccttcctcgttgttgacgcccgtatcctcaccgacgcacgtcgccgacccccaccgagcccgacaccgcccgcccggcgccgacctaccaaaccggcatctccaccgactggcgccgccctctaccgagcccggcgctgccgccgcaaactcctccgttgccgagcccgccaccgccgccaccgagaccgctgcctccaccgagcccaacgccacctccaccgaccagcgacgccctccaccgagcccagcgccgccgccaccgagccctaccgaccgtcctcaggtgagtactccatcgcgctgccctatgctaactgtgaatgacatgtcattgaaatgtggatgtggatgatatgtgattgaactgtgagtgagacatgtcgatgttgggatgaaatgtggtgcatttatgaattttgtgatagatgattgtagtgattgatgaaatgtggttaattttattactgtgagatgtgcaatttcgtttatttatacatggtgcattaatgaattttgtaaatagatgaaatgtggttcgttttattactgtgagatgcgcaattcagtattctgcaatttcgtttatttatacatggtgcattaatgaatttagtaaatagatgaaatgtggttcgttttattactgtgagatgcgcaatttagtttatttatatgtttcatttatttttctaagtgacattaaattcattgtaatagattgtagcactcaattgtgtatttttgttattgagaaaaaaagtatacaatgtctcagcaaggcgaaccaatgtcgacgacaactaatgggtcctcaagggcacgtactcctaggacagggaacaaaatccctaaggaacggttccgcataacagcggtggacgccgtagggttgccgacatctccaaggaaaatattgagccgatttaggtctatctgcggggtcatagggaggcagaaattcagtattctgcaagatgacatcaagctcgtgccggccgcagagaaggacattgcttggctaacgttcaaggagagctttgattatcctgtggagcatgagtaccgtctcaggcgggctgctttcaaggttatgggcaatgcttagaagaacttcaagactaagctagtcggcgagttcgtctacaacccggcgaatccagatccaagagagaaatttccttggatcacggaataggtctgggaggaattccatgcgaaaaagtcgacccccgagtccagagctagaagcgaggcatatcgcttgctccagaccaggaaccagcatcggcaccggcttggcaccgccggatatgccgataaggaagaggaatggcagcgtgaggatgaagaagcggaggaatcgtgcacaccgctcgtgttcggcgatatcccacaccctcgggctagcaactgggctagggctaggtaccagaagaattatgatggcacaatcttcatgccaaatgcagaagatcaacgagtatacgaagctattgtaagtgtctagtcaaactagatgttcgcattgtttcccatcgtgcagtttatttaaacccactaaattgtaatgcagaaggagttggttgccgagcaacaagcctcgcaagaggcctgctctcaaagacgcgaggacgacctcctcacgaaagcgttgggcaacaaggaacatcgtggacggacacagggcgttgggtcttctgttccctggaagtatggatttccagactacgcgtggcagtacaagaagcggacttccaacaaggcggagaaagatgcacgccttgaagccaagatccgggcgtcgataagagctgagctgacatctgaattcgacaaaaagctcgagtcgatgagggccaagattaggcaagagatccgagaagagcaacagaacccccaggccgccgctgctgctgcgcacaaagagttaggaagtcctacccaaaaacgaagcagttgcgcatcaactgagttggcggaaaatccaacatcggtcgacagcgccgtcgaccacataacggtaaccgtgaacttactcaatacatgaaagacttaacgaatccatatgatatataatattctaaaagaattgattaatctatcgcaggaaccgacgagctgcaccctcatagttagggtgatgccgaccttcacggttctagcagccgagggacttgcgtacaagccgaccccagagacaagagtgcatggagcgcaactcagggccgattgtgcaaaagttcaagtcgattcggtgaagcccgaatacgagctgttccctctgaagtatccaccgaacgacgaggtcctctcactaggaaatgatcatggtaccttcatccaatggcccaaggacctcattgagatcagggttacagtgaggccaaccactacaccaggcggtcgtccaccaaagagacccgcctcttctctttcagcccctcctgctcaagatgtcatgcacaatcttatgatgtgcagttgcagtacgacacggatcttggggaggaccgaacggaggccgacagcaaggcgattcatgaacccccaccgatgaagaagagcaggaaggcacactcttccccttagagaattactctcgataaacccgaagcaaaggggagaggaaggggaggaaaggtgcaggcctcgcttctagctccaaggaagctagatctgggcaagggccaggaagagactaagagcaaagaggtcaagaagaaatacgtcactccacaggagttccaactaggcatgccattggttggagatgacatgcttgccgcaatgggcaccgcttgcaaggaccttcacttatactacatggagaaatctaacgccaggaagccaagtaaagctaccgatatccttggagagcacgatggaaagtcattccttggtccaacaaattatatcgtggtcgacttcaaggatcttttcgacctctacaggcttcgagcggtggacacaagcctccttaagtgctactccttgtaagtattgtcgcccaactcaatctgttaataacaatcggtttaacttgcttacaagatcgtttatcctgtgtgtaggttaagttagcaatggtgtcagaagcatgcaccggaagttgccttccttgatccacaagtggtcactgtcacaaatctccaaaatgaccgtcaaggaatggtcaactacatctacgacaccttgtggtcccgccgagacaaggagtacattatgtgcgcctataatcaatagtaagtgtgttaactagatatacacaacagcatgacacattacttgagtacttaattaactttcactatattaatgccacagtgcccattggatccttctggtcataacacctaagtggagtacatgtcactacctgaactccagaattgataagaacgcatatgattggaccccaattcaactagcgatagatgaagggtgggcccaatacgtgcaaagaggaggcctcaggaagacaggacatgacaccctcatccacaaaaaagacttcccggtgaagcaacaaataggtgaccagtgcggattccatgtgtgccacaacatgcgccttctgtatagagaaaaggtgaagactttggctgagtttgaggtcggtggtctcaattgtgatagactaactacattttagtacttatatatgatcgatcaactaatctggaattatgacaatgtagggcacaataaccaagtctctgcctaccagctttgaggaggttcgcgaggagatagccagcttcatcctccgcgaaataattaaccccaaaggaatgtttagacttaaactaaaatgatgaacaatgttgaacttttatgtttaggcaatgatgaacacttattatgcaactgtgatgatgtaactgtgatgtttatatttatgtatatatttcatatgtttatgttaagacttgataaataaatatttgatccaattaactcggttttgcaggtgaaacatgataaatatttgaatggatgttaaatatgtgaatggatgtgaaatatgagatggctgtgaatgtgtggttgtgtgaaatatgttgatgtctgtgtatgtgaatgcatatgtatatgaatgggtgatgctggggagctggggatatcggatatctgtgtttgtttctgtcatttttgcagcgggcatggctagcaaaggcctgaggctagccaaaaaaacaaattttttttgtgtattatagtcatctgtgatgggccataaataaatgcccaattgagatgagttcatctgtgatgggctctagtttaggcccgattgagatcagtagtcatatgtgacgggctctagtttaggcccgattgaggtcagtagtcatctgtgatgggctctagtttaggcccgattgaggtcagtagtcatctgtgacgggctctagtttacgcccgattgaggtcagtagtcatctgtgacgggctctagtttaggcccgataaaggttagtagtcatctgtgatgggcgctagttgtggcccgatagagataggtcatctgtgacgggctataatttgactggtcgtctgggtcaaagctatctgtgacgggctttacttagggcccgattgagctatattcattcgtgacggccgtttgcccgattgagataactcttcacatcagtgacttctagcctgtgacggacgctgtgcccgattgagatggggcttaccgcccgattgagatgagggtatccgttctagtgaactctttatttatcagtcaaaactgaagaaataaaactagaagaacagtggatggttgtcgcggttgtagcaatgtagctgtgtattcctccaatatacacttcccgaaaaataaaactcttaattaccaaaaagaaagggcagatttattctaaaatacactattttttttgaagcactgtacaaatacaagcacccacaacatgcgcacactcatctttatgaaggcacacgcacacctcatctctatgaatactttcgaaagactacgacggcacatgttgagattcacgaagttatcacgtgcgcctcgctgtcgacgggtacaccgaccactgaaaaaaaatagttgtaaatgtgagcactcgtgtttagtctaggacttgaattcggatgggctagttccaccaaaaaaatataaccaattgagttacacttacttttgacggtcgttaagtgtaaacttgaaccatcaactcttgctcctgcatcaaagaatataaaatatactgtcaaacttagtggtaggggttgattactaaccatgtccaatagtattgataaatattagtatgcaagtgacttctggatgaaaacacacccgtcatgtgacaaaatatacctcttaccaatcatatgcgagcataaggattgaagggaccacatgtcagtcaaaaccgattgaatttgagtacatccactgccaaccgccatagtgctcacctatcatccactaggcaaagttggtggccaaaggcagtggaggtggtttcagccgaacaagccttggcgccctcggttgcctccttgcacgtggcagctgcccattggttggtgatggcggttgtgggtgaatcgacctccacaactgtcattccaaccgtcttaatttgggggctataaaaggaggaccacactcacttccaaaatgcacaataaagtggggtatcactcacttttttaattccaagcatcactttagtatatgaaactatatagagagtgaggggaagctccgaaatgagtgccccaaatatcggagttctctccatggagatcctgaggagtgtcgggtttgacaacattcttccattggaacttcggagaagcgccagagttgtcggctttcttctctcacttgtaccttggcggatgcttcttttaaagtaagtattcgagacttctttatggtatataatttacctgcttaagtgagattcccattgttaggggtttgtgcttagtattattattaagtgctctagtactatgactctgggtaaagaaggaagtttctgcgctaggctagagtaataatcaataacttagatgtggtgtctaagttagtggttacctttgtttgttgtgtgctccacggaaagtgaggtaagtggcaggtggtgatatccctgtccgttctttgtatccctccacgttcaggtacatcataaagccgtaggctggactcagtttggtagatcagaggagagccaatgcctgaagcaatcaattgggtttacctttaacttaaatatattaaattaacctataggaatcctcgctagtcttagcctaccattctttttgaacgactcacaccaaacagtgcggagttctattgatagagcaggaaaaaaaatccaagattacaaccctgggaggtcgtaaccaggaaaacgaaaaaagtataccaccacccacacaccgacagcgccaacatatagacctaggagaagactagcatcggactggccgccactaagcgtgaccgaccgccgctaggccaacaatggaacacagccgagatcgcccaaaacccgacccttacaaccaacacaaaaccctactctatccaaatctttgggattgagggagagagggtgagagagaagaatggaaccgctttccccctaggccctccaacgtggccaacttgcagaagctaggccgccaccacaagaggatatgaatctagagtgagcttgtattaatttcttgggaggtttcggcaaggggatgcctagacgacgtctccaaggagagaagcgacgaaacatcgccgccgccatccatcaaggtcttcaagagaaccgagaccaagctttcacccgacagccacacttgagggggtgagacagcacgacaacgccctcaggaggggagtgacgctcgaacgccatcgttgccggtccggccaaggccgggttgggtttcacccgccgtcctccgtctgccgatctaccactgatgtaccattgccccaccgccatctaaccctccgccggcgcgtgggcaccactgcaccggcgcccctcgccgtccagtctccgcacactgccaacggtcgcgtcctcccgctgcaccagtgtcacgccctgaagtttcccctttcttctttctttaaaagttggttgaataaatcgtccgaagaaattatcttaattaacctagagctaaatccctaattaataaatgcaattgataattggaattagcattgtgggatttttcttgggttccacatgtcgcaattgattaacaggatttttagtggaatttttagagccctataagtaattttaaccaattaaaattcgcaaagtgcaatattttaaatcccagcaaaaactttttccttttgctccattcctttccctcctttttctttgtttgaccgttggcccatctctctcccgcacccctccctcttgctgggccggcccaagccgcctcctctcctctttgggacgctgacaggtagggcccatcggtcaggtcgtccccaacctccatccacccgcgcaccgcggcaaccaccgctcccacatcgccgtccgcatctcccgcgcccactccgcgtccacgcgctgcgcccacgtcgtcgtccgccgctcctccgcctttcccactcgcgcacgcgcccgcaaatgggcgggattcgatttgaatcccgtcccctctctctctctccactcccccacgtcgccggccaaatagggggccaccccggccatttctgtcctttcctcgcccataaaaacccttccccgagccccttcttgcatttcccccattcgccgcgccctcccgtgcttcctaccgcagccgcgccgtcgcaccgacctccgccgcctgccaccgtactccggccgcgcgccaccgctgctagagccgccgcagtcgcgctcctcggccgccgcttggttgccgctaatcagccccagaaccccatctccctcgcgagccggtgagctcctccatttccccgccttcggtcgacatcctcgctcgccatggactccttctccccctctaaactctatgttttactctccctcccgcgccggcgaaaccccggtgaggcctcccgccccctcttttcccctttcctctccttcctcccgctgccgtcgcgccgccgcccttcggcaatgcgcagccgcttccgcgccggtcgccgccgtctcccgcgccgccggtcaccgccggtgaccacgctcgccgccgccgctccccatggccggccggccggctttgtgccgagccgagccgtgcctagccgccgcctgcgccgtccgattggccacgggccaatctggaccatcggtcccgtggaccggcggtggaccactcgtgtgatcccggtccacggtggaccggccgcctcatgccgctgacatgcagggcccgcttgccggcgccgccccctctcgctgacatcagcccttggctttattgcgcaataaattgattaaggacttttctttattagtaaaaacacagattatcttctaaaattcataagtaattcttccgagctccgtttaagtccattcaagtctcagtaaatcaagaaaaatgcaaagaatccattaaaatggttttgtttcctgtttcagtagtcttatagcatgttttgcttgtgtgctttgtttgtcgcgtagattttggccgtttcgtcgatccgctgtttctcgaagacgttgctgtggtctcatcagtgagagagcaaggcaagtcatgcattacaattgatcatattgtacccaatttacaaatatcccgcatttctattaaatgttgcattcttttacaatgtcatgtgggatgggtcctattactcatccatatattgtttaccttatgccgttgattacttgggtatcaaaataactagatgttggtttaggaaatgcttagccatgcttagctcaactagtacacaaatggggataacattattacatagactttgactattagcatagctttggattgatgccaccgcaatggtgttagttaattaaaatacactgaatggtgggctgtgggtgtatggttttgctggtcgcacccatgacagttaaggaccggttcacgggaaaccctgggagacttaccgtgcttaccacaagagggagtgggtaactgcttgatctgaagtatagctcgaccctttcctaggcaccggtcagccggggtgtccgattgtccaactgtcgaattcaccgcagcgcaagagggggccgcccactgccttttgaggggtgggggtgaaaccttagcgtggtgtggatggttaggggagggttatgcggagggtcttgtcacgatttccccctttgcagtatcatagtgatacttcggggcatggcgatatgtgtggaatcgtgtcttgtgggtacagttgtacacctctggccagagtaaaactattcgaatagccgtgcccgtggttatgagcgatcaaccagattcaccgtgattagtctcacccctagtttagtttgatgaactggtgtagttcaggtggttggttgggccagttgcaacgtggtgtagcgttggacagtgattggttaatctggcttaatct

SEQ ID NO: 83279 - DNA, 10311 bp, Oryza sativa
ccgccccccgcgccctgcgcggacacctccccgtaaaatttgtccatttctctcgcactccgtcgcagccgtagtactagtccgtggcggccgcgttcgttgctctgctcgtgccagtgtcaccgtaccttaccaccccgttgtctgagccgagacctcgtggactcatgctgaccccgccagattcagaggccagtatagtacggagtactaccgctagcagcctatggtcaaagcacgtagtacctgcaatgcatcggcgcgccctggcacatgcatgcaacaaacggcagaaacagctaccggaacagacacgggcggcacgggatcctatgcttacaactacgtactcctacgttcgcgcgccacgagctgccacaccgagcccacgtacgtacgagctgttggtcgatctccccctgcctgcttaccaagacgtagacgccgcaggtgcgcgacacggcatgcatctacctagtcactggcgtatgcatgtctcgttttatcgctacttcagtcactactaacataaacaaatctataatacgctatgatataacctagtataatttttagagaaggcatttcataatgtagaataacatatactttctccgtactaaaatataagtatttttaactatgagttaaaacaaactgttatgacctgagcttgtgagggatcgaatcacacaaactagcagcagaatacactgataactcgagataatttaggaagaaattggggaatcgggtgaagaacagacagggggcaaaggaagaagaagaacagcaggaggaaatcagatttaattcatttcattcactgaatctctcaatacatgtttcttgccttatatcgtggcggtaagactgacttgtgggacccaatcctatttctagggcccattcgtcattcacccaacactagatacatttatctagtatgggtatgacattactgcccccagaaaaacttgcttgaggtcaagcaagagttaagtgtggcatcgatgactttggacacgcaccaactttcttgcagaagtttagatgacctgatttccacttgatgagaagcacatgcaagtaaagaacatggcaccaggacacctatggactgatgacatactttcaaagctcccaatgcagttgcctacatatcaagtcgatgatattcaggaatcccatcagatctcaatatatagcatttccagacttgatgggggtggtggccaaggtaagataaagattttagcagcccttgcatcaaggaggtcttcagggagtagcattatcttgtcattgtctctaaaagagccaataagtaatagcacttcagcacttgcaccgactacaacatatgtgccaatagctgcagcagaacttccttgacagattgccatgaaagaacaaattcccttgttctaaaattccattgcctcttagccaataatgctactttataaactgcccaattctttttcacaacccactaactgatgaagcttgtaacaccaacaaattcttttgcgtaattcatgacaatagagttgaaaatacctagatctcatggcctgctgacaatcttcaggttcaggtactgatttatcacattgtggaatgattggacaatttctctataacaagtacttctggtaacaattagttcatgcacagtggtttgagaccaactcaaaatgctcaggtcaatagccagggacatatttgacttgataatgactagcaatctgaacattcttctcaggtctgcaactatccaaatgacatgaaagtactgttacctcgagaattatccaaaatggataaactaaaaactgagaaggtggaggccatggttctttctgccataacatcttggtgttttgatagtcaatggtttgtagtgtcatgagagccatcctcataatgcttgaaacttgcataatctgatttttggttgccgcatgtaaacatctatacaagcagtgctcgaatatctattgttggttcttgtttccaggactaaaaccatttctttgccagggaaatatcttgtcaagcaataattgatcaccttttgtttcatatttccagggacataacccatctctactccatggaaaaacctcctgaagcatttgattgctatatgaacaagcccgccatagtggcctacacaaacaccatatgctcattggaatgtcactggtctcacagcacacaaccacattgaccatggagtttggcaccatattttgaacccaaggggtgagatgctccactggtagcttgatattctgtggcatttcaacaaatgcaagagctgatgattcattgctttcgtaagacgtttcgtgtactagatcattttcattcatctcaaacaatgaaacgccgccaatatgagtgagcacatacacctcttttttcttcatggcccaacgtattgggcgatgagcgacgcgaattcgtgacacccactttatgatacgttggcttgtgcccttcctttctgtgaaaaatgaggctgaaatgggcttggtgctggatggaacatcatttacatatgttggacttgagatagagctggcatccagagaagttgttatgggcacagagctaggcaatgccgtggacacagccatcagcaaactagtaccatgtccgttgcatattgacaaacacctcacaggcgccaccgacattatgtcattggggcatgattgcatgtacttgacatccaggaagcaacagccattgtaaatgcagcacccatggagtgcttctctagctcgtgttgcatcttggcacagccggaacagaatgaaagcctcaacttgaattgttccctggttatacacacgcacttcctctgcaccatatggactgaatacctgaagaagaacctctgcggtcactggatagagcacatggctcatcgtgacgtgaaggacacttgctgtggttggctccttgttacttggcatttcatcgaacaccttctgggaatcaacactggaggttgcccctggacttgaaactgataccaaggaatccaccggggtagcaggtaccgaggaaggggatagagagcccatagcatgatccaatctggcccctaactcatcgagcttcgccaaaatgcggccatacatggcctccttcctctgttggtccagcgagtcactggcgacggtctccatcagcatgataaccactatcttcactcgtctcttcgtagatcgaaccttggttggaatcacggcgctcaagctgaacaccaacccttcctttggctttaccgatcaggctgaaatagaacggatcataatggctctgataccaaattgttatgatccaagctcgtgagggatcgaatcacacaaactagcagcagaatacactgataactcgagaaaatttgggaagaaattggggaatcgggtgaagaacagaaagggggcaaaggaagaagaagaacagcaggaggaaatcagattcaattcatttcattcactcaatctctcaatacatgtttcttgccttatatcatggcggtaagactgaattgtgggacccaatcctatctttagggccactcgtcattcacccaacattggatacatttatctagtatgggtatgacataactgtgtatacagatttatatagctaaattttaggacagaggtagtatgaagagactatatttcatccagcttcgtatataaaaagtaatgtttgtacatgagtttgataattaacatactatgtttaaatttgtatatatagcatatagaagttggtttttctaaagaccgatagtgttctcgctctctgtacatgcgtcgtgtcaaagactcgatcgaagccctgcatgactcatggctggtcggtcgtcgacccgatcgatcgatgtcagtcgtgcacgcacgcgaatgtccaactctaacggtctgacgcatgtgatcgatagctcatcagtagtcatcacggctttgagctgtcgatcgagccgggtctctaacgtacgtgtgcccaagcgacgggctacacgcgtatcgccagctaccggccgggtctcggccggtgacgtgcatgcatggcttcaccagccaatgtacttgctttgtcggcgacatgtccttttcccctccctacactttctttttgactgtgcagcgaccacgtcgacatctcgcgtgtatacatatacggagtatgtacaaaggtcaattgcataacttgctttgttcccttggttaattaatttgctatagctaatgtcatcttctattgatcagtatctgtcatcagttattaacttaacttaggaaccatcaaactaacaagaagtttgtccatgttagctactcctacctacctacaacctagtataactggcacataggtaattgatgagttgatgatttggtcggcggtttaggttataacccacgggtaagtatgcatgtcttacatgtggacacacacaaattaaactagtagctagcacgcagcttgtacgttgtaccttgtaccggtgcataattaccatattgtttctcccgtgtacttgtggagtttggagatcggaatcattaatttagggggaaataaaacaccagctgcgcctgcgcacaagattcggcgaaacgagaggcgatctctctcgcctcgtcgccatcgtatcagcgacccgggccacatgggttcggctactaatctatgggttcttttcacctaacaatggctgcaagagatttaattaattagctctgcaaaaagtgactcgctttttttttatctcctgcaggcccagcagccgtgcacgcacagtggctgtggagaagccaccttgcagttacagtggatagaaaatcaagtgattaacgatcgattttgagctggaattgttaataattatcctgtggtattaaaaatggatcaaaagctaactaattctgttagtgtagtgtatgcttgtattggtcgttacgcggcagcattatcattgcttcgaggtctcgttttaatttttgggtgtcttttcttgacgtgtcagtaagtacgtgttgatcagagaatctagcgctggcacacgtataattggttgcactaatatttctgagtagtactcattggcagataaaacacatatgcaacataattaacctggatttggtatacatatatgtacagatcgatatatatatgtgcctgtcaagaatataattaatataattagtttgcactatgcatgcattgcatagcatatgacacactagctttcgatgatgcatatggaattgaaggaggggtaccaatatagcatggctgcacatggacgcatatgcgtacatagctgctgacgtgtacgttttattcgatcgaagagacgggatcgatggtcgttgcatgatgagtctaagctagcgaccgagctcactatgctatagatgcccttaaaatgctgatcactagctacatagatgctcttcttcgacctagctagagcaatcaaagcatggtgaaggaccaatccaggagacgacaataatgtacaattcaattagttgagagcgaatttgatgcttaattacgtggtacattattggtacgtgacattatatatatatatatatatatatatattcacgcgcgcatctgatgaactaattaaatggctagatatataaatgttgggagatgtatatttatatatatatagatagatacatgtttgtatagctagtaatttcaacggccagcttcttccccccaaggaattaatcctttttcatcaacagaatccttatccttcaccttagttcctggctccctatgtactgtgatgcgtgtctccatgtatgaacctggctagcttctttctagatctctctagctcgtgcactaccttatctcactcatatatatgcgcatatattagtcacatggcttcgcttggatcaatggatattagcatatgtagagtcataaaatgcatctttcactttggatatatagcctcttttactttatatatagtcaagagctagccttagctagcaagctagcttgctccaccaaaagttaagcatgatacattccagaatgaattgagcagtacagtctaggaagtaggaagtaaacagagaacaaaattagcaaaagaggaaaatggaggacgagagagagagatgaagaatgctgaaacgaagtcagctatcaacactagtgaaagacacccgctttgtaaaaagttttggttaagttcatctacatttacatcggacaatttggttacattattagctagatcctaaatcatatcaaggcgttttcttccccgggcatatcatcaaggcgttttcaaggtggcaatgtggcattggattcgtctgatcttttctatcgtttttccctttgccccatatacccggctggccgggaatcagcatatatatatgttgaacacgtagagcatgacaccgatataaaaccaagtctacatatataaacctcgcatctaaatgattggagctctctctatctagctataggccagcactgacatcgatttgttcttttatttagtttttgacaattagaggtaaattgcaggatacattcttcttcttagatcgatcatgtacttgttggttaattttatcggttattgatgatacaattaaggagatatctgtgtggtggagtcaggatttttagaatgagtattcgagatttgcattaatacttttatattaataagaaaaccattcataatttttgttggagcattttcttttttaaaaactatgttttgtcccaagttgtagaaaaccataggtattacaatttatggcatatgaccacatgtttcatagtataagggttccatcactacagcaaaacaggcaactagagacggctaaaatactacgggtcatcaaaccgttgctactaaactatcccaacgtacgtgcgagaaatcccccatcacctagagtcggataaaagagacggagagataaactgtggctacctccccacttaacagcacccaccattataatatcctttaaaattattaattaatcagataatcactatttatttttggaactgctcggtacaatcgtaggtctatcgaaaccctcgacagagtcgcacgccgccgcgcgcccgccccagatcgccggcgtgcctcctccaccaccatcgcgcgccaccgctgaccaccgccgctccggtcctgcaccctcgcttctcttttttggccgttgctgcctatcgccactgtgctgccaccccattgcagccaccacggctcggttcagatcttgcgagtcactaggtagatgaacacgtggggagcatatttgtggagggatgagactgatttttggctaattcagagtatgatcccctgattggctgattgaaagtgctaggacgaccaagggattgacctgccgtgaggaatcagatcgagtcggacagcttcatcaaagaaaaggtaatttcattgttctctctttctattgagaatccacataggtatacattggtttaggacgattcgtgatgaacatctggtttggtgtgctttggtagttttaatttacattcattgggactgtggttagaggccattgttcttaatgatctttctttcctgaaaagttaggtatgttgttcaaaattgtcaacattactgcattcaatgtaaatctagtttctggaaaatgaacttaatcccttaatttctgaagtccaaaaagggcacaacagatatacaaagatatatattgactttgattgctttcgtatgcttcctaccttaatgcagggtttctgttagcagactagctagagggacggcttttgctgctatttgacacatatgcgattatcaattctcaggaacttcaattactgctgaagcacctccatgttactactagcaaggtgaggttgattaattcccaataaaatattatgcatatatgattgctaacttacatgttgccttatcaagagaaatgatatcaactctgcacttgttgtcaatatatattttgtttcactatatatccaatacagggcattattaatcatgtttcactattcttttgcttttcctaagcagatcaaaagacgatttctttagacttcaatacaagctgaacctggaaactccgtgatatacttgatgattgaaaggcatattcctttgcatccatggtgcttcttgtaagacataacttttttgttcatagattctctcacaaactctgagtgatctactttcagtttcagatgttcagataaaccatggagttaatttgatctattatttacatgattcatagtccatcccgtgttgttttccacggtaagtcttgtcattattttgttgacagaatattttatcagtagcttccttcacaatctctactctagtccactttcactatttatttttttcacattgtaaagttacattgtatagcaggttcttgtgtgaagatgatgattaacgggtgcatgaagatgatgattaacgaaataacagttcaatcaatctggagcaatagatagtatacttcaattagatggagaagtccaagttatgtatttgtttatgatattgtagctgaaattgtacattttttttcctgaagttcaacttttcatgtaagatgtaaattaccattcagtgaatgaaatgtgtgatttttcaacaagtccctccctgattttttttatttataatgctaaagtgtgatgcagtctgatgttctccaaataaaattgtggatgccagaattgaggaggtttgtttctgtatctaagaaatttatttgtagagacggtctgaagccgtgtctagtgtgtttattatgatatttctgcaaaatatggaaaatatatgtagagacggtttttctgtctctatggaccgtctctacctgatagacacggctagcaaaaccgtctcttgtttattgagacgggagcaatggcaacgcctcagagacggttcacaggccgtttctagtacacctagagacgggcaaaaccgtctctacaagagaagaaaaccgtctctatatcttgtttctgctgtagtgcatagaatcctgccttaatgaaatttactcaagtaaattcagcatatctaatataatatcatttataataggaaagaattaaaacaacaaccacctatatcaagaaatcaataattgaaattattatagatacttcataatatgaaacttttaattagtaaatacatattctacatgtatatataggagtatgtacggggtttggtgaaacattaggaacatggtatttgggttatgttcttcaagtcataacatatttcttttttgcaacttttgttatattaggttttctgatatttagtttttctgaaatcaataagagcacttgataaaatttaaataatttataatcgtgaaaaaatagcatttgtaaaacatttatatgtaacaatttagttatcagcatgaatctttcaaattaaaataaactagtattttggaccgtcatactaattaatatttcaacaatatgatactatcttgtaatattgaataaagaataattagtaagacgatgtattgcggggttaatgggggtgggctattcattcctgtcaccgcaccacaccacaccattatacattgtattattcttttaaaaggggtagtatagataatatatacatagctaattagatgtgtgcatcgaagaagtatcgtatcacctggacggcaatcaagtgcacaccaatagaactttcgtgtagaatttaatcatactaagaataattagagggtccacatgtaagtgagtggtgcaaaatattatagtagaggtggttctgtggctttatgccctaacttttccatgtttggaaagacgggcaaaaaggtaattacaagagtgtaaattctgcttgttgaacacgtcgtctcctaagcacacattgtcatgcatgcaactaactaatcataacaccaaatctttcgaagcttctttttgtatcgttgtaaatcgcttaagaaaaaacggcaagaatattttcataacggttcaagaatatgtacatataatatcggcttttgccacttgccagtagcacattttgattgaaaatcgaaaagcaactttagcatagattacccgtgtggcctctttatgcaaattgtctttatatttgtccctttgtacgtacggttaactagagctttgtatccatgatctctctcc

SEQ ID NO: 83280 - DNA, 576 bp, Oryza sativa
acacgtacgttagagacccggctcgatcgacagctcaaagccgtgatgactactgatgagctatcgatcacatgcgtcagaccgttagagttggacattcgcgtgcgtgcacgactgacatcgatcgatcgggtcgacgaccgaccagccatgagtcatgcagggcttcgatcgagtctttgacacgacgcatgtacagagagcgagaacactatcggtctttagaaaaaccaacttctatatgctatatatacaaatttaaacatagtatgttaattatcaaactcatgtacaaacattactttttatatacgaagctggatgaaatatagtctcttcatactacctctgtcctaaaatttagctatataaatctgtatacacagttatgtcatacccatactacataaatgtatccaatgttgggtgaatgacgagtggccctaaagataggattgggtcccacaattcaatccttaccgccatgatataaggcaagaaacatgtattgagagattgagtgaatgaaatgaattgaatctgaattccttccgctgttcttcttctttctttgcc

SEQ ID NO: 83281 - DNA, 6023 bp, Oryza sativa
aggcaagtcatgcattacaattgatcatattgtacccaatttacaaatatcccgcatttctattaaatgttgcattcttttacaatgtcatgtgggatgggtcctattactcatccatatattgtttacctatccatatattgtttaccttatgccattgataacttgggtatcaaaataactagatgttggtttaggaaatgcttagccatgcttagctcaactagtacacaaatggggatcacattattacatagactgactattagcatagctttggattggtgccaccgcaatggtgttagttaattaaaatacactgaatggtgggctgtgggtgcatggttttgttggtcgcacccatggtagttaaggaccggttcacgggaaaccctgggagacttatcgtgcttaccacaagagggagtgggtaactgcttgatctgaagtgtagctcgaccctttcctaggcaccggtggcgagggtgggcgtgatgtagttgggtcggccggggtgtccagttgtccagctgccggattcaccgcggcgcaaaaggggaccacccactgccttttgaggggtgggggtgaaaccttagcgtggtgtggatggttaggggagggttatgcggagggtcttgtcacgatttccccctttgcagtatcatggtgatacttcggggcatggcgacatgtgtggaatcgtgtcttgtgggtacagttgtatacctctggccagagtaaaactattcgaatagccgtgcccgcggttatgaccgatcaaccagattcaccgtgattagtctcacccctagtttagtttgatgaactggtgtagttcaggtggttggttgggccagttgcaacgtggtgtagcgttggacagtgattggttaatcttgcttaatctactacatatgtttttactgctttcaactactgtttttaaatgcctgctttattgcaaatgaaccctaagcctcctttggatatatcctgcatcatacctcctcttccggtatgacttgctgagtacagtgggtagtactcagtcttgctctcttttcccccacaccagagctgaagatcttcctagttggagctgtcttgtcgaagttggtttcgtcgctgccatcaaggattgcctgtggagtggagtcgccccgctgcagaagtcaagcttccaagtttagctcgcttttatcttttccgctgcatttgtaatcttttctatttttataagacgtggatctgtatgtcaacaattgtcgtttgtgtaccctggctggtcctagacagggatttaatgcacattcagcttagaaattctggttcgtgaatttctgggcgtgacaagttggtatcagagccaaccttgcccataagacaagccaactggaaacctaagagccctctcaaccccttttcatctgcatatgttctttgcactaggattagtttcgggaaaatttggggttttggctctttggtttgagggagaaatcttggtcgttcattcggatcggatctttaaagttagctcagtctagggttttagaaaaattttatttggagtttattcaacagtaagtcggggatttatcgggtgatatgcactaagtcgtgtctatgttcgatggggcaattttatgcgtatcattatgactatgcatctattttatgcattaatttattgtttagtcagttgcattagtgtctttatctgggttcatgaaaaatgttctatgcataataatcaccatgctcagttatttgtttgagtcatttgttgctttgttcaatttggatttgagcatgaattggttcctatcccttgtccatcttaggtgtcagacctgttcctcgatcgcaagtgtcggtccgagcttcagagtcgccgcccttagctgtatcatcttcttagttttgtttgcttgctagtttctgtgcttaggttagttgcttgtgggttagtcgacggtcgatatcatgtgtcagtggtatggctgccttcagtaggagttgtttgcttccttttcagtgtttttatcaagattaagataattgcacttaaatttataagaaagattagtttctaagcccctgtttttcttccttttctcatatttctacctatccccctccagatggtgaagacaaggaatggttcccgtgactccaacaacgccagcggcagcggagagcaaatcaatggaccacgtgccagcggtgcatctgacagcagttcatctccaccgcccgagaacccaacgattgctcaggtgttggacaatcagactcagatgatgacaatgatgatgcaacagatgcaacaacagtaccatcaggtgttgcagcaggtgcagcagcaagcacagcagcagcagcagaacatttagtttggtcttccacctccccagtctaagctgttagagtttctccgtgtcaagccaccgactttctcaggcaccaccaacccaatcgaggccaacgactggcttcatgctattgagaagaagctgaaccttttgcaatgcaacgaccaggagaaggttgcttttgctacacaccagctgcaaggtcccgcttctgtttggtgggacaactacatggtgacccgtccagctgggacagaggttacttgggcagagttttgtaagagtttcaataaagcacaggttcccgaggggattgtggcacaaaagaagagagagtttcgttctctgcaacaaggaaccagaacagttatagagtatttgcatgagttcaaccgccttgcgcgctacgctcctgaggacgtgcgcactgatgccgagaggcaggagaagtttttgtctggtcttgatgatgaattgaccaaccagttgatctctagagattatgaggactttgagaagcttgtggacaaggctatccgtcaagaggagcaatgcaacaaaatgaaccgtaagaggaaggcagctcagctcaggactccccaggggaagagtcagaagccttgcttcacgatgggacatcaaggtgaaccttccaccatgattatccggcagcaccgtccctaccacccgggtagcttcaacaagaactacaagagtggcagtcacagcaacagtgagcagcacagcctcaaccctactccaagtccactaatgattccagctcagtcagttcagtcagctctgccagctcagccagaacagcccaagaagtttggagaaaagcccaaactctgcttcaattgtaacgagcccggacacatggttggtacgtgcccgaagccaagacgtgccagactcaagttcgttcaggcccatgtcaatcatgcatctgcagaggaggcgcagtcagcaccagaggttatattgggcacatttcccgtcaactcgacaccggcagtaatattgtttgattctggtgcaactcattccttcatttccaagcgttttgctggtgcacatgggttatctttagtgaagcttaagatacctatgcgagttcatactcctggaggtggcatgaccacatctcactattgcccatccgtgacagttgaaattcaagggttgatttttccagccaacctcattcttctcgaatccaaggacctagatgtcatacttggaatggattggttgacaaggcacagaggagtgattgattgcgctagccgcaccatcaagttgaccaatgcgaaaggagaagtggtaaccttccagtctccagtgccgcagaagccagggatcagtttaaactaggctgctggtgaagaacaagaggtaacagtggagaaaaccactaagaagttggaggatattcccatagctagagattatccagaggttttcccggaggatctaacaacaatgccaccaaaatgggatatcgagttcaagattgacttggtacctggaactgcaccgatccacaagaggccttacagaatgggagccaacgagttggcggaagtcaagaagcaagttgatgaacagttacagaagggatacattcgcccgagcacgtcgccttggggtgctccggtaatttttgtggaaaagaaagacaaaaccaagaggatgtgcatcgactaccgcgcactcaatgaggtcactattaagaacaagtaccctttgtcaaggattgatgatctgttcgatcagttgaaaggagctattatgttctctaagatagacctgcgatcaggctatcaccagttgaggatccgtgaagaggatattccaaagacaacattcatcactcgttatgggttgttcgaatgcacagttatgtctttcggactcaccaacgcacctgccttcttcatgaatttgatgaacaaggtgtttatggaatttctggacaagtttgtcgtggtttcatcgatgacatactgatctactccaagtccgaggaagaacatgaacagcatcttcggttggtgcttgaaaagctaaaagagcaccaactatatgccaagttcagcaagtgtgacttctggctaaagaaagttcagtttcttggtcatgtcgtaagtgctcaaggagtggctatggatccaggaaatgtggagtcagttaccaagtggaccctaccaaggacggtcactcaggttcggagtttcttaggacttgcgggctattaccgtcggttcattgagaacttctctaaaattgccaagccaatgacacagcttctgaagaaggaagaaaagtttatctggtctgctgaatgcaatagagttttgaagaactcaaacgacggttggtgtctgcacctgttttgattctacctgatcagacgaaagatttccaagtgtattgtgatgcatccagccaagggctggggtgtgtgttgatgcaagatggcaatgtggttgcgtatgcttcacgacagttgcgtcctcatgaaggcaactacctgacccatgatctggagttagccgcagttgttcatgctttaaagatctggcggcactatcttatcggtaaccgttgtgaggtatatacaaatcacaaaagcctaaagtacatcttcacccaacctgatctgaatctctgacagcgaagatggttggagctaatcaaagattataatatgggaatacactaccatcccggcaaggctaatgtggtagcagatgccttgagcaggaagagctactgcaatgttgcatgggtagaaaaactatgttgtgaggttcaacgcgatttggaacacctgaaccttggtatagttgagcatggattcgtggctgccctagaggcacaacccacacaggtggagcaggttcgcatagctcaagcaagtgatcctgagatagcagaactcaaaaagaacatgagggttggaaaagcccgaggttttgttgaggatgaacaagggacaatctggatgggagaaagattatgtgtacctgaaaataaggagttaaaagacctgatactgacaaaagctcatcaaactcagtattccattcatcctggcagtaccaaaatgtaccaagacctcaaagaaaagttctggtgggtcagcatgagaagggaaatagctgaatttgtcgcactctgtgacgtctgttagcgagtaaaggcagaacacaaaaggccagcaagtctgctacagccccttcagattccagaatggaagtggaaagaaattggaatggactttatcaccggcttgcccaggacttcatcagggcacgattctatttgggtagtcgttgaccgactcaccaaagtggctcacttcattccggtgcatactacctactcagggaagaagctagcagaactttatctggcaagaatcatgtgtctacatggtgtacctaagaagatagtgtctgaccgaggaagccaattcacctcaaagttctggcagaaattgcaagaggaattgggaacccagttgaacttcagcacagcctaccatccgcagacttatggccaaactgagcgagttaatcaaatattggaggatatgttgagagcctgtgcacttgattttggtggatcatgggacaa

SEQ ID NO: 83282 - DNA, 38628 bp, Oryza sativa
  unsure (1)..(38628): unsure at all n locations
ttgaagaggttctaacaactgtagtttctcttataattaaaaactccccaaacaatcccgcatattatccatattttgagatattggagttacaaaatctagaaaataaattagaagccagattatggatttcttatagcatatccaaattctcagaagttagctaccaaccagctgtttcttactccatccgtcccattttaagtgcagctatggttttccgcgtctaactttgaccgtccgtcttatttgatttttttttgaaaaaatttaaaaacataagtcacgagtaaagtaatatccatgttttattatctcataacaacaaaaatactaattataaaaaaaatttaaaataagacggacgatcaaagttgggcatggaaacttatggttgcacttaaaatgggacggagggagtacaatattaagcttcctcaaactgggtttaagaaagagatattcttccattgttagagaggttacttccctaccatttgaaaggtaacgaatttaaatcatttgaactgattaaaacaaactattgataatataatgttaatacttttctggttcttgtgatgatgtataaaatgttatatatacatcgtagtattagacaggagctagatatatacccataactaaaaatattttactgtcttcgagaaaacatctgcatgtaccaaaattttgtaccgatatctcgagatacccaatatatgtaggtaccacgttttacattatcaaatccgatatatctcggtacaatttttaaggatggtaaaattacctcctaactatatctaagttgaactaatttggggctgcaacgatcaataagtatatacatatatattcttatagaattgatttcagacttgaattgagttaatgcctccgtaactccgtttgacatttcctttatatttttgtggcaattcgtgtgctcacgtgtagcatcaactgacctatatatatatcttaacagtttggctgaaaaatgtaacttgtaacaacttggtacgcaactggatcaataagtacatattttcataaactcgatttcaacgaccttggataattgatcaacttaatgtctcagcttaattagaattttgttcgtatttttatggtgatatatatatgcatgctcacgcgtagtatcaattgacctagatctgttgcagtacagtgtattgatcataattaacacatcagtactgcaacgcagcaatcgcaaatgcacgcactgtggcagaaagaaaattccaacttaattcataattgtccctgcacgagattgatcaacttctgaaacttaggattaattgcacgggctgttttaatcaagtcgattgatctctgggtgtcactggtttgtttctgagtcgattcgcatttgcacctaattattattatttcgatcgcgtcagcttcagcaagtttaatacatgtcctgagtgactcgatagcgttgctttcggggtcagcgtctagaataaattggccattaaactcggtttcgctgaactgaaacaagaagaagaagaagaagaagaagaagaagaagaagaagaagaagaagaagaagaagaagaagaagaaactgtagctagctcgatgtgtgagtagctctctctgctacgtacgcgtgtacaactacatatatatactgacatacacatcgtctgacggattcaattcgatcatcgatccatcgatttctcccccttaatgtcacgccgcagtttactcctcgatcgacagtgtgcggctttaaattttgtttgtgtgcatcgtatcgatccatatctcctacgatcttggacgacaaattcgtcccatctagtggcgaaggcaggaaatttcctgaggcaggacgccttcttcgtagcttaattatggattatgcattatcattagcaactaaccccttctagctatgaacctaaacacatgcatgtccagattctttatatctagagtttctttcttttgagacaaagtagtaattctaactccaactagcatttttctaaaaataaacacagtataatcacaaacattcacgtacacgtacgcacgcactcacatctaacaacatacacatgcatcctagtcctataaacatctccaagaaacttagccgcatatcttcatattggtaaagtcatctcgatatggatgattgggaatcggcatgttttatcccagaaaacctaaccagttaatctacgctcacttcgtaactgatataagcatcgcattagcatgtgaactcatcacaccctaatcttattctagctagtgaaagttaacaggggttttgactgtatgcgtatatataagcatgagtaataattgagcttaatttgagttttgggttcagttaattaatcaaggtaggcatgcaacctgacagtagtgatcataatctgcgacgaaattcccccacatgatgccaattactccaatcactaatctgccagtgtccggccggtgcatgcaacgggataacaatggcgctagcaatgttgcagcaaaaattagctgtacgcatgtgatggtgtgtgtggccgaatagttctagcgtacacatgtacactcttatattgtccaatatatatattctggtgccacacagaggagctaggcagctgtttccaatggaaaattaaatggaatatgacgacacaatcgatccatgcatgaatgccggacatttgagatgcatatatttctccatatatgggtcctgaatctgcaattaacaccactgcaggagttactcgatgcattgtaattgcatccagtactatactatactaactcaagttattatatatggcaggcaaagtcagcagcataaaatctagaggttgggttgccaatacttataccagctagtactagtcagtactcagtacatatactgctacactgcttcttacacatattttcctgcagtaacattgcaccatgggtatacatatcatctctcatcaataatgtatactccctatgttacctccgttccattttaagttcagttgtaatttctgtccaatgcttgaccattcgttatatttgaattttgttatgattagtgttttttttattaaatgataaaacatgaatattattttatgtgtgatttttttaatttttttattttttttaaataagatggacggttaaacatacacacagaaactgataactgcactcaaaataaaacagagggaatagatgtgatttgttctcactctcttgcagcctcgcagtgctgcaatttagtagtagtaccatgtcagatggctcttctactatccatatggcaaataataatttattgtgagcaacttaattaattatttatatatgatgatgatccatctctggatagtaggtagtactatgaccatgtttagatcccaactttttttcttcaaactttcaactttttcatcacatcaaatttttctacatacaaacttttaacttttttgtcacatcgtttcaatttcttcgaacttctaattttatcgtggaactaaacacaacctatatatagatacccttgatgcatgcatgggcataatttctccttagattattgaagaaaagatatgtaattaagctatagttagtacagcaactttgcatcgatgcttcagtgcaaaacacacatcatccatgcatcctgtgctctctcctccatatattgatctttagttctttacagctaagctagcaggagaggcaagcggcatatgcatgcagtgaagtacttgtatggatgatctctctatctagccagagcatactaataagtcatctcacatgtgcagtggtggaggtgtgcatttatgaatttgttttctcttttgctcagcattcaattcccacactctttgagtctgagttttctctgccactttgtttatcaccatgtctctggctccatcagcaccaccgtagctgtttagatcgaggggtgtaaagttttaacgtgttacattggatagtattatatagggtgttgtatagggtgttcgggcactaataaaaaaactaattacaaaattcgctagtaaaccgcgagacgaatttattaagccttattaatccgacattagcaaatgtttactgtagcaccacattatcaaatcatagagcaattaggcttaaaagatttgtctcgtaaattagtcgcaatctatgcaattagttatttttaaacctatatttaatactttatgcatgtgttcaaacgttagatgtgatggggtgtaaattttttgtgcgggaactaaacatggcccatgtctctctctagtctatatcttttctttgactgctatatatttcatactcctactcctactatactcagtaattaagagggtgtttggatccaggggtgcaaagttttggcgtgtcacatcagatattatatagggtgtcgcatggggtgtttgggcactaataaaaaataattacagaatccgtcagtaaaccgcgagacgaatttattaaacctaattaattcgtcattagcaaatgtttattgtagcaccgcattgtcaaatcatggagcaattaggtttaaaagattcgtctcacaaattagtcacaatctgtgtaattagttattttttaacctatatttaatacttcacatagatgttcaaacgttcgatgtggtagggtgaaaaattttgaggcgagatttagacagggcctaaattactgccaatgttcaaccatgcatgtgctctttctccatgcaactgcactgaaatttttgatggagcagtagtgcccaaattctttaggattatgaatgggggtaacattaagttttccctgcatatatatattcacatgtctcttcagcatgcttgcatgaaatcttttttaacttttggccatgaggtcatggcttgcatatgagagccaggccatatttgaaaagttttttctaaaaaaaaaattaagtaagggtgtgatgcatgaaggacatcatgaacaggacagtgcagtgccttggctacctgaacatgcaggagaaaggaaaggtcgatggcactctataaaatctctgcaagcgagagtgagctatagtggcatttaagcgactctttgtacgtttccaagaactactcaagtcatgacattgcactctagctcttgtttccttgtacttaaattcagcagtagtatatctacaagcatatgtacatgtgcatatgtactatccctgtaatgcgatatactacttgcatatacatttgtttttaactctcccaacatttttgacagtatgggtaaaatctgactgcatgtaaaaaaaaaagaaaagaaaagggagaaatctcactactgaaccaaccatatactctacccgttccaaattataattatttctaggatttaaaatttctaccttttcatcttaaccaatcctaattcttttttacctcaactttattaatttccgctaaaacttccggaaatacttatagtttacagaatcagtaaaatatcactgcatctcaaaaaagagaaatctctgacgttctgaaccaactagattctacacgctgtacaatcaaacatgcatgtcggtaaatttattagcataggcttgaatttttatcccattattaaaaaaatgtcggtaaagttattcaataactattcccgtttgatatatttgcctatttctatctcatcaccctggtaagtcatttattcaagataataccaatttatagttttctacttcccgggctccttatgatgagttgatgacaatcaacattggcatgtaaaatagtctttattagcggtctctctttatcgtcatgtaagtatatttggtgacgtggaagagagaggaagaaggaaagagaaagatggttgctacgcatgacaacggcatatagtcgactcttagcatttattagaaattttttgttgcattgagtctaataaaggaaagatgactagtaagaaagtattttggtacattaatggttagagaccgtactatcttaactattgtaacgtgatagcctctaattaatgtagagaccacaccggtctctacctttgtacttgccctcagtccctcacttacttgtggttttccgaaaaatcatgcataaattaagctagcatccaacggatttgctaactggtatgcgacagaaatttagggataaaatcttacatgttttggatcgtcaaattcgcaccaagatttgtgcctgagctccttctcctataactccggcgccggtgacgcccagcccaactcgatccagctgattaatacacagttcttcacaaccaaacggaagaaattcgccaccatctgctcttcccaagtttctttggagctctcgcgtcgtcctcccctaggggcggcacgggaggcggcgacccggccgcccctctccctcccctcctccccctctgcttcgccgccgcccgagcggccgccggcaaagccggccggccgcaaggacggcggcggcggggcctctcgcgtcctctcttccgggcgggcagggggccgtcctaggcggagcggcggtgaccaccagatccagcccgctccggccggatctggcggggtagcgactagcggcggcgagggtgggggcaacggcggcggggagggcgacggcgatgtcaagggcgcgtgacgctgggcggtggtggctgaaggcggcggggatggcgatggcggcggggatggagttggccgatggcacggaggcggcggcctggtgctctcgtggcggcgacggcacgttacttggtggcgacggcggcggtaccccccagatccgcgcctctcggccggagctgcagggtggcggcagttggcgacggcggcggcagtttggccagcggcagtttggtcggcggcagtgggcgacgacgacgacgacggccggcggcagttggcgacgacgatgacgacggccggcggtagttggcgacgacaaggacgacggccggcggtagttggcgacggtctcggccggatctagataccggcggtagttggtgacgacgacgtctgtgtggtgtcgtcggcggcgccggcagtggccaggcgaaaacgtggtggctgccgtgtcaactggcaacggtggtggaagccatggcgttgagctgttagctgctcggtggtggagggcgacggtgcagcaaaggttttgcggaggcggtggtgatgtcggcggcggggaaggagtcgggtacgagttgggaataatgacggcgaggtggttgggtgttcgccagcagcggctgtggtggtggtgaccgtgttcgcggtcaccgaaggcatagcggcctcggttgactagccgagggcgtgggagacgtccgcatctggtcggcgcggcaccgttcggtggaggggtcgaagaccggcttggcacagagaagtgcagccgatggcagtggaggccggctcggcgcgaaaggcacggccggcgnagatgaaggccggcttggcgcggaaggcgcgcccgatgaaggaaggccggattggcgcgagaggcgcgtccagtagaggaggccggcttagcgcaaaaaggcgcgcccggcggtgaagaaggcgacctaggtgtgaggaggagctgccggtgggtgtggcgcggtcttcggcgcacgaaggctggccggcgggggacgccggtgcaagggtcccacatgtcggcaaagcttgtgtggtggtggagcatcggtgcatcagtcgtggtttcgcaagggcgatctcgtctgtgccctttgttgatctagtggcggtcggtcacgcttagcggcggccaatccggtgctagccttctcctggtcgtgtgtgttggcgatgtcggcgtgtgggtggtggtatattttttccttttcctagttacgactctctccagggttgtaatcttataattttttcctgctctatcaatagaacttcgcaccgtctcgtgcgagtcgttcaaaaaaaacaaccaaacggaaagaaggatttcgacaaatttgctaattaaggctgttgagccttaattagctgttagaacattcagggattcatcgttaggcatattttggtgttgatctttatatagaaatacatataaatgtgattaaaaagacacactacaagttgttataaatgtgatatttatatagaaatacatataaattccttagactctgtttggaattagtgctggctttttttttctgaaagtagtgctcggttgtcattggttggataatcccccgtccaaaaatataacaacttttagcactcaggttttatcctaaaatataacaacttctccactaacattctcttaccaaccaatctcaatcctcccaccattcacttttcacaccaaccaaattcaaaaaatgcatattgaattttaattttttttgacaaaatttgatcggaatttaccaggaggcagtggtcgtttttggctcggaaccggttaatttgatgaaccctgaacataactctagtaagatacagtatatacttgccaaaggagctagctgagccacagggtcgccatctcaaaggaagaaaaattaggtcaaatgtctaagtagttataagagctaacaaaaatgtgatgctgtcgaattaatctaatgacgtacaaatggtcttctaggtacacatttggcggtgacggagaggctgtaggagagctagcactccacaaaggcacaatgccaatttatttcccatccctttccttgtgtcgatgcctatctttactcaatttaattcgcattaattggaattgtcatgtaaaatcatgtattgcaagtgcttttaagagcttccgctcttttctataatttctaagatatcgacttagactttgatacatatatatgtttgatcgatcattgtcttttcttatcatatatccataaaaataaaaaatatataactacctaaaagtattgttatgtccaaatttgcttattttcacatatgaaatcttaatttttttttctctgagctggttttgttagacttggccacaataacgtggggataacatatcttaaattaatttacatagactatgatgacccagttggcacatttgaggaaaggcaatcaatgatattcactaaatgagatgcaagatttattgggcatgcattatttgtcttgctagtacatagtagcagaggccctatttacatgtatatataaataaataggagaaaatcagaaaaggattatgtgttgaaaatttgaagatttttcttaagacattaagtccatttcaaagtagaattaagttgcttttgggaaatcagcaccatctataatctatttttttattggtgtggggaatggtaggtgtatgactccacctatcaagtaccaagttttagatccatgtgttcagaaatatggttgtgtacactttttgacgtaggagtcacaagttatacttccattgtaaaaaaaaaaatgtttgttccacatatcaataggaggaaaaaagttacagtatatttttatggaattgggctgtgatgtttgttattagagatgtagttatatatactctatcgaagtgcatcaaatagttgatgttttgttattatccaggccaaacaaatatatattgttcaacctcttttaaacaaagaaatactagcaagtcaatggaagtgatacactatgcaaattttaacgtttcatatacagctccatgaaagtatttggataatgaattatagtaattaattggcatttcatcctacaaaaaaatatgtttttttttaaaaaatacaaatggaaattattaaagattgttattagcccacacaacctcgaatttggtgctaagtatagttgctaacaagacaaagtttaataaaatcgatgtacatatattatataagtagagaaattaaatactacctacagcatgcatgtgattttcattattaaatcgaatcaaataaatgcatgatagctctatttttattctaattgaataaaaagatcatttgattttcattatttatgctttgtctgataatataatttaggttaaattaaaaggtgccacaaacacacaagcattcatagaaaaattaaccggccggtgcaacatgatgcccggatctcaagatttaaatacacgtaatttaaacgagtatgatttcttatgaatattaactagctctcaaacgagtttaaactaaatttgagcttaaaaatgcctttttttaaaaaaatcttatgtgataatggaataattaaaataaagttgagtttaagtttgttttgttgttatgtatatttataccgattcacttaaaaaacattggttaaaagccttaaggcatagtatttaaaaaaatgcaggaatttcattggaaatatgtcatttccaacagaattcgggaagaactcactttccaagctactactcatcagagcggcaacactcgctagatttttctcagaaaattaattaggggaaacaagacacgatgtatagtaaaattaataaactgtaacatctatacacatatatatcttttaaaaagatgtacatttatgtctttatttatccactcaggactaactaatcacaagtcacaggcctaccattagtataaattaacttacatatgatcagttccaaaccctagcatcatcagagagactaattaactaaaaacctacaaaagaaaggattaattaaccaagctagatcaacacctgcaaactcgatttaaatcaccgagaattaactcgaagcccttttaattagctttgattagttgcatcttgattaattaactcggcaactttccattatttttttttgttcttgctgtctacttgattaatttaattttggttgtactacacttaaaagaactcactggggtcccccaatggcaccacgtccatgagccccatgccgccgtcgtcgagcagccagctctccagcatcgagaacgccggcgcggggccgccggcgccgccgccggtggccatcttgctcgtctccgtcgagcactccggcgtctgggcagtcgccgcggcggcggcgccgctctggctcgccgacgcggacgcggatgccgcgccctcgccggagcactgcggctgctgctgcgtcgtcgccgtcgtggaggtcgaccccgacgcctcggggcccttgccgttgccgccgccgccgccgcccgggcgcatccagccctgcagcagccgcgcgatgttgtccgcgctcgacgcgtacgccgccgacgaccccgctggcgtcgccgccgccgccgccgtcgccggcgacgggtcggggtggtcgagcgagagcgcgtcgcgcagcgcctgccgcgccgtgtggatgtccgtctgcagccgccgctcccactgccccttaggtgcggcggccttcacgcttttcccgccgccgtcgccgtcgccgcggccgccgccaccctccgaggcggcgccgctgtcttccccaccttcggcggcctgcatcttcttgagcttcttcttgaggtgcgtgttccagtagttcttgatgtcgttgtccgtcctctccggcaagtacgacgctatcgctgcccacctacacagccagcaacccactcatcagccatggacgccatggacaaatcaatcaaagcaaaccatgaaaaaccaagaagaaatcaccggttgccgaggagagcctggaggtggacgatgagcttctcctcctgctcggtgaagttcccccgcttgatccccggcctgaggtagttcgtccaccggagccggcagctcttgctgcaacgcatcagccctgcacacgcgacgcgcacagatgaaaacaaaaatctcggatctctcgccgatcgatcgatcaagaacgcaagaacacgcaccggtgttcgtcggcacggcgcgccagttgccggcgccgtgctcctggatgtaggagaccagcatcaggtcctcctccggcgtccatggccccttcttcaccccgaccttgtcgcagcacggcggcctccccatcctgcagctcgccggcggcgggcggcggtggttggtggtgtatgcgtgtcactactactcgatctcgatcagggaggagacgaggggagaccggggtccaagaagaagaagaagaagatgggggtaaaaggggagggggcgaggtatatatataaagctagctagtagctagctcgccatggccgatagatggcaagctcgagctacagctgctgctgttgctgtgaactgtgaagtgtcactgctagctgcagtttgtgctcgggtttgacctaggtagaaagctgagctaataacatataacgatggatgaactgcggcgaaatgacatgttacatgtacacatggtgacaagaacgcagatatatactagtatggcgtaataaggcgaaaacgaaatattgtttttttattaaggccctttttagtttcaaagtttttttttctaaacttctaactttccatcacatcaaacatttcatacacacaacttttctataacatcgtaccaatttcaatcaaactttcaaacttcagtgtgaactaaacacaaccctgtttattttattttgttttgcttgctggcgcaagatagatatgcttttttaaaaaaaacaaagtacaaacacatacacttgtattgcgcacgcatccgcgcacctatctcaatgagcatctccgaaagacaaaactagtatatcttgagactggcgaagttatcatgagcgtctcgctgtcaacgggtacgtgacctattactgaaggaacaattagccgtaaatgcaaacattcatatcaagtttagaacttaaatccaagcggttagtttcaccacaaggatcataattagttgagttacgctcatttcgtgtgtgtcgtcattttagtttgctcttaaatattaatgaattcatttaaagtggtatagtagatttgatttagttgtgtggggctgttgaattttataagcagaaaaatgcaaaaataaataaataaatcttctcatatgtaattttcctacctagacattttggccacgccattggtgacgtgtctaaacaggacaatgctgccacactggaaagaaaaacaaactttggggttggcagcctctcgttgccatgccgttgctaatggcatgacaaaaggttgaactattgggaattaagatgcaagaaagcttgtatgtattcttttaggaaaatatttaaatatttttaatatcatctgtctgttgtgattgaattttaaaataataaccgtatgcatcatttctcatgaaatcgtatatatatttaatttgtggtgtcttgtcgtcacacaaataataattatggctttccggtgaacataaagatagtaaatatgctatcttgctttcaagtatttgtttttagggttaattggtccatgccattacaaatatgccaaattagaaaaatattattactattcgtgatatcagctaagtgccactgaaattttataaaattaaaatcatatcatcgccgttaaatttactgtcaactccatcgattttaatctcgttctcctccctctctctctcttactgccgctctctcttctccactctctgtgcgaggctgaggccgaagaggtggtcaccgcaacgctggctctggtcgaggtagagctcatcaaggggaagccaacggtggtggccataggatctagggatgccctgaacgacacataccagcgtccgaagctcatggcaaaaatggagagagaactcggaggaactatgaggtgcaggaccttggaaatgaccagtggaagggaggggaggaggttgatgccactttattggtaggaggaaggaggggaatgaccgtggggagctcggccggccatggaggaggcgaaatggccgaagttcaatggagatagaaaccggtgatttaggtggtatttgaatccagggactaaactttagttcctattacatcggatatttggacactaatttgaagtattaaatatagactacttacaaaactaattacataaatgagagctaattcgtgagacaaattttttaagcctaattaatccataattagagaatacttactgtagcatcacataggctaatcatggattaattaggctcaatagattcgtctcatgaattagtccaaggttatgaaaaaatgggtttgtcagtagtctacgtttattacttctaattaatgcccaaacatccgatgtgaaaggaactaaaattttttatagctccatccaaacacccccttagtgcggtattgaatggagattcatgggggaaataaaaagaagggaatggggaatcgatttttgtaattactaggaaatgaaattgtgtggggaggtggattaacttgttggtggggctatggttttggccgggagagatgaatggctgagctgaggtgaaagacgacgacgtgtcacctccctaggttggaacttatggtgggtcccacatgtaagggtattttggtcaatatgatgatagaaaatgtgacggcgatggtatggttttaattttacaaaattttagtggcacccaaccaatatcgctaatagtaatgttatttttctaattttgcacatttataatggtatggatcaaatttaatctactcttgtttttaccttgtcttgtggatgtcatggttgaaatccaaccaaaccttgtcctctgccaaaatcttgtgtccctcttatttctctcaagggaaaaatggaagaaaaaaacgaatgcgtgggagacggcagtgtgaaaatggctaaaacataaaacaaatttaattttaacttacttttcttccttacctttcttaaatcatgtggtttagatttattgttcccccgagagcctgagacatgcatgtatttgttctttcttctcgtttgatctcctttacatctgtaaaagttcagggtttcttcaagaacataagaatcttaattataacacgaattttgtaggaattagttcaattcctacaaattttcttcaacatgtccttcatccaaaagaagcccttgaggccacactagcacaccaatggacaacatattgaccgtgtatttgtatctccaataagattaggtggtgtttggatgcagggacgaaactttagtccctgtcacatcggatgcttggacactaatttggagtattaaacatagactacttacaaaactaattgcataaatgagagctaattcgcgagacaaattttttaaacctaattaatccataattaccatatgttactgtagcatcacataggctaatcatgtattaattaggctcaatagattcgtctcgcaaattagtccagagttatggaatggattttatcattagtctatatttaatacttgtaattagtatcccaacatccgatactggatccaaatttagtgtaggtgtttcttacaccccaaactcaagtcttttcagtttttttagcaagggcttggcagcccctatttctattgccagaaatgtgacaagctacagagttccaactcaaatcttttcatgtcatctcatcttacatggcagaaaattaagaggtgcactcacactaggatttaatttagttaacccacaacaacctagcttactatcctaattaacacgatgttgacgacccaaacattgtttagcataactcatagtacaaggttccagaaatagattttctgggcaaatagctagtacaacagtgaacagagattgtcaaacaattaacaagaattgtcaacaagccatgttttcacaagaatacacaacagtaaaatcttgtgtgcagatgcgccaaacacgtggtactattatctttttggcagtgagtagggagttcttcaaaggaggacagcaagggtgcatttaatcggatgggggctcgctaaagtcagcttgattggagtgaactgatctgcgtgcatttatttcctgagcccccctcatcatcatcgtccccggcccacacacctttttttttccctccttaaactcactttttctgcaccatcttattagagcaggtataatagtgggctataagccagctgcaaatatattttaagaagataaatgatgagagagaagggcagcgggctacagatttgtagccagctatagcacggactctaagacgctgtgtgtgtatgactggtgggaccagatattaatagtatagtatgtaactattgtatgaatgagctattagattgtctatagataaattggagctagtagttggctatactattgaacttgctcttagtagtattaaggtttttaaacgggtcaaatgtgaattcaatagtttcaaaatgaatgcagcatccgaacatggcatgtttggttgctgctacaatttaccatcatttgttagcaaaattgtcaacttgtctaagggtatatttgggggagctactcccccaaagagtttaaatttcactcacattctaagaatctagttgtagaatctaaaaaatgaactagaacccagaaactgaaaaaccccttcttcagattctcagaagctggttactaaccagcagattcttaaaatcttaaactcacccaaacagaaccaaaggttatgtgcgtaaattctttgccaaacttaattagcaaggctaaaagaatatctccacatttttttaagtcattcacaaatggaacctaatttgttggttggaaatattatcgtaattgtggctacaacggaacaattatctgagttaaacaatcttaaacgtgataaattatggtaagtgtgttgtgtctgacaactaaaacatgtcaatagcgtggacatgatctttgaaactattcatacagctcggatgtcatactaagcaaacagataaaaattaccagctcgccatcactttagaatagtgacaatgatctaaatgtttaatctatgactgataagtcatggaaaaataaactaagtaaccaaaataatttatggacaaatcttccattgtatacggactactttgcaatacatgattctaaaaatatacgaaagtagaaaaatacggaaatatgatgtcatgttttacacaatgatcttaggcaaccatgtttcagtagcaaataataaaacaataaatggacttttaggggaatttcatacctttcactcctcctctttcttctttagctagaaaataataaaataatgaacgtggtgtctaatagcaaataaccatgttttgatggtgtctttttttttctaaatattgacttctatcgtatccaccaacaaaatttaccttaatcttatagggttaaaacacatgaatataaatttggtgtgtttggatgcttcacgggaaataaatgtaggaattttaaagaaattgtgtgtgccagagatagggtagaggaaggaagagagtgcatcggacaaaagaggtatgagctcatgtttattttcctatgaaacaggggcaaacccaaaccatcggaattttggcatctctatgcctttgatccgaagggtctatagaaatttttttttgaggatttcagttctccacaaatcctttgaaaattcttcgatccaaaatagccctacatgtgttcttagcgatataaaaactaataatggaaactaaactgcaaaaaaacttcaaaataggtttcaaataggttgcgaaaaaccaatgaactaaattatgttttaaaatctaaattttagctacggtagatataagacaacaagcaatcgaggagaggcacgtctcatttttatagttaggggctgatcggaactgttggctgctacagccgtcacggctgtggccgttttcagctgctgctgctgctttttagctctcgtagccgcagcggttgcagcaggaagcgctaccgatcacactcttagactcaaatagggaacggtttcctattcaaagtacagtgccggtttgaagaacctcgtttcctatgtatttttacaggggtttacttgcagtaaactttgcttgagtgctcttacctttagaaaggcaggaaagatcaagtatgtgtggtatagaacactagttcttgttgtatcctaggacataacccttcgaagggggttaaatctcactcaaaagtcgctcaccttcaaattgttttgatatcacatatgtgaagccttggatcatcaggttatatataagcaattttaccatccaacatttggtacctcgaggtaccacatttcacacacaattttcatacctcaaggtattactccctccgttccataatataagggattttgacttttttgcttgcactatttgaccactcatcttattcaaaaaatttatgcaaatataaaaaaagtaagtagtttggataataaagtaagtcacaaataaaataaataataattttatttttttaataagacgagtggtcaaacaatacaagcaaaaagcctaaatcccttatattataggacggagggagtactaactaccactaattaagtacctcaaggtaccacatttcacacacaattttggtacctcaaaggtactactaagtacctcgagctaccaaattttacactagaaagtatgtggaggtaccaaaaattcgtagtatctcgaggtattaaatgttggatgataagattgctcagctatataagctatatatagttaggctcatccctttgagtatgccaattgatatcagggaaaggcatgactcaagtattattgacaacatttttttgagggattattgacaacaatttatatgctctaaaatttactgcatgtggccggccttcaaaaaatgatcaaaaaatttatagaaacacgtcttgtttaattgtcctgcccatcatgtactgaacatatgtacgtagaatacgatgaaattaagccagcatggtcccttcttgagtgtctacttcatgtattaattaacgcataagtaattattgattaagtaaagccggaattgcatgcgctgctatattattttgagtgaatcttctatgttgtacagaatcaaaccagctctcatgtatgttctgtacgtgcatatatacgcgcgtgtacatatatacgtactgtgtacacgcgtatatacagtatgtgcattagcgtgcaaattttaaggcccatttgaatagcaggattgagaaaacagaggaaaagaatatcatacttattggattcctatgggattttaaaacacaagaaagtctccaaactatcgtttgattagcacatgaaaaaaacgcaggaattttagatacatgaagatgaaaccatgaggtgagaccttatatttattttcctctaaaattgctctagtaagatctattccataggaattttaaagaaattgataggaaacaatcctctgtttcaaaggattctataggattatttttcataggataaaatcctgtagaattcctatggttttttccttttgaatcaaaaggggcgttagtatatatatacggagtagatcagtaggatcgatgcacgttaaataatatatatacttatatttgcgttctcgattggtccacaacaatacttgctactcgtgcatttacacacacacacacacacacacacacacacacatatatatatatatatattgattgattctgactcgttaaattgagatataaaacgcactactttcatcgtaaaatataagtttttggttaataacggatcctaaaaacataaacctcactttagtggaattaaatagggaatgttgtgtagtggaattaaatagggaatgttgtaattggttgagaagatgaagtggatatggaattttaatgatggaagattctgattggttgaaaagataacgtaggtgaaaaagttgttatattttggatcaaatttaaaaggctagatgctattacatatattttgtgatagatgaagtaaaaggtcaaaatgttttataatataaaatggagatagtacctgtgtacactatatataccattatatattcgtcattttcactgtataacaagatgtgtggatttaattgtgcgaagtaaaagtagctcaactgatttggttccttgtggtggaatcaacccatccggattcaagtctagacttgaagtgaagcgctcgtgatgatttcatcaatctcaatatatgctggtccagtcttccggaagtgatcataggggtagggtgtgcatgtgtgcgttaatagggatgagtatgcgcacgttacaagtgtctatgattgtactgtgttttttttaaaaaaaatgtgtggattttgtcgacgggtggtacccgtagaccggatatagagggtattggggtacgttggtacaaggatctacgtagtacgacatcaagcaaacaaaagacaagaattatactggttcaggccccttgataggtaatagccctaatccagttgatgtgggattatatggtagaaaacacaggttacaaagagaacaagggaatttgttggatccggcgagattgtagtcgagttgattcgactagctctcgatgacttggctcctcgtaagctccggcttcgtaggctgtggaggttgtgttggctctgagattcgatgcctaaaccctccccggggggccccttttatatcgcagatgtggaggtctcctcatagaactcggaggtatcagaccctatacgatacgccaacgacccggttctgcccgagtaggattcttcccatctgtagattccgtgaaaggtttccttagaatatacaggaaatatccgcatgcgcgtgggtatgccatatcaatatgtaacgtatatcgaagggtaaagggtatgcctaacccgtaaccttgacagtagccccgacttctgcttaaaatgaactcgtgcaaccatttgcgacttcgggtgtcgagactgttgtcattcccggtgcgaggaccgcggagatagaccgtagtcgagcacgccatttgaagcccaacggtcacgagcgaattttaaactgaagtccaaaaaaccgccgcgcgtaacgggaccagaaatttccggcgggcatctctctctgttcagtggaattcgcaccgtcggtagtgcgcctatttaaaggaattttgggagtccattttgaagtccaccgaacctgttaaacacacaccacctccaagcactctttgccttctctgccgccgcaagaaaccctagttcatcaacctagtctcgttttccggcgaccttcgatcagcaatggacctcggcaaatcagcttccaccagtgcaatgttgaagaaactccaggaggatggcgctcttcctggccgtggaaccatggagagggaagcaggaggtactaatcctcagcccatcttgggtcgcatggttgcgatcgaagattatgttctctgcggttttctccctccaccttccgaatttcttttcctggttttaaatttctatggtctttctcttttccatttgaaccccaattccatcgccttccttagcatctttgtgcatctttgcgaggcctacatcggggtagagcctttccttaatctttttcgcttttactacgaactgcgttggatggaatccaacagggtatctggttgcgtcgggttccgacttcgggatggcctgaagtcgcgttatattcccttccactgcccttcttctcgcagcaagtggaggaataggtggttttatcttgagatcaaggaatcgaaccctgtcttcgtggttcccgaagatcaaccggacaagattccgtcttggaccgcaaagccccccttgaccccctctcttcagtcgtttatcgacatcatcgacgatctccgagtacggggtttgtcaggatatgaagtcgttgcagacttcgttggtaggcggatccagccgcttcaggctcgagcccatccagcttataactattccgggccagaggacgcgacccgggtttctcctcagggtatctttctcgcatttatcttgacatacttgtgctcacattcctcttgacttatcaaaggttggttctcgattaacaggtctgagcggtgaaaccgtggagcgccgcgtcggccaagtgatgatcagtggcccgaccacggcgagtgacatccctgtgcccctttgtgaaaagggggcggcggaacgtgatgaagccatcaacgtaagtatattcgatgaacatcccgcattctcctttcgaaatcaatttatgacttgattgagcgtaggcccttcctttgactgatatcatcggaccgctcgcggaccatcaggtggcgtcatctctgaaagttaaggtcgtcaaggaggtgtctgatgctgccaccactagcggtggcaatgttccgacaaagccgaggaaattctcgtctgtaagcagacaacgtcgcaagccgtcgaccccctcggtaatttattttgtcgttaaatcatgcagcaagaaggatttttccttactttgcgttcattgtcttccaggcctcagatgcgtctcccccacctccacgacgacaatgcattgtgacaatcggcgagaagtaagtagatgatttcttcaatccccgcgcttattattcgattgttgtctgactcgtggtcgtcctgtagggaggcgcaggcaaaggctgcgcgagccaagtccggaggagcttccagtgcgtcgcctgtcgtggcctcgacggatgtcgtgcccgcaaccgggagccgggaggcgacgcctagtgtcccagtcagcgaccccgcggcaggtcgtgatctgccagctgcagtcctcacctgggaggagctccaagtcgagatggggcgcctcctcgaagccggtgctcacggcatcggccgcgagattgcggaggcgaggttggaagcggcgacagcgaacgtgcgtgctgacagactggtgcgcgagttggctgaagcccgtgaagacctcacgaagatgagggagttggcggccggcaacgagcgacaacggaaggggctcgaggaccgaatgtcggaactcgggaacaacctatctgagatccggggctcgttgagggtcacctacactggccttcaccagctcgccggggaatgcggcgtcacgtccacgatcccggcgaatcccgatgagttttcgctgacctcctctctcgcggaactggcgacagcgatgggggaaatcccctccaagcatgcggccaggattgcggaggagacgtcaaacggaatctacaccggggcgtgtcatgtcctcgtgtgtgtaaggctgttgcgtcctgaactcatctgcgcgagatcttggactagggggcggccagcaacacgcgtaaggaggtgatggaagaagtcggtgatctgggggagtctgttctccccctttttgaagagtaggacttcttgtatttcctagataatgtgtaaaactcgaactctgaccgccttcgtgcgtgcgattactatcccggcttactttggtatgctgacctcgggaacttttgtcctctgtagagatgttgatgacgaggatgtccagcagcgcgggcagcccgagtcactggcagtaatttcggtactcgagtttgaaccacacgtctcgcctgaccatgtggatcaaccccttgatatagagggaaggatggcgacgacttcctcaggttagtagtcccttcaccccttaatgcccacctgactaggtcagccatgttcccgaaagagatgtatagcttgacttagtggttatcacgtttagcagatctcgagggtgcccttgctagccaagatcgtcgtatccaatactggaagacgaagtttgaagtggcggagctcgagagaaccatgctggccgtgaagaaagagcaggctgtggaaacgctccgaggccgtgaggtatggtttaactcgtacttgaagagttgctgcacatccatggccagagtatgcagggagcttcgagtagtccgcggagatcccgaggagtcggtggccgggtacatctcgtggcttaatagggcctatgcccaactcgatggaatcggcaagcgtatcgacgaggccttgaagcaggagtgtcgtcgatcgagccgatatgccggggggcacgtgttggcttgcctacaagatcatcgcccacacttggacctcgaatatcttcgtgagggttttgctcgttctcggaggactccggcggagatagactatctggcaaggtcaatgtcgccgctggccaagaagatcttccagtctatggactgacgttggccttcttggtagtactcgtaccctataacaaatatcttaggaaaagatgtaatgtagcgaaatatttgtgaaaaaactgtaaggagtattttgtgaataaagaaatctatctttgacaaatgtctcttactctggatgtcatgtgtaagagtgcgttctcagttaacgactttagtcagccgtttgagtcgtacactctccctagcccccagccttgtcgtcggaggaattttctcagaggataaagctcttggacctttggcctgccttggttgaataagctctgatcctagcccccagccgtgaagttggaaagttgatttccgatttcacggcttagttaatacgcatggcgagaactcttacacgaccagatcttacatggtctttcgtctctacaggatctgacaaggccttatcggctctgggcgtccctagccgaagatcccttaggttcctcggaggccttgtcgagacggcgtaaagggacataaggacaggtttcaacgctaggtgtcatcacagtgagggatcatcgggcgaaacacgttgattgtgatatgggcctagaaatagcctttattgatactgtaagggtgcttacaggtatggatgatattgactcatacatagaatttacgtatttggtcaatgttccaagaatttgctaattcgcgaccgtcgccgtctgcgattttgaatgcgcctggccgcaagacttgtgtgatcgtgtaaggtccttcccatttaggtgagagtttgtttcgccctgcttggctttgaactcgtcggaggacatagtcgccgatcgaaagtatgcgtgcacggatgcgcttctcgtgataacggcggagggtctgttgatagctggctgctcggacggcaactcgttcccgatgctcctcgagaagatttacatcgatatctcactgctcctcctggttctcgtcggagtacttctgtactcgtgtactctgatgttgtagctcgcttgggagcatggcctcagagccgtacacgaggatgaagggtgtttccttataagacgttgtcggtgtggtgcgtacggcccatagtactgatgggagttcttcaacccaccttttgtcgtgtgacatgagcctgtcatagacgcgggttttcatcccttgtagtactatgccgtttgccctctcgacttgtccgttgctttgagggtgagagaccgaggcgaagcatattttgaccccctgcccgatgcagtagtcctggaaatcggcgctgatgaactgggagccgttatcagttatgatgtagtgtggtagtccgtatctgcaaaatatccctttgatgaatttgatggcgttgtcggccttgatttcccccgtgggtactgcttcgatccatttggtgaatttgtcgatcgccacgaataggaatctgtagccaccctgtcctcgtgggaatggcccaagtatatctagcccccagcacgagaatggccaagtcagagggatagtctggagcgcttgcgcgggtagctttgtgtgtttactgtggaattgacaggcttcacatcgctggaccatgtcgcatgcatctttaagggcggttggccagaaaaagccttgtcgaaaagctttgctgaccaatgtccgaccggcggcgtgtgacccacatatgccttcatgtatgtcgaggaggaggtgtgtagacccccgattttggaaatcagaaatcttctgtgtttatccgtaccaatccctgtgtcggtgacatggggccgggggtatcgtgactagaggcttgggtagccgtggtcacctacgtggcctgaccccctcggtgggggggggggggtcgggcccgacggtaacgtgcccacccctccctctgtctccccgaggggtcggcccgctcccgtttcggccccgagggttggggcgccccgaccccctgtggttttggcgccacgtgtgtgggttaggtgagcacaaggggctcacctaccggcatttatagcagttggcacgagcgcgccacgccgcatttaatggggcgcagcgcacgcttatccggaccgtgaccagtcgcggtgtgtgaccggtcacagcccggtaagatcgcggggtaggtggcaacaggcggcctgtcacacgcctcgccccatccggtaagaataatgagagcttcctggctctcgtccctagccggagccggcgtgctaactcctggagttggtatgtcagtcccggtcagatccattccaggcttcagcgcaaggatggcaaggaagtcgctggccattaaatgaaggttgaagtgggcgtccccgggaaaagcgggcgagcggggcaggaggcgtgtgctccgcttgtcatatgtcctttccggctgtagattagccctcattgtaaaagcgtgtttcctttcttaggtagcgggaggcccatgtggtgacccctgaccagataaaaaggaggcccaggcctgagagagaaaggaggagaaaaagaaaaagaggagaagaggggggcgaacggggctagagcctgaacgctctctcgctctccggctctggatattccttcactcacagatccaccagaacacaggagtagggtgttacgcttctcagcggcccgaacctgtctacgtcgcccgtgtcttgcgcatttcttctctcgctgacgttcctcagatcgagggcgaagaacctcacttagcgcccccggtcgaaccggcaaaggggggcctgcgcggtctcccggtgaggagccccacgctccgtcatctggcgcgccaggtagggggcgcgcgggtctttctaagccctcgtcctctctcgtgtgcgccaagcttcgcccgctcagccgaatggccgaacgggcagtggcgcacagcctctctccgaacgctagcggtgacgatggggagcagaacccgcgccgtcgggctcgcaccccaccgtccccctctcgccgaaatcctgggcggggggaggcgctcggggaggtcggaggatccgcgacttcgccgcccgcgggcaacgggggaggacggcgagacggggcgcgtcgccgcctcgtctacggcgatggcagcacgccccagggcgcgctccaggctgcgggcgcgctcctgcgtcacccgcccgtcgtccccgatccagagactccagcccgacgttagctggatgacgtggccgacttggtcatgacggcgcagcagcgactaggcgccggcgggcggtcctccgccatcgaggcttctggcgctgccgccgccggctccaagtcgtcgaggcgaagggcgcggcgagcggcggccgttacccgccgttcgtccgccattccctcgtcaacgcccccaacccaagaaaatgtgcgtggggggccgaatgcccgcctcgatatcgagcgccggcgcgacgctcgtcacgccgcccacgcaacggagggcgcttcctcgtccggagcgccacttcggtccgggcacgggagccggccccccgtgtccccggttggcggtgccggctgtcgagcctttgtggcgagccttcggaacgtccgttggcccccaaggttccggcccaccatcaccgaaaaatatgacggaagcgtcaatcccgccgagtttctccagatctacacgaccgggatcgaggccgccgggggtgacgacagggtcatggcgaattttttccccatggccctgaagggtcaggcgcggggttggctaatgaacttgccacccgcgtcggtccactcttgggaggatttgtgccagcagttcaccacgaacttccagggcacatatccgcgcccaggcgaagaagcggacttgcatgcggtacagcgaaggaacgatgagtctcttcgctcgtacattcagcggttctgtcaagtccgcaacaccataccgtgcatccccgcacacgcggtgatctacgcgttcagggggggcgtgcggcacaaccgcatgctcgagaagatcgccttcaaggagccccagaccacagcgcagctttttgagctcgcggaccgtgtggctcgcaaggaggaggcctggacctggaactcctccgtttctggtgtggcagctccggccgcccccgggtccgccgctcggttagggcggcgggacaggaggaggaagaaggggtcggcccgttccgacgacgaaggtcacgtcctcgccgtcgagggcgcttcgcgggacccccgaaaggggaggcctgcgagcgacaaaaagaaggaggccggcgctcccagcagggagcgcccgaccggcaagtggtgtaccgtgcacaacacctccctccacgacctcgcggattgccgcgcggtcaaaagtttggctgagcggacgaggaagtgggaggaggagaagaggcaggagcgccgtgagggcaagaccccggcggctcccgccggcaaccggcgaggtgaggccaagcagaaggccaccgccgaggacatcgacgatggcgacgatgacctggggttccaggagcctgaggacaccgtcgccaccgtcgatgggggagcgtgcgctcacgcttctcgccggagcctcaaggccatgaagcgagagcttctggccgcggcccctacccatgaggcgacgcggcgggcgcggtggtcggaggttgccctcaccttcgaccagaccgaccacccgccgtgcgttgcccggggaggacagatcgcgatggtggtttcccccaccgtttgcaatgtgaagttggggcgtgtcctcatagacaggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgacaacttccgcacggagcgggtggacttcgatgtggcggacctcagtctgccctacaacgcggtcctggggaggcccgcgttggtgaagttcatggcggcggtccactacgcctatctccagatgaagatgccgggccccggtggccccatcaccgtccatggcgacctcaaagtcgcgcttgcttgtatggagcagcgcgcggaccaccttgccgcggcgtccaagcctgcgggtggcgacgagaggctcagcacctccgtcccggccgccccaaggcggcggatggtcacgtgcgacgaggtcccggtcaaggaggtttccttgggcgacggcccgtccaagaccacacgaatcggtggtcttctggacgacaaataggaagacgcgctcgtctccttcctgcgggcaaacgccgatgtcttcgcctagagaccggcggacatgcccggggtccccagggaggtgattgagcaccgtctcgccgtgcggccgggcgcaaggccggtccggcagaaagtgcggcggcaggccccgaaacgtcaagccttcatccgcgaagaggtggcgcgacttctggaggccggattcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacgcataaaccagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccagataggacgcaatgttgaggcctatgttgatgacttggttgtgaagacgcgcaaccaagagaccttactctcggatctagcggaaactttcgaaagtctccgctccgcctgcataaagctgaaccccgataagtgcgtgttcggcgtgcctgcgggcaagcttctcgggttcttggtctctgcccgaggcattgaggccaaccccgagaagatatgagctatagagcggatgcgcccccccaccaagcttagggatgtgcagtgcgtcaccggctgcatggccgccctaagtcggttcatatcgaggctgggagagaaggcgctacccctatttaagcttctcaaacgctccgggccgtttacctggacggaggaggctgagcgggccttcactcagttgaaagcgtacctcagttctcctccagtcctggtcgccccggagccagatgagccgttgctactctacctagcggcaaccccgcaggtggtcagcgcggcgttggtcgtggagcgcgacgaggacaaccctcgctccacgcatccctaccctgtgtcgactcgacccgggagagagcagggaggagaggcccccgagccgaacggcggcccgaggcccccgacggccggagctggccctccgcctgcttgtccgacggtgccaggcgcccccgacccccaggatggccccggggccactgcgggaaggccgcgcctgtcgccctctgaccccgaggtcgtcggcacagaagccgagtgcaccccgcgtggcctctcggacgaagagcaccctggagatgcggcccctggcgcagaggatcggccccgccgaaaggtgcagcggcccatctacttcgttagcgaggccctccgggacgccaagacccgataccctcaggcccagaagatgctttacgctattctaatggcttcgaggaagttgcgccattacttccaggcgcatcaggtcacggtggttacgtcttaccccctcggccaaatcttgcataaccgagagggtactggacgggtggtgagatgggcaatcgaactctctgaattcgatttgcgctttgaaccacgccacgcgatcaagagccaggccctcaccgactttgtggcggagtggaccccagctcccgagcccgtctccgcccccgaggccagctcgggcccctcgcatctgcctcacaccgcctactgggtgatgcagttcgacggctccctgtctcttcagggcgccggtgcgggggtcacgttgacctcgccgagcggagatgtcctcagatacctggtccgcctcgactttcgggcgaccaacaatatggcggagtacgagggactccttacgggactcagagtggcagctggactggggatccgccgcctcctggtgttaggcgactcccaggtggtcgttaaccaggtctgtaaggagtaccagtgttctgacccgcagatggacgcttacgtgcgccaggtgcggcgtatggagcgccattttgacggcatagagcttcggcacgtgcccagacgggataacgcggtcgccgacgaactctcaaggctcgcttcctcgcgagcccagactccaccgggcgcctttgaagaaaggcttgcccagccgtcggcgcgacccgaccccctaggggagacggacgcgcctgaacggcccccgaggcccgtcggagtccaggcctcgggacccgaggggagcgctcccagctcccctagattgattgcttggatcactgagatccaggcgtacctcgcagataagactctacctgaggaccgcgaagggactgaacgcgtccggcgcatctccaagcgctacgtgttggtggaagggaccctttaccggcgcgcggctaacgaagtcctcctgaagtgcattcctcgggaacaaggcgtcaagcttctcgccgatgtccatgaaggcgagtgcggagcccactccgcctcacgtaccttggttggcaaggcctttcgccagggtttctattggccgacggctctcaacgatgcggtcgacctggtccggcggtgcagggcgtgctagttccacgccaggcaaacccatcagccggcccaggccctgcagaccatacctctttcatggccgtttgctgtctgggggctcgatatcctgggtccgttcaggcgggccccgggcgggttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcggaaatcctcaagggcctcaaaaccaagaccttcaacatcctcaagaagcacggcgactcgtggatcgaggagctgccagcggtgctctgggcgaaccgaaccacgccaagccgagccaccggggaaacgcctttcttcctcgtctacggcgcggaggcggtcctcccatctgagctcaccctgaggtcccctcgggtcaccatgtattgcgaggctgatcaagattagcttcgccgagacgacctcgactatttgaaagaacgaaggcggcgcgcggccctccgagccgcgtgctaccagcagagcctgcggcgctaccatcagcgccacgtccgggcccgatcactctgcgtcgacgacctcatcctacgccgcgtccaaacgcgtgctggactgagcaagctctcaccaatgtgggagggtccgtatcgagtgatcgacgtcccccggccgggctccgttcggctggccacgggcgacggcacagagctgcctaacccgtggaacatcgaacaccttcgtcgcttctacccctagtggggatcgggcatcatgtctcgggctcgggccaaccccgcaccccccccgggcgtgcaggattggccgggggctaccacatgcatatacttaccttttttctcttccgtatttcaataaaagcatttttgatttcctgaggactgtgtctgtgccatcatttccttttgaagaatcttggcttgaattagcacgctcgtgctcgaccttgccctcggcggcccgggccggctaaaatcgccaaacggggcccagaaccgagccgtgccctggggcatggtgaactccgagggggaatcggcaaaggcccacaatcgggtcatccataaccctcggtcaccgcgctcccggcctggccagtctcgacacgaggatctccccaggcactagcctcgacccgcgccgtttgaggctgggacctgggcacgagcccttgttcaagccaagacacagaaggaccgcggcacaaaccattctcgtctcatacacacaacaaacagaactgacgcggaaatttcctctttacttgattacagattaaatcagtctatacaagaagggggcccgaaggccacggaagaagaagcaaaagttattaagattggcgggggcctgggggctcactccgacgcgcccgggacgtcggcctcgtcgtcgctgtcgtccgcaccgtcgtcaccgccctcctcgtcggagtcgagcgcgaacgcgagccgaggggccgtaccctcgaagctgtggacgatatggtcggtggcgtcccggaccttcgcgcgcgcgccgtcctcggttccgggaggaaactcttccagcgctgcccacggggagaagtcagggtccctggcctggtagcttgccagtacgagctccaccgccccccgggcgaggtccctcgaggatgacttgatcgtctcctcgagctcctcggggagccgctcgagggccccggtcatctctgagaggcgctgggcgaggcccgcctggttggcggcgtacttcgcgtgccgcccgccccagaggcccgcttgccgcccggcgcggtctagacgggagacggcgtcccgaagcatgccgggccctacttcgctcgccaaacggagggcctcgacctccccggcggacgagtccagcgcgccctgcagctcggcgatggtgtgttcggcggctgcgaggcgggcggctaggtcgccttggcccgcagccgctccgccgctgtgcgctctcgcgtccagctccttcgcccgcgcttcgagctcagcggcccgctgatccagtgcggccctctcggcgcgggcgccttccagattgcggcgcgcctgctcctcctgcgctgcctcgcggaggaacagactgtccgccagccgctgcgccgcggcctcggcctcctcgagagctcgcccccgctcggtgagcgcgtcctcgcggaagcggagtgcggactcctcttcggcgcaggcggcctcgtgcgccgccagtgttgcctcccgggtggcgacggcggcctcgcggtccgccaggtctctctccttcgcgtcaagggcgcgggcgtgctcctccagcgccgtggcgcgagcctcaagggcctcttcgcgctgccgggacgccgcctcgttctccgccgcccgccgttcccgggcagcggcggcgtcaaggactccccgggcggcgtcgagcttctcctctagctccgccgcccggctcccgtattggaggcggaggtcgttccgcgcctcgtcgagcacggcggtggtgatgagggcagtctcccgctcctcctccacctccctggcgatctccgccaggtccctacgacgggcttcgagctgtgaggtgtgccggcggtgcgccttgcggcccgcctccaccatggcctccaccgagcgccgcccctcctcgacgcgcgcccacgccgtgtcgagctccgcccgctccgcctgcagggcctccatctgggcacttaacccatccagcaccgtgctgttcgcggcggccaaggcctgcaggaagggctccgcgctcagtggggcagcagaagacagaggggagagccgcctcggtgtgggtgccgtgcggctcggcccgccgatcaacgtgccggactcgggggcgtcccccgaagctggctcgtcctaagcgtcacccgaagggtcgggcccgagcggcgcgcccgcggcctcgtcgtgggtggcctcggaagtcgtcgtcgcctcgggcggagtcgggtcgggggtttggcaggccgcctggcgtgcgcgcgccgcctctgcctcccggacggactccccggcccggcggagtctggcctcctcccgagcggcctcctcaacctggcgaacccggacggcctcctgggcagcctcctcggcttcctgaaggcggtccgcggcttctcgccggtcagcttcccgcctccgggcctccgcggtcgccgtctcctcggcctcagaccggccgggcttgaaagggcgggggggggggggggacgcaacgggatctcgctgaggcagaagaaaaaccagaagacaaaaagaaataggtgagtgaaaactcgccttgggagatgggagaatgaatacggccgcggtgggcgcggggacgaacctgcgaggaggtcggctaaacgaccacctcaggggcgagatgaggttcccccgacatggcacgatcccccccatcttgcggagccgtttcttctttcgctccccctcgggctgcggcatcggcacggcaccctccgggcgcctgctgctggcacgcaccgccccgccccctcggggaggagatgggggaggggttccctcctgcttcctcttcccccgggcgtcggcagggcggctgccccccaggcccccgtcgcggggcccagaagcacgaccccctcccggggtagattgttcccccctgcggctcccgcccgcgccatcgtggcctcggggggcccgctcccctgacgccccgaccacctgcatgatggtcaggatcttggcgcgctctggatcgcagcagagggggaggaccccttgggggatgagggatgcctccacgtagctgagattcagcacccgttggaccaccatcctgaagtcctcagggtcccagtcccatttgcgcccttggtgggtcctcatgtagtcgtcgggcccggtgtactcccaggcgccccgggcgcgccgctggagcggcgcgatccggcgacgaaggtagtcgccgaacaccatggcccccgtgagcccctgggatcgcagacccgccaggcggtcaagaacggcgtcgtagccgtctcccagatctactgtcgctcgccagctggaggcctgcgccgggggctggctcggaagtcggaggcgcgcttcgtcggcgaggggggtgtagaaccaatcgcttttccagtcgtcccactttttgcggaggacgcagggaatgtagcggttcaacacctgcccccgcggctggaagtagcagccaccgactaccgtcggcggcgacaccggctgtacggtgaagaaccaccggaacagctggagagatgggcgcaccccgataaacatctcgcacaggtgcgcgaagatggccaacgtcattatcgcgttgggggtgaggtgcgccatctggagatcataaaactccagaatatccatgaaaaaaatagagaatggcaggaccagccccgccattgcgaaagagaggaagaagatggaccgccccgggtagtgtggcgccgggcgtccctcggccagcgcgaccacctcccggccggtggcggattccggcatgaatcggcgcggcagcccggcctgcctctcgctcacgatgcgggaaggcggcagcacgctaccatcgagcggtgcggagccccgtgccatgacgccggcggaggaggagcttgagagcgagcgagtgcggcaagggtagggcacaggaaacggagagttagagcacaagtggcaaaggcaaggggaagagtggcgagaggaaggaaacaaatcccttccttggcgtctttgtacccttgccaacgctatgcccggctcctcgcttcccgcgcccactacctcgccccctcgtttctcgcgcccacgcctccactaaccccactcgcccgtttgcggcgcacgcggaagatgtgcggccgtggcgtttgagatggggcagatcgtgcgcgcattaactgcgctcgccaaccgcgaaaaacgccatcatcgtgtccccgggcgaaacaaacctgctcgagtaatgtagcggtcttgaagaggccgctcattattgtcgatcggtttttcccttgccaatgcgcgcgatttgcgaccgttgggttttcgcccgcctgtggggaccggccccacctgtcaccgggcctaaggagtggcatcacgcccgagcgcctccctcgggggggtggtcgccctagcgtaacgctgggggctactgtcggtgacatggggccgggggtatcgtgactagaggcttgggtagccgtggtcacctacgtggcctgaccccctcggggggggggggtcgggcccgacagtgatgtggccacccctccctctgtctccccgaggggtaagaaaggtaangaagaaaagtaagttaaaattaaatttgttttatgttttagccattttcacactgccgtctcccacgcattcgtttttttctttcaatttttcccttgagagaaataagagggacaccagatttttgcagaggacaaggtttggttggatttaaaccatgacattcacaagacaaggttaaaacaagagtggattaaattcgtccattacattataaatgtgcaaaattagaaaaataacattactattagcgatattggttgggtgccactaaaattttgtaaaattaaaaccataccatcgccgtcacattttctatcatcatattgaccaaaatacccttacatgtgggacccaccataagttccaacctagggaggtgacacgtcgtcgtctttcacctcagctcagccattcatctcggggggccggatgcccgcctcgatatcgagcgccggcgcgacgctcgtcacgccgcccacgcaacggagggcgcttcctcgtccggagcgccacttcggtccgggcacgggagccggccccccgtgtccccggttggcggtgccggctgtcgagcctttgtggcgagccttcggaacgtccgttggcccccaaggttccggcccaccatcaccgaaaaatatgacggaagcgtcaatcccgccgagtttctccagatctacacgaccgggatcgaggccgccgggggtgacgacagggtcatggcgaattttttccccattgccctgaaaggtcaggcgcggggttggctaatgaacttgccacccccgtcggtccactcttgggaggatttgtgccagcagttcaacacgaactttcagggcacatattcgcgccaggcg

SEQ ID NO: 83283 - DNA, 16099 bp, Oryza sativa
gccgtttcgtcgatccgcggttcctcgaagacgttgctgtggtctcaccagtgcgagagcaaggcaagtcatgctttacatttgatcatattgtacccaatttacaaatatccctcatttctattaaatgttgcactcttttacaatgtcatgtgggatgggtcctactactcagccatagattgtttaccatatgccattgataacttgggtatcaatatgattagatgttggtttaggaaatgcttagccatgcctagttcaactagtacacaaatggggatcacattatcacatagactttgtctatcagcaaagttttggattgctgccaccgcaatggtgttagttaattaaaatacactgaatggtgggctacgggttcatggtttcgctgtcgcacccatggaagttaaggaccagttcacgggaaaccctgggagacttaccgtgcttatcacaagcgggagtgggtaactgcttgatctaaagtatagctcgaccctttcctaggcaccggtggcgagggtgggcgtgatagagttgggtcggccggggtgtccggttgtccagctgccggattcaccgcggcgcaagaagggaccgcccactgccttttgaggggtgggggtgaaaccttagcgtggtatggatggttaggggagggttatgcggagggtcttgtcacgatttccccctttgcagtatcatggtgatacttcggggcatggcgacatgtgtggaatcgtgtcttgtgggtacagttatacacctctggccagagtaaaactattcgaatagccgtgcctgcggttatgggcgatcaaccaaattcaccgtgattagtctcaccctagtttagcttaatgaactggtgtagttcaggtggttggttgggcctattgcaacgtggtgtagcgttggacagtgattagttaatattgattaattactacagctcttttactgctttcaactattgcttttaaatgctagcttgatgcaaaagaacccctagcctcctttggttatatcctgcatcatacctcctcttccggtatgacttgctgagtacagtgggtagtactcagtcttgctctcttttcccccacaccagagttgaagttcttctcagttggagccgtctcagagagattggtttcgtcgctgccgttaaggattgcttgtggaatggagtcgccccgcttctgaagtcaagcttccgagtttagttcgttttatcttttccgctacatttgtaaacttttatatttttgtaagacgtggatctgtatgtcaacaatggtcgtttgtgtaccctggctggtcctggacagggatttaatgcacattcagcttagaaattctgattcgtgaatatctgggcatgacaagttggtatcagagccgagcctgaccgtaggacaagccaactggaaacctaagagccctctgaaccccttttcatatgcatatgcctttttcacctggatttgtttcgggaaaattttgggttttgcctctttggtttgtgggaaaaatcttggtagttcatttggatcggatctttaaaattagctcagtctagggttttagtaaaattttatttggagtttattcgacagtcagtcgggaatctatcaggtgatatgcattaggtcgtgtctatgttcgatggggcaattttatgcgcattattttctatgcatctaatttatgcattaatttattgtttaatcagttgcattagtgtctttatctgggttcatgaaaaatgttctatgcataaaaatcagtcatgctaggttatttatttgagtcatttgttgctttgtttaatttggaatttagcatgaattggttcttatcccttgtctactttagatgttagtcctatccctcgattgcaagcgccgctccgagcttcagagtcgccgcccttagttttatcgtcttcttagttttgtttgcttgctagtttccgtgcttaagtttgttgcttgtgggttagttggcggtcgatatcatgtgtgagtggtatggctgacttaattaagagttgcgtgcctctttttcagtgttttaatcaagattaagataattgcacttaaatttataagaaagattagtttctgagccccctatttttcttccttttctcatatttctacctatcctccttcagatggtgaagacaaggaatggttcacgtgactccagcaacgtcagtggcagcgaagagcagattagtggagcacgtgccaacagtgcatctgacaacagtccatctccaccgcccgagaacccaacgatcactcaggtgttggacaatcagactcagatgatgtcaatgattatgcaacagatgcaacaacagtaccatcaggtgttgcagtaggtgcagcagcaagcacaacagcagcagtagaacctgcagtttggtcttccacctccttaatccaaactgttagaatttctccatgtcaagccgcccactttctcaagtaccaccaacccaatcgaggccaacgactggcttcgtgctattgagaagaagctgaaccttttgcaatgcaacgaccaagagaaggttgcttttgctatacaccagctgcaaggtcccgcttctgtttggtgggacaactacgtggtgacccgtccagctgggacaaaggttacctgggcagagttttgtcagagtttcaataaagcacaggttcccgagggaattatggcacaaaagaagagagagttccgttctctgcaacaaggaaccaaaacagttatagagtatttgcacgagttcaaccgcctcgcgcactacgctcctgaggacgtgcgcactgatgccgagaggcaggagaagtttttgtcgggtcatgatgatgaattgaccaactagttgatctcccgagattataaggactttcagaagttggtggacaaagctatccgtcaggaggagcagggtaacaaaatgaaccgaaaaaggaaggcatctcagttcagaacttcccaggggaacagttagaagcctcgcttcatgatgggacatcagggtggaccttccaccatgattatccggcagcatcgtccctaccacccgggtagcttcggcaggatctaccatagtggcagtcacggcaacagcgagaagcacagcctcaacctgactccaagtccactaatgtttctagctcagtcagttcagccagctctgcctgctcagtcaaaacagcccaaggagttcgaaggaaagcccgaactctgcttcaattgtaacaaaccgggacacacggttggaaagtgcccaaagccaagacatgctggacccaagtttgtgcaggcccatgtcaatcatgcgtctgcagaggaggcacagtcagcaccagaggtcatattgggcacatttcctgtcaactcgacaccggcagtaatattgtttgattctggtgcaactcattccttcatttccaagcgttttgctggtgcgcatgggttatctttagtgaagctcaagataccaatgcgagttcatactcctggaggtggcatgaccacaactcactactgcccatcagtgactgttgaaatccaagggttgatttttccagccaacctcattcttctcgaatccaaggacctagatgtcatacttagaatggattggttgacaaggcatagaggagtgattgattgcactagccacaccatcaagttgaccaatgcaaaaggagaagtggtaaccttccagtctccagtatcgtagaagcaagggatcagtctgaaccaggctgctggtgaagaacaagaagtagcagtggagaaaaccactaagaagttggaggatattcctatcgacagagagtatccagaggtttttccagatgacctgacaacaatgccacctaaaagggatatcgagttccggatcgacttggcacctggaactgcaccgatccacaagaggccttacagaatgggagccaacgagctggcggaagtcaagaagcaagttgatgaacagttacagaagggatacattcgcccgagcacgttgccttggggtgctccggtcatctttgtggaaaagaaagacaaaaccaagaggatgtgcgttgactaccgcgcactcaatgtggttactgttaagaacaagtaccctttgccaaggattgatgatctgttcgatcagctgaaaggagctactgtgttctctaagatagacctgcgatcaggctatcaccagttgaggatccgcgaagaggatattccaaagacagcattcatcactcggtacggttgttcgaatgcacagttatgtctttcggactcactaatgcacctgctttcttcatgaatttgatgaacaaggtgtttatggaatttctagacaagtttgtcgtggttttcatcgatgacatacttatctactccaagtccgaggaagaacataagcagcatctccggctagtacttgaaaagttaaaagagcaccagctatatgccaagttcagcaagtgtgacttctggcttaaggaagttcagtttctcggtcacatcgtgaatgctcaaggagtagctgtggatccagcaaatgtggagtcagttacgaaatggaccccaccaaggacagtcactcaggttcggagtttcttaagacttgcgggctattaccgccggttcattgagaacttctctaaaattgctaagccaatgacacagctattgaagaaggaagaaaagtttatctggtctgctgaatgcaataggagttttgaagaactcaaaggacggttggtgtctgcaccagtcttaatcctgcctaatcagacgaaagatttccaggtctattgtgatgcatctcgccaagggctaggatgtgtgttgatgtaggatggcaaagtggtttcttatgcttcacggcagttgcgtcctcatgaaggcagctacccgacgcatgatctggaattggccgcagttgttcatgctttaaagatttggcggcactatctcatcggtaaccgttgtgaggtatatacagatcacaaaagtctaaagtacatcttcactcaacctgatttgaatctccgatagcgaagatggttggagctgatcaaggattacgatatgggaatacactaccatcctggcaaggctaatgtggttgcagatgccctgagcaggaagagttactgcaacgtcacatgggtagagcaactatgctgtgaggttcaacgtgatttggaacatctgaaccttggtatagttgagcacggatttgtggttgccctagaggcacagcccacactagtggagcaggttcgcatagctcaagcaagtgatcctgaaatagcagagctcaaaaagaacatgagagttggaaaagcccgaggttttgttgaggatgaataaggaacaattggatgggagaaagattgtgtgtacccgaaaacaaggaattaaaagacttgatactgacagaagctcatcaaactcagtattctattcatcctggcagtaccaagacgtaccaagacctcaaataaaaattatggtgggtcagcatgagaatggaaatagctgaattcgtcgcactctgtgacgtttgccagcgagtaaaggcagaacaccaaaggccagcaggtttgctacagccacttcagattccagaatggaagtgggaagaaatcggaatggatttcattatgggtttgcccaggacgttatcggggcatgattctatttgggtagtcattgatagactcactaaagtggctcacttcattccggtgcatactatctactcagggaagaagttagcagagctttatttggcaagaatcatgtgtctacatggtgtacctaagaagatcgtgtctgatcgaggaagccaattcacctcaaagttctggcagaaattgcaagaagaattgggaacccgtctgaaattcagcacagcgtaccatccacaaactgatggccagactgagcgagtcaatcaaatactagaggatatgttaagagcttgtgcgcttgactttggtggagcatgggacaaaagcttgccgtatgctgagttctcctacaacaacagttaccaggctagtctgcagatggaaccatttgaagcactgtatggacggaagtgtcgtactctgctcttctgggatcagacagaggaacgccagttgtttggtacagaagttttaaatgaagcagaagagaaagttagagctgtcagggaaagtttgagaatcgcgcaatctcgacagaaaagctatgtagacaaccgccgaagagagctcgtttttgaaacaggggattatgtgtatctccgtgtcactccgctcagggagtacatcgcttccaaaccaaaggaaaattggaaccacgctttgtgggaccatacaggatcttggaacgtagaggtgaagttgcttaccagcttgagcttccctccaacatgcttggcatccacaatgtgttccacgtctctcagttgaagaaatgtttgagagttcctgaggaacaggcaagtccggatcaaatcgaaatccaagaagacttgacgtatgtggagaagccgactcgtatcctcgaaaccagcgagagaaggacctgaaacaaagtaatcagattctgcaaggttcagtggagtcatcactcagaagaagaggccacctgggaaagagaagatgagttaaaggccgcccatccgcacctcttcgccagctctttcgaatctcggggtcgagattccgtttaaggggggtaggtttgtcacaccctgaagtttccccccctttcttgctttaaaaattggttaaataaattgcccgaagaaattatcttaattaacctagagctaaatccctaattaataaatgtatttaataatcgaattcgccgtggtggaatttttcttgagttccccatgctccaatacattaacatgatttttgatggattttttagagccttggaaataattttaaccaattaaaattgagcaaatgcaatatttttaatcctaggaaaatgctttgtctctttttcttttcttttccctcctttttctttgttggaccgtcggcccgtccctctcccgcggcccctcctccttgtgggccggcccaagccgcccctccctcctctctcaggacgccgacaggtgggccccacctatcggtcgtctcctacctccggccgttggagccggagctccaaccgccgctgccgctgaaaccgccacgccgccgccgtttcccgccttctccgctccatgtcgtgcctccactccgcgcccacaccttgcgcccacgtcgccgctcctcccccgctcctcccgcccccacgcgcgcctgagagtgggcggggttcaatttgaatccccctctctctcttcctccccactcccccacgtcgccggccaaatcggccaccttcccggccacgtccgccccctcctgcacctataaatcactcccctgagctccctctctcgtctcccccatttgccgccctctctcgagcccctatcgccgccgcgcctagccgctgccgctgcctatctccggccgcgtgccgccgccgctagagccaccgccgcgccgcgcagtcgccgccgtcgcgctcaccgagcccgcccgcacctcggccgccgcttcgttgccgcgaatcaccgccggagctccgattccctcgcgccgccggtgagctcgccatagtttccatctccggccatttctcctcgccgtgccgcggctcctgtcttctccctaaccccttcaccgccttttcccaggtcgcgccactcccgtccgccgttttccgaagcgctgccgccgctcatcccctcccgctccggtcgccgcccctccgatgaggactccctccccctctattctccccttcccacgtgcgccgccgcctttggccgtgccgccgctccggccatccgccgccgcctttcgcgccgtccgccgccgcctccctccgccggtcgtcgccgtcggcagccgcgcgcgccgccgcctctcgccatggccggtcggtcggctttgtgccgagccgagccgtgcctagccgccgcccgtgccgtccgatcggcctcgggccaatccggaccgtcggtcccgtggaccggaggtgaaccacccgcgtggtcccggtcacggtagaccggccaccttgtgccgctgccagtggggcccacttgcccgagccccctctccctccccttgtgcgctgacaagcggggcccacctgtcggcgcagccgcccccccggatgacgtcagccctgggatttattatgcaataaattgattaagaactttttctttattagtaaaaacactgtttatcttctaaacttcataagtaattcatccaaacttcgtttaagtccattcaagtctcagtaaattcataaaaatgcaaactatccactaaaaatggttttgtttcctgtttcagtagtcttatagcatgttttgcttgtgtgctttgtttgtcgcgtagatttcggccgtttcatcgatcagcggtttctcgaagacgttgctgaggtctcatcagtgcgagaggaaggcaagtcatgctttacatttgatcatattgtacccaatttacaaacaccctgcatttctattaaatgttgcactcttttacaatgtcatgtgggatgggtcttattactcagccatatatcgtttaccatatgccattgataactggggtatcaaaatgattagatgttggtttaggaaatgcttagccatgcttagttcaactagtacacaaaaggggatcacattattacatagactctgactatgagcatagttctggattcgtgccaccgcaatggtgttagttaattaaaatacaccgaatggtgggttgtgggtgcatggttttgctggtcgcactcatggcaattaaggaccggttcacgggaaacccttggagacttaccgtgcttaccacaagcaggagtgggtaactgcttgatctgaagtatagctcgaccctttcctaggcaccggtggcgagggtgggcgtgatggagttgggtcggccggggtgtccggttgtccagatgccggattcaccgcggcgcaagaggggatcgcccactgccttttgaggggtgggggtgaaaccttagcgtggtgtggatggttaggggagggttatgtggagggtcttgtcacgatttccccctttgcagtatcatggtgatacttcggggcatggcgacatgtgtgaaaccgtgtcttgtgggtacagttgtacacctctggccagagtaaaagtattcgaatagccgtgcccgcggttatgggcgatcaaccagattcaccgtgattagtctcaccctagtttagcttaatgaactggtgtagttcaggtggttggttgggcctgttgcaacgtggtgtagcgttggacagtgattggttaatattgattaattactacagctgttttactgctttcaactactgcttttaaatgctagttttatgcaaaagaacccctagcctcctttggttatatcctgcatcatacctcctcttccggtatgacttgttgagtatagtgggtagtactcagtcttgctctcttttcccccacacgagagttgaagttcttctcagttcgagccgtcttagagaggttggtttcgtcgctgccgtcaaggattgcctgtggaatggagtcgccccgctgctgaagtcaagcttccgagtttagttcgttttatcttttccgctgcatttgtaaacttttatatttttgtaagacgtggatctgtatgtcaacaattatcgtttgtgtaccttggctggtcctggacagggatttaatgcacattcagcttagaaattctggttcgtgaatttctaggcgtgacagggagccagttgagatctggcaaacggtacggaacctctgaataggcgtaccgtaccttcccatcaaggaagaaaactagctgttggagtgcacactaatgctggtacatgcccacatcaagaagttttaagcaagaaaaagaagaagaaagcatatggaatatgcatctcctcgtatatccatggatactcgcataaagtctcatacaaccaatagaaattggcaatgagacctatcatgggcaatgtctcttttagacaacaaaactcattggcagtcaaccaggagttgaatggaattaatgaactagaagttgaaatgaagaactcaacctgaatgattgataagcattgaagatagaatcaatgaacgcatttcaggagtttggatcgggcacttgcataatagtacatgaagatgtactaggtcccgaaccaacataaaagaatagaataagccagaaaagaattgaaaaaaacaaacacattcgttttgaatttgagtttgatttgaaatatttggccggatccaaatcatgctgacgcttgcaactaaaggcatgcgacagatagaagtctagtacatcagtccaactgcacttagaaatgttcatgatgcatggctttggaatagtcaattatcgccaaaatgggacggaattcctaaacacgagtgtcatagcagcacatgaatacttggctaattgaactaaaccgaactaagcattattgaactgttcagagcctcggcatggttttgagagatggttacgcgcgacatcaatcgcgatttgaaaactatctcaacccccacaatttatgaaagtaaaacagcatatgtcgcacatatgcaatgagttatgtgagaagcaaactcactaagcatatgaacccccaagctcttctatgtacatgaattgcatagaagcgatgaactaagtcatgtggaagtcttgcagattcatctgctaactcattactgacatctttacttgaataggtgtgtccgagaaatcagaataatgagacttagagaaatgcaaaaatcagggggagaatttcgccgactcattttagaatcttgatatggaaaatcaagtacccaaaatcaatctagaaaggttgaacgaagaattgggtggattgtactctttttcccttggataagttttcccagcagtttcttatcaaggtttttaacgaggcaattcgtgcgatattgcaagcgtatgctatgtactctttctccaaatttttcccactgggtttttgtggagttttgacgaggcataggcatcatgcggtgagtgcccaagggggagtgttaagaaaccgatgggcttgggcccatgaaggcccagcccatatacactaattgggcccacaccgaaaccttccatatatggaggaaggctatataagaaggagaggggtgctcatattgtacacttgtgcttgaggatgatagaatgatgaatgagaagagagtctcacccctatatcttgtgtctccacttttgtagaattacgggacccttttggactacttcgtgtagcaagagggttgcgtaataatttcctccctcaaatccgcttgattcaaatggctaattccaaaattgattggggggaattaatcccctttccctcctctctctttcccccttaattcccccttgaatggcgccctccactgcccggaacggccgcgccttcctcggtcgctttccatggccgccggccaccattcccgcctccattccgctctctcccgtggccggctcccaacccgcgcctataaaatggaaccccctccttgtgttctctcatttttgcctcctcctgagtcttcccgaggtccctagccacctccccaccgtcgtcctctctctcccgtgccgccggccgcctgtgccgcctcgcctgtgcaccggccgacatcgccaccacctccctcggctctgcaatgccgcccccttcaccggcctcaccgtcccctcgcccgaattttgccggaacgccgtcgtccccgccgcccctccctcggtctcatcggcacccactccggtagccccttccgccgtgctagtgcgccggccgacgtcgccgtctccaccttcggcatcgcagcggcaaggtcatcctcggcctcgcctcccctccatccgaaccccgctggcgttcgccgtcgtcgtctttatcgttcgtccctgtcgacgtctcctccggttagccgttcctctccatcgtctcatcgtcctgcggcgccgcctctgtcgtcggcatcggagcggcgcatttcatgccgtcctcgccttcatgcagctgctgccggctgccctcgtcgcctcctcgctggccccgatcgttgtcgtcctctcgtcgttcctgctcgtggtgacgttcgtccctccgtcaagccgttcttgtccgtcgtctgtgttccgtcaagtgagccgctgcagccccgtcgtcgtcttcgtcctcggctccgcgtcgtcaagccctgtgccggccgcgtctcgccttcgttcaaggatcgccgccgaagtcgttccctcgccgtcatctccgtcattcccgttcgtctccgccgcccgttcgccgtcgtcgttcccacacctcgttgcgtggtggtaaggatctctccttcgctgctcccgtcctcgttctttcggtgtcgcccatgcccgttgtgcggttgtcgaccccggtacccgtgtaccggtgttggtagtcgttcgtgtgtgcgtgtggtaaccgtgtttgtgtgcctgctcggtagccgcgtggtttccacgtgtgcagcccgcatggtgtctagtggagtccgtttgtcggccactcatctcggttgacacacggggtccgcttccctcgacccgtggaccgtttctgtgtacctggtctgccgtggtcccttaggttgacatgtggggtccgcatgtcaacagcgcagccttcctatcttttccaggttagcacttccacatgttttatagttgcaaaacctaattataataatccgcaaatctccatataacagcattaaatttcggatgaccatgtcttggtcatacgaactccgaatcgatccgttcaagtctcgtaatgtttgttataacctaaagaaccatgtgctttctttttatgtattgttattgcttctttataggcttgtagctttgcttgtgtgcttcgcgtagcttctgtcgttccagaggttcccgaaacgtggttcgcggtcgtcgccaaaggttcggaaggccgttctctttgagcaatgcaagtcacatgatacttgagcatattgaatcccagtttataaaactattttggtttaaattattgcattatcgctttatttaaattcccgcgttatcactgttttatttagccatatctatttacctttgttatgaccttattattattgctattgttattattaccttgttcaccctaggataaacaaaaccccaactagtgggtactctattcatggttccactagtatgaatttagctagatgcttcgctgattaattaggcaacattaggtggttttataactttagactttgggaatgctcatatcatttggacattatggaatgattggcttatgtggaaatggacacaccccttctcctcaattcaaaacccccaaaatggttttaggctaggctcgaggtgcatggttttgatagtagcacctcggccactataaggaccggtcttcgggcctctgttgcaaagcactaccgtacttccacatgtctagtgggtaaggcttagtttgtggctcagtctggtcatgggcaaaagtacacggatagggatggacgaagtcggggctcgatggacttctctaggacaaatgaaggctacatgagctgcggcccggtagtcgagatgtcatggcacagggccggtgtcctgctgcttggggctcaaccttggttacctgtctggggattccggccgtagccagggttgggtcggtactcctgtttatggctaggatgggttgggaactatgtcacgtcttccgtccgtatgccgtggtggtatgttgtgcgtggttacacgtgaggaagacgtgtcttgtgggtaaagatgtacacctctgatcagagtataatctattcgaatagtcgcgccctcggttacgggcaagcctagcaatgtacctaagttagtggtttacttcttaaaacttgattaacaactaaaatgtggaagggttggcctgggttggcttgggacgagctaggacccaggtcgggttgctagttcggtctgaatcatcgtaggccttgggttaaggcaggttcgtgcgggttcacggccttgattaataatattgtgtcgccctaggatcgcctttataaaatagctttgagcaactaagtgacttttaaatgctgtttactgcaaaacttaacccctatattattactccttgtaccctattgcattaatcatacatctcccggtgtgacttgctgagtactgtggttgtactcattcttactctatcttcccctcccttcagtaagagaagctttggagaagaagtcttagttggagtcctggcttatacccagttgagcgcctgtgaagatggagccgtaggcccgctagtccgctgctgtttatttttgtttgttaggcctaaattgcctttgtaataatgtaaatattatcgatataataaagatgtgccttttgtatcatgtttgtgtggtgtaccccggcttttcctgggacggggattaatacactagcgttctggaaaaggtatttttttcgggtgcgacaaccgctgcgttattgctgtagtcgtacctcgaccatctgagtttgcggtgcgagagattactccgacaacaaccttttctcgagtagtccagccatggccggtgctatgaaatatgtcgtcggtcttcgttggcaggttgggcgcgacgactctgtatttttcgagatcgttctcgataatacggtatactcgaccacaacctactcgagtgctcaattgttcctgaaaaatattttctagaaggcaagacatatagcagataatattgagtacgtactcaaaaaactacatggatcttctagcattatcaggatataatgagcatttctaaatatcaggcattatgtaaaccgtaaacaagcatgatttatacggaaggaaatagagcgagcccccagcgttagaccgtagtcgatttaacatcggggacactcgcgtaacagatattgtataaaaaatatgctctaggtaaacataataaattatagatctgataatgctgtatgatctaaattggtacgataaattgcatataaaatattgagtaccttttagatacatgccggatatatctacgaaattagtagattaattagattaattaatctactaattaccttaattagccttggtggccgatctctgttggtgttttcgggtgattaaccaacgtatcatggctctgtacataccaacatatatttattcgcatacgtacaggtgctcgagacgtgtacgtgtactgtatatatatatgtgtatggtcacggtacaatatttactcatgccacgtgacgtcaggctttgtagtcctcgcggttgcccgatcatgtcgcgtgatgcgagattgatccgagctgacgagcagttgatttctccggagtccatcattgtccgctattgaaaatcggattcgatgtagtcatcggttgacctggccgaggcttcccggtgggaaacatcaaaccatcgttatccccggcgacgatatcttgtagctcggtcgatctcgccggatcgacaagttaacggcgctgattccgatcttgtcagggggcatactccggtcaggttagatctccccatagccgaagtcgtcgagtagcttgttgtcggagaatccatcttttaaactcatcttgtcgaaatcttgaagcaccaaaatccccctacctagcgcgccactgtcgacgtttgatgtcgcgattccggtatttgcatggtatggggatcgttggtactaggatatacacgagactgaggtaaaagagacggaggcaaggatttttatacaggttcgggcccctgaattgtcaggtaataaccctacatcctgttggccgaagccgg

SEQ ID NO: 83284 - DNA, 1393 bp, Oryza sativa
aacaccgacacatttcctttcagaaatttgataaatgtaattatgtaattatagtacaatcgtggtataattatattgtaagttaaatataactacaatgtaacttatatgtaactttcaaaaatccctccgtaacatgctatttttgtgaaatggaggtcgtgcaaacgaatcttctcacgtgtggttgttgatgaaaaatctacactcgggctatggtgcgagatctgtgttgatctagtgcagaactaagatgacgaacacaacggcctgggagatctgcttaactttagtgcagatccaaaatattgatgagatgcaggcgtgccagtcagtttgatcatgtaactgacgagctatataaagtgaaaatcaaagagccgatttgctgacaagccgatatagcaacgctagccgatgtcgatagggtattgaggaattggttttatatccattgtagattttgacacttgagtaaataatgatataaagacaatcgaccgatgataatgtaataaaacaataatataatccaatagaaaccaatcggctaataatgatatgatagaatgattgttgatccgatggttaaagcatacatcggctggtattccgatgcccaaacgattagataatcaattaaacatttgttgcaattggctaaaaccaatttgtacgtaatcattttaatctgatgcaacgtctagataacttatcggctgaaaccccgatgaaacccttattggcaatcaagaagcatgtcagagattatggttctaagcatgactatggctgatgcagtgcaaagtatggtaatgtaatgccccgattttcgttcgggattccaaatcatttaataatgcattttctagaaattaaataaaagttaaagcaatttaatcaagtgatataatgggacaatttgaaattttcctttaaaaatcattggccgggaatattttttaatattctttgtgccctaatatactctccggaattttccgtgaattttcggagctcaagaaataattttaatagcacatagatcatttaatcaattagttataaagaaaaccaaataaatctccccatcctccctttcgggctcggcccagttcccccctccttcccaggccggcctcccctccctcggcccgctcggctctccctctccctcaagtatgctttacctcccttgcccgttttcccctccctctctccccgacaggtgggccccgaggccccacctgtcatcttcttcccgaacctcccgtcgccccaactaccgctatggctgccggtttcgccccacgacgccgcgcctcccgcgctccaccccgccccacgagcgcgtgaaatcggttccctacctcgtcctcccccacttcccccg

SEQ ID NO: 83285 - DNA, 15652 bp, Oryza sativa
ccactgtcgacccgagctttaccaccgcctaccgcctgcggccgcctctagtcgccatccccaactacctcaagccgcgccaccgcctctgttagatccaccaccgcgagggtaagcccggccgcccatccctttttcccctccaccaccagaacaacctccccaccacgccaccctaccggccacctttttccgcctccggtcgccgttcgccatcaccccggctgccgccgcgacgcgccggccgcatcgcctctctcgccgcgtcacgctcttccccggccgccgctcgtccgacaccttccaccgccgggagcccctccgtgttgttgacccaaggagcgccgccgcctccctccgccggccgctccctccgtcgccgcgcctctcggtgagaaccgcctcccctccccttctctctttcttcccttcgccggccgccttccgtgcttgcgcgcgtcgcgctgccgccgccggtggctgcccggcccgtgtgccgccgccgctttggtcccggtcgccgccgccgccggtctagtgtgcgcgatggccaggccgcgccgcccggctgtccccagccgtccgatcggccttggctgatcttggccgtcggggggcgtgcctgcgtggccggtcgccgccgtggactcggtccacggtgggccggtacccaccttgtgtcgctgacgtgtggggcccgcccctttgtggatgtggtccgcgcctttcccccttgctgacgtcagcagtccccttttcctttgtaaaaataaataataattacgcaataaattggtattaattccagaaattcatttaaaatggctcaaaacttctaaaattcatatctaattcattcaaactccgaattgagccattcaacttgcaaaattcatctaaaattaagctctacatgtttgtttactttttatgtactgtttccttagtttttattagagtttttcctcgttttgcgtgccagcgtgtagaatctgtcgtttcggaagatcgcggtcgcgaggataagagttcagaagatccaagtgaagaagcaaggcaagtcacacattccccttgagcatgtttatcccaatttataaatgttttaccatttgcaaataaatatgcatgttttgctaattacatgggatccgggtattacctatatgtttgcttgtgccatgtttacttgatatatgtcctttgtcaacattgggtaataaatcgactagctcatgttacttatgtgacctagctagaactatatgcttagccgtgcttaattaccactagctcagttgatgggataattacagtattagacctttttagtatcagaatgagctgcgtgctcgagacatctggccatgcttcatggtcgtaattatccaactgaaatgcgactacatggtgggctgtgggtgcatggttttgctagttgcacccatggcaattaaggaccggttcgcgggaaaccctggaagaatttatcgtgcttaccacaagccagcgtgggcaacggctgggcttgtagtgtagctttcctctagctgatgcatccaggcaagggtgggcgtgatggagtttggatgggccctgcgacggcctatgcggcttccgaattcacctaggcatgagaggggactgcccgctgccttgcgaggagtgggggtgaaacctaaggtgtggtgtgcttggttagagggagttatgcgaagggtcctgtcacggcctctttccagtatgtcgtggtggcatgtcggcgcacggaaacgtgtcgtggggctatgtcttatgggtacagttgtagacctctgatcagagtaaaactatttgaatagccatgcccgcggttatgggcggtcgaccagattcactgtgattagtcccaccttaataaatcgactcaatgcactgtagttcaggtgggttggttgggcctgttagacatggtgtagcgttgatcagtggagatttaatgttactttaattactcaacatttttactgttttgttcaataaaatgttttacaaccgcctttaagcaaataaccacaaaccgtccttgtgttccccttgcatgtctgcatcgttggtgtggcttgctgagtatggtggttgtactcagccttgctattattcccccttttcagaagtgtagtgcttctgagttgaagacgaagttagaagaccaaggctcagaccccagttgagttttgcctgtggagtggactgaagccccgctaggatcgcctttttccgctgctgtcgttctctttcagtgtgaggactaagtgcctcttctgtaagtattttatgctttatttacatttggaactgtatattacttgtcattttgtgtaccctggctggtcctggacagggatttaatacacaaaatagtctagaaatttgggctaaatttctgggcgtgacaggtaagaaacacaatatctagacaatcaagcccttaactgattttcaaggtggtagatatcttaactaatctagattgacagagcaatttagccaatacaggtaaaaccgtagaaaagatctaatcgatacaaataaattgaataattgacttagactaactaacatatatgataaataggtagcaaatatatcaaccgaaccagagtattatcgtgaaatggcggtcgtgggaacgaatcttctcacatgttcatgcgtcgtgactatttttttccttcctcaccggcatgaattttgaaacaaatctaaagattcaagattatacgaaagttacattcaagttagaatataattgtattacgataatcacatatgtcaatttttaagagagaatttattgacaaatatatagcataattgttcaatgttactgcaacaagcttggaaaactcttgcagttgcagatgggctgggctccgcggctgcgactagctcaacaatgaagctgggccctcatccggccttcatctcgatcacgcaaatggatcggaaatttgaccgtcgggtacacgtgcggactccgactcggatccgcactcgtgtctatttatcgagggactgtttacacccaaatttggcacctaagattaaaataggaaagattgcaaaatttggaagtctaccggtttcctccgagtgggccggtctgaccgccgtgtgttgggcggttagaccgccggttcagggccggtcagaccggcggtgtgtggccggtctgaccggtaggtccaagtccgactgtgtttcgtcgggtttcgaggtttccttgctcgggaaggcatgtttcaggtttcctttagtttctaccccgagttggacatggaggaaggcctgtagagggcaagaccaacccctatataagggacatggccggttcattgtaaaaatctaatctacaatcaatcaatcgaatcgtttttcatactgcttttagttttctcttagtttgtccatctttgtcggtttgcgccgtaaaccgtccgccgccgctgcgagagtgcgacatgtcgcgaccgagaaaattgccttttcccgaacgctagtgtattaatccccgtctcaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaagggggaaaagattgagcaagaatgagtacaaccacagtactcagcaagccacaccggagatgcataattaatgcaagggagtacaaggggataataatataggggttaagttttgcagtaaacagcatttaaaagtcacttagttgcccaaagccattttataaagacgatcctagagctacacagtattattaatcaaggtcgtgaaccctcacgaacctgccttaacccaaggcctacgatgattcagaccgaactggcaacccgaccctgggtcccaactcgtcccaagccaacccaggccaacaattccacattttagttgttgagcaaattttaataattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgagccccctagcagcaggacaccagccctgtgccatgacatctcgactaccgggccgcagctcgtgtagccttcatttgtcctagagatgtccatcgacccccgacttcgtccatctccatccgtgtacttttgtttacaaccagactgagccacaaactaagccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataagccaaccattccatagtgtccaaatgatatgagaattcccaaagtctaaagttataaaaaccacctaatgttgtcctatttaatcagcgaagcatctacctaaattcatactagtggaaccatgaatagagtacccactagttggggttttgttttcctagggtgaacaaggtaataataacaatagcaataataataaggtcataacaaaggtaaataggcatggctaaataaaacagtgataacgcaggaatttaaataaagcgataatgcattaatttaaatcaaaataattttataaactgggattcaatatgctcaaggatgatgtgacttgccttgctcggagagaacggccttccgaaccttcggcgacgaccacgaaccacgcttcgggaacctccggaacgacgaaagctacgcgaagcacacaagcaaagctacaagcctataaagaagcaataacaacacataaaaagaaagcacagggttctttaggttatatcaaacattaagagacttgaacgggtcgattcggagctcgcatgaccaagatatgatcatccgaagtttaatgctgttatatggagatttgcggattattataattaagctttgcaactataaaacatgtgtaagcgctagcctggaaaagacaggaaggctgcgccgttgacatgcggaccccacatatcaacctaaaggaccgcggtagaccgggtacacagagacggtccacgggtcgacggaagcggaccgcgtgtgtcaaccgaggcgagtggccgacaaacggagtccactagacaccacacgggctgcacacgtggaaaccacgcggctaccgagcgggcacactaacacggtcaccacacgcacaagcgaacgactaccgacaccggtacacgggtaccggggtcgataaccgcacaacgagcacgggcgacaacgaaaggacgaggacggagcagcaagaggggagaccttaccaccacgcgacgaggcgtgggaacgacaacgacgaacaggcgcggcggagacagacggcgagggaacgacttcggcggcgatccttggacgacggcgagacgcggccggcacgaggcttgacgacgcggaggcgaggacgaagacgatgacgggggctgcagcgaccttgacgaaacaccgaggacggacgagaacagctcgacggagggacgaacgccccgacgaccgggaacgacgagaggacgacgacgacgacgaccggggccggcgaggagacgacgagggcagccggcagcggctacacgaagacgaggacggcgtggaccacgccgctgcgatgccgacgacggaggcggcgccgcgagacgacgagccgggcgaccgatgggacgtcgacgacgagaacgatcggagacgacgatgatggaccgcggaggggtttggatggaggggaagcgaggccaagggcgaccttgccgctgcgatgccggaggtggtggtgccgcggctgaccggtaaacaagcgaggaggaacgggcggccggaggactccggcgaggcgggtggaggggttggtggcgacacggcggcttccggtcgaaaccgaggggtggacgaggtggagggctacgtcaccgtgccgagggaggggacggcagcgccggctgacgcacgggcatggcgaaaggggcagccggaggagatgccgccgaggaggaaggagaagccggcgcgggcgacggtgttctggcgaaattcgggcgaggaggaggtgatgccggggatgagggcggcgtcgcggagccgagggaggtggtggcgacgtcgaccggcgcttaggcagggagatagaggcggctggaggcggccgacgcggaggaaagggaagggcgacggcgggaacgcagctccgggggtctccgcgggaaacggagggcaagccggggaaggggaggcagctgcgatgctggaggaggcgacggcgcgaccggacgacgctccggcgaggagggagaggcggctggaggcggccggcggcacgggagagagaggaggacggcggggagagggctagggaccacgggagatcgcgggagggggctaaaacgatagaacggagcgagggggttgcattttatagcggagggaagcgagccgagcacgggagagggcggaacggcgacgggaatggcggccggcggcaaaggaaggcggccggacttggcgcgtccgttcccggcgattgggggcgccattcaatggggaattaagggggaaagagagaggagggaaaggggattaattccccctaatcaatttgggaatcccatgcttgaatcgcgcggatttgagggaggaatggcgctagggttcacgggagagggagagaggacggccgggcgggaggaggacgatgacccgcctgacgcgtgggccccacgcggccggacgcgcggtcagcgcacgcgcggcgcgcgtgtgcatggccggctcggctcggcctggcttgggcgcggcttgggccgggcggccggcccaggaggagaggagggggaggcggcctgggagaaagagggaggaggagggagtggaccgggaggggaagaggggcccaagaggaggagggagagaaggagagggaggagagggagacttcggccgcgggccgaggggagagagggaggactttgggccagacttggaccaaaggggggagagagattatttttaggttttttttttctttttaataaactctaatatttgtttttgttgcttaataattattttcggtgctctgaaaattccactaaaatttgagggctctttttagaccaaggagaatttaacaaaaattctccgggccacatttgaatttttcttgtacgtattttaatgtttgccaatttcttttcgaattttaattaattctattattccttttagggaatgatttttatttcgggatgaatttatcaggacgtgacacgacatctctttgtaggtttgtcctaaaaacttccgttttgcccacgagacgggtagttatctagaaatcggctccgctagccggtttagttatcaaaacccatctaggtttagctctttgctagatcgaggtggttggcgactctaggatcaccgcaaggcttaaggtgctgcgatcgtgcttgtcaacttgtcaaaaaagatgccaacacgatttttggcgattccactgggaaagagatccgttcatcgtcaactcaacttcgacttcgccatgacgaagccgccatccaagacggaggtggagccatccaatgtgataccggtcacattggaggatttcgaaggagaggaccacaaagttatggaggagtacatcaacgaactcacacgagaggcgttgatgagggcaagcactaggactcgtcaaggggtgatcatcaagcccgggctacttcctaagctcgtccccgatttggtaagcaatgatgaggtaacacaatctatacaacagcaagtagcatctacaatagattcatctatgattgcttttaaagataagttagatgcaacttttgagggtaaatttgatgagtttttaagggttaaattcggtcctcttatggccgattacatgtcaaaggataaagcctctaccactgctaaccaacctcctatagatcaaacgggtagtaaaaccgatggagcggcgcacacggccggtctgaccgggcctgacggccggtcagaccccgacttagccgtcggtccgaccggccaaacggccccggcggtcagaccggtactcaggccggtccgaccgcgcctctggatgccggtcagactgggccctgggccggtcagaccgacgcgattataccgatacagggaatcgatccgatgactaatgctagttatttgtatcatcttaaaacatttgatcctcctgtatctactgctgcaaataatccccagttcccccacatgttcctaatgcttataatgatgttgctagggggtatcctcccgatactagacaaggctaatataatcatattacgccacaaacacaacctattaggccaccaaatccaccgccaaatcaacatgggcctaataatatggaggatataattagtgagattattaggaatagattcgggattgaaactaggaatcgtgctagggtttacaaaaattcgtatcctgattattatgataatgtgccgtttccccgtaattatagagttcccgaatttaccaagtttagtggtgaggatggtaagaccacatgggagcatgtaggtcaatttttggcgcaatgtggtgaggctaatagtgatacttttaaattgggcttgttttctttatctttgtccgataatgcttttacatggtttacttctttatcggcaaattctattcatacttgggctcaattagatgaaaaatttcatgattatttctatactggagaaactgagcttaggttatgtgatttaacatcggttaagcaaaagtataatgagcctgtcattgattatattaagagatttagggatgttagaaaccgatgttatagcttgaatataactgatagagatttggctggtcttgcttttaatggtttaattgctcctcttagagaaagactagatgaccaacaatttcttgatgttagtcaacttatgcaaagagctctggctcaagaaagccgggttaaggataataaaaaacttgttagatcatatgacaaaaagcctaatgtgattgattaccctgaggctagtgatagtgaggaggagggtgatcatgatatatatgttgctgaatggtcatggactaacaaagacaagccttttgtttgctccaacctaatgccgactcctcgcaaagatcggcaaagtgatgttaaatatagttttgatgtggccaagtgtgataagatttttgattatcttttacaagaaagacaaattagattacctaaaggccatgtcataccatctcaagaagagttgaaacgtcgagcatattgtaaatggcatgattctcattctcattctactaatgattgcaatgtgtttcgacgacaggttcaatcggccatagatgaaggacgattgaagttcaccgatggctccaagatgaagcttgatcatgatccttttccggtgaatacaattaatttcaataataaaaaggtgttgattcggccggagcaagccgaatctactaaaggaaaaggagtaatcattggtgaaccaagaccaaagatgatagtgccaaataagccggaggttggtgtttggaaggaaaataagagtgaagcttcaacttctaaagcccctaggaagaccaaagtgacttttgatatgcttttggagaaatatgagaagcaaggtggtgagagaattcgcaacaaaggaaaaagaccaagatcacctcctaggaagcgatttggtcattcaccaagacggtcgcattcacctccatatcatcatccacaagacatgtcatggggttcttatccaatgccgccgccgggttatccttatccttattacatgccatggggggcgacgctgccaatgttcaatcatatgcctccaatgcaattcaaccaagggtggggaggaccgaggaggccaattcatgagcgtttgtcttcaccaaacaatagccggttttatggtaagaatcgggctaatgaagaaaagagggaaggaaagcgcgtcaaggtggaggcaaggacttcagaagtaattaccatcaaagtggggtctcatgatgtgccaataccttttggagatggagttggagtatcctcaaacaaaaaatccgaagccgaaaccagctcctcgcagtcggccggtctgaccaggccttctggccggtctaaccgcaaccatgcgaccggtctgaccgggccatcaggccggtctgaccgccgacccgacagcagtccgaccgacgcctcaggccggtctaaccgtgcgccaagtgtcggtctgaccggcgcgtctggccggtctgaccggtggtctacgtccggtctgaccgggctccagcgccgttttgacaggggaattgcaaagggctatgtgagggcttcatcgtcttcaaacaagattaataggggacattatttacctcctggaacagagtcgaatcctaggtggatgcctaaggatttgacggctactcaaaagagaaggttgcaacgtcttcgggcttaagagataagagagataaagggttcaatgagttgcgaccgccatcggtatggaggcgtaaatccatagagaaggaaaagccggttgttgtagaggagaaggaggagcaatcggttgataaaggtgaatcatatccaaaagaagacatggatatcaacatggtatgtatgttacctatggagttttgtgctatggatgaagccgaggttgctcaattctcattaggtcctaaagacgcggtttttgagaagcccaatgagtcaaaccgtcacatgaagcctctttatctcaaaggcaatgttgatgggaagccggtctctaggatgctagtggatggaggtgccgccgtgaacttgatgccgaactcattattcaagaagttggggcgtgaggatgatgagttgaaaaagaccaacatgattctcaatggcttcaatggtgaaccaacggaggcaaagggtatcttttcggcggagctcaccgtgggaaacaagacgctaccaaccgctttcttcatcgtcgatgtgcaaggtaactacaatgttattttgggtcgttgttggattcatgccaatttttgtgtgccttctaccttgcatcaatgtttaattcaatgggacagcgatgatgttgaaattgttcaaacggatacattagccgaggttgcaatggccgatgctacttttgagtggcgtcatgggaatatccaatgcttatcagttagggatctttctagctatgattttattagtatctccgatggcaaatttgtacctatctctgtaaagcctgctagtgtagcacggctaagccatataaatttgtataatgagtaaggaggctaatttagaatggttacaaaagagggtgcaagaatatcggtctgcaaagaacgatattggtgaaaccgttgaagattttgatgaagtggagaagcttggataagggtttgcatcggccgatccattggaggaagtggacataggtgtggaaccaaaccaaggctgacttttgtaaacaaaaatatgagagccgattataaggttaagataatcgagctacttaaagaatatgttgattgctttgcatgggaatatcatgagatgccgggtcttagccgcgagcttgttgagcatcggcttccaattaaaccaggttttaggccttataagcaaccacctcatcgttttaatcctttgctatatgaccgggtcaaagaggagattgatcggttcttgaaggcggggtttattaggccatgttgttatgcggagtgggtttctaacatagtcccggtggagaagaaggggagtggtaagattagagtttgcatagattttagagatttaaataaagccactcccaaagatgagtatcctatgcctatagccgacatgatgattaatgatgcctcgggtcataaggtgattagctttctagatggtaataccggctacaatcaaatctttatggcggaagaggatatgtacaagacggcttttaggtgcccgggatttgttggtttatttgagtgggttgtcatgacttttgggttgaagaacgccggtgcaacgtatcaaaaggcaatgaatttgatctttcatgatttgctaggtattatcttagagatctatattgatgatattgttgtcaaattggatggtatggaaggacacatagccgatttgagattagcttttgagaggatgcgccggtatggtttgaagatgaacccacttaaatgtgcttttgatgtgtcggcggggaaattcttaggattcatggtgcatgagagaggagttgagattgatcctaagaagatagaaaagatttgtgatttcaaagcgccgacatgcaagaaggaagttcagaagttgctaggtaaggtaaattatttgagaaggtttatttctaacctagcgggtaaaatcgatgcttttgttcctatacttcgcttgaaaaaagaagccgattttacttgggaggcaaaacaacaagaggcgtttgaagagttgaagaggtatttgtctactccacccgttgtgggagcgcctaaagccgaaaagccttttcggttatatattgcctctgaagacaaagtcattggtgccgttttgacgcaagaggaagatggcaaggaatatatcattacatatttgagccgccgtcttttggatgccgaaacgaggtatgtttttatagagagactttgtttatgcttatactatgcttgtaccaaattgaggcattacttgttatctagtacatgcatagttgcttgtcaagccgatgttattaaacacatgttgcaaatgccaattctaagtgggaggattggcaagtgggcatatgctttgatagaatatgatttggcttatgaaccattgaaatctatgaaaggccaaattatatgtgattttatagtggaccatcatgtagatattgcttatgaggaaaaggtttgcttagttgaagttataccttggaaaatttattttgatggttcttcttgcaaagaaggtcaaggcataggggtagttttgttttcacctaatggcatgtgttatgaagcatcggttcgtttagagtattattgtacaaataatcaagctgaatacaatgctttattattcggcttacaagttatggagatggttggagctaagtacgtggaggcttttggtgattcggaattggtggtgcaacaagtcgccggagtctacaaatgcttggacggatcactaaataggtacctcgattcatgtttggatattattgccaattttgttaattttgctattagacatattgctaggcgtgataattccggagcaaatgacttggcacaacaagcatctagctataatgtgaagaagggattatttctgatattagaagaaccggtgcttgtttttaaatctttgtgtgaaattggcaaaactggagatcaggggcggtctgaccggcattgcgtggccggtctgaccggtgaccaagggcggtctgaccggccacatgccgccggtctgactggcgaccccgagcggtatgaccggccctgtgtggtcggtctgactggttctgggcagagcgctggggggcacgtttcaatcaatttagaggccgaatcaattgtgaattcggacatttgtgcccaggaagcagaagaaaattggagaattcctttgattcgatatttgaaagatcccacgcttaaggttgatcggaaaattcggcagcaagcgttcaaatacacattgcttgatgaggatttatatcgccgaaatatagatggtgtcttgttgaaatgcttagatgaagatcaatctaaagtggctatgggagaggtacatgaagggatttgtggaactcatcaatcggcccacaagatgaattggttgcttaggagagcggggttctattggccgaagatgattgatgattgcttcaaatattatagaggatgcgaggcttgtcaatggttcggcaatgtacaattggcgcccgccgccgtgttgaaccctataatcaaaccatgccgttccgaggatgggctttggatttcattggtcaaatttatccttcgtcatcaaggggacataggttcatgctagttgctacggattacttcaccaagcgggccgaagccgtgccgttgaagaatatgactcatacggaggtaattgactttattttgaagcatattatccatagattcggtattccataaacattaactacggatcaaggtgcttcttttatgtctaaggaagtgaaggttttgccgaatcttatggtattaaattgttgagttcttctccttactacgctcaggctaatggacaagccgagtcgagtaataaaatgttgttgaagtaagtgaaaaagaagattgaggaatacccaaagaggtggcatgaggtgctttctgaagcattgtgggcacataggatatctaaacatggtgctactaaagtcactccttttgagttggtttatggtcaagaagccgttttaccggtggaggtaaatcttggttctcttcgttatatcaagcaagatgatttgtcaagtgaagattacaagacattgatgggagacaaccttgatgaagtcatcgacaagcgcttgaaggcattggaagaaatagagaaagagaagaagagggtggccaaggcgtccaacaaaagggtgaaaggaaagttgtttcaagttggagatttggtttggaagacaattttgcctttgggtactcgatccaaggagttcggtaagtggtttcctagttgggagggcccttatcgaatatgcggcattgttcgaggaaatgcatattttttagagacacttcaaggggagcgttttcagcgagcaatcaacgggaaatacttgaagaaatacttcccgagcgtttggcaagacgcttaggaggtactatggctggtaattggattatcgtcctaagaccaaaacatgttctatgcttttagattcacgttgttcatcaaaaagacagggcggcatgtatttacacccaaatttggcacctaagattaaaataggaaagattgccaaaatttggaagtctactggtttcctccgagtgggccggtctaaccgccgtgtgttgggcggttagaccgccggttcagggccggtcagaccggcgttgtgtggccggtctgaccagcaggtccgagtccgactgtgtttcgtcgggtttcga

SEQ ID NO: 83286 - DNA, 4551 bp, Oryza sativa
  unsure (1)..(4551): unsure at all n locations
attgcgacccgttgggttttcgcccgcctgtggggaccggcccccctgtcacgggcctaagagtggcatcacgcccgagcgcctccctcgggggggtggtcgccctagcgtaacgctgggggctactgtcggtgacatggggccgggggtatcgtgactagaggcttgggtagccgtggtcacctacgtggcctgaccccctcggggggggggggtcgggcccgacagtgatgtggccacccctccctctgtctccccgaggggtcggcccgctcccatttcggccccgagggctggggcgccccgaccccctgtggttttggcgccacgtgtgtgggttaggtgagcacaccgggctcacctaaccgcatttatagcaggttgacgagcgcgccacgccgcatttactgcggcgcagcgcacgcttatccggaccgtgaccagtcgcggtgtgtgaccggtcacagaccggtaagatcgcgggttaggtggcaacaggcggcctgtcacacgcctcgccccatcccgtcagaatgatgagagcttcctggctctcgtccctagctggagccggcgtgctaactcctggagttggtatgtcagtcccggtcagatccattccaggcttcagcgcaaggatggcaaggaagtcgctggccattaaatgaaggttgaagtgggcgtccccgggaaaagcgggcgagcggggcagaaggcgtgtgctccgcttgtcatatgtcctttccggctgtagactagccctcattgtaaaagtgtgtttcctttcttaggtagcgggaggcccatgtggtgacccctgaccagataaaaaggaggcccaggcctgagagagaaaggaggagaaaaagaaaaagaggagaagaggggggcgaacggggctagagcctgaacgctctctcgctctccggctctggatattccttcactcacagatccaccagaacacaggagtagggtgttacgcttcttagcggcccgaacctgtctacgtcgcccgtgtcttgcgcatttcttctctcgctgacgttcctcagatcgagggcgaagaacctcacttagcgcccccggccgaaccggcaaaggggggcctgcgcggtctcccggtgaggagccccacgctccgtcaccctggatcagtagttggtatacacatacatagttggatcacaacatatcacgaatgaattcaggctaaaagagttaaatacttacattagggctaggtaggccaacaactatcagagaacaacagcggaagacaaaataatataagggcccggttaacatgccacaggcagtcgactggggaacgagacctagaacaagaccgcactccgatcatcttgtgggatacgcaagcgtaccgacaagggcttctcttcaacactctcctaaaagatatataaatagcaagggtgagtaccaaccgtacccagcaagccaccacaacaacaatgcatatgatagagggtttttcaaggaatggcttcaggttcttttgcataaagctagttttgtaattcttttcacaagcctaagacctagcatagactgatcaaattttaataccagttttcacattaaacaacgacggttctgtccaccatccattatgatcccaaggatagctttccgccattgaatcgtcatggttttctgaggacttccactttcccgcctctcaggaagtggctccaacagcataaaatcatcatgcaatatcccatcccacacaagttaaagaatttagagtctagccaagtgtaatacatgtcccggtgctcaataaccgcgagcacggctattcgaatagatttggtttactcacactgcagtggatatacactttacccgcactccgcgactgcccaacacatgagcctcgtcccaacacatgagacgcgtcacggcaaagcttttcgataacctcgcattggcagtatccgctccatggacttaaatcctcatgcactctaggcgtccatgtttctagtagtgtgaggagttttggcgctcccgggaaagagaagtctcacacatattaaattatggttcaagttaagttctctctctcacacactcatggcagtcctaccaatggcgacaccgatgtagggcacgcctctcggccctacctcaacggctgtcccatcgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagcctttcccagataccacccaaatcctccgtccgcccaagtcgaaaacaattgtttaattttatttctcctttcacaaattatgtcatcaacatcatggcaatgtggcgctcatgtctccacatgccgcatctcaattaccttcccaaaagtaattgcccaagcatcatttgataaatatgagtatgcatgattctagaatagcatttctaagcaattgtcataattgactagggactcatacgtaaacatggttacgaaggaataaggggcaaacaataatcaaggcatggcataatcacaagtaggatgttcatcattgcatgcaattttatttgtaaacaaaacaatttcacaattgggatcaacatgttcaaggaatagtgatgacttgcctgctcaggatagtccttattctcgatataatctcgatcaaccttcacctcctggaagttgcagacattgcctcacgactaaccgatacacaaagtctatgatacgcgagaaaaaccaatattcaaacaacaatcaaatatgcacaacaaaatgtacttgttagggtcgtacctagggttgctcatactattattgcttgctaggggattccaatcatgctaagggctaaagtttcttaatctttctgttgtcacggtggtttatttggagctagccatcgtagtataaatgagatacacatcttgctaatatggggtttagtctagctagtggttatggaaggattatggctatatatgcatctatctaaatagaacggttatatactagaggttcttttgtcggatggatttaggatcaatcaaataattacagtgaatcatttgtattattatgaacatattttatttgtcacaataaattatgaaaggttaataattatccatgctctatatgttacacttgtgaggctaataatattacagattatcccatcacataattttacaatgaataatcctaatttacaattgaacttagatcatattagatcaaggtctataattagtatttatccaccatacatgttgatcatatattctcttaaattttaatacatgcaatcaagcaatttaatactacagcgtatagctataatgggttgtacagtatatgtgtatgtgtgcaacaacgtataaggttttggtcgcctactgtacatgagcttatttagaaaatgtactacccaatgctccaagtgattcctgaatatattgtagtttaattatacattagctagtttctatgagtgatattgtatatgtgatgtgacaagtttaagcactggttctattgggttactaataagtggtaatcaatttaggcatatatatgctattctatatggtattgcatcgattaatttacttagtgattcctccacatctagctctgttattattctcctaaacaggttaaagattcatctatgtgtgtttatattttagttacataatcataaggctatacttgatttaaataacctataagccatggatttaattatatggccatcgaatattaaataagtactagtattttcctatacatccattcatttgagacatcacataaaattagtttgtgtggttgttacagtggcaagacatgttagagacaaatattattacatccactctactgtacaatactaattttatttattagcatatttttaagttgactattatgcatcatcttgatattaattatttaatatttataaatatattttatcaaatagtgaattatatatcattggaaagcttatgaatttaggttcaagtttcactcaaatcggagctgaaatgaataagttatgctagtgtaaagattcaaatttgaattaattctaataattgcgaaatggtactgttcctaattcatttatttataatacaaccttatccacaagctatagtgactgacaggtggggtcaaagtcttgattttcttttctacagaattagttttctaagggaaattggatggaattaatgacaggtggggccactctaacctctctcctccattctcttttctctctcttttctctgttttctcctctatttctctcacggcctcggatagaacaggcgggcggcacggcgcgatggcaagcggnnnnnnnnnnnnnnnnnnnnnnnnnnnnnnnnnnnntttncganngnnttgtgcagctgncgatctcatccgc

SEQ ID NO: 83287 - DNA, 674 bp, Oryza sativa
aaaaattgggatctgtcttgtggttcaagggaaaaatcttggtcgctcgtttaagtgagatttgtcaaaacaagtcagtccagggttttagtaaaactgttgagatttattcgttagtcatttgggatttgggtcctagctcaggaacatgggttgcaaggtatttatgctcttattgttattattagtatgtatctaatttccccattattttatcgttatgtgggtctgtcttctttattcgctctcatgcaaaatgatctatgcataaaatttcgctcttattcgattctcttatttgagtcttttattgctttatttaaatttggatttgagcatgcattgatcctagtcctttgccttctctagatggccggccacccccccaaccaccgaggagaaggcatgatcgactttgtggcagagttggcacgtatgacgctggtggtgggctaccccaacgcgccagagtacacgacggttccaccgctcagtggcgagcttcctcaccgtgttcgcctggaggtccacggctacgtgggtacctgcctagctaatatggtggttgaggcatccggaggcacagtagatcacgcctgtcaggaggcagcatacctgatgatggccagactacgggagcgccacaactacatcttccacgacacggcgtaccg

SEQ ID NO: 83288 - DNA, 11210 bp, Oryza sativa
  unsure (1)..(11210): unsure at all n locations
gccgtgaattgaagatcgnnnnnnnnnnnnnnnnnnnnnnnnnnnnnnnnnnnnnnnnnnnnnnnnnnnnnnnnnnnnnatcgtgctgcagcctcccagttacctccaggcacaggccattcttggtgagtctcttgctctgtcgagctctgtcagtttttggcttcactggccctgtttcgatgaacacgggctgctctctgattgtggggttggcttgtatgcggtggatctgatccttctcttcaggtggtcccaagatccggtgctcggattccaactggcgacgcgacgggcgacgcgacggcggcgacgggagtggcgcggggctcggcgcggcgcagccgacggtgacaggcgatcatgacgatgtgacggcgatgacgacggcgcgcggcgcggtaatgatggcgacgtgacggcgacggcgacggcgcacggggcgcgaggcggcgcgacggcgcgcggcggcagcggcggagcgaggcgacggcgactgcgacggcggcgcggggcgcgaggcggcgcgcaccagtgggcggcagcggcgcggcgcggcgcgtgcatgggcacggggcgcgagggggaacgcggcagtggagggggggaagggctagggaactacatcaaacacctaggccataatgaacagtgactttttcctaattatccacttttgaggcctatttcctattaaaacttgtcccataatttctagatttcacacaattagagttttacccaatatatgttttattttagatgaaagttgaccaaaatttaatattacccatattttatatattttcctattgtattatttaaatgaggtttaaatctaaaattaacctagataattttggaggctttgagggttctaaaattaatttaaaatatcctaatgtggccattattattacaatagcacattgaatgaacttatttgtataacaatgcattttacgtgggtctactcattctataaatataaattgagacttagtacaacattaatctaattgtttaattaaacactcacatattcttatttatgtataaagcctaatttatttatatgaccattattttatatgagtgattttcatgctatgaggagcttgataaggtgtttcaaatattaattatatattctagtgagatactctattatagatggggccattgatgtgatcatcatttcatgtgtacttatatttcatgtgagattggattcaagtgaattatattcaactatgttgtttccttttgttaaatatgaaatcaggctatcaacatggtttgattatttaatatttgatttgtgatttataccacagggtttaataattgacttgtactttatttggcctggctttcatgtgcataaatatttatgggattgataataaatatcgtatcgttgtaaatcgtaactattgctcgggtgtaaatctttagattgatttttttccattgcgtcgatttatggtttggcaagcaataacaaccataactttcagcatgatgcaaaaagttttaaaaagttcgaaattttagtgatttttaatgtcaggaattttcaggatgttacaaggtgtctaccgtcgtcggtcgagatgcatttgagaagtaccccgtttggcgctttcttgtatagatcgttgccgaccatacagtagatctttgctttacgggttattttctcggcctctgtatcgtcctcgggcaactcctcgctgctgatgaatttgattagtggggtgcgccagtcgtctgtggtttcgatgtcggcaacggcgcgttctgcctcggtgacctccgagctaatgtcgggggtgttcgggctgacttcgccgctaacctctttcactgatggctttgtcaggatatcgagaaaagtgccgggctcgagcgattctcatctggacgcatgtcgtgctatgtcgtctggctcgatgttgtcctttcggtagacgtgtcggaccttgatcccatcgaactttttctctagcttcctgacttctgcgagatacttggataactcggagttagagcatttataatctttgtgtacctggttcgcgactagttcggagtcccctttgacaattagtcgcttggccccaagtgtagctgcaactcatatcccggcgagtagtccttcgtattctgcagtgttattggtcgccctgaagttgaggtggattacgtgattgaattgatctccggagggagacgtcaagataaatcctgccccggctccttggctgttgagtgtgccatcgaacgccattgtccatgttgcattgtcgccttggttgtctgatttgttatctggcatagtccaatcggcaacgaagtcggcgagtacctgggacttgatggctgttcgtggcacaaagtgggcatcaaactggctcagctcgactacccatttcgcaatgcggccaacaacgtctttgtttctcacaacttcaccaagaggaaaagaggagacaactgtgactctgtgggcttgaaaatagtggcgtagcttccttgatgtcatgatgactgcgtaaagcagcttttggatctgtgggtatcttgtctttgcgtcgtggagagcttcgctgacgtaataaactggtcgctgtactttctctctctcgacaacaatgacagtgctaacggagtgtggcgtggcggcgatatagaggaataattcttcattagtttagggagcaacaagtacaagggggtttgataggtagcgcttgagtgcaatgaatgcctcttcggcttcctgtgtccatacaaatttgtcttgtttcttcaacagagcgaagaaaggttgtcctcgttctcccatcctagcgacgaatctgcttagtgctgccatgcatccggttagcttttgtacctccttgagtcctgtaggcgacttcatgttctcgattgccttgatcttctcggggtttgcttctatccctctgccagagacaaggaatccgagcaacttgcccgacggtactccgaacgtgcacttctcaggattgagcatgaggcgatattgtcggaggttgtcgaatgtttcctgcagatcgtcaatcaatgagtcgtctgtcttggttttgacaacgatgttgttgacgtaagcctcgacattgttgccaagctggttgctaagtgcgccctggaccgtgcgctggaaagtattcccagctgtaatcagtccgaacggcatcttaacatagcaaaataccccgaacggcgtgatgaatgctgtcttctctttgtcctcttttgccatgctgatttggtggtagccagagtaagcgtcgaggaagctcaataactcgcaaccggctgttgaatccaccagttggtctattcgaggaagtggaaagtgatccttggggcacgccttgttgaggtcggtgaagtcgacacacattctccattttccgttggccttccacaccatgactggattggctagccactctagataaagtacttctctgatgaagccagctttgagaagtttgtcgagctcttctcgtatggcttgttttcggtctggtgcaaatctccacagtctttgctttactggcttggcatcgggtcgcaccatgagtttgtgctcaatcacctccctagggacccccggcatgtcggacggctgccaagcgaacacgtcggcattgtcgcggaggaaggtgatgagcgcgagttcctatttctcgtttagtgtcgccccgatcttgacggtcttgtcggggttggcactggagagtggaacaatcttgatggcaccgtctggtttcggcgtcttgtttgtcttggtcactttcttgggtggctcagtcgtggcgggtgggctgggcgtttgctcgaccatgtcgaggctccgcttgtcgcattgcaccgccagctttgcgttcccctgaatagtgattgttcccttcggtcccggcatcttaagcacttgatatgcgtagtgagatgcggccatgaacttcgcaagtgcagttctcccgatgatggcgttgtaagctgtatcgaattcagcaacatcaaaggtgatctgttctgttaggaagttgttggcttggccgaaagtcacgggcaacgtaatcttgcccaaaggtctggacgatgattggggagtaattccatggaagggttgatcagttggtgtcaactcgttttgcgaaattcccatcgcgtccaaagtgctggcaaaaagaagattgattgagctgccaccatcaatgagaactcgcgctaccttgatgttccgaatggtgggttcgaccacgatcggatatcgtctgggataacggcgatcttagggtggtcttcttctgagaactctatcttctgctcagaccacttcatcttgggtgcagccccctgccatgtcgagcagacttcacgttccactttcttgtattctcgcttggacgagtacgttgtggaaccaccgaagatgtgtgagacgtggaggtcggagtctggatacgctgagtccggttcgtgaggaaccgtctcttcgttcgtctcgacaacgcgtactcgcttgcctttttcaaatgccatgtgcttctcgagcgactttttgaaaacaaggcaatcttccagagaatgtctgtccgtcttgtgtatggggcaccatgatttctttgtgtcgctactttgtgggtatgggcgtttgggagggttcgcgtattctgctgcgaggacttctgcttgagctttccttttcccgtttttgtgatttttcttcttgcttgactcagatgtgtccgtggctggtttcttctctcccccggtcttcggcctattgttcttgcgtcttagcacatcatcagcgtgggcgcatcgctcaacgatctcgaataatctccgagtggttctgatgcatcttgtcgccaactcctgggtagtgtagcgatctctgacaccagatttgaaggcgtgaattacagaagcgtcggtgatttcaggaattgtgtttctgcactcgttgaaacgtcgaacatattccctcaatgattcacccgagttctgtgtcaacgcgtgtaggtcgtcttcgatcgcgtggcacttgtatgttccttggaaattggcgatgaattgttgccacaggtctgcccacgaagagattgagtagggaggaagatgcatcaccatgaacgtgcagaacccttcaacgcggttggtaaatagttcgctaacgcgttgtcgtctgctctggcatcatagagtactgtggagtagacttgaaggaactcctcttggtcgatgctcccatcatacttttttattgctccgggtcagaatctctcaggccatcggacatcacgtagggaacgcccgaaagccctacacccagcgttgggggcggtgggttgccggcggtcgtgtgtccttcgtggatgtttgtctgacgatgaggaggacgtggatgatgacgatgacgatgggtcgcttggttccggcgtacgattacgaggatgacggcctggatctcgggaatcttgtcgtcgtcttccgctgttgtctcggcgccgatctccatcgtcgtcgtcgatacggcggcggccatgaccagtattgtctggcacccgttgttcacgatcgttgtgatcgtggtggttgtcgtggtcccggtcctcgtttgagcgatctcctcgatttccgttatcatggcgccgtgaagagacatgacgccgagagcgattcacgttgtctcatgtgcgtcgtgcttcccggcggccgttgatttgatctcgaagatcgccagtgccgtgaggtggaggggtagcttgttgaggtgattccctccgttctgaatcttcaccactggcctcgccagttggtggctgctcctggtgtgctgcggtagcggcttcttcaaacgcgttgctgaggttagtcaccaattcccatagtcgttctgtccaacgctcgaggtcaacgttcagaacgggatcataaggagtttccctcagtatcgcttgaacggccctgatgtgctaggctggagtagtcgattgattccccgcttctgtgttggcgtgcgctgacgtaccaacgtcatcgatagccaatacctcccgcggcgcgctcgttgtcgataacccatagtcctcgaggagatgtaagaccgatggttcgtgaggatcgatatcgattaccccaacgaatcgatctgaagttggagtcgctccttgttccttgccgttatcccttatggggatatatgacttaggagactgagctttcatggcgccgagaaagactttgtagctcgagaggtcgtgattctttgtcttgtgaataggacaatagacatcccgagttggagaagtacgctgaattccacgttctttgcaggcgcgaatttcagcacgaacgttgaggaaaacccagcaatcttgcagggtgtgtttcttggttttgtggataggacaccaagaccttgtggcttcggaagtcatctttgtcggctcgtggttcatgtcggaaggacaaggtttggccgtatcagaatccttcttgagcttggatgtcgtcgatattccgttctccgtctcgatgggaggatttttcgacatggaatcgccttggttcgtaaccactgcgttctcgtctccggtcattggagaaccggttgagatcggcgtcgtggtgtaaaccgggaagacgatttcaccgacttgagtccatatcagcattgttgaagcagggagtacttggttgaggctggtgctgacgttgttgtcgacgaagctggatgacatagtagtagaaccttgagtaccaagatcccctacctggcgcgccactgtcgatgggtgatatccgtagaccggatatagagggtattagggtacgttagtacaaggatctacgtagtacgacatcaagcaaacaaaagacaagaattatactggttcaggcctcttgataggtaatagccctaatccagttgatgtgggattatatggtagaaaacatagattacaaagagaacaagggaacttgtcggatccggcgagattgtagtcgagttgattcgactagctctcgatgacttggctcctcgtaagctccggcttcgtaggctgtggaggttatgttggctctgagattcgatgcctaaaccctccccgggaggccccttttatatcgcagatgtggatgtctcctcgtagaactcggaggtatcagaccctatacgatacgccaacgacccggttttgcccgagtaggattcttcccatatgtagattccgtgaaaagtttccttagaatatacaggaaatatccgcatgcgcgtgggtatgccatatcaatatgtaacgtatatcgaagggtaaagagtatgcctaacccgtaatcctgacagatttattttccagcagaggaaaaaaccataatagagaaaaaaaaatgttggcaattgctgctggtacagtagacgaggtgggtggcgatgcaataatttccacgttttcgagctagtgatgcacaaatgcatcaatttatccaacacatatcattaagttattgcatactttaattaagtactctctccgtttcaatatttgacaccgttgactttttagcacatgtttgaccgttcgtcttgttcaaaaaaaattatgaaatatgtaaaattatatgcctacataaaaatatatttaacaatgaatcaaatgataggaaaacaattaataattacttaaattttttgaataagacgaacggtcaaacatatgctaaaaagtcaatggcgtcaaacattttgaaacggagggagtaccatataatatatgttgctgcttcaaatcgtgactttggcacgaaaaggtattttttgtgtgttttctttgaatctgatcacacaaagaaaaagggttgcttaattacatatgtgtggatatgcatatgatccacatgaaagatcgaattaattaagcaccaaatttattgcaagccaccaagaacagcctgttaaagagaggaatacgtatgagtgtcacatgtacgtgactgaagtatatattttccttgttttcgtacgtcacagttataaaacagctacagtgatgtataattattccaggcttccagcagctaagctagatggccgtatatccgtatagcatctagtagaaattaatttaaattaggagtactaataaggaagaaagtactcttgtcatgtacatatgtctatttgatcctaaacataagagcaattttacggtacttaaggaggtaccatgaggtaccacttttcttattgtaaatttggtacctcttattgtaaatttggtacctcttagtatctaggtactatgaggtaccatgaggtactcaaaattagtgtaaaatttggtacctcatggtatctcctcaatgtcacgccccgaactagtcccgaccggaactagcccgtgacgctccaaattaacctgctaatcgataccagtcccaggaaacagtgctggtatcacagggagacagagtatcacagcaacagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactggggggggatcatttatatagagcaagggtgagtacggaagtactcagcaaagccagggaaataagtgtttaatgcaggcttcaaggagaggctgttgttttcgcaatttattttatttgaactcttttctaaaaagtctaagtgagtgcttctcaaacgacacggatgagacagtgcgcctcgtccggtcggagtatgtgcaatgtatcagtctttagatcttgaaacagggttggcacccggccaacagcttttcaaacggccacccgggcctagctgatcccgtcagctgctgatttttttttcaaatatcgaacccagattcacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccagatcacccagcccgtggggatcagccacgtcgggagacctccaagctttcacgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaatcggtccttaagtgcgagagcgggaaaccgtacacccggtacgttccccggtccgcggttttggaaattcgtttagttcgcaagcaccgacccaggtgtcgggttttccaagtcttttgtaaaactccagttttacccaagctgttactcagattataagtttgaaggcgtccgtcgatactcgcacaggatgcacgaatatcaggacgcaactaggtggttacaaggggacatgttgtaacaattaacaaggaaaggatcaaatgcaacaatttaggtaggtctgccaatctgccttgcagacgggacaacagatttagtgtgatcctatcaatgcatagtatttcgcaagcaatataattaaatttcaaatataggctcgagatgttcaagggtggcttgccttgctcgagatctggagcttgatcctcgaaatcctcgcactgcaggtcctcgggctccggaactacacgcgaaacggaacaactcaacaaacggtgaaaataaagccctattaatgacctctaagcatgccattagatagatctcgagatttgaggaattttggaagttgaacggagtcaaacggacttacggttgggaagatattgaatttctaagattattggatttttggtctaacggaaaaaggatttaattaaatcctttttggaaaagaaaaagaaaagaaaggagggagggaatatagacttttctcgggtggctagggtgcggcccaagagatttggggcggctcggccgatcttaacgggccggccggcccaagaaggcggcccaagacggtcgcgcgcgcgggagggaggagagagagggagccggtggaccgggctcaccacgcgcggtcctgggtgggacccgcttgtcagcggctcggctcaccgtgcggagggagtatgcggcgtacgcgcgcgggcagggctgggacgcggtgcacgcgcgtggttcgcggaggaacggatgcgcggggcccacgcgcagcctcacggctcaccgcgggaccacacgcacggggagaaacgtagggagcggctggccgggtcggcttatccggtcgcggccgaggtggcgccgaggtggcgcctacgtggcagcctcacgggccggcgggaggtagacgacgacccggccgcgaatggacggcggtgcgacagcggcgagcggcggagcgtgccacggcgataccggcgaaagcgcgcacaccgggcggttgcatgtgacaaggggagacgagcaaacggctcggattcgccggaggtagctcgacggcggcggattgcggcggcggcaaccagcggcgggagaagagggaaacggcgacgaggtcacgagaggtcgattcccggcggtgagagcatctacgcgaccacgggaatccgatgctagcgtcggattggacggagctacgccgagcgaggctggcgacgagcgggtgctacggagctcgggcggcgacggcggcgagcacatggcgaacgacggcaacggtcggggcggcgccggctagctacggggagtctactcgagctactaccgaaagctagggggaggagatggagcgaggaggaagaacggaaagagnnnnnnnnnnnnnnnnnnnnnnnnnnnnnnnnnnnnnnnnnnnnnnnnnngtggntgtctcatngtcctaccnggggacagc

SEQ ID NO: 83289 - DNA, 775 bp, Oryza sativa
cttaggatatcgatataactttcgatgaatatatttaatcattactcgcatagcatagccacatatattaggcgtgttcggaaggccaggccacaatcgtggcagcagcagccacatgttagtctgatgcttgcagcactgttgccgttggctacgctacaacgcagccacggttgccgaacatgcccattatcaaaaccatttttgatttaattattttgggtcaacttttattacccaaagttaatatcactttgtgttatgtttttttaatcttttgttgtacttttgactaacgcttttgttttgtatagccagatccaatctctccccggagaagatatgagctttgcctgtaaataggggtgatagttggcataattgtgtggtctttgtaaaattgataaaaaaaactagcccaaagtaaaaaaaattagataaaggatggtccaaaataaaacctaggtaagaaaaggtagaacaaaatggaaatcactcaaaccatatttttagaagcatttactaactaaaattctaatgtctaatgctagtatgtacttaaaagaaaatctttaataaacatttactaactaatatttcaaccgatagattttacggtcttatttaacatgactcaaaattgctaaatttaactttctagtagcatactctaaagtggagtgacttgaatcctgcttcatctctttaattaatcatcacccttttaggtgaggttgaaaccattttgttagccgttagctcttaaacagattaa

SEQ ID NO: 83290 - DNA, 699 bp, Oryza sativa
ccgttatttatgtctgcttttcagaggagatagatatctctctctgtgcgcaggcagaggtgtagcttttgggcgacatggtctcgctagatctttcctgcttttcagttgcatggtaaagagatttgcgtctgaaaagtttctctcttggtgagagaagaaaaaagatgtgtggatggagctaagctagccataggatatatatatatatatatatatatatatatatatatatatatatatatatatatatatatatatgatatatatgtctagacatataatgcatatatgcatgcatgatgggggtgcagtgtgcagtctttggggttgggttgggttgggtttgctttgctttgcttatcatggaggaagggaattgatgccctgcatgaaaatatgcctatgtatgcaggacctccatgtgtgtggtgagaggagagatagattgaggtgtagaagccataattaacagccactagaacaacaatataatgctgagtaatgcgccatgcatatgttggtgacgctaattgcctgcctgattagtttaagacaggctcgctaatgatgtcaaatgcgcgtcatagtatgcatcatggtcatgcatggcatgcccctagtaaagggtgcgtcatgcatggtatgaaaccatggaccagctgctgcacagtgtgtacgggtagaaaagtagagtat

SEQ ID NO: 83291 - DNA, 2414 bp, Oryza sativa
ctcggcacgctcgcgcggaaaacaacgggcggaaaggatggccatggggaccggacaacgcggacggcgcaacaacacggctcggacgggaaaccacgcggcgcgcgcgagcaacggcgcgcggggccggctttgcgagcggggggggctcgcgcgagagaagggggcgctcggcgcgggcgactcccgcgcacgcgcgcgcggcgcgcggcggaaccggaggggagcggaaagagaggcgctcggcgcggctctcacacgcgcgagcagcgagggggggaaaacgcgccgggggggcaatcgagagagagagagagagagagagagagagagagagggagacgcccgggagagagagggccggggaagagatcatgagatggcacgggcactagacaacaatcaaagaaacaactttcgcaattagggtttttaggagataattttcccgctaggcgccacgacggaacgggcgctacactcaaggaccgtaaaattgttttaaacgtaacactagacaacaatcaaagaaacaactttcgcaattagggtttttaggagataattttcccgctaggcgccacgacggaacgggcgctacactcaaggaccgtaaaattgttttaaacgtaattaaactggatcgaaagccaccatggaatataattcagggggaaaagaggcattttcaaagtttttatatggattatcctagaaccgagttgatggttcattcatcacaggacttcagttagcgtgaattttaggttggactctattttatttccaacgcttcaaattggaaccttttctaacatgttgtgttttgctttggatctttttcataatatttcctttattttccaggtaaaaacgagagcttaaatgtagtggtggagacatgtgtccatggagaatatcgtgagtaaaagggttgaatgtaaaactaaaagttaaaaaagagaggattaaagtgaaaattaattatcagtgtactaaatataggatttgtacccgtgtacgcgcgcgcatatacctcagtaagaatactacctacatacctattattggacaagaaacaaattcccaaatctaagataaactcgtggacatgaaatgtgatctcagaaagaggataaagctcatagtctgacataagaatgactaggactgctcgaattgtgtcttagcttttgcctttcgagttctgcttggataaggaggtgtccaggcaagtgatataaacacaaggcattgaaagggaggacattctaatctctatagataacacaatacatatataaatacaatgtattgctgaaggggcctctacttgttctttgcctccactagattttgcattggcaagtgaaggtattggaggcagaaagttgctacatcgagatcaattggatctggtcgacaaaaggaggaatgtgacaaaggaactagttagaggtggaaggaacacatatgagaagtgtaggttgccattataccttcaaaattttcttaatggagagattgaatgtgatccacgtcttcatccaagcagcggatacgtcttgaaattagttgccagcccttaggcaccaccaaagtacagcatggtttcctttgtaaggaggtcttgctgctcgggggaggcaaagataactaagtcattggcatatattaacctttatatgtaagtattaaatttgtgcaacaaaaacaactacttcctccatccaaaaaaaactggatgttgtaacatcctaacaattttccagaaaaaaaaggtcattttagcaatatgtaattaaagaaatggggtcagtctatttctatcgactcattccagaccactcgtgatttgctttgccctatgtaatgtttgtgtccatggcgccaatgtgtattgtaactcctgtggcacgtggcaataagttatggaaggcttaattaattacaatcaggaaatattctctcgaaccttccactacgccagaaccctacatctgtgacggtacaccagtgacgggtttataaattggtcacagatgaccgtcacctttgacgggtcgttaggtttaccatcatcggtgaggcatctggcctcggcccgtcacaggtatcacctcacctgtgacgggccagaattttaagccgtcacaggtaagatagtgacgagtttgacttccaacccgtcactggtatgacctcatttctgacgggccagggagttataacccgtcacaggtgatgggccgtcacttgtgacggatatgacttctggcccatcactgattttaagtttgcacccatcaaaggtgatcaattttgacatataaaaaaggaacccccaccccccacccatggggccccaccgacacctgctcagtctctctccttctcctctcagactctcttct

SEQ ID NO: 83292 - DNA, 14243 bp, Oryza sativa
agcctccctcgccggagcaggtgggatgggcggaaggcgcagtgatctccgcccagtcggcggcggataacatggcgtcctatgtgctggatctcaggaggggcctggccgtgttcgccgggaccgggcgccccgaggaggcggtgctcaggaagaacgtcgcgtgggccgacgcgcgccgcgcggcgcttgctggagaaggagctcaggtgcatggcggcgagagaccaccccgtcattccggagcttgcggcgctgatcaccgccatgcgcgagtccaccaaatcactggtcctgcaggactccggcgatgatgccgtccgtagccgtaaggccgggttgttggacagcgcgatcaagttcgaggacgccgtggtggggaagatgaccgcgttgaaggagaagctcacgcgtggcgccgccgccttcgtgggggaggaggagatcgtgcaggcgctgaacaagcacgccgcgacggccgaggcggagattgcagaatcacaagcgttctctgcggtcctgttagccgatgccaaccgagcagcaattctcgtcgttgtcgtgcacaagaggccggcgccggagacggagacggagacggaggaggaggaggagccgccacgacagaggcgaggcacaggagatgccggagacagtgccgcacaagactagctatagctagattagcaaactctgtgtttcctgtctcgtgccgatcgatcagctgttgatctacatcttgtaaatctaattagtccatgatcgatctgattttgttaatctacatgtaatatcagaccaatatacaggttgtgtcgtatgcatatactagttagtcatactccgtttttccctatactagtgcagggatgtatcgcactggtataggtagaatccttgagaagagtaacgcggacgaacaaagacgatcgatcgaacagagcaaaaattcaggcacccctgtaaaaagctactaccactagtcagatttgaaaaaaatatcgggggccgggcctgggccgtgccgcccatttggccatctatatacctacatatttgtcgacatatttgtaaggaaaaattatttgatatttcatttcatagatgaatggtagtaattcatctaagttgtctctcaacgatgagaattagaatctaaatatttctcgaatatttgacttagaatactactattactttgtggatatagaaaccggagaaggagaagaagctagctcaggtgcttggcggctagagaccaccctgtcaatccggaggttgcggagctgatcatgcgcaaggtcaccatcaatcctgtcggatttggtgagaaatccgtgtgttcttgagtgtttgagtgagataaaagttaggttgctaataatttggtatcagatccttgttggaactttttattctctccatcgctctcttgatctgcggtaaaactcatggaagaggtaggaattgttgcttcggtgatggattccacagaagcttcggctccctcgactaggttcatgagattcaaagcacgatttcaaccacaacatactaagccccgatacgtgaccaagcagggggccaagatcatggaccaggacagcaagatggaggcgtccgataagaagcaggaagagagcgagaagtggagggagcaatcagaagagagagtagggcagagttcctgactctccaggtgaaagtagaatcaaggatttgtgaggtgtagaagcatgatgatctcatgcaggatttggtggaagaattgcaagagaaagtgggaagttgctaaccatggttcagaattcatctcatgagactcttcctgcgcatgcacgagtcctacaacaaaattactacaataaaaaagtgctacttatacaattttagtagttagaaaataaatattattcttttgatttatatttaaaactaaattttgttgtaaacaatatcttgtataacaaactcataaatataatagtctcataattattattcaataatcaatcagaattttcgttttagatttattttgttggtctcgtgtcgatcaactgtttgatctagatatggtagatcaatcgagctaattattcgattcgattattaatgggaccacctatacatttgtcgacacatttccttttagaaatttgataaatgtaattatgtaattatagtacaatcgtgatataattacattgtaagttaaatataactacaatgtaactttgtaacttatatgtaactttcaaaaatccctccgtaacatgctatttttgtgaaatagaggtcgtgcaaacgaatcttctcacgtgtggttgttgatgaaaaatctacgctcgggctatggtgcgagatctgtgttgatctagtgcagaactaagacgacgaacgcaacggcctagcagatctgcttagctctagtgcagatccaaaatattgatgagatgcgggcgtgccagtcagtttgatcatgtaactaacaagctatataaagtgaaaatcaaaaagtcgattggcttacaagccgatatagctgtttgacgtattttgtcaattttcaccaagcaaataagattactattcagcttctaagctagcttgattgttggatttttatgagatgcatgcatgcatgggccatgcagtactgtgcacgtgttaactggtgcatacgtatatatatactcgtatctagccaaccatatggctcatatgcatgaatgaattggccaacaggagagatgagctgctctgtgactcatgggctcgcgcgctcgtggccgtatactcggcgtatacgtatacgtataccggacggttttccataggcttaaaaagcagcgagctgggacgtattaatagttgggctgcatatgggctggcggagctgcactacatgctcgtcgtgaacatgcggctagatatctaacgcgtacgcggcaggcgaaatttctctccaacggcagcgagatacggatgtggaactgacaacgtcggataactcaagtcttatctgatgatttcggataaggagttatccgcggcaactgtacccggaaatatcggagcgatcacgcgtggtcgcggcatgcgcgcctgctcgttaggttttcctccgcgcctatataaagccaccaagagacggcgccaggggatggacaatcattcaactcccatcgatccatccatcggcggcggccgcgtagaacacataggcgaccacgtactcaggcatcgctatagcacaagccttgttgacgtgacttcgccggagcagaagcggtgcacgccgcccgcgctcggcagcggcgtctggcaggaggacgtgcatctgaccatcagccatcacgggaagaaagccgaggtcgatggctgtccgaggtaagagcgctaattagattgtttcttcttatattttgcagcacatgcatgcacgggcagatggagaaccacaacggagaagaagcagatccatctacacacatgaagaacacacacaagagaaaacatgtacagggcctcggcggaagggcacgccaacgtgtgcgccgccggccggcggcagcatggcgcaccaaaagtgtggcccgccgggcgtcgttcgatgctgaaaatcaatcgatcaacacacatccatctatcgactcccatccggcgccgtcaacacatccatccaacaattctcatcggtgatccatccagcgccgacacgcaccggcggcagcgagcgacttcggccggagctccggcgtctggcaggagagggcacgcgcggtgacccgatcatcggcaagcacaggagggagtacttcgacgaggaagaaggaacttgatggctaccaaggtagaagctagcaagatcgtttcgtttttctttcatctacagcatgcacacatccatctacacatatggtcgccgccggtgaaagttgcggtggccgattcatctacacgcgatagaagcctcatcgatgccggcgcccatccgagtcgacaagatgtctggacccgacgccgccaatttaagccgctggtggtgcatctactagaagccgcgacgtcgccaaggtgccagacgtcctcgctttgctgcaagtttcaccgtgccggagcagactgactatgtcgaagtcatcgtgacgccgcgccctgctggagcacgtcgaagatcgccggagaaggtcgtcgtgaagttattccgtcggagcacgccgaagatcgccggagctaccgccgactgccatgacttctccccgcttttatgccggaggtcaagcatcacgtacgtagggcgtcgaaaccagcagatgacaacgaaggcaagtgtggctgcagcacaggagggaggatgacgagctgaaactagcagatgcatgctaattaagctaattattgtggtaacgtggccgaccaaccggagggtggcacatcatcaccatgctacagttgcacaagaagtcgtcaacgcgacggctaaagtaaacaaatcctgttgatttcaagctttctcaattagatgccgagctgtgattaaatccggctgccgtctacatcgtccacctcgttgccgatgctctaacgctcgccatccctgctcaagctaccggtgatgctgtctaccggataccgccatgtcgtcgagatgcgccgatgcccccatctcgccaactgcggcttctcttctgtaatgcgcgccgtaccctcgccggcgatcgcaggagcagccacgagtgtcgcccgagctgtttctgatccaggagacggtggcagtcgctgggatgttgctcaaggagccgtcgacatgccaccctgctgtgacgcactgaaggtccccggagcagtcgcggataccgtcgaggtgcccgtacgccgttcgtcaagtctggctgtgattctttcacttcatcacgccggagttgccatgtcaaccgatctgttggcgctgatcgcaagcgtctgtcaagctcgatgccactcgtcctcaggactgatgccatctgttcgagctgccggtgatgattctactcgttgcgatctcgccgagatattaaacgtcgtcgccttttgccgaccgctgcctcgcaacaccgtcaatatctacccaccctcgccgccgttgcaatcttggtgcccacacgctgtcgtcaagcccggccatgattctttctcgtcatcaggctgaggtcgtcgtgccgtctatccacgacgctttcacttcatcacgctggagtcgttcgtgatgtcacaagacaatcacgccggagcaccactgctcggtgcccgtaaaccatcgtcaagccggagccgttgtattgtccgtctgtgatgcctttacctcgtcaagtcggagttgccgtgttgtctatccatgacatctccttctcttcacaccacatgataagatgtcatctgtctacgatgctttcacttcatcacgccaagatgagagctgtccgtccgtgatgctctccccttttcgtcaagattgatgcctcttgtccgtatattggagcgtcgctcgtctacatcgacataatgcaagaatggtgccgtctgtgatgccaaggaactattcatgctgaatctacaccaacaataccctcggttgttccgccgatgagatattcacttcttccaaggtcgtcgtcgctaccgacgctctcatggagccccttttatgggctcgtcatcatatcaactgaatcaatagtagatccattatccgaaggaggtgccagagccccgttcatccggctgttgtctgcaccaacttcttcatcaacctcttcgttacatgtccttgttgtataaggagcttgacgagccaggaggtgcccaaccatgtgtaatccggctgccgtctacaccaactgtatacgtcattttattttcatctagccaggaagtacccagccatggatatgcatgcggctgtcgtctacaccaactgtcttcgtcaattcttcgttcgtttgatctcgacgagccaggaggtgtccagccacgtatattcggctgttgtgtacactgacttcaccaacttctcttccctttaacaccatcccgacaccactattgtgacgtctcaaccgtccaagctatggagatccatgcatgctgaagattaaccatctacaccaccacgttgctcaagactgatgaggcggagtgaaagggcgggcggagtctatatgaaggctacgtcaccaacaccggcgcacggaccgacgaggccgtggataagttgccggctatcacgccctgaagtttcccccttcttctttcttaaaaatttgttgaataaatcgttcgaagaaaatggtttaatttaacctagagttgaatcctaaattaataaatgcaattaataattggaattggcatgatgggatttttcttgagttccacatgtcacaatatattaacaggatttttaatggaattttcagagccttagaaataattttaaccaattaaaaatgagcaagtgcaatattttaaatcccaggaaaatccttttcctttgtctcttttcttttcctttctttttctcttgatgggccatcggcccagtccacctaacctcaccccgcgctcgggctccccttgttgggccggcccatttccccttccctctccctccgggacgctgacaggtgggccccacctgtcggggtcgtccccttcctccaaccgccgccgccgaaaccgccgcgcccacctcctccactcctcccgcgcccactccgcgtccacgtacgcccgcacccacgtcgtcgcccacgccccgctttcccgaccgcgcgcgctcgcacggggcgggattcaaatttgaatcccccccctctatctccccactcccccacatcgccggccaaatcaaccaccctcccggccacgtccgcccctcccgtgcctataaaattgctccccgcgtccccctctctcgtttttcgctctcgccgcgctcccccgtgcctcctaccgtcgctgcgccgcgctcgccaagcttcgccgccgccgaagctctccggccgcgtgccgtcgctactacagccgccgccacatcgcgtaaccgccgccgttagcttcaccgccgcgagagctacatcggccaccgctcacttgccgtgccccatcaccgtaccgctctccccacacgccgccgccgctagagccgtcgccgcgcctccgctcgccagtcgtcgctgccgccttcttccttcgcgccggccgccgtgctcgccggtgaggaatcccctctcctcctttctttcctctctcccatgagcgccgccgccctttgcgcatgcgtcgtcatctttggccgcgccgccgctccggccgtccgccgccgcctttcgcaccgtccgccgccgcttccctccgccggtcgccgtcgctccccatggccggccggccggctttgtgccaagccgagccgtgcctagccgccacccgcgccgtccgatcggcctcgggccgattcggaccgtcggtcccgtggaccggcggtggaccacccgcgtggtcccggtccatggtagaccggcctccctttgtgccgctgacatgagggccctgcttgccggcgccaccccccgccttcgctgacgtcagccctgggcaatattgcgcaataaataattaaggactttttccttgttagtaaaaacacatattatcttctaaaattcatacctaattcatcttagctccatttaagtccattcaagtctcagtaaattcataaaaatccctagaatccattcaaaatggttttgttctctgtttcagcagtcttatagcatgttttgcttgtgtgctttgtttgtcgcgtagatttcggccgtttcgtcgatccgcggttcctcgaagacgttgctgtggtctcaccagtgcgagagcaaggcaagtcatgctttacatttgatcatattgtacccaatttacaaatatccctcatttctattaaatgttgcactcttttacaatgtcatgtgggatgggtcctactactcagccatagattgtttaccatatgccattgataacttgggtatcaaaatgattagatgttgatttagaaaatgcttagccatgcctagttcaactagtacacaagtggggattacattattacatagactttgtctatcagcatagttttggattggtgccaccgcaatggtgttagttaattaaaatacactgaatggtgggttgtgggtgcatggtttcgctggtcgcacccatggcaggtaaggaccggttcacgggaaaccctaggagactaaccgtgcttaccataaataggagtgggtaactgcttgatctgaagtatagctcgaccctttcctaggcaccggtggcgagggagggcgtgatggagttgggtcggccggggtgtccggttgtccagctgccggattcaccacggcgcaataggggaccgcccattgccttttgaggggtgggggtgaaaccttagcgtggtgtggatggttaggggagggttatgcggagggtcttgtcacgatttccccctttgcagtatcatggtgatacttcggggcatggcgacatgtgtaggatcgtgtcttgtgggtacagttgtacacctctggccagagtaaaactattcgaatagtcgtgcccgcggttatgggcgatcaaccagattcatcgtgattagtctcacccctagtttagcttaatgaactggtgtagttcaggtggttggttgggcctgttgcaacgtggtgtagcgttggacagtgattggttaatattgattaattactacagctcttttactgctttcaactactgcttttaaatgctagcttgatgcaaaagaacccctagcctcctttggttatatcctgcatcatacctcctcttccggtatgacttgctgagtacagtgggtagtactcagtcttgctctcttttcccccacaccagagctgaagatcctcctagttggagctgtcttgttgaggttggtttcgtcgctgccgtcaagggatgcctgtggagtggagtcgccccgctgctgaagtcaagctccccagttagcttgttttatcttttccgctgcatttgtaatcttttatatttttgtaagacgtggatctgtatgtcaacaattgttgtttgtgtaccctggctggtcctggaccgggatttaatgcacattcagcttagaaattctggttcgtgaatttctgggtgtgacaagttggtattagagccgaccttgaccgtaggacaagccaactggaaacctaagagccctttgatccccttttcatctgcatatgctctttgcacttggatttgtttcggaaaaaatttggtgttttgcctctttggtttgtgggaaaaatcttggtcgttcattcggatcggatctttaaaattagcttagtctagggttttagtaaaattttatttggagtttattcgtcagtcagtcgggaaactattgggtgatatgcatttggtcgtgtctatgttcgatagggcaattttatgcgcatcattatagctatgcatctattttatgcattaatttattgtttagtcagttgcattagtgtctttatctaggttcatgaaaaatgttctatgcataaaaaaatcatcaggctcggttatttatttgagtcatttgttgctttgtctaatttggacttgagcattaattggttcttatcccttgtctactttagatgtcagtcttatccctcgattgcaagcgccgctccgagcttcagagtcgctgtccttagctttatcgtcttcttagttttgtttgcttgctagtttccgtgtttaggtttcttgcttgtgggttagtcggcggtcgatatcatgtgtcagtggtatggttgtcttaattaggagttgtttcctttcttttcggtgttttaatcaagattaagataattgcacttaagtttataagaaagattagtttctaagccatctgtttttctccctttctcttatttctacatatcccccttcagatggtgaagacaaggaatggttctcaatccaacaaggtcagtggcagtgaagagcagatcaatggaccacgtgccagcggtgcatctgatagcagttcatctccaccactcgagaaccctacgattgctcaggtgttggacaatcagactcagatgataacaatgatgatgcaacagatgcaacaacagtaccatcaggtgttgcagcaggtgcagcagcaagcacagcagcagcagcagaacctgtagtttggtcctccacctccttagtccaaactgttagaatttctccgtgtcaagccgcccactttctcaagtaccaccaacccaatcgaggccaatgactggcttcgtgctattgagaagaagctgaaccttttgcaatgcaacgaccaagagaaggttgcttttgctacacaccagctgcaactgcaaggtcccgcttctgtttggtgggacaactacatggtgacccgtccagctgggacagaggttacttggatagagttttgtcagagttttaataaggcacaggttcccgagggaattgtggcacaaaagaagagagagttccgttctttgcagcaaggaaccagaacagttatagagtatctacacgagttcaaccgtctcacgcgctatgcccctgaggacgtgcgcactgatgccgagaggcaggagaagtttttgtcgggtcttgatgatgaattgaccaaccagttgatctcccaacattatgaggactttcagaagttggtggacaaagccatccgtcaggaagagcagtgcaacaaaatgaaccgtaaaaggaaggcagttcagttcaggacttcccaggggattagtcagaagcctcgcctcacgatgggacatcagggtggaccttccaccatgattatccagcagcaccgtccctaccacccgggtagcttcgacaagaactaccatagtggcagtcacaacaacagtgagcagcacagcctcaatccgactccaagttcactaatgaatgtagctcagtcagctctaccagctcagccagaacagcccaagaagtttggagaaaagcctgacctctgcttcaattgtaacgagcccggacacatggttggtaagtgcccgaagccaagacgtgccggactcaagttcgttcaggcccatgtcaatcatgcatctgcagaggaggcacagtcagcaccagaggttatattgggcacatttcccgtcaactcgacaccggcagtaatattgtttgattctggtgcaactcattccttcatttccaagcgttttgctggtgcgcatgggttatctttagtgaagcttaagatacctatgcgagttcatactcctggaggtggcatgaccacaactcactattgcccatcagtaacagttgaaattcaagggttgatttttccagccaacctcattcttctcgaatccaaggatctagatgttattcttggaatggattggttgacaaggcacagagtgattgattgcactagccacaccatcaagttgaccaatgcgaaaggagaagtggtaaccttccagtctccagtattgcagaagccagggatcagtttaaaccaggctgctggtgaggaacaagaggtagcagtggagaaaaccactaagaagttggaagatattcccatagtcagagagtatccagaggtttttccggataatctgacaacaatgccaccaaaaagggatatcgagttccggatcgacttggcacctggaactgcaccgatccacaagaggccttacagaatgggagccaacgagttggcggaagtcaagaagcaagttgatgaacagttacagaagggatacattcgcccgagcacgttgccttggggtgctccggtaatctttgtggaaaagaaagacaaaaccaagaggatgtgcgttaactagtacgcactcaatgaggtcactattaagaacaagtaccctttgtcaaggattgatgatctgtttgatcagttgaaaggagctacagtgttccctaagatggacctgcgatcaggctatcaccagttgaggatccgtgaagaggatattccaaagactgcattcatcacttgttatgggttgttcgaatgtacagttatgtctttcggactcaccaacgaacctgccttcttcatgaatttgatgaacaaggtgtttatggaatttctagacaagtttgtcgtggttttcatcgatgacatactgatttactccaagtccgaggaagaacatgagcagcatcttcggttggtacttgaaaagttaaaagagcaccagctatatgccaagttcagcaagtgtgacttctggcttaaggaagttcagtttctcggtcacatcgtgaatgctcaaggagtagctgtggatccagcaaatgtggagtcagttaccaagtggaccccaccgaggacagtcactcaggttcggagtttctttggacttgcgggctattaccgccagttcattgagaagttctctaaaattgcaaagccaatgacacagctattgaagaagaaagaaaagtttatctggtctgctgaatgcaataggagttttgaagaactcaaacgacggttggtgtctgcaccagttttaattctgcctgatcagacgaaagatttccaggtttattgtgatgtatctcgctaggggttagggtgtgtgtttatgcaagatggcaaagtggttgcttatgcatcacgtcagttgcgtcctcatgaaggcaactacccgacccacgatctggaattggccgcagttgttcatgctttaaagatctggcggcactatttcatcggtaaccgttgtgaggtatatacagatcacaaaagtctaaagtacatcttcactcaacctgatttgaatctccgacagcgaagatggttggagctaatcaaggattatgatatgggaatacactatcatgccggcaaggctaatgtggtagcagacgccttaagcaggaagagttactgcaatgttgcatgggtagagaaactgtgttgtgaggttaaacgtgatttggaacatctgaaccttagtatagttgagcacggattcgtggctgccctagaggcacagcccacattggtggagcaggttcgcatagctcatgcaagtgatcctgaaatagcagagctcaaaaagaacatgagagttggaaaagcccgaggttttgatgaggacgaacaaggaacaatctggatgggagaaagattgtgtgtacctggatgggagaaagattgtgtgtacctgaaaacaaggagttaaaagacctgatactgacagaagctcatcaaactcagtattcaattcatcccgacagtactaaaatgtaccaagacctcaaggaaaaactctagtgggtaagcatgagaagggaaatagctgaattcgtcgcactctgtgacgtctgccagcgagtaaatgcagagcaccaaaggccagcaggtttgctacagccacttcagattccaaaatggaaatgggaagaaattggaatggatttcattaccggtttgcctaggacatcatcggggcacgattctatttgggtagtcgttgaccgactctccaaagtggctcacttcattccgatgcacactacctactcagggaagaaattagcagaactttatctggcaagaatcatgtatctacatggtgtacctaagaagatcgtgtctgatcgaggaagccaattcacttcaaagctctggcagaaattgcaagaagaattgggaacccgtttgaacttcagcacagcctaccatccgcagactgatggtcagaccgagcaagtcaaccaaatattggaagatatgttaagagcttgtgcgcttgattttgatggagcatgagacaaaagcttgccgtatgccgagttctcctacaacaacagttaccatgctagtctgcaaatggcaccatttgaagcactgtatgaacggaggtgccgcactccgctcttctgggatcagacaggggaacgccagttgtttggtacataagttttaaatgaggcagaagagaaagtcagagctgtcagcgaaagattgagaatcgcgcaatctcgacagaaaagctatgcagacaatcgtcgaagggagctcgctttcgaagcaggggactatgtgtatcttcgtgtcactccgctcagaggag

SEQ ID NO: 83293 - DNA, 32420 bp, Oryza sativa
  unsure (1)..(32420): unsure at all n locations
gccgacggnaagttgggcangncaanncnncgagnnnttggaaaaagctatcgatttcgaaccctacttattagtgctaagcagaagtcaccctttccttctcttgtatccagatctgagcttgcagtcaaccgattccggcgtctcctgtggttcctgtggctaaatccttgtccaaggatgcatctagctttaaccccatcaaaaatcatgagctattggatcattagttagatgctctttgtgtactagtattttgtttggatagtgggcatgcatgttgtttcgctttgttttcttgttctatttaagttgatgcatcagtaaatctgtttttattttccttgttagacctcttaccagaagttttttttggtgtgttcttggatactctacaaatcccccaatttctatgctagctgaacaaattagatgctagttctttctacaaatggtgagcttcctttgccagttgatctatttccgtttctttcagataatatttaactactgacatgcatatggatgactatcaaggatggttgaaaggctagctaatgaatactaatctgaggtaaacttatttttgccttctcagacagagtgaccccattttaatttgttgttttggagcaacttatgctgattatctggctgttaggctattcttgcatagttatatgcatttgtaacatatcgaagctgttcctgctactgtcatcccatctgtaacatatatctggttgttaggctgttaggatattgttgcattaaacttctctgaatgatgtcattgcaggcactgggggctgtacttatgctgatctaattgtaagtttgtatgtcataccatattcgtcaggctcagaaaccaaagatggaaatgctatgttcaagtttgtggcacttaggctatatttctcatttttcagtatgttggcatcgaagtatgttctcttttttctggatttatttctggtgctttgaagcatcggcttggctcaatttgagaacttgcaatgcatgtgtgtgaatgtctatggattttcggtgacaacttggaatgcatgtgatgttagtttgaaacttttaatgcaatgggctgaaactggagacatatatattgcatgtgtatgttctgtttttccagaggcatggctagcaaatcctaggggaaattattatttttctggatgtaagctcaccactgacggttcatattgcaaaagccgtcacaggtgaccataccagtgacggctttgcacatacatgtcgtcacaagtgacacacctgtgacgttttttactctctgagccgtcacaggtgagtcatctgtgacgggttgcaaaatggcatgggttagcgcagacacttatctctgacgggccgtagagttctagcccgtcagaggtgactgtcatcagtgacggtcttccacccgtcaaaggtgaccgaactcaccagtgaccactgatcactgaccaagcctaaagccgtcaaaggtgagggtttgggcccgtcactggtgaccttgtccagtgtagtgttctgaattgcatgtactcttatcgaaatgataattgaatcaaataaataggctgagaaatcttaaaacatcgaggtttttttagagagaggaactatatttttttcaaatataaatgctacatattcataattttgtcccatttcaccaatcatatgcaaattcggttgggttgtgtccatattgaaatgataactgaatcaaataaataggctgagaaatcttaaaacatcgagtttttatttgagagagaggaactatatttttttcaaatataaatgctgcatattcctaattttgtccccatttcaccaaccatatgcaaattcggttgggttgtgtccgtatcggcgagagtgaaagattaattaaccaagaggatcaaatggtcattgtcaaatatatcctcccaagtaattaatcctctcacaatccaatcgatcaaagtggacaaggaagttattttggtttgaaaactgtctataccaattagcaaactgtttctcttaagagttaaagtggatcgttttcacgtttactagctacttcctatgtcctaaaatataacaatttttaacactaaaaatttgtcctaaaatataacaaattttgtacctacattcctttttaactaatcacaaccttccaccattcaaattcttcacctactttcccttcttaaccaatcacatttttttcctatttaattccacatgttttcttaatacctgttcttaagcctaaaacacctcatgtattgggacaaaggtagtatttgttaactcagaacatatcctatacatacaagtttcgcgagtacactcaccctgtacatcaactaataaacatcatcaaaaatccagaaaaattatacgagtatttctaatagtattatacttgtatatatatgaactctcaactccaaaattattatattttagccataattaaaaaaacaaaaatctgatagctttaatagtataaatttgtcaatcttttgtttatttctgctctatatatatgatgaattttaggttgagattttatgcgtatgtataatactatagaagtatatgtatgacttctgttaaaaaaattatgataacgttttgtttgtgtgcttgacagtatactccaatcttaacgttatcttgcgtgctgcagtgggaactacaaatcagatatactgagaaaggaaggatgagggaaaaaatacatgtatgttttgtactcgtttcgtcccaaaaaattaaatcctagctatgaaactggatatgcaattgtccagtatatagctaggatttgcttttttttagacggaaggtgtatctgggaggtgccaaatataatagaccaaataatttggcattaattaggcatgcttgactaaaaaaatactaggatattagggaagcccctactaaccatgtttagtaatgtatatgcggttggagaaactccatataaaagagagatcaagtccatggagagtgccatttatatactagattgccagggcatttataacaaatactgatccagcaatacggtgcggtcttcatctgcacagcaaggcgcgtagtagttgatttttagtggaataaatttaaagcttacaatcaagtggttctcgaccaatatagctagctccatatcacttcaagtggcagatttagctcaaattttaattatatagaaatctagatttctcatatccaaaaaatatatacactaatatgtaaaaaataaaataacttcacaaaaaattagaagagaaaagggtgaaatcgaaactcaccccagtgaagcaactctcaactggccaatggttctagaaactgggataatcaatgataagtaaacagctttaacaatttatggggttagcaatggcccattgccacacctggacacgtggtaagagcatgagcagataccgacgcaaagagtataagagtttaatagtagagtccactactagctccaattaatctatagccgatctaatagccaatttatacaatagttgtttactatactgttaatatatggtccacttgtcatacacacattgtgtcttgaagttcatgctacagctagctacagatctgtagcccgctgctcttctctctcatcttttatctcattaaaatatgtttatagctagctaatagtctgctattgtaccttctctaatgtgtggtataagagcaagtataatagcagactataagccagctataaacacatatcgaggagactaaagaagagaaaaatgagcagcgagctatagatttgtagccagctgcagcatgaactccaatacgtaatgtgtgtatgataggtgggaccagatattagtaatgtagtatatatttataggtaactattgtatgaattgactattaaatcgactatagattatttggagctagtagttagttatactattaaatttgctctaactccgtatgcaagttttccagagctggatattctaactccataaacctatggatttagatatgtaactatctatgttaatgatatttgaatgaatcttttttaaatcattttaaattttaaatcactctaatttagcacacaaactcaatccagcatgtatatatgagatctagagtaagacttagcagggcttacttataagtctacttatttacaacccaatgtggacatcatctacagtactggcaaagtggcaagaggcaacattaatttgtttggattaatttccgcgtgttgtcttcttaaggaaaaagattatgcaaataatcgaaatcaaccgtaccttttataaccttactgcttcatcatactccttctcaacaggatacctatatgtctagttgtctactttggactaaagcatatgttactcttgtgctagagtacctgacaataaaggtcgatactaggagggaggccatactatggacgcactataacgaaacctattacatcatggtcgatcggtgataaagaacctcctttcctaaaacgaatccatctcgatctagagatgaatctagacacacatgcatgagtcttttaggatagcgggatcggagtaaataggaaagacggcgggaaaatgtcagcatgcagcttgaacggactatcattgttgaaattagagagggcacctaaggtggctacacaaagatgacaatattagcccttcctgtaacgatttcctccttttttaaaaaaaaaaaaccttctcgaagaaattgatgcatattaggctactttgaaaaaaaaaatctcctcatatacatatataaaatctcgcatatatagaccccttccaccacttggcgtttagttgtgtgttttcttttaaaagaatgcctaatattttaaagaaatataatatgaaaaatagaaaagttctaagtgcgtaagaaacccaaacttattagacaataggttgaaactcaaaagaacaatatatgtttattcctcttatattaacacaggttaccattttgaagagtctatgatactctaccatgaaacacttttgaaatttttcataactattttatatattcaaaagatggaagcacatatattccatcgtgtttcaaatttttatacgcgtgaacactgaaaacgaaataacaaaatcaaaaacagataattgtaattaattgtccatgatgaatcgtcatctgtgtgtgctgtatgcacccgttcatcaaaagtgaatttatgtgcgttgcaacaaaaaggatatgatcaatatcgtcccagctgcactgccagcaaaacgaaatggtttttgcaaacgtgtgatttgtcatgttgggcttgacgtgtccaaaatagtagaagtacgcagaaagcgccagcgtcacttgagtttctgtactcaacactcaacaggtttttgctagccgacatgagatgatggggcaccgtttaataggtttttcccgatgagaaggctatgaatctaaaggacgaaccactgtatgtgttgtctcttgtgtgcatgtatcaatttaggttaattttattatctttaaaagataccccaagttactacatttgtaataaggtggaaaacttggagataaaatttagttatctcgagatatattttgtcaagcattgcaattttttttatgatttactacataactacttatatccttttaacacgtatgttaatgtttctttctaatgctcataatatagtatcataggattatataagacatcacctgatacaatgtatctggataaagggcatattcagataaattgtactgggtgatgtcatatccaatcttaagttattactccctccatcaacttttgatagtcatatttcatcttgacacacagaccaacgataagtgattctacctatcatccatttaaatatgctactagtcatttctcgtaaacaagtgattcattaatatttatatttctcgatgcccatgtaaccaatcttatgtagaagaatggagagtcgcgcattaaatccaagaaagctattaagatgataagttgttggattgaaatatgcctatcaaaaataatttttttagatttggaaatatgactatcaaaagtagatgaagggagtatattataggacgaagggagtactacttttgcacctaaagattaataggctgtgttcgttggtgggtgttgggaacccatctcccacgcacggataattagtggtcaattagagcatgattaattaagtattactagttatttttttcaaaaatgaaacaatatgattttttaagtaactttcgtatataaaactttttataaagtacacactatttaacagtttgggaagcgtgcgtgtgaaaaacgagacggagagagttgggaaccaactgcaacgaacgcagcctaaatggctctccgtcatccccattacccttcaccaaacctatctcacagtcaccactgttacacgtcagttacccaaagatttttcatcctaatgttcggtttgtgaaacatattatgccatggcatattgcaccttttagcaatcattttcatcaataaatatatttattgactttttggtcagcctttcgaaaaatgagaccatctttatcacctttgtttaagcaatgcagccgcaaaattcaactaatgaaaaataagattttaaggaattgataattctatatagattttatagaaaagttagcaataattcaaatcttatgaaaaaattctttaatttgagtctatctctcatccaattcatgtatttttttttctacgatctcaaattattatttctgtatttttcctataacttacatttctctattttgcacttgctttttaatcacgtgtaaaaaagcccttggttgttcgttcaacgtatatacagttatacacacatgtatgtactctaaataaataaggcataccatgttcgtcctattaaagctatgcttggctctactttcagatcataatcaaaagtttgtttttttcaagaataattttattttacttgtgttcttagccatcataaaaagaaagcaattagccatgcatgcagtaaaggaaaacccctaaaatcaaatcaggcaaattaacaattcaactttagcttcatatatattaattataatccaaagtagagacgagattcgtcggcaactcggcgtcggcgcgtgtgggacagtgggacgttgcaatcgcaaggccgctctcccggtagactggtgtgcgtcatggagtcaattggtgaatgctctagttaatttactcctgattacagcagtccacgtcctaattaatctctacatgctacatccatcacccctaggctgagtttggatgttgataagctctcattttctgtaaacacgcttttaattggtgtttttttttttacaaatattttttatatattttttaacatctaattattttttaaaaaaattataattaatactaaattaatcatacacacataacttgtctttttttttcgtgacaccaaaaatctaacacaaattttactttcaaattcagccttactgattgctcacttttaaactcagccttgctcattgctgttcttaatagccttcccttttaatgttgttcgacctaccatctatatgccaaaaaaaaagggaagaaagcagttgtgtcaatccggtgaatatgtaaattgaaatgaaaaccatccattctcacatgaaatgaacaaaaaaatatgtaaaaaaaatccatccaaacctatgaaaatctgacgttgagaacgggacaagaaactacctatatgtaccgagatgatgggagctaaccaaaaaggccattgagatcacgaagcagccctgcatttgttacagttggtgggacttagcagggaatagaggacactgacgtagcaattcagttaccgtggactcccttccatcccaaaaaaatatcttagtacaattaatctgttaattttagtataatcaatctggtaagggttatatcctcttttaggttaagcttttttaaacaggacgagtcacatttatttctaggttaagttttttttaagagcaggaggggtcgtagcaacaaaggcccccaaaacagcgcgttgttatccacgtccacgagaaagcataggacaaagggtatttaagactgttgctatttgtgatacggagcggattgcgagtggatattgttctgtatccagagctagacttttcagagaaacgctgcttaccaaactaaacctttgtcacggctatacgtgtggcgaaagccggaatttggcccccatgacctcccttttccattcggtttggaatgatacaaccaacaaaaggaaaagttgcaaggcgggcactcatagctcacgttacaattccagcaaccccacagaattttggagtgcaaattacaacaatggaatttcttaagccccttttgatttagattattaagtggattgttgtcgtggattatctacctgattaaagggataaactatattttctaaaataaagttaacagatagtttaaaataagtggtccaaacagtgcagcagaaaaaaaggatttcgagaaaacgtatttttcgaagcgtgagttcaataatcccgtggatgagctaaaaagaacagagatcatacggcttaggttagtttgggtattgacagtggaggtcttagagtaccacgggctgcggccagctcctttggaacgcatgattcttaaaacaggaattacaagaaaaaatgtagaattaaagtgcccttacacctcaaatcccatggattgaaaaaaaaaagacataaaaactatatgaatgacgtgagaaaaatgctagaaccagaaaagagatattcacaaagggtttttattccaagaggttgaagcttatgttattcctccaaaatttctatgttttgaggttttgagccaatcgaaaggaattgcccaggatttttgcatagctattccatttatacaaatgaccatataggaaaatttttcaaaggattggattcctcccaaaatcctttgttccaaagcagggttttcaatttcgaaattggattttatgccaggggtgaccgtaatttcgggaatttctggctgaaattatttgaaaatttgactgaatttgaataaaatttgaccaaattcgtaaaaaattacaaaaaaacaaacatttcgggcgagatttgaacatgccggtaggggcgaaattattgaaatttcagaaatttcgaaccgggatttcaaaccctgttccaaagtggttttaaaatgtctgctcctaagggcatcaccaatgtatatgacaaagtgatccatatagatgggacccacataaatagtttttccctatagcaatctcaacagtgtatatagatacaaggtatcaataggagaagagagatgagtagagatagataatataatttattccatatgggtagtccatatgcatatgggtatcttttgttattttttctatatggactagttacacaatggttatagatggcttaatggaatattctattgcttatggactacttttacaccacattgtggatgccctaacatcttcaatttcaatcctcattaaatttcacgctatatgctataaaatctagaaactagcataaaatcactcctctatctccctccccttccactctctgtcgatcccctatcctttgacccctcactctttggcactgccttttccctctcccctctcccatctcccctatcctttgacccctcactctttggcactgccttttccctctcccctctcccatctccaatgacaggtagacctctcccttctcccctgcctactcacccttcttggtgacgcaaacggagacgaggcgagccaacaagctctcggcagcacagaatgaagtggggtgcaccgatgagctcccagtggagtggattaggcgatgaggatgaactcggcagtggcaaatcgaacgaagagctgagcgactgtgagactggacgaagaagtcgacgttagcatctcctcgcaaacttcataggcaaagtcgatatgtcactcgtagttattgcctctccattgtccacctccctccaaattaggcacagcatggggctccgtgcttttcctggtgaggccaccgtaacttgcggaaagcacaagcacacccacaagaccactcactccaccccctttctcctccacggtggtttgtctccgacatggtcaactagagccgctggctagctcaccgtgttgtgaatagccttagggcactcacaatgcaggacatgggtatgagggaccttagagagccacataagtcacaaatctatttatctcatggtgcaaagtggttctaggagtggatttaatttatcatgttagtggctaacttcttcacttctatcctgacattttctaaaggaaattacaaagcagtccaatattttacacggaacactctaaaaattaaaaaaaatcatctccctacattttccccacacccacctgtcacttttcactccactcgcatttttgtctctcccttgctcaccggcgtcgccgcctttaccctcaccttggcaatgcctcaaaccaggcaagcatcgagcagatcaacgcagcgatgagcagaagcatcgaggaggccaaggcaccgtagcaaggaagctactgctgtagacgggtcgaggcggccatcatcgagctggtgttgcggacgggttggggtggcttggagtgggggacgataacaagctcgacaacgcagaacagggaacaacaataaggtcctaggcaccaaatctgccaccgccatcttccttttttcttacctgcatctctccccaagctgtcatcattgtcctgtcgagctcgctagatctagcatcaggctcgtttgctagcaccactgctttagggatgacgaagcaactcagggtagtgccctcgccaacgacaaccatgcaaggagcagcaggacgactgcgccacatcacacgggtctaggggcatcgcatgtgataacaatccggcccaggtggggttgcccgaggcccaataacttaaggttgcccggaccccaacagttcataggcacacccactcggggaaaggcccaatctccctaaaagactagtctgataggggaaagggtggctctcccttttaaggtggcttcctcctcccaagctaagcaaagcaaggtgggattattcagaggctcacatggtcgtcgcccgacttttgcgtctttgcctgcggttaataatggaggatgtcctcatcattcccacccccttaacaagggcccagctctgataccaaaggataacaatccggcccaggtggggtttgccgaggcccaataacttaaggttgcccggaccccaacagttcataggcacacccactcggggaaaggtccaatctccctaaaagactagtccgataggggaaagggtggctctcccttttaaggtggcttcctcctcccaagctaaacaaagcaaggtgggattattcagaggctcacacggtcgccgcccgatttttgcgtctttgccagcgggtaatagtggaggatgtcctcatcagcatagggcaacgccctcttctaatgcaacgtgcgagccatgccctgtcttgttgcgacaaacctaacgaggaacgtgcctcaagggatccgtggatcttcatttggtaacggagaggcagactagaatctccgacgtgagaaatcggggcaaacgccacctaggcatactgcgaaagcccttagagcagctccattgtgtgtttgactactgcagtaccaagatagcgaacacactttgattcgatgacttcagcgtgcgcaccgatttatgggacccgcataaaaaaagtttggaggaaattttaaattatgtgactgaggttggatgggttcaaccccatctgcaacaaatactattttaattatctaagagcgacttatattttgagctcgatttagttcactgacacacaacaatcgactcccgatagttcaatttctccacacaccatagggttgtttagcacagctccagctctagcttcacctctcatagaattaaaattcagccaaacagttttagttccacctaaataacagcggagctgggtgaaacgctctcataaaataaactagttagagtttactcccaaacaagccctataggctatagctgctcttatgaaatccggttctgatcgtttttgtttgtccttttcatgtgcgaggttttaggcagcagctgcagctcagctctacaaccggagctcctgcaatgcaggcactccacgcaaccgcaaccttgaacagttcactagtactagtactggctctgttcgggagggcactctattattgtattctattattgcataattaattaagtatttactatttattttaaaaaatagattaatataattttctaaaataacttttgtatataaactttttgtaaaaacataccgtttagcaatttcaaaaactttcgcgtgaaaaacaagagagaggatggtgggaactgctactgcagaacgcagccagagcggagcagagaaaaggaagcgcgatcgacgccacacgccaacacgtgcatcctatcctaccagtccactcaggcaaatcaaaggcaaccccccatcactccgcatttataaccccacccgatgcaaatgcggtggcgcctctaaccgcgttcttttctccaaaccggctaccttcacccgtgtggagtccaagcgtccaaaactccaaacccccgcgagctgggacacctcacttgccacaccgaacttcgctttccaagcccttcaacgcggcgcccacacggccatcctccggcatccctgaccctgtgccgcgcgccacggctcagacgacgacgacggcgacggcgcccgccctgacgcggccgacagccgacgaggtggtcgacggcgatggccaggccagaccaggctgagccgaatgccgcgttgatggtagctgcggcacggcgcggcaataggatgcgtttgggttcttctctcagttttcccaactcacatctctcatttttcacgcgcacgctttttaaaatgttaaacggtatactttttaaaaaaatttctatacgaaatttattttttaaaaaatcatattaatccattttttaaaaaatattaattaatactttattaattcatgtaataataccgccgtgtctagttccaaaataattcttcaaacttccaactttttcatcacatcaaaactttcctacttccaacttttccatcacatcgttctaatttcaaccaaacttccaattttagtgtgaactaaacacagccgggtgctgttttgcgtgccggggaaggtccaattattgagcggatctgcacgtacagcgccctgtactgtactttaccaacttgttcaggttgtagcagcaggagatagcgcgttttcagccttcaaaagcatggatgatttgattccccaggggataataacagaaacaagaatgcatcgatcggcatatcgctatggtcaaaaaagtagagttttgtttacctgtggagaccaattgtcatggatgtgtgggcttgtacttcctttccatggatgagaggggatcagggaattagaacagagattcgggcaaccgctgcaatcatgtgcgatgaataaatgccaccagatcaaaagggttaggcatcgattcgatcataccggaaccaccataagctgaggagcatgatggtgagctgcaattattgatcagggcaatatgctttgcacacactctctgtatatatggaattgtggttggtttgccaagcttggaaatgtggcacccagacaggaattgatgctgctgcttctgttactacaagctctagtacagtatgagtataggatgttgttgaatttgaccctgccgtagttgtcgtaactgcacattcatctacctgacgagaatgattccttcagaaagctgtagagttcctccgcgactggtgatgggaattcctcctgcggcagaagggcacctggaacctccacgaattttgtcacgcctttggcgcctctgagagcttccatctcagccttcgacctcttcggggcattcacggtcgatgcaaccagaactggagcgtcaccgtccaacttggcaaacagctgaaggaattcttcccttgtttggacagggtcaagaaggcctgtcaagaatgcagccgggacaaaccgtgcacctttccttttggttaactcgtagcgactttccacgatatttggagtcacgttctcagggttggcataaacgtgagacttgtactgggactggatggacttctcgttgctcaccagaacattgtacatcatccagccaatagccggggccctgagggtccctcgtagaagcccatacctgttgataatggttagggaaacaattttcagcatgatcaattttgtatctaaagaaacaaaaggctgagatgtctgtaaaaaggctcaacgggaacatgttatcacataattatctacatcagtcagttttcaaaaatgtaaaaatatatatatacaccattaattgttattttgttacatgtactttactacatctcactgattagttacacaaatatatcattagttaaatgaattgtactaataaacgtaaaaggaatgaaaacgactaatggaaaatcaaatcagtagctttcttaaccaatttggaaaataaagtgccagcagaaacatggcactggcactttctgtatgcaacgacagtataacacacagatatgtatttatcaacatggaaaacgaaatgcctgcataaacatgctagttgctactggcacttcatctatgcaataccataaacatattcaaaccataaatggcatccaagactatattactagtggcttgactgcataaacacaaccatattttctcagttgcaatgcatcataacctcactgcaatacttacttacccatcacccatctaccaaatgtgcctcttgatttaatgagataggtcagtaagtatacacaattcaacggatgacaacatgaaagatggctctattgcaagagcccaaggattactatatagaatacaagacaaaaaatctagaaattactcatctatacacatgagactgcactattacccatttacccttgacagattacaattaccattcacaattcacacatatcacaaaatatatttacatcttatatttgtatttatgaagggataggtaatacatactacaggattacaacctgcaggacgagatcttaaatagtgtgtgtggtatcaacaaggagcatcgaaaatgcaaactgttgctgaaaatgtagtggtgaagataatatttcatattagcatcaagtgttcgggcctcatcatttgccccatggcttataagctgctgctgaaatttaaatttctaaacttgatttcgaaattgattttgatgttttttcaacatagtttctttttcagcattggcttttaagtcgctaaggacacatataaaaaagttttacccataaattaatttttggttgttaataagctgttacagtttataataagctgtaagcaactgatgaggaccttccttttttatagtagtactgatgttgtctttgaaattatcttaccaaaaaaaccactccgcataatgctgagcataaatcaaagagcaaaggtgataggaggacctttcctagcattctctgacaaatatttgtaatatcaaagctatacacttagtctataccttgtctccatatcagaacctcggccaaatacaatgggaaggggtccagcccaagtaggtgcaactgcagcaatgccagatggccttataaggcccttcccagccgcacggactgcaattgttgctgcatgacctcctccaactactaccacttcaccatctgatcatgataaagaattacaatggcaccatcagttgagtaatgatattcaagaaaatgtgttgttacagaagtattaactggaatatttttgtaaaatatgttttctgcactgttttagttgcattgggtaatagtactgctaaccttggctatgagtaatcctgatttctagttgaatcattgactattacagtaacaatatgcagataaagtagtcatctataatataagaaccagaagaaagaaatgtattgttcattacagaatatgcccaagtgaagtagagtgtattgaatcaggtaaaaaatacagtggaaatgcttacagtatcagactatcagtgcgctttaagatgaaaatgttgtatacctgtatttgccacaggactatttggtgaattaattaactgaaccagaaaattctccatcacatcagcattgtagttcagtgatggcctgtctgaataacccagaccaggccaatcaacaattgtagcacggtaacctaattctccttttcgtgccacaatatctttggctaccaccctccattcctccactgtgctaacatcagaaattgtaggaatcataagaatgttcttcacgttctcagcagtctcatgctcatgttcctcatagtaaatgtttattggcttatcctcaaatgtccactgccatttcccagtctagaaacacatgtatgtaatgttatagcttagtgtcacagtcaaacaacaaagaaaagcagaacaaaattttccatacaactacatccaaaacatttcattcaaaatctagtgtttcagtacttgccactgtggtgactgaaatccattctgaacattaacaattgagacaaggacaattgatcatttgccactctaaagagtgctgtttcattaaaaaaaatgccattataaacaatgtaaatcttttttcttttgctgctctaacaatggaattattcatatttgcccctatgggcaatttaacccctctccccctctgtaataattggttgtagctctcttgagtaaaggccgggatgttatattccattatctaaaaaaaaaaccctctccccctctcatccttcttcctagtcttgccatgcccactggtgaggcgctctaccacaggcaaacaaaaatatagaaaaaggcataccactagaacttctgatctcttgccatatctattcttctatgctcccaaaagaacacaaaaataatatatccacccattatttgaccgaacccccacaagcattcttgtatgatctggcagttgagagtcacctttcttgaaattgtgaatttctcacccttcaacaatcaaaaccattcatgactagcttccttccaatggcattcatatcattggttttagggttaaaaaaatggcatcaattataaacaggagtaacatggacccaacagagcaggaggcatcatgtttataaggtagggcccaagataaaagcatgcaaatgacaggaagaaaataaaacctgcatatctcaaaaatgtaaggctgggtcccatttttgtaaatctaccaggtgatggatcattaacctatcttcttttaggaaaaaattttcaaaagatatcccaggaaggaaatgaagagaacagggtgataaattccccttgcctctgtccctccatatggttgaatcgcattcctcgttttaaccataggagcaatttgccaacaattccctctcatggagaactggagatcatgcacactatgcaatcagccaagcgcatgcatgtgtgtcaacagctaagtaataaaattccaattttccctgaaattgtctactccataatcacttcagtagaggccaagtaggattgatctaatgatgggaagatatagcactgattatgaaaagaaactaacgagacaaaactagatattccaaactgttaacctagcactctgaaactaaacggacaattactagactaacacaagaacacgtacgtaaaaactagatcttataatttaacaaaagaacagctcgtcgtaattgggagttcaaggattcgctagatgtattctgtaacagaaatgcatgttaacaaaactgcgttgtttcaggtcaaaataagcagcagtttgcgccaaaagttaagcaactagatcccaaatgttctattctgttcacgatcagagcaaagttttgcaaacatcaatgggattttattcgaacctgcataactacgcatttcagaacacatttagcattaccaattctgcttgttcatactttagactcacaagtcgacacgggaactttactaattactactacccaccaatttgagatctacaaaaccgcacagaagcagttagtgccgtgtggattgcatggcttcaacgcattcactgaccacccaaattggcgatccgtccggtgagctcgatccaccaccaggcgcaccaatgtaacaaatagtacatgactaccggccgcggccaactcggcgagcaagtgagtaccaggcgatctcatctcaccttgaaggggggagccgcgggcttggggaccgttggaggggaggcgacggagcgcacagcgaagcgcctcgagcggcgaagtcgacggcgggcggcgagcggggccgcgcgactgggaaccgcgacgaccggtaagacaaagccggcggtgccgcccccgtcggtgggacgcatggttggtaaggaaggagtgggaggtttggtggaagcaacggtggagttggagtggatagaaaccgaacgacgtgtgctgccgtcgactcgggactccaacgttcgctgccgtcgttttgtcgcgtccatttcctctcctctggtgcaggtttcacctcgttttttcgtctctttcgaattttttttctcaaaccactatggttccttttttttctcttgattaagatacatgttttatctggtgttaacacgtttttccaaaccattaaattgtatattttatacgaaaactttatattgtatataaaaattactttaataattaaaacttaattgattatgatctaatgattttcttattttatatgtcagtactcaatctcatctaaacgcaaatggctgataggccacgtatatgtacttgtatccgtatcactatagtacgtatccatatctgatacggatacgtggcctatcagtcatatccgggtacttaagaaaaacacaactctatagcaataataaatttagatcagctactagctcaatatatatatatgtgtaggagaagtaataatggtgtagtggtggagtagtgggtggatgatccattcaccaaggtttaaattttaatgttcacgaatattacgtacatataggtggattttcaatagtattgtagtaagattagggatgtgcctgatttttggctttcaacagaattttaggaagagtaaagatatgatgctagtttttagcttttcacagattttagcaaaattaaagatatgctggtttttatctttttagaacgtgtgaaagagagtgtatatgtgggagtgtacgtgtgatattatctgtgtagtagtgtgtgcgcgtgtacactactagtacgtaataaaaaaaagataatactattgtacgaaacagaatggtctgcgaccaaaaccagtttttcgtgggagccatacgaaaacgtggacgctccaaagtccaaaaggatcaccaatcgacgaaaatgaagtccgtatggtgaagtgaacacgcagccaaccaaactactgttgggcctctattccgtaaagcagaagctctctgctccgtgccacttgatgggctacaacttctgtagacgacgaacggatgcctcacagcaactcaaacccggcctcggatacatcacactcctcgaccggaaaggctaatgggcgggtgatccctcccccacccgcccagcgatcacccgtccaccctctcccctatactattagatgcctccctcttctctccctttctccattccttctcctctttctactacagtagaccacacaaatttttttgaaaaacaaaagttagaaaaatttatatatagaaatactatatataaaaagtttgaattcaaattcaaatttgaatcgggtatgtaaacttttgacttataaactttgggtctataaactttagatgtataaactttagatgtatagaaatactatatatagaaaatatttgaattcaaattcaaatttgaaccagatataatttaaattcaaatttgaatcgggtatataaactttaggtctataaactttagatgtatagaaatactatatatgaaaaatatttcaattcaaattcaaatttaaaacgggtatataaacttttgacttataaactttaggtctataaactttagatgtataaactttagatgtacagaaatactatatataaaaaaaatatttgaattcaaattcaaatttgaaacggatatataaacttttgacttataaacttttggtctctaaactttaggtgtataaatttactaaaataggaaagtaatgcggtgccaaaaaaggaaaccaggtggagggatgaaggggggaggtggggagcgaatctgatcgctacccccatccccacggtgatcgatcgcccattaggcgtacccctcctcgacggccctttcatttttaattttttttcttttaatatttacagaaataatctattggcgtaaaaaattacaaaaatagactctgccgctctagtggagggcggcaagctgacgtggcagacggcggctcgacggcgccgtctgcaaaaattgcatttagccccttgccgccctcggcaaggggctaaatgcaactttcgcagccctaaagagcatttggctagtactttttgcatctgagccccttgccgcccaaggggcctagatgcaaaaagtaccagccaaaaagtactaggcccgggctggcttttttgcatgggggtagagggcggcaagggttttcgtgcaaaaaaaaccctccctctcccgtctgccgtcaccgcccgtccctcctccgtttgccacgtcagcttgccaccttagtggagggcggcagggtctatttttgtaattttttgcgccgatgggttatttctgtaaatattaaaagaaaaaaaattaaaaatgaaaaaaattcggcaagtgcatgccgcccgagagacaggcctaatgcccaaacccacggttacccacctaccgcgacagcacgattcactctcgcgccacgtaaacgccacgcaaagaaataagttcacttttggtcccttaattttgtcgcccagtgtaagtttcatcctcagtccggaaaacccggatacgatggaacctccaacttacaaaacgagtgcaaacgagccatgtaggatgaagatatgtgggacgaagaccagtaaaagaagccacgtcaactaaaatcggggatctcgtttgtctggtctagtaagtttggggatgcgttgtattcgtttttacggttaagagacgaatctcagattcaacaatttgatgcatccagtgtgaacttattgcccacgcaaatcacaccgagcgggccgcagaaaccggagagaacacgcgcaccgcatgcgcgcgcgccggttgcgcgtcgcccccgacgccgagtcgccgacggccgcgagcacacctgcctcgtctcgtctcgctctcgctctcgcgggcgacgcgaccaagcgcacaaaccaaaagcaggcgagcataacaaaaggaaacggacgacctcacgcacaccgtacgagtcgtcgtcgtccgccgtttcgatcgatcgatcggctctcgggccagccgcattttccagattcgcgctagccggaaagaaaataaaacattatcatcgtcgtcgtctacgtcgtaacctcttcttttctccaataaaaattagaatattcgtgacacgcttttcaaactgataaacagtgtgtttcgtgtgaaaactttctatataaaagttattctaaaatatcagattaatttgtttttttaagtttgtaataattaaaactcaattaatcatatgttattattactccgttttacgtgaaacacttaatctttaatctttaccttgactacttttttcgccggcccatcgacgtcgtaatcgtcgtcggcgactcgatcgatcgggccgtggagttcacgtcatgggaagaacggccggacggaccggcctgagctttactcatcttttttgcctttttggcctcggctggcctccccgtccttttcatccgcttagctaagctagcgagcgccagcatgtgtgtgatgtgttcacaaaactttgtatattgttactttatggatagattggatcatcgatcgattaattggcgagtgtacttgcatcatcggaccttgattagcatctacgaaaacggtgagattgtgcttataagatatacatatataatactccaattaagtaatctttcatgtcgctctccgggaagacgagtgctccagagtctagaccgacacacacggcaggcacaggcaggtccttccccgttagctacacgcgccggggctcatcgtcaaggagatactatgtatgttaggtatgtcgtatgtgcaactcttccataggtatgggttcaccttttcgattgagtgctggattcctacccacctataggttcccctttttgattgagtgttggattccgacctccaatgatattatatttttttcctcaattttggattaaattttgattgaattttactatcttaaatttgaatttttaagaacctcgacagtgtcttgacctccatactggctctactgcgtgcagtccgatttgtaagaagaccaccttctggatagatgcgggggcgcaacagctcgggatcttgctggccaccctcgttacttcatgatttagcctcttctgcccaatctcctcggctggagcttgtttgctaatctgtgtgaaatcaatgtgtgttttgattatttagtttgtgatgaacaattaattttacaaataatttattcgataaattggtttgagaaaatgtgtgaatattggtgtgtgggtagactaaaatcattgtaaattctaagttttgaggttctggctgctagtaggtagacttatgcaacttgtttgaatttcgtctaatatattgatgcgcaagtctcttgcgtgtttcaaaagtaaatctcgtaaaccattcaaaattgtactcagaacctactttttgtcttgcgtcgaaacatcgaaattttgtcgaaaacgtgaactctgtttaccatgagttgttggataaaaaacaatcatgctcgtacgacagtgttgaactttttttatttttttcagttttgccgagtttttcatcattcatctttgttctttcatctccattgttaatttacccttcagcttattagccgcgtctaaaatttaaattttaaaacttaatcaaatggttgattatgagtttcttcatcataatttttttagcatttacttttaaattttaaaaacacacatataatatgttttattaaaaaaatacttttatgtcgttaacctgttacgtatacggggagcctaataggcgatcgtccagtgataagatctgccctgcctcctctcctccctcttctcccccttcctcctccccttcttctcttcctactacaatacatcacacatttttttaaaaaaacaaaaggttagaaaaatttatgtatagaaatactatatataaaaatttgaattcaaatttaaatttgaatcggctatgtaaacttttggcttataaactttgggtctataaactttagatgtaaagaaatactatatatagaaaatatttgaattcaaaatcaaatttgaatcagatataattcaaattcaaatttgaatctggtatgtaaacttttgccttataaactttaggtctataaactttaggtgtataaactttagatgcataaaaatactatatatagaaaatatttgaattcaaattcaaatttgaatcggatatataaacttttgacttataaactttgggtctctaaactttagatgtgtaaacttgagatgtataaattttaggtgcataaatttactaaaatagaaaagtaatgcggtgccagaaaaggaaactaggtggagggagggaggggatctgatcgctactcgatgggtcgggcgatcgatcgcccattagaagtttcgtacgtatacggccataataatctgtataagcgaaacgatgattgtgttcagatgttagctctgccatctagcatcttctccaggaacacgctctttccgtgtctcgacaaccacagctgcggtgcttccgtgtgttcctttgcagaacttttttgatgcttgaaaaccctgatctcaccacccaaatctgatactgtattgtcgacctgatcgagccaacaacaactgggtccaacagaaaatctaggccaattcctcctctctctctctctctctctctctctctctgttgctctcgagctgatcgtagttgggttttaggtaggtgaggatgtacgcgccaccatattccacaacataatcaacatgaggcacaaatggcaccaaaaaagaattcctggaggttgtagttgtactagccgtgcatgcaccatcaaaaaaaatactttaatctaaattgatatgatatgcaaatcaccatgaaagaatcttggcctgattttaagtgggatgcaatttgcaaacattctttttttttctgggaccagcatgaatggacgtctctgaatcgatcagttgctataaccataatctgagtatgaatgtgcatgatgatcatgtacgaaatgattagtggctctcccggaatcttctgcaggtattgaatactgatcactctttttttagaaggatggttagtaggtagaggtactgtattaagtacgttgatgtaaaggtggaggcttcaatttaattgtgagattttgcggaagaacaattaggatacggctcttcagtcttgaatgctaaatagtcgttgaagttgttgactccccctcaagtttaaattcagagtatatacaaagatgagaaaagattgttgagttgaacctaatgtatgaactgttgaaaattgcgaagaaccgtgaacgtttctgctggttttacttggacagaaactgggaaatttcagcggtctgaaactaacaaaaccttctgagcatcatgtcgcttaatagatgtcgcatctgaaactgttactgattttttatttttttttctttgtagaacatcttgtcgctttgactttttacttactattcgttttatttaaaaattagtataaatataaaaaataaatcatacttgaattacttttgataataaagcaagtcataaataaaataaataataattttaaatttttttaatgagacgaatgataaaaatataaacaaaaactcaaagcgacaactaatatgagatgaaagtagtagtattttttttccagaaagaagaacatctcatgtagtttattgttggagtggactattgaaggcaaactaattaagttcgttgcttctcttattttatttttgttgattgatgtatatattatttcttcttctcctctaactgttgcaacgaataatttctgtcgctctcaccggtctccctcaatcccatatggaaaatttgtcggtttttaactctatgacaggaacccgtctttctcccactgaaagcgatttttttactgttattgcgaatatttgaagcaaagacaatcaaccattgccaggcaggcatgcagattatcaaagctggacacaacaaattgagcctaattaacactatcaacttcctgtgcttattcctgcaaagaacgcagacaaggcccagtcctgatcaagaacagagctttctcaaaaaataatactaccaataatcaagatcagagcgagttgattaaaacagagtggaatgcacacaaaggcaactgattcgatcacccaaatggctccattcaagtggtgacccatcaaactgggtaaaagtgtttaatgaacctgccctcacgccacccaaaatcctctagagtttgtactccctctatactcgtaaaggaagtcgtttagggcaatgtttaagtcgaaccttaggaatataaatcataaataactctcaagttattgagtttgaaaaggtaaaaattatacgaatagatttatcttgaaaaatactttcataaaagtatacatatatcatttttaaataaatagttttatagaaacaagaaattaaagttatgttttgaagaccgtgtcgctgtcataaacgacttcctttgccagtacgttccaaaccaccaagaaccccgctttggtttcatggacaaaaaaaaaaagttgagattttgagggcgacttggaggccatctccactggttttttttcctcctctggtcgccatctgaatgcctctcgtctcgtcatggtttgggtttaacccaagcaacctcgacatgaaaggtgagattttcctttcgccggtgttggtgtcaaggacatcatttttcccaacaaggacaaatttgctgtggatttatttggtgcagatatattcgatatcgaactgtcatggctaatagttccttgaaggctcaactgtgatatggtacgaactcggttcatacaagtttctccttgacaaaacagatttgtgtgtaataatcaaaatgccatcaccatgagctgtttcgtggagcccatgcgaaaacgtgtactgcattcgcatttctatatgcattgtgcagatattctgcatttatccgtactcatatggagtgcttctcctctaagattaggcgagctgaattaatccatttattatttattacttggttttccgtactgctgccgaagaaggggaccaaataaacttgaacactaatcgattccttttcattttttatgtgttcccttgttctatttgaagaaatggaagaatggattaatggcacgcttcttaagcaccaaaattgttaaaaaaaaaatcaaaaagaaattccatataataatttcttaagaaactatttaaattccaatttttaaactttataataatcaatttatttgtttttctctcgaatagtaatcataaaatcattcagctattctaccatattggtaaaaaaagaaaaaaaaaacatagccacttagctaaattgtccgaataatttttttttacaacacggtacaaacgtgaacatccacgaaagcgtggacactcacagaacacatatatgcacaccatatccttatgagcatctttaaaagactgggtctatatatcttgtttgacgaagtcactgtaagcatcttgttgttgatgggtatatcacctactactgaaaaaaaataattagtcataattgcgaccattcgtgtgtgtatgacattgaacttgggtggacaggtttacccaatcagttgaattatgcttactttgcaatttgtttgaagaagtttatagcttctttaaaacacatgattaaaaagaaggtaagaataggaaaaacacaggatttggataggatgcaaatggcaaaatataggattacttaatacataaaaaacacatgaatgatcgtctgattagatcgaaaaaaaggaatcaaatgagagagatttaaaggaatttttttaactggttggagctatcactaacttttcttcaaaatttttatagtgttgttcattgcataggaatttcaaatagtttcatagaattcaattcttgtttcaaatgtctttgcagaaaatttttctttaggactaaaattctctaaattttctatgtaattgtttttttttcacaaacaaggggcttgacagaatggtaagagtatacaaatcctgggaaaatgcagagcgcggcgctgcgcacggtggccactgtgcccccgattcatttggactcatacgcaagctgcctcgccggcgacgcgacagggcgggccaccgtggtgctccgggccttaatctctggagctccgggcccactgtttaagagcaagtttaacagtatactccaatttttttttcactactcgtacgcacaagacggtgcgaagttctattgatagagcaggaaaaaattacaagattataaccccgaagggtcgtaaccaggaaaaagaaaaaaaataccaccacccacacaccgacatcaccaacacacaagcccagaagaaggctagcaccgaccgaccaccgctaagcgtgagcggccgccactagacctactagctccaattcatccttagccaatctaatagccaattcatacaatagttgcttactataatattaatatattgtctcatctgtcatacacacattgtgtattagagtccgtaatgcggctggctacgggtctgtagcccgctgctcttctctcttatctttttatctcattaaaatatgtttgcagctagctaatagtctgctattgtatatgctctaagcaattttaattagtgcacttttggtttggatatgagccgctcgtgatctgcaccacccggtagatgtcctgtttctgtttttctgctagattttgttggaatcatgtgaatgattttgctttttgctccccttctggtgtaaagcgcggttttgggttgccacgtctctttcgtgcgtggctgactggtgatcgatcttgaacggttcaggtgtgacgaactggactcgtgtggttagaaggttgtgcatgagcatcatctaaaatctgcccaaaagataatctcactcagtctcataaatggtatctgcatgtgtatatttataggaataattgtgcgtgcgcatgtgagcatatgcttgttttttttttaaaaaaaaacgatgcactcacgacacgacatgctatatcaatttttgtaaaaactaagataaaaaaaattgtaaaaactttataaggattttttatgtgtatcattttccctaacggccatttcccaactaaacgggcaaaattaatggagatctgaatcacgcaatttgtggcacgtattcctggttgccggcgactaatcgagtggagcagcgcgattacagtatcatcatcatcagctttgcgccttgtggctgcgcattgactcggatcgaactccggctttatgccaaattgccaaggccaccaccccttgcacaagtgtctccgcattaagccttttccatatccgcacggatgcatcataaaaaggagcgaatctcagatgcacacgcatttgatgccgtggttaattactacgaggcacaaagcacagtatagcatataatctctctcttagcgacaaggaataagggcatgtacaaagttagagtcaggtatgagctctatgctatatagagactagcattctataatagttggagacaatatggtctttaatcattaatgtatcaaaatattttttttcttactattgtttcctttctttcaccaccatgcaacaaaatatgctctaataaatgctaagagtcgactctaagccgttgttatgtataacaaccatatttctctttcctcctttctctttcttccatattatcaaatttacttgcatggcaatagaaagaccactaataaataccgttgcacatgcctaaaaggcagatcatatatatactcttaaaaaccttcattatggaaggctaccaaccaacgattgattacacgctgcaaaaaccgaaaggtgtatccttgcatcgtatcctactctcatctgagcagttcactccaccaacattggaaagatgagtgcaagctgcggtatatagaagggaaaaaatccagattattctataccatatagcgttaaggttttatttggtacaattctcgttctcagatcatgctgaaattagaatttgtaagttaaattatagtggtttaaaattttatattgttctatgaaacaaaaacaaagcaatacattcaaatattatcactgtaatcgcatatccaaattcgtggatttctagagttaaaaacgcctagctcatacaaatcttcgatatgaagctgctagccctaaattaatcgttgaggcatgcacctggcactttggcagccgagttggactccactaaaaattagagaagaaatcttcccaatggctgccgaacaagtaccacaatctttgtgatttagctttcccccgtgcacatttggtacacgagcaccatcaatcaatcgagccagccgagtcggtttctctttctcccccgtgccaagctaccaaagcggcttcacgcaagaaaggaataacctgatgtggtgtggctccgatcacggcgccggcgccgccccagtcaccggtggttgttaaacctgtttttttaagcactaccacacctactaaattttttttactaaatttatactaacaatcatctcaaccgtttaatttagatagataaaagttataaaaactctaaagacactcatagcatgccaatgtcagtattagtaagaactaagctctgtcttaaattataagtcttatattttttaacacggtcttcaataccatataacagatataaaattagtataacatgaaagtacttcaaaatatgatatagtgatataacatgcataagtaaacttagtatagacatagtttatatggttattagccaaaagttattaagtttgatattttttagaaatgggacgccctataatttagaaatgggacgccctataatttggaatgcagacttttctcctttttcctttttttttctttttttgccgagtcatcagccagccagcctccccctccgcgtgagacccccaacctcagcgacgcgaccggcggtctcacgcgaaagcggactcgccaccacccgatccgatcccccgcgcgcaccgcgagagccgctcgtgcgtggcgttcgtcggttggttgggttcctttctttttgttggttttttcgcggtgttttcactgcgtttttcgccccgtggcgcacgtctttgctgcaacggcgaagggcgtgtgttttgtttttgtttttgtttagttttgccgcgttcgtcagaggagaggtttaggtgcgaccaaccagacctgaggctgcggctgcgcgctacgatacacgacggacgcggtctttctttgaagccctgcccagaggggagtacagagactctagtagcagtcgctctcgtcgtcgtcgtctcttccgtttttctcccgtcctaccttcatccacacctcggatcggtggatcgaccgatcgatcgacgggtggtggcacgttgttttcttctccatccatccatccatccactcggtggctatggcgtagggaggaaaatcacgaaaaagaggatcactcggacggattcttttctctctctctctcttttcttcttcttgttctacttctttgatcttcttcttctctgctgctctgccgtccatggtggtatggtggtgatgtggtggcgtgcaaggtgaggtaaagggggtgtggtggtggtcggctcggctgtttatccatccatccatggatgccggtgagggtggcggcgcgcccgccgccgccgccgccgtgtcgaatgggtttgttcacgccgtcgtgcggtggtgcttctctccgctcttcttctggctgttcaccgtcgctctcgtcgccgccatccacctcgcctccacctacatctctccctccaggtatgaatcgatgataagcgatttcaccagaatcatcgatgataattttgcgggaattctgaatttcttgatgtttttgttttaaattttgtcagagacgaagaggacaaggagaagaaggcgcggcgcggcggcgatttcgccggagccggggaggagaggaaggaggagaaggtgggaaggaacgacgacaagattctggagatgatgcggagcttcagcttcatgcatgcgagcgaggaggatttcatggaggggatggctacgtacgaccacgtcgtcgccaggatggcgccggagccgctgccgctgacgccgccggccgcgccgccgccgtcgacgttcagcttcaggttccagcaccagttgcccgagattctccgggagacggccgtggtctcgggtgaaatacctgtgcaagtattggaagaacacgagccggagaagaagccggcgattgcgatggaatcgaagcaagaacgnnnnnnnnnnnnnnnnnnnnnnnnnnnnnnnnnnnnnnnnnnaagggacaatcaatccagc

SEQ ID NO: 83294 - DNA, 649 bp, Oryza sativa
aagctaattgacaccaaaatcaagtaaacattaaccaaatagatttattttattttgtgcttcactagaaaaattagccgacaaatctgagcccatgacaaaaaaaaatgtgtagcctttgtaaggctaaacagaaggagagcatagctcttgtactccgcatcattcatccctatgagctacccatgatccatttctacacaaaaaggaatgatcaattgctcattaaccctctaataatatggaaactcatatcaatcactcctccagcaacgcataatccagagaaatacgcactagggcgcatcactcgtagcaaaggcgacaataccatttcctaattcatgattacatctctagagacgaagaacaactcaaagaggatacgtgtcaaaaatcagaaccgcagggggggatcgaagtggggaaaggagagcggacgcaactgttggggacgtgggagatggagacgccggtggcgacgaggtcctcctgggacggccgggcgagctggacgacgtccccgaaggcggtgatggagagcgggccgcggatgccggcggcgcggagcgcggcggtgacgcgcggggcgacgcggccggggttgacgccgttggggaggttgcagttctcgaagtcccaccacacg

SEQ ID NO: 83295 - DNA, 10706 bp, Oryza sativa
aaggggggtaggtttgtcaccccatgaagtttcccccttcttctttcttaaaaatttgttgaataaatcgtccgaagaaaatggtttaatttacccaagagttgaatcctaaattaataaatgcaattaataattggaattggcatggtgggatttttcttgagatccacatgtcacaatatattaacaggatttttagtggaatttttagagtcttggaaataattttaatcaattaaaaatgagcaagtgcaatattttaaatcccaggaaaatccttttccttttttctcttttcttttcctttctttttctcttgatgggccgttggaccagtccacctcgcctcaccctgcgctcgggctcccctcgttgggccggcccgtttccccttccctctcccttcgggacgccgacaggtgggccccacctgtcggggtcgtccccttcctccaaccgccgccgccgaaaccgccgcgcccacctcctccgctcctcccacgcccactccgcgtccacatgcgcccgtgcccacgtcgtcgcccacgccccgctttcccgcccgcgcgcgcgctcgcaagggacgggattcgaatttgaatcccccctctctctctccccactcccccacgtcgcgggccaaatcgaccaccctcccgaccacgtccgcccgtcccgtgcctataaaattgctcctcgcgtccccctctctcgtttttcgctctcgccgcgctccccagtgcctcctaccgtcgccgcgccgcgcttgccaagctccgccgccgccgaagctctctggccgcgtgccgtcactgctacagtcgccgccacatcgcgtaaccgccgctgttagcttcgccgccgtgagagctacatcggccaccgctcacttgccgtacgccatcgttgtaccaccctccccacgcgccgccgccgctagagccatcccgcgcctccgctcgccggtgaggaatcccctctcctcctttgtttcctctctcccatgagcgccgccgccttcgcacgtgcgtcgtcgtcttcggccgcaccgccgctccggccgtccgccgccgcctccctccgccggtcgccgccgtcagcagccgcgcgcaccgccgccgctccccatggccggccggccggctttgtgccaagctgagctgtgcctagccgccaccaacgccgtccgatcggcctcgggccgatccggaccgtcggtcttgtggatcggcggtggaccacccgtgtggtcccggtccacggtagaccggcctccctttgtaccgctgacatgcgggccccacttgtcggcggccgcccccctccccttcgctgacgtcagccctgggcaatattgcgcaataaataattaaggactttttcgttattagtaaaaacacagattatcttgtaatattcatatataagtcatccgagctccgtttaagtccattcaagtctcagtaaattcataaaaatccctagaatccattaaaaatggttttgttctctgtttcagtagtcttatagcatgttttgcgtgtgtgctttgtttgtcgtgtagattttggccgttttgtcgatccgcggttcctcgaatacgttggtttggtctcaccagtgcgagagcaaggcaagtcatgctttacatttgatcatattgtacccgatttacgtatatcccgcatttctattaaatgttgcactcttttcaatgtcatgtgggatgggtattactactcagccatagattgtttaccatatgccattgataccttgggtatcaaaatgattagatgttgatttagaaaatggttagccatgcctagttcaactagtacacaagtggggattacattattacatagactttgattatcagcatagttttggattggtgccaccgcaatggtgttagttaattaaaatacaccgaatggtgggttgtgggtgcatggttttgctggtcgcactcatggcaattaaggaccgcttcacgggaaaccctgggagacttaccgtgcttaccacaagcgggagtgggtaactgcttgatctgaagtatagctcgaccctttcttaggcacgggtggcgagggtgggcgtgatggagttgggttggccggtttgtccggttgtccagctaccggattcactgcggcgcaagaggggaccgcccactgttttttgaggagtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcaccctagtttagcttaataaactggtgtagttcaggtggttggttgggcctgttgcaacgtggtgtagcgttggacagtgattggttaatattgattaattactacaattgttttactactttcaactactgcttttaaatgcctgccttatgcaaatgaacctttagcctcctttgcttatatcctgcatcatacctcctcttccagtatgacttgctgagtacagtgggtagtactcagtcttgctctctttttccccacaccagagttgaagttcttcccagttggagctgtctcagaaagtttggttttgtcgctgccgtgaaggattgcctgtggagtagagtcgccccgctgctgaagtcaagcttccaagtttagctcgcttttatcttttccgctgcatttgtaatcttttatatttttgtaagacgtggatctgtatgtcaacaattgtcgtttgtgtaccctggctggtcctggacaggggtttaatactcattcagcttagaaattgtcacgcccggaatttctatccaaaattccaaacgcttacatgtgtgtgaaccctcgtccaggaatcaaccgaggcacacaataacaaattgataatagagtacaattattactctaattaataagcgaataaaatgtcattacagaggtagatagttcctctcaaccaataaagatctaagcagcggaaaaataagataaacggcgcagacgactccactccataggcagcttgaccagggctacacctaatcctgcacaccatcagcatcactgtagaactcctcctctgatgaatgattgcaaggtgagtatatgacatactcagcaagccacgcagcaaatatgcaagtgcacaggataacaaaggatggcatagtatggtttcatttgcataaatagcatttaataaacatttcagaatttaataaaacagttaagtaataattgaacaatattaatccaacgctatacaacataccctgttgcataggcccaaccattctgaacaaccatcccggctgcacagttctatctccaaaccaggaatgtaccattccaaacaaggagctaatcaaattattaccagttatagcatcttttattatgatgagaagtgtgaaactaatcacgaaagacattgttagacccgcccataaccgcgggcacagctattcgaatagttttactctggccagaggtgtaccactgtacccacaagacacagccccacaacatgtcaccatgtgcctcaataccaccacggtacctcggaaaggagctgtgacagtacccctcgcacaacacaatccaccacagcgcaccgttcctggatcataatcacccccttataaacaaggcatggactccccagcgacccccgtgggcttatctccaccacttctcagtctggtgccccgcaatgaaccatgttatacaaaaggtaaagccgttgcccatgctagcttgtgattggcacggttaatgtttcacaaccgaaactcgtgaaccggttcttaattgtcatgagcacgaccatcaaaaccatatgctcacaacccaccattatcaagttttagttggcaaattaattaattaaccaatcacgatcaaccatcgtgagcttccattaagccatcattaaataatagtgagtcacaaattatcccaatagtgtgctaatgtttctaagcatggctaagcaatcatatttaatatctagttgaaccaatatataaagctcaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaactcttcaaaatcttctcctgcaaactcagactctccggaaacgtcggaatctaaacagaaaagagcaaaaacaccaaaacagcacataaacaagcatgaacagtacatgtggatatttttaacatgtagatctcaattttagaaaaatttagagacttgaaccaactaaatccgagctaagatgaattagttatgaattttcaaagattaaatcggattaaaacacttatatggattttaattgaattatgacgcaataatgaattatttttgaaaaggaaaagggaattattgcgtcagcggctagggttcgcggtggactgggtgcacggcggcggttcacgagattgggcggccgagatcgatccatccaaaacggacggccaagatccatcggtccaccgcggctcacggatggacgatgacgatgacgccagcgacgacgtcaccaccggcggcggctcgggcgcgcatgctcgccggcgaaccacggcgcgatgacgcgaacggaggacaccaacacgtagcgggcgacgcggcgaactcaccggtgaccaaagcgacggcggacgatgaccggacgacgtcggcgacgaggaaaaggcggcggcactcttcggcttgacgacggcgacggtgttccggcggtcgacagcgacggctgaggggcggacaaggacggcgacgtgacggcgaccacgatgacgacctccccgagcgacggcgacgactggagcgacggcggcgcacggctggagcggcggcgacgacggcggcgcgaggtctcacggggctagggcgctacaaacgacgagagacgaaggcaagggtggcgacgggtagcggcgggcttggaggtccttttataggggttggaaggcggcggcgaaggtccacggtggccggcgacgagaaggaaagattagggttcggggagagagatgaatccaattcgagatcgaatccacagatttccaaacgaaattagccgacgattccataagagaaaagatagaggggatcccggggatcatttcccctctattaatttcaccggaaacggaaaggggcggctggatttggaaggagacgacggcggcgcggcgctagggttcgggcggcggccggccggaggtagacgacaggcctgacaggcgggccccattgtcagcggcagcgagcgcgtgcgcgggcggctcggcttgacttgggccgacttgggccgaagaggagagagagagggaaggttttgggccgacgccaaaagagaacttttaaaaccttttccaatttaaattattcatgaaatgcaattccatttattaaaaatacttccttagctcaaataaatcccagaaaaatctaggaattatagaattaagcaaagtatttaatgaaattttatctggccctattttacattggaatttattaattaaaactagatcttctcttctaggcttttaaaataaattctaataattccaataataattccaatttagacaacaatttatatatttgggatttttagggtgtgacagaaattctggtttgtgaatttctgggcgtgacacacactgacagggtgggggtacacagtcgccgtcccatcggtcattcaaccggtcacagaccggtcagatgcgcagcacgccgtattaaatgcggcatggcgcggttgcatagaccgctttaaatgcagttaggtgggcgttaggcacgcccacctaaccctgtacattgggctaatacgtggagggggtcggagcagctcgaccccacgcgagggcggcctcctccctctagctgggatggggcagtcgccgcgccaccccgggctcgacccccctcggggggagccacgtgggtttgggggcggcccgaccccaagctgggagggggcagccgccgcaacaccctgggctcgacccccctcgaggagagccacgtgggtttgagggcggcctccaacctctagctgggagggggtagctgccgcgccaccccgggctcaaccccactcggggggagccacgtgagtttgggggcagcctcctccctctagacgtgatatccctgggcccatatcgccgacagtagcccccagtgttagccctgaccaaaaccttcccctagtggccagggttgacgccactctcctagtctaacaatgtgggcccggtctcttctccattctttgctagcattagggcccatgcgcctttttcgccccaacttgagggcgactcgccggcccgtaccttaggttgtgaacttattttctgtatatattcaacaaacattgttagattctctcgggcccatgacttcatgcggcgcacctcgcctgcccctgccttttgttaacctctgttcatgttctacttcatctattcaaacgatgttttcgcatgagtgtgaggactgaactttccatagccagcaatccccacccgcgatcaagccaagctgggtgccatagccagccggcggggccaaagccagctgctacgggagagccagcacagggggccccgggcgtcgacggcgtccagagctcgacgcagggctaggatagagctaggaatcgtagcccccacacttttagcaaagaatcatttgaatgggtgaagtgaatacatactttttgttaccaaggggggcaaacgacgtgcgacacgtgggtatcatgggaccatgaggaggagatgggtgagagataaatataagccataataactttgctgataagcatgaacaaagaagatacaaacttaaaggaagtattacaaatgttatgctcaataagagctcccggccaacgctgagctttcccagagaggtctactttggtccggatattgtaatacctcctttgttacctttgtttatccttgcttgcacatcgtgacctttcaaacctttggctcaaagaaggcttcccaccgtgagctctgtaccctttaggggcccacggccacttagcaaacgaggtcaggttcccacgagcctgcgcccccacgctacacattatgttcgctctttcctttcggtggccttgttctaatctcttttccttctacatggacgattactttcgcacgagtgtgagagccgaaaaactctagagccagcactccccgtccacagttgagctgggccgggcaccgtagccagccgacgggaccaaagccagccgctacggaagagccagcacaggggggtcccgggcttcgacggcacccgaggctcaacttaagtctaggataaggctagaaaacttagcccccacacttagcgaagaaccgttcatgtagatgggagagaggttgggctcttaccaccgagggaggaaacaaatgtgcaacacgcgagcgtcgcagagccatgagaatagaatggggggaaattaaatataaggtttcaagctgatgaattgaaaatttgaaaatgcttaaaacctgaaatgatgattaatgcttgaaagacggatgcctttatgcatggattgtggtggcgacagggtctcctgtttggcaaccagcctacaaaatctgagcgcagaacgccagcaactaagaaaggacctctccgaggggacttgtcaattacacagtcatgccggagcacggtgtaagcctaacttcccatcttagcgagcgtgcgacttgtggttggcgctaggtgaccctgtacaccatgcgcttttggcaggtttttaaacgcttgatacctgcctgcaagagtcctctcaggagtggaccgaggcgggcaacaggttcatgagccaatcccgtgcttggcccctgagggccatggggaagaagctcgccatgacctggtcatcaccccccgccgcctctatgatcgttgtgtagatctggagggactcggaggggttgacgcaaccgtcgtacttttcggtgaggccgggccgaaactttgggggccatcaaacattccgaagactcgccacaaaggcctggcagccagccttacccggtgaggatgtggggggcctagccccctgcctagggtggcgtgacactcttgaggaggttgttgtgagtgatatgccctagaggcaatcatagagatgattgtgtcacatactatgtttacatatttatccgacattgttccttgaaatagataactccttattggttaatgaatatgcgattctttcatgagactctttatgttgtttgttactatttctaaaggatccctgattaaatattatatgtggaacaaatatgtttatatgatcagcacatgtattaattgatgatcatgtctcatggatcatggtacagagataccaaattaataatgtggacacatgttgttggatagacccaacatgagacactgcaagagccatatgtgttgtgtcatcagtgatctcattgagtgttggtgttgaatccttagacctgagattatcatggttctcaacatgtgtagtagcttacttaaggactgctaaacgcttctccgtaattgggtagttataaaagtagttttcgggtatgctatgaaacatgtagtgggatatgaataatcaagatgggatttgcccctcctatggagagatatctctgggcccctcgatgttgtagattatggaagtgcatggccacgccaaaaggtgattgaggagtcaatcacaagttatataatctatcaacaggttcgagtaaatgattgagctattagaggatagcacatacttagccttgagcttaatcgatatcgtgaggcaaaaggttcatacaagtatacactagagcttcagccgatatgatctttatgtatgcccggtgggtcaatacgttctgctaggggccgctgttgacgcgtggaccgaaaaggagttttcgggttacagccgagtatatatgaacctacagggtcgcacgcttaatgggccagaataaggggattggatagaaatccaatatgagcttaattcggatagggatccgaataggagtcctacgtgccttggaggcccgagtgatggatcctatatattcgtgtggggtgtgaccggcggaggcattgcatcacgttagaaaccctagccgtcacttccctccccgagcaaaaccctagccgtgcgcgggtggtagcatatctgcgcgtggcgttccgtccctgtacgtgtggataccagtagaggcgccgctggtttgcggtgctgatcggcgtgggagtacggcgaggagaacgcacgaggaggagaaggtcgagccggtgcgatcgactacttcctctatatcgacgcgcgctacttcacgagagttccttcgacttctcagcgtcttcttccgctgcgcagcgcgtcgagtggtaacgatctatgatctaacacttgcatggttcctggtttacacgatagaaaattttgatttatgctatcgtagcctacgcatatcccaacagttgcgccttcccccatactggcggcgtggcactcaccacgccggcgctcgaaagaacctcaaaaatcacgaacgcgccccctacctggcgcgccagatgtcggagggttaactcctccaccagggaactgtgaggcccccttttttggttcggccgggggcagcgggtgaaatttgaggcttcgagagcaaaactaagtcatcttgaggggatcagcccccccctcaagacgatgagacaaaaggggtttatacaggttcgggcctctatgaagcgtaataccctactcctgtgtgtatggttcttctgtacttagaaagtccctgaatccccgatatgcaagctagggttagacaagctttggcttagggattctaagtccgatcccccctcctcgctaggcatggtcctccttttgtactctaaggggatactacatgtgctgcgaatgctatctagggagaaggaaaaatattctctatattaattacatgtcttgtgccttagcccagaagctatctgcacgtcggttgctgcgcggggcccctcaaatcatgcaaggcgcctttgtcattcgccatttaatggatgagaactttcgggttctcgttcacactagaaaacgggaacccgggtcagttcagagtggttgtactagctctgaccgaggtaagaggctgtgaagcccctcatcattatgatgggacgggatggagcacgccgctcgccgcctgacacacagatagggtggggggtacacagtcgccgtcccatccgtcattcaaccggtcacagaccggtcagatgcgtagcacgccgcattaaatgcggcatggcgcggttgcatagaccgctttaaatgcagttagg

SEQ ID NO: 83296 - DNA, 2680 bp, Oryza sativa
ttgatcaattgggtctgttgagccagcacttgagcaagggttgggttctcttcattgttattgtttccacttccactagcgtgagtgttcaccatctgttgcagattagaaaggatagaaggagaggggttacactaaagataagaccttaaccaggttaacactgatctgatgtgtgtagaccattatattgttcaagttgattaagcaagcaacctagtatagtcacacactcatcaatgaacttctccaatgatgggaatgcaaccatacctacacacaaagcaaacaacaaacgttctaccctactaactattcttcaaaattactttggcggtataggtgctaagacaggatccaaacttcattccatcttgaccacttggcacttcagttcttcctcgatccactttacttaacctccttaagtagacctcattggtgtcttcaagtttcaaccactagtttcagaactactcaagttgaacgagagaagagagtagacaatgaaacaatttgcaaagagttctagataaggaagaaaggaaaattttcacaaattatgttttcggaaaaatagtccttaaggtttgaccatttggcttatcctacagtcgagatggctctgataccaacttgtcacgcccggaaattcactaataatttccgaactaatttgtgcatgaaatcctcgtccaggaatcagccgaggtacacaaactgacaatttaatatacaaatccatcataataataacgttacatacttacaaaagaaaagaaaaacagcagcggaattaacggtctagcgatggcttcagctccactcccataggcagctcaactggggtataagccaaacgtcttctccttctggatcctttatcttcaactgaggtttgatgattattgcaagaatgagcatatgacatactcaacaagccacacagcaaatatgcaagtgcacaaggattccaaaggatggcataatataggctcatttgcgaaagcagcatttagcaaagagttaagagtagtaaaacagtagattaattaatcagaagttttaatcaacactgaacagcacacccatgctgtacaggcccaaccatcctgaacaaccatacccggctgaacagatctaactccaaaccaggagctaagcaaattattaccagttattacatccataattattgtgaaaggtgtgagactaatcacaaaaacattgctcaacccgcccataaccgcgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgttcctggatcataatcaaccccttataaacaaggcatggactccccagcgacccccgtggacttctcgccacttctcagtctggcgcactataatgaaccatgctatacaaaggataaagccgttgcccacgctggcttgtggttggtacggttaatgtctcacaacagtagctcgcgaaccggtccttaattgtcatgagcacaaccatcaaaaccatatgctcacaacccaccttaaccaggttttaattatcaattaattaacatcacacgattaaccatcgtgagctaccattaaatataaccataaataataatgtagtatatatgattcatcccattagtgagctaatgtttctaagcattgctaagcaattatatatataacttttagctgaaccaaaccaatacataaggttcaagctaatcaatttattacccaaggtatcaaggaatagggcattcaatgcaaattggccataacaaaggaataggttcacaccacccggtgacattcgaaaataaatgcacagttgaaataaatagagaatttaaatataggatcaacatgctcaaaggattgtgtttaggatctgtgtgacttgccgtgcagtaatcgatcttcaattaaccttcttgatcacgtccgacgcactcacgaaccttcgcaacgacggaaacgacaagctaacacgcaaaacgaagaaaaagactaataaaaaccaaataaacagtacataaaaagtaaaaaaacatgtagatcataattttagatgaattatgagacttgaacggcctcattccgacttcaaatgaatttattatgaattttacaagattaaatctaattaaagtccatttaaaaagacttaaataaatttaattcaatttatggacaattttaatatgtagatctttattttagaaaaatttagcaacttgaaccacctgaaacggatctatggttatttagttatgattttccgaagatttcatctattagaaaaaaggaaaaaaaaagaaaggatgatgatgtcagcatgacatcacccacggaggccggctagggttggcgacctcgccggagctagggaccttggccgggtgattggaggacacctacgcgtagaggacgacgaggcgaacccaacggtactcaccacaacgacaaacgacgaacgatgatggccggcgacgaagaggacggcggcggcggctcggcttgacggcgacggcggagctccggtggtcggcggcgaaggggg

SEQ ID NO: 83297 - DNA, 8144 bp, Oryza sativa
cctcctcgctctagctgggagggggtaaccaccgcgccaccccgggctcgaccccactcggggggagccacgtgggtttggggccggcccgaccccaagctgggagggggcagccgccgcaacaccccgggctcgtcccccctcggggggagccatgtgggtttgagggcggcctcctccctctagctgagagggggtagctgccgtgccaccctgggctcgacccccctcggggggagccacgtgggtttgagggcggcccgaccccaagctgagagggggcagccgccgcaacaccccgggctcgacccccctcggggcgagccacgtgggtttgagggcggcctcctccctctaactgggaggggtagcgacgtgataccctcgggcccatatcaccaacagatagtgagaaaaaagttccaacaaggctctgataccagattattagcaacctaacttgtatctcactcaaacactcaagaacacacgaatttctcaccaaatctgacaggattgacgatgacctcgcgcatgatcagcttcacaacctccggattgatggggtggtctctagccgccaagcacctaagcttcttctcctcctcggtttatatatccacaaattaatagtagtattctaagtcaaatattacagaaatatttagattctaagtctcataattaagaaacaactttgatgaattactaccattcatctacgaaacgaaatatcgactaatttttccttacaaaatgtcaacatattgtaggtactccctatagtattgaccctcctaatcccctccctctcaggctgtgtttagttccacgccagaattggaagtttgaagaaattggaacgatgtgatggaaaagttgaaagtttgtatgtgtaggaaagtttgatgtgacgaaaaagttagaagtatgaagaaaaagttgggaactaaataaggcctcacttatatgtgggtccaacctgattttaaatcttaaactatgctgtgttcaattgtcaatttctccaactttttcacgcgaacgtttatcaaactactgtaaataaataataatttttttataaaataattatatataaatgttgttttaaaaaaatatgttaatccattttaaggttttcttaagctaatagttaattaattagtatgtgctaatgagctactcgttttccatgtagtgggattgagttcgcaaagcatatgtttcactgtttagatccgaaacaaatctctcgtgcatatggaacgaagagacttattagcacatgatatattaatatgctttttagaacaacttttctatatttttttttgtcaaaacacatcgtttaattaggagtttaagaagcgtgtacgcgaaaaacgagtgaggagagttggaaagttgactatcgaacatagctagcctccggctccacacccaagattttgctgaaattttgaaaatcgtttacaaatatttgaattgaatgtacgtttcaccggaaacttaattcctagacgctagaaatcagtgttggctagctgtaatagatgaacttgctggtaattccatctcggccattacatgtagcacaaaatcatcacatcgattatggactaactagcccgccgtaattccattgcgcgtacaagatctagattaacagctgacaaaaaaaaagagcacatggtaatctacctactaactaataatgacaaattaagtggcgatcgacatgagctcgctagtcttgtgcggcactgtctcctgtgcggcgcctctgtcgtggcggctcctgatcctgctccttctccgtctccggtgtcggcctcttatgcacgacgacgacgggacttgctgctcggttggcatcggctaacaagaccgcagagaacgcttgtgattccgcaatctccgcctcggccgtcgcggcgtgcttctgcagcgcctgcacgatctcctcctcccccgcgaaggcggcggcgccacgcgtgagcttctccttcaacacggtcatcttctccaccacggcgtcctcgaacttgatcgcgctggccaacaacccggccttgcggctacggacggcatcaccgccggagtcctgcaggaccagtgatttggtggacacgcgcatggcggtgatcagcgccgcaagctccggaatgacggggtggtctctcgccgccatgcacctgagctccttctccagcaagcgccgcgcggcggaggcgatctccaccgcctccgcgcggcgcgcgtcggcccacgcgacgtgcttcctgagcaccgcctcctcgggcctccctgtcccggcgaacacggccaggcccctcctgagatccagcacataggacgccatgttatccgccgccgactgggcggagatcactgcaccttccgcccagtccacctgctccggcgagggagggtcggggtcctcaaggtactcggtggcttcagacagcgctgtggccgtgatctcctcacactctcggtcgtcggcctcttcctccgggccggcctccatgagctcggcgatgagctcctggaggtcatcgtcgacggcgggcggcatgtcgtccgccatgatcgatcgatggatgcacgcactacctaccgtccgtgttaccgccaaaaattgcaaagcccaaaaccttggagatatgggacggaatcgatggatggatgtccctcgataaatagacacgactgccgatccgagtcggagtacgtgtacccgacggaccgatttcctttccgatccaatcgcgtgatcgagatggaggccgaacgagggcccaacttcactgttgggctgctcgcagccgcggagcccagcccatctgcaactgcaagagttttcgcagtaacattgaacaattatgccatatactccatttgtcgataaattctctctcaaaaattgacagatatagcgaaagagcctgtaacctagtggttacaagagtctcagtagcacctaaggtcctaggttcgactatttatgggagcgaatttttcaggatttaacagcgttgtgctttcagtggtaggtggcgtacccgttgacagcgaggtgcctgtagtgacggcgcacgaacatgtgagaagattcgttcccacgactgccatttcacgaaaatactctggttcggttgatatatttgtgtacctatttatacatatatgttagttaatctaagtcgattatttaatttatttgtatcggtcagatcttttgtgtacctatttatcatatatgttagttaatctaagttgattatttaatttatttgtatcggtcagatgttttgtagggttttaccggtattggctaaattgctttgtcgatctagattagttaatgtatctaccacattgaaaatcagtcaagaagattgtctagatattatgttcctttaatactttgtgctgcatcagtcctagtcatgcttagaaccataatctctaacatgttttttgattgctaatagggtttcatcggggtttcaaccgatgagttatctggacgttgcatcggattataaggattacatacaagttggttttaacagattgcaacaaatgtttcattgattatctaatcgtttggacatcggaacaccagccgatgtatgctttaaccatcgaatcagcactcattctatcatatcattattagttgattggtttctattattgttttattatattaccatcagtcgattgtatttatatcattatttactcaagtgtcaaaatctacactaggcatatagccggttgctcaaaaccctatcgacatcggctagcgttgctatatcggcttgtcaaccgattggctctttaatttttactttatacatcttgtcggttacataatcaaactgagtggcacatccgcatctcatcaatattttggatctgcattggagctaagcagatctcccagaccgttgtgttcgtcgactttgttcgcaccaacacatatctcgcaccattgctcgagcgtagatttttcgtcaacaaccatatgtaaccatatgtgagaagattccttcgcatgaccagacgacctccatttaacaaaatcagcatgttacggaggaatttttaaaagttatatatatacattaaaattacaatatagttacaccacaattatactataattatatttgtcaaaattctgaaataaaatgtgtcgataaattatgcaggtgcaggtgggttaaagaggtggggccgaggacttgtttctccttcttctctccttgtctcgtcttcttccgagcggcgaggcgagggcggcgttggcgacgggcggtggtcgtctgggcttggaggagaggccaccgtggcggcagcgagcggtggccggaggagcagcgctcgggcggggacgaatcgacccggcgtggcgggcgtcgttcgggagcgtggaggcggcggggcttcggcaacgtcccgaggttgccggcagcgaggtggatcggggcgtacggtggggaggaagagggaagcggtggtggtcggtggaggccggcatgttgggcggcgcggctaggcgagggggagaggaggctagtggctagctcgctcagtgcgactctgaccgcggcacgcggcacgcgggcttttacagccgccatgaccgcgaggagggcgaggacggcgtgggacgggagcaggtggctgtagcggcgtgcgaccgcatgcactggcggcggcgggaggcaacggggcgaggagtaggggcatgggctcgatgcgacgcggcgaggccgtcttggtccgcgggtatggcgtggacttctggcgacgaggcgttgcggtgacggcggctacagtggcgcgccggctttgaggagaggcgcggtggctcgctgctcggaccgcagcggtgcggcattttgtcgagcaggtggcgtgcgagggcggctgtctcggggcaaggccgtgggctggctgagagatgtggcttaggttgaataatatgccttaggattgagaattggagggaattcattaggtgttaagtttggattttgattttgaatggtttctaattttagaggggagtgtgaggatgtatgaattgagatcctaactgaaatttatcttgggagaacctcttgttgattaaaaaacagacaatatttgtcttttgcaggcagtttcataagatggttttactccagaaaagaagttctctaagctgccatcaggaggattaagggagctcattggtgcatacttaacacttctccagaatttctttttgaagttgtgcataagtattgttagtgagatggttcacttttgtaggtcaagatggcataggcaggagcaacatcatggaagcagaaggtattttgaaagatctgattgatgataaggtgaacaatgttgatgccgagttgcatgtcttacaagaagagcatgaaaaagacctgctcgagcatgacagtaagttaagttttatctctattccttccccacccacacacatgttgcactattttacttatccttaagtaaaaaaacactgtgttacatagtattattatacgcaaataaggatgatcatcttgcatttcacaaacataagctgattatcaaccctcaaataataatcctctctgttcttttcttgaaaggaacggcccaaaagaagaggaggcccaggaaatgggaagcccaaagcccagatcagattggcaaacagcaataaagcggggcgaataccccagtttccctctctcccccgccgagccttcgtcgtcagctggtgttaccccagcttgaattctctgcaagacagcaagttcttccctactccctctccaccctgcgcaattccctcgcattctcatcctactccaagagcagaggaggaaggagatggagaggcaggacggcgacgctgagggatcgggacggggagagcataggagcagaggctgccgttccccggcagagaccaagactgaccgaagccccggcattcccaggtcaggaggaccagcgaatccattctcttctcgttcgtcttcgcgttcttgcatttcttttcgaccgtttcaatcgcagttccaccgccattcttccttgctgtctttcttggtcggtgttcttgaagttctcgtttggtttgctgcaagaagcatatctgatcgattgattgcagagttctggaggtggggttcgccaccgtgcgagaacaccacgggaccaagagcaccacgggaccccaaaagagcaacaacctccagaacaagaagataaaatcaagagaagatggcagagaaccggaggccgcagagttgagacggggcgagaggagaaggtcaggacctgcgaatctttctttcccttcttgttctttgtttcttgctgcgttcttgctttgttttcgatcgtctcaatccctgcagctttcttgcgttggttttcttgccaagttgtgtttggcttcacacgtgtctgatcgatgtgcagagaccacgaggtggtatttgccgctgctgcgcgagatccacctacactgcagcgccccgacttcgactgcgtgcgtcagaacaaacatcccaatggtaatcagtctctctcctgtcctgctctgtgtccggtttaattcttttcctttactctgggaacgaacatgcatgtataaaagcctatgtactagttgttgatccatgtccatgaatctggattgaaatgttaacagatattggcaatatctgtaaattcttgttggaaccatgcggaaacttaatctagttaagttcactgatgctttgacaccttggtttctgaaactggatccttgtttcttgcactcctgcctttatttcaaaagagaaaaaaagtaacttcagaatttccaacaagaaactgatcttttttttttcttcctgcaaaatgcaaatgcaagttcactgattcatagagagttgtttaagttactccaatctgattttctttcactacaagaactagtcctggtgttcagttttgacaaacttctatgatataaaaactccctgatatgagaagctgacatgtgtatgtgtggccatgcacccagccaatactgagaatgagatgacgggcggtgatctcgagaaagcaagtggaagcttactagaccagagcaagcaaccgctgaacataaagagggatcgtcgcaggctagaagaagtcaggttagtgacttctctgctcccttcttatgcgcaaatatgtattgttggttgctctgtttgatctgataataactgttagaattgagattatgttgttggtgaatctgacaaattgttgaaccctagtgataaaatgtggaaggatgaagcgaaggagattggaagcaggtcgccagcactaacaaaggggagcacgaaagagtctcagatgcttcagtctctcggtaaatatatttgaatttgggcttgctcttttgaactgtggagtggagttgattgggcctgtttttacttttggtgtgtgtggatgcactatcaggtgcacaaactgctaagagctccagtggttgtcagggaaaaaaatgctagtgtccaactcaatggcttcagggcagccacggcatcttttttcttacaccctatacacccagtgtagtttgatatctatatcaggtcatgtccagagtaacgagtggatatttcaattaatcaggatggaaattccaactaggttaattgcttgctcttggtttcacaacttgtaaattctcgtctcatgcatggaaaccgtacagaaacctctaatctagttaagcatgtcaattcatactgtaacaacatgcatgatttctgacaagaaacagaattcattgtttatgttttgctgttacttgacaaaacaacaagctgatcctccctaatttcttgtaaaatggtatcttgttgttttgtatcatgttaagtaataattatgtaactacaaaaggattattggaaagtgattattttgccaatttggaaagggaacgttcacactctcagtgtgcaattttgtagatgaaattgactcaacatcagtacctgaaaattgactttgaaactgtggtaacccttggaacacttcaattttacctccaaaatgtgtcc

SEQ ID NO: 83298 - DNA, 13071 bp, Oryza sativa
  unsure (1)..(13071): unsure at all n locations
cgaagcaagaacccgagcgcgatgcagagaagaaagaggtggtcatggagnagaaggaagaagaggagcacagtananaggtcgtgaagncgncgncgncggccccgatgatcgtgtcgaccacgcacaactaccggttcttgacggagcgtgacttccgagggttcgtcaaggagccggaggccatcacggtgcgcgtccaggaatccttcgtgccatcgccggagctggagcggtggcggtggcggcaaccgcgcaaccggaggagcggcgagtggtcgacggggcgccacggcgcggcttcctcacgaccaacgacttccgcccggcgaacgagccggatagcgcgcgccagagcgtggcgtcgcagctggggcggaagccggcggcgagctccccgtccgccgcgtcgaggggcagcgccgccgccgccgtgagcgggaggacgagcttcgcgtcggagttctccggcttcggcggcgactccgactcggagtcaaccgccagcgacgggtactcggtgaaggacctcgtcgtcgactccgacagcgactggttcctctcggagaaggacttcccggcggcggcggtggccgggcacgacgccggcagcctcaggggctattacaaggccaaggtgctcaaggccctggaagccctcgacgcgtcggcctccaacctggaacgttcgttccaggactcggcgacgacggtgtcgccgggctcggtcgtcggccaggcctcgccggacatcatcggcgccgccgacgaccccgccaagtaccccgaggacatgtggtcccggagcccctcgccggacgtcgagtacaacgaagacgagcacaagggaaacgaggcgacgaacatggcggaggaggtgagcttcgacatgagcgacgacgagcggccgcccgcctccggcggcaagaagacgacggcgatggcagcatcatcatcatcatcatcaccggtgcacgacgccgaatctgaagatgagaacagcttggatcattcggagaaggaaaccatcacgatacatgatcattcgtacgaatctgtctccgatgtcaagaggaggagcccagaagcaatctctgacgcagaattggatgatgcctcgtctcgccatgctgctgttcttgatgccaaggtaagaagcccggacgttcattcatctgaacccatctttgacaattacgaagaacatgaggtctcaaatgatcaatcacaagcggcagtttctgatgagaagagaagcacaccgcattcggagagagaatttgctggtacagacgatcgctcacacgaactcatttctgatgtttggaaagatattgtcggtgcaaatgatcagtcattagcatcagctcacgatgaagaaagaagtcctgatcaatcggttgcgattatttctgatgatcacaaagcaattgtcagtgctacgaatgattcctcaaatggagaagtttctgatcataagagcaccccagagactgcagagcaggaattcagtggaaatgatgatccatatgaactagttgccgatgcaaggatcatttcagagcgtgcagaagaagatgatatcccaaatgagcgtccagggaacgccactcggcatgtcaccttctccgtcgccgagaaggggaaggtgttggacgtggtggaggaggatcaagaggacaagtggaaggatttgacggaagaggaggaggacgagctggagtcactgtgggagcaccaggatctgatcgagcagctgaagctggagctgaagaaggtgcggtcgatcgggctaccgacgatcttggaggagtcggagacgccgaaggcaccgatggaggatctcaagccatggaggatcgacgccaagttccttcgcgaggacccaatggacgagctgaataagttcttcaagagttatagggagagaatgaggaagtttgacatattgtgctatcagaagatgtatgcaataggtatgcacatttttaccattaccagtttacccttatttatctcagattctagtactaatatttagcactagagtacagttgctacttttgtaactatcaagcatagcatccactagctttttaaagctagttaaggacaagatgcagctttatgatgctttccctagcaaattttttgttcaactcaatgtcctaaaagatatatttttttggttgcttgaaattctgttgtgctaatatggtaccgcaattggatttgccgcagattttcttcagttcagagggcctcaacaatcggcaaattctctaaaatccttatcaccaacggtgacatccatcctgtctcacaatttccggtcgtcacgtcgaaaatcacccgaggacccgtcagaaaggtttctcaaggagctccggtatgacttggagacagtttacgtcggccaaatgtgcctatcatgggagttccttcggtggcagtatgagcaggcccatgacctgccggaatccgatccttaccacagccatcagtacaannnnnnnnnnnnnnnnnnnnnnnnnnntcaggtagttgtgcagaggtttgtggaggatgagtccttcaagggccctaggttgccaaactacatcaataaccgatgtgttcttcgaaatctcttgcaagtaccagtaataaaaggttataatcagatttcagaaccaaataatcagatagttcatccattgtatttctttatatcatgtgctagatgatttatttgaatgtgaatgttggattgcagaggacagcttgaaggacaggatggaggatcagcgtaaggggaactatgtcataacgagcgaggagctggaggagatcatggaggaatgcatgcgcgtcttttgggagttcatcaggtccgacagagtcgagacgacgtcggtgctcaagggcttgtcgagcactcatgttgagctccaggaccctttagaccatgatcttatgatgcacatcgactccacgttacagaaggtaaatcaccaaattttcgccagtaccgacaaaattgtggatttgctacagtaagtactagtagtgaaaatacttgctgcagtacatgacactgataagtgattaactctgaaatggatgcagaaagagaagaggctgaaggatctcctgaggaccggcaactgcatagtgaagaagttcaagaagcccaaggaggacaccttgaaccagagcctcttcttctcgcaggtcgacatgcggctcgtggcacgggtcctgcggatgccgaggatcaccagcgagcagctgcagtggtgcaaggcgaagctggacaagatcgcacttgtagataggaggatccacagggaggcttcatttttgttgttcccctgttgagaatacatatataaatacacatgcttcttttgttcatttttcccccctccataaatcatctccaccatgtaatccacggcttgtagatttttcttaaccttttagtaatccaggtctctttacacatgtccagtaaattacaaattgtaacatggtaaaacagctcataaaccacagagtccacacggtacagtacttacagtaccctagctagaaaatcagagtgtaataaatcagcatttcctctcaagaggaaacatctacctcagaatgcacagatttctactacatctgaagatgaactgtgttcatgtaactttgcctctgtctgtcaccacatggatgcaactgctgaagttgtagtactacggtatgcgaataaagaagcaataagggctttgcccgagcaaagatgagctgaatgcatcatcctcagttcttgctggattgtttgtgtgtgtatgtaccagatggtccatccactgcactgagatccacagttattgatcacttgtgtcctcttggtgaagatgaacagtgtgccctgtgctcctcttttttctgattgccacatgaggcaaactaatggcggccataaccggtcctaacaaccaaagtactgactgcaaacgctgcattctgctgctgcgtactataccacagctgagagagagagagagagacaaatcataactcgcaaagcgataagaaggaaactgctgctggggacctgggtgtttgctggccgccgccattatcagcaggaaatgcgagagtgaggctcagcatcgcagcagacaaaggtggatgcagatggaacaagatgcaaacaggctgtgcggggtatgcgagtttagagctcaacagcgaaagcttggatgtattatcgcttacaccatatgtctcaaaatatagcaatctagtatgaaatatgacacatcctactattgccaatatgtgtacatgtctcgtatccggattcgtaggactgggatgatctagtacaagattactacattttaggatggatgtagtatcattttatcaactttttgtgagcggtgagttgagtaagatgatgataacaaaccgtgtcaatcttgtttccggagaaaatcgattcgagaaatccaaaaactggttggatggcaaacaacttgtcaccgatcagtccaacttaacgatgttgacaacgaaatttctatccaggttactactatactatacgtctataccatgcccgattttacacggaaatatcacttaactaaaagcgatcacgatattcacataaagaagaagccaaatttcccgtccaactttgcattggacaaaattattcagatcaggtttcagtgcaagtgttcaactggacgtgacatttgccatcttttttcaaaaaaaataaattaatttgacttcttgttcagcagcctagatgaaatttgcgacacttgacatttgcagtgggatttgaagtgacacgacagcagccagacggcccacgtagatcctgggccatcccgatccggcccattaccgcatcaagcgaatcttagccgtccgtgctaggtcaagcctcccccggaggcagccatttatacccccatccgcgccgccacgcgctctctaccatttcctcctcctcctcctcctcctcctctagggtttatccatcggcgactacgcggcggcggcggcggcggcgacggcgagatggtgcagcgcctgacgtaccgcaaaaggcacagctatgccacgaagtctaatcagacgcgggtcgtcaagactccaggtctggatcttctctcttcttggggcactttttcttttggggttgggttcttgatctgttgaggtggaagatttttcgcctggttgagcgagcttttgtggcgttgtggttgcaggtggcaagctcgtgtaccagtacaccaagaagagggcgagcgggcccaagtgccccgtgaccgggaagaagatccagggagtgagtgcctgctttatcttgtctacaatgcatctttttttgtttgtttatttgttttggtaggatgatttcttgagtggtttggtgcagtggcttggtagaaatttgggataggccgatgagtatttctgttaaatgtagatgaattagtagcatttgttgctcgatcttagcgtatcaccgtgttggagtgctgatttatgatgcttaactatttatttagcctaggacctgataatgatcggacgttcttgtgtattgtgcatttagtctttttggcacctagaaatgattccttctggtggatttgattacctggcgattggtcaaccatttctgaaattttctggagaaatctacgcactgcatgattttcagcttggcatataaatgtagaacagctgacctgtgttttgtaaactgattgaattgcattatcaccattgttgtttactcatgtttcttttgctttgtttctgtgctcttaaatattgaacacacacacacacacacccctaatgcagtctaattattttttgctgatttgctttctgccacaagtatagtttgtaactatatcaattatatttctgtaatttctgtggggataacagtttttatgatagaacattaagatattattctactaatcagagtttgaacattgaactaagggtggtatatcaattttatcccttgtgaactaattccaataaaatgtgcaatgaaatcatcctatctaaatgcgtatgttcagctttaggctgtggcaatcactcataggcctcattgctgggtctatgaacagctttctcattcatactcttcgtcatggtttgtaacatgtactgtgctggaaaacatatatagttcctacacaaatctaatcactgaactttgtgtactatgtatgaaactgttggacttttgattgttgaatgtttgtcacgattagcattagataacacttgtgttgtgccatttttatcgtattattttactgtatgaggtgcattattttgactcaatactgtcgcttccattttcagattccccatctcaggcctgctgagtacaagagatccaggttgtctaggaaccgcagaactgtgaaccgtccctatggtggagtgctctctggaactgcagttagggaaaggtcagcataacatgctccaacatatccacatttgattataacatgtatcttctgtcacctcacatgattcatattgcctcgcaggatcattcgtgctttcttggttgaagagcagaagattgtgaagaaagtcttgaaaatacagaaaaccaaggacaagtcagcctcaaagtagacaactcttggaagtggaagcaaggcgatgtgctataaacaaggaaaacatttttgttgatggtgatgatcaatggtctagcctcttctagctgaatgttttagtataactgtctgagtttggagtacttgaaatccgtctaccattgtgatgcacttgatgtcaaatgttgctgagacatatttgatccgctcttttgttcacttctctgaattgcgaatgaattttacttacttgagctggtgttttgtttctactctgtctgtctgattgtttgtgcttctgtttcccctgaggacaatgaacgtatggtacgatatgatccatgcatttggataggcaaatctgcagtcgtaagccctcatattacgtttatcagccttctgtccttggtcagacttaagacgtatacagtactatatggtgtattttatagttgattaaactgatgtattgttgttgtcacagaagcgtcgattatttgattattttacgacttgggccgagtttagttacaaactttttctttaaacttctaattttttcatcgcattaaaatttttctacacacacaaacttttaactttttcgtcacatcgttccaatttcaatcaaacttctaatttttgcgtgaactaaacacacgtcaaaattaagtttgactaaaattgaaagtttgaagaaaaagttgaaagtttatgtgtaggaaagttttgatgtgatggaaaagttgaagtttgaagaaaaagttgggaactaaaccagccttgaaagtgaacatctacactaaattaatcaaaatttaaccttgtatttccaaaaaaaaatatttcattcactataataattcaaccctgtaaaaaaatatttcattcactatattaacaaactataataattcaaccctgtaaaaaaaatatttcattcactatattcaaaaaaaatatttatgtcaagaatgggattcgaacccatgccctttcggaccagtacctgaaactggcgccttagaccaactcggccatcttgactttgcatttatggcgtcatttaaatcttatgtaattcgttaaacttgaatccttaatccgacggacctcccccatgatttacggagtagtgctaccttcgtttccgaaccgggagttgattcattcgccagccatggcggatcgccgcgctctccagtaggttaccctcctccctctccgatccctttttctccccccctcgcgccatctacatgccgcctcgccttcttcggtccttcacccctatcgccgccggccacctttgngcgctctccgngttcgccccgcgcgcttgggagggcgcgccccacctgttcggcggaaatgcggnncggggcacccgaccttctcgcgcgccntcccgccgagctcgcgttattcgcccgcgcgcgcgccgcggggcgcgccgcgccgagccagttcgcctaccggaacgcgctcgccgcgtgcgcccgcgcccccgcccccgcgcttgccgagcaggtctactgcgccgcatggaaggacgggctctccgggaacgcgtacgtctgcaccggcatggtcgacctgctcgccaagagcgcccgcctcgggacgcgctcagggtgttcgcggacggggacccgagcagcgccgtgtgctggaacgcggccggctccggggcggtgcggaacggcgagggcgggctcgccgtcgagatgttccgtgatatggtgtggggctcgtgcgagcccaactcgttcacttactccggggctctcagcgcgtgcgcggcgggtgaagagctgagcgttgggcgggcggtgcatggtctggtgcttcggcgtgatcctgagtacgatgtgttcgttggaacgtcgcttgttaacatgtatgcgaaatgtggtgatatgggtgctgccatgagggagttctggagaatgccagtccggaatgtggtttcgtggaccaccgcgatagccggtttcgttcaggatgatgagccagtcagtgcaatgctgctacttagggaaatggtgcggaatggcgtggcgatcaacaaatacacagccacaagtatcttgcttgcttgcgctcagatgtctatggtaagagaggctagccagatacatggtatggttttgaagacagagatgtacttggattgcgttgtcaaggaggcattgatttcgacgtacactaactttgggtttattgagttgtcggagaaagtgtttgaagaagctggcacagtaagcaatagaagtatttggtcagccttcatatctggggtcagtaaccatagccttctgagatcagttcagttgttaaggaggatgtttcatcaaggtctaagaccgaatgacaaatgctatgcttctgttttcagctctgtaaattcaattgaatttggtggacaacttcattcatcagccataaaagaggggttcattcatggtattcttgttggcagtgcactctccaccatgtactctagatgtgataatgttcaggatagctacaaggtttttgaagagatgcaggaacgagatggagtctcatggacagcaatggttgctggttttgctacacatggtcattcagttgaggcattcctaacattcaggaatatgattcttgatggatttaagccagatcatgtgtcgttaactgccattctttcagcttgtaatagaccagagtgtttactcaaagggaaggaagttcatggtcacacacttcgtgtctatggagaaaccacattcataaacgattgttttatttccatgtattcaaaatgtcaaggggtacaaacagctagaagaatttttgatgcaactccacgcaaagatcaggtcatgtggtcctcaatgatatctggatatgctacaaatggttgcggtgaggaagcaatctcattatttcagcttatggtggcagcaagcattcgaatagatagttatatatgctcgtctattcttagcctatgtgctgatatagcaagaccattctattgtaaaccattacatggatatgcaattaaagcaggcatattgtctgatcagtcagtaagcagttcacttgtgaaggtgtactccagaagtggcaatatggatgattctcgtaaagtttttgatgaaataagtgtcccagacttagttgcatggaccactataattgatgggtatgctcagcatggaagtagtcagaatgcattggcaatgtttgatttgatggttcagcttggggtaagaccagatactgttgtattagtgagtgttttgtctgcatgcagccgtaatggtttagttgagcaaggttttaactattttaattcaatgagaactgcatatggggttgagccagagttacagcactactgttgcatggttgatttacttggtcgatctgggaggcttgcagaggcaaaatattttgttgatagcatgcctatgaaaccagacttgatggtatggagcaccctacttgctgcttgcagagttcatgatgacactgtacttggacggtttgtagaaaataagatccgtgaaggaaattatgattcaggttcctttgcaactctgtcgaacattcttgcgaattctggagattgggaggaagtagctagaatcagaaaaacaatgaagggtgtaaataaagaacctggatggagtatggtgtaaaaaccgaaatgcttgaggagatcagttataaacatatatttcatgagcagagatcggctataaagagagaagcacctttgccaaatatttctattttatgaccaagacattgcagagtatgttcatgattaaaacttctacaaaaattcttttttgaatgtccctaagctattctttattagcacatgtgctaaattttgattgagttggagtgataatattggggaaattggaaatgaacacccgttggttttatgtggtcctgctcatggaaaggacgttacagttatcaaaagttcccactgttgggagaactgggtttgtgattcctcttgctgtactttatcaactattcactttatgagaattttcatataatcatactcggcatatagagcacacccctaattctcagagtaagcataagatctttatagtacagtggaactcaatttatataactaagctattctttcctcagttaatcttcctttaatatgagtaactttcaggtataaatctgacttgatatatatagcatggtagttcttttgctaacaactgaaggcttctcttggtcttagtgtctatatgactatgtaacattttcctataaaatgctattgcacatgactgtaggagttgggagttaaggggaattcacatggcatattgatattgcttgtccagttatctgaaggatcacccaataaatcaaatggaaactttattttctgccggattccacattcactgcctgtactgtattcagtaccagttcttgtatatggatcctcatcactattttcaatgcctccatttgtgcctataacccaatcaacttcatatccattgcatggttcagtctgtccaaaccgtatgtttggcgaggcttcatatatgctattgattattccaggggttatgctgagaagcagcgatgtggcacctgacatatgctgcagggtttgtgttttgaatggtaaggtgactggacaattatggttgtctttgtctgattgatgagttaaagatggactgcacttgaagtttatgactttactagaagagccatcttgtctattgttgggcttctgctgcctcccctgcaggcactgctgactgttcaactgagttatcggtattgcaacttcttctgagcaagaggaactctctgaagcaaattgcgagcttgttgttgcagttgattgaggaccccaggggtgagataacgctctttgtgccatagagttaggctttttaaatatcttacaaatagcccagatatcctgtttggtgcagaaaaatattagaatgatattatatagttattttattttatttttttgctataactatatagtaattccagtaaaatactcactttggctggttttttatctattggtattttagaaagtgaaggctccgtgagtgaaggaagtctgaactcatgcatcatccaatcagtcttgaacccttttgctgctctccctttgtaaaagacaagagacttcttcaggcttatgcatttggttccctcggaagagtagatgggcctctaatacaagaagttaaaagaggaagagaggatgaactgtatccgagcttcatgaaacttccctaaatcgtcatgctttatgccgatacatgagaaagggagtttaatatatgctttaaaatgaaattacaactgcttgaacatgacaatgcgacccacaggtatgcatttacctccttgtattgagtagttctttattccttctctttctgaacgcacttgacttgtttgacaagagactttagtccctttcaatttgcacctagataaatgatctaggagtctagaacaccatgagcgaacattcgataatactcacgcatattatttttccactgtcatctcagtatccaaatgaaatactagtaatttatgttagtatatagtgcaagttaagcactcatcaacaattgtactaggcaccaatatttacaacctcaagattcttaaattctagatccagtggcaatgcactgatataagatggggaaaatcagcgggggcctcccctgctgtgttcctttcaaaaaaaaaaagatggggaaaattgttgacggtgtaaaaaagtactccttccgttttttaatagatgacgccnnccnnntnnnnntacatgcatgtcgactttgaaatatttattgactctcattcatcggaatttaccacaaggcctcggtgggttctggcattccatccggttaatttgacgaaccctgtacatcccccctttcacttatcggatttaccttccaaatgacctagctgcgccctacaaaccgccatcttaaatgaacaaaagctcggtccaatgtttatagtctttattagaactccctcttatgcgactcggggaattaatctcacgacgtccaagtggtcttttaggtacacatcttccggcctcccatgcgctgtacgacaccttccacttcacaatgggcacccgcccaatttatttgtcaaccccttggttacggttaaaccttaccctatccccaaggaacgccccctaatctttttttcctatggtaaaacatgtaatttgcaagcgcttttcaaaagcttcccctttttttttataccttctatgaacatccactgtaaactttgatacctatctatggttcgacaaaacattgtgtttgtttcg

SEQ ID NO: 83299 - DNA, 21129 bp, Oryza sativa
  unsure (1)..(21129): unsure at all n locations
tttggtatggtcaggacataatatctttcccttgtacttccaataaatttgattttgggcaaagagtacatcgtcattccttttcagaaaatattttctccactgtgaaaaatttcaaccaatctttagtgcaattggattcccccctatacttaagtgcgtgccaatagcttcatttccatccggcacctcccttccagctttaagtcataatgaataattttgtttaaaacctcctgcttttcttaataaaaattagcattttttacctacaactttttgttgaattccaggacattaaagacccatccaagtttcaaattgcctggtttttgtggatggagtaggtttcttggcgccaaaaattttatcgcttaagtgggggtcatcatcactttttttaaatatcaacctccaaaaacaactttcagccctttcacaaacaancacaaaaaacttttccacaagccaanccnncnnacnncccannannnncaacggcgtcatctattaaaaaacggatgtagtataagacagggaaaagtgtcaagggtgtaataaatgttttgtttgcattactgaagtggataataactatggaccatgatttacattcacatgtgtataatacagacattcaattagctaatatgtttcatactttggcatcacttctttatccatacacactaacagactttacactcccccaaatcttacaggcatgactgcatctaatgactgttacaacgatgtgaatggacccagaaagcaaacgtttagcatctcagtaatataatggagtcatcaacatcatttgtttgattgtttctcattgaatttaccagagaagtcagtaaggcagacagcagatcaatcatatcgaaaggaaaggacaatcagcgaatcagtatcatctgttgacacagatgatgtatgaacagccactgatagggaaaaaaaatcattgagccgacctgaaagctactcgcaacgattcaggaaagtacaaatgcatttgttatggcaattattgttctgttagtaacaatagatctatagcaatttgcatttgtgtagccgccatttagtctgtgaggtacaatagaaatttgagaactacaataccttctagagacaaagaaatatagcaatacggcaatgaagagagaagtttcagaccatattatctgaagcgtgtttccattagatttcataggtagaaacaaatgacacaagtcttgtaaactccattttcactagctctagaagtttccaaactactatctgaagaacttacagatagagctgtggatgttttttttatatttctacagaattgaggaccaaattcaacttaattggacagatacaagaaaggcaaagtcagatagaaagctgtttgtgcttccttttgtagattaaagttagatcattgcagatgagtacaaacacaatatatttcgctcgtaatttacttctgggagttacgggaaacatgaaattacagagaacagtaaaataaaggagaacccattgttcttttcaagtatctttgatcaagttactaaagcatatgcacaaagccgtaggctgatcagtcaaagccttcaagatgctcccaaaagctccttgatatcatacccttgcagctgaagcaattgaaagttatacatgtcagttacatctcatagttactactgcatgaaattaatatgccagtacatgccatctaaattctgaaataaccaagtaacataaatagacaatcatcagataactaccctattcatatgcaattctctgcaagttatacaactcaaccctatcttgatcaagaatgaatatgctgacaaattggagtataagacatacctgaagaaaggttaacagtaatattactcccgagttccaaaatgcatgtattgtgataggagttagaagattatgggtttgagcatatgaaaaacccaacgcaacacctgcataccaatcagaaatgttatggaaatggaataataatctcacaatgtaataaatacttcgatagtttccaaaagaaaatcactggtcataaattgatcatagtatcacactgagggtttgcatctatcatctttctaacaagaggtcacaaatgcaagacaccacgaggcagctacactttagtgtgatcaactttgttgataaccaaatgcattcatgcacttcgccaaaacacggaattcacagggtttttatatcttatttctaaattgacatataaaattaccaagtataaacaactgtgggaattgtccaggtgtcagatgagcaaaggcaaatagagcagcactgacaagtatgcaaactggagtaggaaacctgtatacaaagcaaactgttaaaaacaagcaaaactgcaaactgtacataccaatttgctatatgcaagcatgtgaaaggaagctactaaaaagagctaaatagtatatgtttgtttaccacttagtcaaggacaccattaaaaatcctcgaaacacagtctcctccagaattggtgctagaactccagtaatgcccaccagaaaagcagtgctaataatatattaaaaagttgaagacaaagtcaggttatgactgccaggtataaaggcataaacccactgaaaactggatggatgatacctggcacttgatgagccgattaatggcaataaaagaactaacgagtcagtctgaaaaaaaaagtccagagaaatagatcagcaatcaggactcaagaaacagcacactgaaaaaaggtaatcagtataacaggaggtaagtacacaaaacatgttgagattcaatttggaaaagcgtaagcccctatcaatgtaaagtgaggccttaccacataagcttgtcagtcaaagcattgaataaaccttgtgtatgaagcttcactttatcaaagggtgcattccatcttaattatgccgcaaactgttcctaattatgctgtctcatctcaaaccaaagagaataggcatatttgctaattcctatgctactcatggaaaacctatctttctggcttccctaccatctgaatcttgcacaagtgaccatatgatagccttgagttgtcattgtttaatcacaatcagcttaatccagtccatacatgagaagattgtgattagataagacctagggtcatgcaaggcaagccaaaagggttgggtaatcaaagacaatggtctaatacaaattgcatgaattgctccatttggcatattgttataggttattgtttaatgaatattaagcggtccaagatgtgttttttttcttgctgaacaaattgaattagaggttaatgatgaatgggattaaaacaatgtgagttaaaaactaaagattgagaggtaataattaattaaatgggaataaaattgtatggcctgagaaaaatctatatagtacagtatgtaaaaggcctgacctctctttctggaggttcaccattcagataagtcatagcaaccccaactaaagcaatagaaattatagcgccaaagagaccaactccagcccacagaagccagccattttgaagcttgaatggttctttaatatctgcaaattcagcaaaagttgctagttagatatgcttatttcttattcagaaaaagcagaagttgtaaaacaaaattatccatcatgacttaagcatgaaaggcagtgccgaatgaaaatgaggctatgccacgcacttagttatagggtgaatccaattgcactaaagaattgtagaaaattttccacagtagagaaaatattttctgaaaaagaatgcacgatgtactcttcgcacaagatcaaatctattgtaagtaacatggaaagaatatcatgtcctgaccataacgaaatatatcatctggcagtggtcggaaggtattggtgatgccatatacaacacccagcacaactgctgtcacgctactgcttaagacagtgaaaagaaaatgataaatactttggcaactgtcaaagtatccattgtttgaagaatgcaaaaaaaaaaaaaaacagcaagtgcttggattcgtacagttgtccaaggaaaagtatttctgccttctgatctaccgttgcctcgacagctctaaaccccacatacgtcaaaaccgattgctcaaccaatcctgtcagaacaaagctgtctaaagaacattcagaaaaagctttcttcaatagagctgtcgatgattgaatacactaaaatactgtaaagagcaataaatttgagcattatgtatctgccaattctaagttatgaacatatggaattttcttttcataattagctccaaatccaatactatgtgcagcattgcaatagcagatagacatcactaaaacactaaccagcatagggtacaaaagtttaggagtaccttactccacagcccaccatggtgagcaccaccgtctgccactcccacggcacatcccatcggcgaaggattggccattcgtctgaattctgctcacatccaaattatgtcacaaaatcttcagcaagagaaaccatcgcaaaagagaggaatacttacatccaactaaactagacatgttttccatcataataagatactcctatcaaatgcacatttgccattctaccgatgcatccgtaaaaaaaaaagaaaaaaaagaagaaagaaagaaagaaagaaagatcttagaggtgtgttcttccaagaagctactagtatttaaattcctcaaaatctgaagcggcggcggcggcgtagagtcacctcactggaaggcggaggcggcttattgccggagttgaaggagaggcaggcgtagcccccgcgcctcctccaccggccgatctccggcgaccggagccaccgccgctgagctcttaccgccgccaggcagccagctcttggcgatggaaatggcctccgttgcctggacaggagtacggctctgcacgggagcggccggagcaggtgaagagagatcgccggcgacaacgccgccgccgccgccgacgacgaggaggccgccatgagaaggatgcgcttctttgctctcagctcgagtgctcgctggctcaccgaagaagtcgcacgtgtccttcgggataaggtgagggaccaatttgtaaaactgtaaaagtacaaggactaaaataaaaatcgaagtgataagccttctccggaattgtgtataggttcagggtggaatttgcaaaagtgaaccacaccgcttcttctccatagtagagagggctcttgcggcggcggcgatggcggcgacggcgagcacgtccggcgagtggctgaagggcgcgctgcaggagctgcgggagcggatgggtggcgcgctggagctcgacgcggacctcatctcgggcctcgtctccttctgcgagctcgcgcctccgcccgacgccgctgactacctcgcggtccgtacccatactatccatcatcccccctacgatgatgcgcagctatgcaggggttactctatttaggttctgatcggagatggttgtgcgattgttagtttgtttggtgtgtcgcgggtggcctgatctgtgcgtgcgcctttgtcgggttagggtttgtgagatttgatttagcgatttctagggttaattttgaaagtctgatcgtcggtgtgtcgcgatttttggtgcgaagtttgatgcgttgtgctgcttccctctttggttttgggatttctgcgagttattattgcaaagggaggataacatgaatacttaagcggggttagaaaaacaatgtatggctcatggatttgttagagaatagagaagggggatttgcaattatgatactattagaatatgatgatactattatgaattataccgtgatgaatgaaactctataacctgatgcgtcactttaagtttaagcacgatgagtgcattagaacagtcttttacctaagaggtgtatctgcaatctcggagcagcatggtgcttgaattgttgagttagctgtgtttctgttcagttgttagtttgtatccatgtctatttatgcggctgcaacttttcatcaaagacataattgcagaacttgtgtgcaatgatacctttttttttcctagcaaacatgtcactttgaattgaaatttgaaactctaggcttgatcacgaatttacatacccctgatgtgcatctgcaatgaagttgaaaggactatgaccaggaatttacatatccctgatacacatctgcaataaagttgaaaggactatcttgtgtgttcagtccaaaaataagatgttcctatctattcctcctagctttctgttctcaactggacatttggtgttcgcgaggatttttagttctattttctttatttgtttcatattgctcatcttcgagtgacagtgcttgccattaggtaaatattatgcatgaatgcatctgaaattactgttgcttagtcctttgtcctttgtctttattcttcatcattgatcatggtcagtgtaatggtgcagaatattattggagtagaagctgctcaggaccttattcaggagtacttgcagaggaggggttacattgatccattgaagggcaatgaaaacctacaatcatcaaatcttcagccttatgtgaagccttctgctgaagctgggcctacccaaaccaagaagcagacacgcacacaaaaagatgcagcagcatcttcttctggccagagttccaagaatcaaccagagactactgaaccccgagttgcctccaagagaggttcaaaaaagaaagcagtaaaggccatctcccttgctgaggcagcgaagggttctattgtcttcaagcaggggaaaccttgttcatgccaagcacgccagcacaaccttgtcagcaactgcttatcatgtggcaaaattgtgtgtgaacaagagggtgagggaccatgcagtttctgtggtgcacttgttctaatggaaggaagcacatatgctggtttaagtgatgttgaaattcctctttcggaagcagaagctgaagctgaagcatatgcaaagaggcttgttgactatgacagaaactctgcagcaaggactaaagtttatgatgatcaaagtgactactttgaaatggaaggaaatagttggctttcttcaaaggtaaattttatatttgcattcctatcctaatgactcatttaaacacctttttactgattcattgtgctaaacagccttatagaatgttcctgttgtttatttatatgtgcacacttcacccaatcctgcctgcaaattgttttttcaatcagaattgctggttgcctttttggaggacactaatgaacatatactacaaaccttggagaaaacagcggcactcttaattacatcttacgcttgaaattgcttgcacaattggcatttgatatatcatcatatttatatgataagaacatataacttgacgggatcagacagcaatttactgtgcaactatttgagatactagcaaatttgtccaaccaaaccatttggaacaatgttaagtaagttctcaatctttcttgcttcaggaaaagtcagacctaaagaagcagcacggggaagctcaggaagcagctgaaaaggataaagggaaagtggtcgtcacatttgatttggtgggccgcaaggtaatacaatgtcgttcctgtcgcacagcatctaatttgcttaaagctctaggcaaaacatttggaagaggacgtaattttgcaactgtttccgacaggtaattttgaacaaggatggagccaccgtgttggaatccgagcaccggatcttgggaccacctgaagagaaggatcagatccaccgcatacaagccaaccccacaatcagagagcagcccgtgttcatcgaaacagggccagtgaagccaaaaactgacagagctcgacagagcaagagactcaccaagaatggcctgtgcctggaggtaactgggaggctgcagcacgatgacaaggacccccagagcttcctgggtggcaagatgaagaagggtgatcatctggcgtacagttctttcggccaaccccgtgaaggggacgacttcgactgctcccaagattttgattgagcctaatttgcttgtggatggtgatggtcgatgggtgccttccattgtaggtatgtcatccccgattttggttcatactggttgttgagttctcagcttttacccagaggaggcaaaatacagaccaggctgtagaaatgctatcatacacatgaacacatccatatatacccatctccttttttgtaaggataccttggaacctattgaaaatgtgagaatggcacatttggttatctcttgttgcccttacagttccttctatcttttcttttgggaataattgctgggtagttgctgttaacccgtcagaaaaatcatagtactacataggaagaacagagagatggaaacaaagtcgagctagcaatttggcctttctcatctggaaagtagctatcaaactgttgttttcagcccattcgatctttgaaatgggtcttcaagacagtggttgatcaggcatagcccatccatgaaaggaaaaggtccctttgtactccctcaatcatcagctgaatccaattattatccttcaaccacaaaactggtatatcaactctcacaagatcgggttgagagacaaatccgagattgaagatcagattcgagcaatggtagaaaggagcgaaaatggacattttctttcatgaagcaaatcgcatacaattgttgcgatcaggcccaaaacattaggccatgctctttgatgagccaaaacgaggattggccagaaatttggcaaaccaaatttggccatgtgccagcaacacacaccggatattatatagcaccttcagtataactgctgcccattttgttacaagtcctactccttccgtcctgaaaggatatcttcgtttgggaataaattaaattaatctagtataggacatgacatatactaacactacaaatctgcaataagttaatatggtacaagataagacatcctaatacatcaggtacattcagattcatattactaagatatatcgcagattcataatactaagatatatcgcatcctgtatcatattaacttattttgagacagagataataccatttttctcaacaaagttttgcactagcatcagatgacatgagcaagtagacaacgagatgggcagagaagaaactgcacttgtagagtgcccgttccatcttggaacaattacagaacacttaatcaaagtagcgttgttgctttatatacacaccacgttactcccgggccgacaagcaaaacgcacaagcgaaatccggagcgcaaactgggagagagacaccaaaccaaatgcgcctttacactctctactactagtacactggcacacacacgcgaacaaatgtatctgtggtttctgcacttgacagtagcagcagccgtcgatgaattctagccttgggcgattcgagcactgcccggctgcagccgaccaagccactccttcaaggctgtggctcgtgctgcggtgtggtcggcgaatccggtgcaatggtgaaatgcactccggttccttgcccagactgaagaatgaatgccacctcagttgctgctaaggcagccgcctcctgaacaaacatacattgaaacaaacacttgaaaacaagataccccgtgaattaactacaatccagaagctaacaaatattattgaaactaatgatgctcaaatatccattgcattatgcaaaaactatgttaatgaaagcagttcaaaattttccgtcctaagatattcgaatatcccccaggatcagtagcctaactagttctatgatctcacatatggagaggaagagagcagataaaaactaaaaattcaaacagccaagtagatcaactcgaatgcaaatatctgaagaacaaggcaataacaaataaaattatcacacattccaagttctaacaaatttaaaatagtagaaaataatgtaaatcacctgtatgataacatactgacctgtcgctgtctgcggcgctgcaagatactcactgcccaagccattatatagaatggtagcagaaatccagcagcacgcaatagaaaaagctgtcaagtaatagagcatcaataccaacttctaatgatgatgtacaacaaaacaatgataaccagatagttaaagagcattctttcactcactgaaaacattgcagaagtatcatcgtcatcttcatcagttagagtcagcgcatgtctcaataataacagagccattaactgaacataagcaaaggtaaataaacaagaccttccattacatgtgcaatcaatataaatacatctgttgtctcaaaaaatatataaatacatttgtggcgcagaaattaggaactcacaactagagcagcagagcgacaaaaagcagcagtgctggcatttgtggcagagtaatcatcgtattcagcttccataatgtggttctgtgcaactgcaaggatcctaggatcacgcaagtcaaatgcagtaccagtaatggtccagccaccactgtgcattccaaaagaaataggttgcaattagcctggaatactacaaatgacaccacgatataatatcaacaagaacccatgtcttcaatatagaaaagcatgatgccctacctgatgtcaatggtagtttcatcaggatgaggcctagtaggtgcagtgtaaccgtgttcatatggctgcagtaatgtcattccaacaggtcaaattcaggattgctcctgtggaggaaggaaagatgaatcatttgaacataaattcacctcatgacaaatttcacacgttacatctcctttctcattgcaccatcgttgcacacaagcccgatgagcatactgtatcacaaaactaaaaatgtatgagcaatatccacatgcggtatctagggatcataaattcggaaacttatagttacataaaaaaaatcaggagcgccacagcaagaacttcagttgcagttgtggatatagccaggataaaaacaggtgtggatacaggtggaacagaataggtattgcttccaccttttacacattatataatacacaatgcaaatatttgccaacatactgggatatggttaaaaaagaaccattagtagcatcaggaaacttgtgagctgtttctcatcataaatgagattttagaagacatgctgagatgccgcaactaaatcatgttattaaggtgagacttttttcctagtagactatgacttgttgcctacataaccagaagaatctggcttgagacactgcacatttcatgaaaagcatgtcaaatatttgatacatgctaaaaatgtgaaacagttcatagattgctgcaaatttgagtctccatcttgtcagcatatatcaacattcagttttcatcccctaaaaaagattcagttttcaaaaacaacccatctaggttaaacattcacaattgcatattatccatgaatctatcttcaattttccatgcacgcggtctgtggatagaaaagaaaataagatcctaagcatggcactgaatttacaaagcctgtcaagaaatttggtgccaaaagatatttatactatgaaagataaacagtataatgtacagttccggtgcagaaattaggaaaaaaaatcttaatgggtatttatatgatgattggtgaaacaatacatattaactgaaaaaccaaataattgaagcattccgaaatgggtggtttatatgtatctcctgttggatatttaattattttcttcaagaggaagaagtcaaattgcatttgactactagttggtcaagttggttgcttgttgctgcttgaagtttctagcacaaatgagtgataataggttcaacaatacacaagtgattgtatgctttgttgtgttggcatggaaggatacagagcaaattttactagctagcaccctgtattagtagtttcattgctgcttgagcttggtaagcagacaagcagcatgtctgtcttggtagcaagccagttttgagctattagatgaggtgtaacatgagctgtaagtagcagcccgattactgtagaaaccgacctgtgtaaatggtgtcttggcttgtgcaatatatgaagaatactatagttcatgcacctattcttttatcctagtattagggccaacatctcctagagacctagaccgagtcaaatcaagggcatactaacacccaatctgccaatctgggaaacaaaaaggcaagaacgacaacaataatatccagccaaccacactttgctgtgaacacgaaaatacaacaaacagaacctaacgagacgagttaatcttgcctaatttcatatgttgccctttaaacagagatacttgaataaacacttgcaactaaaactggagttcatgggataatgtttgaacctttagactgccagtacaggcacatgggctctccagattttttatactgtcttcctcctgacaaatgcgacattccaccaactgcagaagaggttcttcttcaggggccatgctttctccaactgccaaaaaggtatgcactgtagtgggtgcctgcgcagcggcttcccctgatgaattcttggctgccccagtggtctcaaagcattcaggcgccattagatcatcaacatttaccattagatgatccttcattgtttcaaataaaaaaaactactccaacaaaagaattctttacaaatcctatgagatccgctcaaagttcataatcttagttgctagatcaggtgtagccccctgctgaaaaagtgaaaagaaaacaaaagggttcaacaaatgacatgattaattagaaaaacctacacagaacgaatacaagaacatgaaacctacagtaggacagttgcgaagcagctcacagaaatttcttattttcacaaaatgaggcaccaaagtccttggtacgagataaatggggcactaatgatttgagctccacctttctgcatgcaagttcctcaatcagcaaatgttgcagcagaaacaggaattattcatagttcatatgtcataactctcagttgaatagtaaaaagatatataaacgatgtttccataacatcaaaagcaatgcaatgctaaatcagtacagataagataagtccaagaccacacataatggtattgctcagcttatgcaaatggtaacacatgtcccagcattttaatgcgatgagtcacaagtgtgcttacaaaaagaacactaaactataatccttataattccctaaagatttgataacaaaagaataacaagaacgagagtccaccctacatttcgtgcctttgttattgtctctattgtggtataattgctcgggaatggaaaccagtgttctgcagctcagaacattatgcaaatgcaggattataaatgcaatttacaataattacatctcagaaatcatctcaatcctaaatttatatggaccgaaaccgaagataactcagtataaggttacatgaaaagcatatccatgacaaattaatatgaggtttccaagaaaaagggtacccttcttgcctcaggattgatgaaatggaggtttccttccgccaccaccctcaattttatcaaaccagaggaaggaggcaaaaattaaaataaattgttgccatcgtacatcgcgctaccaagaaattacaaatagaaaaatagtcccaaatttcatggtaaacctcgagccaaccttcctaccaatcttgctccacgataaatgcacatgggcgtgcccacccaaatccaaaataccaaatccctcaccgcgaagcaccgaaaagcataataaaccgacgaaattaccctctcccaggggcggatccggacatgggggttcaatccagttgaatccccatacttttgggggtggaaatcaaacttttacttgtaagtactaaggttaatgctctgaaattaagaggaaaagcttcttccagatctagaagaggaagctgtagggttaacgcacgcaaagcaaattcgagacgaaagcgggtgggggagagagagagaggatttggatgctcaccaggatgcaggaacccctcccctgctccggtcgcgagattgaggatcggcgccctgctctgccctcctcgcgagatggagatcagcgctggcgcatggagcggagacgagacgggagtttttcttctttttttttttcttggcacgcgacgggagtttttcttttctttccttttttttatttacgcataagggacagcgacgaaagatttcctttttatattttaaaaaaaagtctgtgtattgcaacgggtgaatgctattttaatcttattattgttgtacggtttagctaagatgaaattcactttgggaatttgcttagattttttttagaaaatcatgaacatcaattagtagtccaactttcatatcaagtaagcatgcggattttttaaagggatttcttatatgactccttttatattttcaaaagcaaacgaatttaaaatccgactcaaacacgaatgatgtaccaaaatattaacaaaaacatcttcaaattttataatagtagagatactaatgtaatactatctcatccgaattaatatctaaagtgtttgttttttggatgtaggaagtaaataaattataggtttgtctaaactattgcttattgcttatgtttggtaggcttggctacggtgcaactgtagccagccgctacagtccctgtgtgtttgttacaaacttatagtgcccgctaaaaatgttacgtacagcgtgacggtggtcaagcctactaaacagcacattattatgtactccctttatctaaaaatatagcaacctataattgattcatagtaataaaatatgtctcatcgggtactaggttactacattttataacggaggtagtaggtgttattttgaacaaccttatttcaaacttttcatttaaaaccaactgttctttataatttggactaggggcccacctttcggtggaattcggttggggatgggtgcagacaacaaactcctccgccacggatgccagcgacacccactggctaccactcttcacatccacgcaccaccaccgccgctccttctccatgagccatcgtcattcctcctctgcacccaatcgcacacattagccaccgacatgtcttctcttgcctcccatcgtaatgcacgcggctattatagtcattgttgagatcggtagcaccgggctagtgaggatttagagaggcaggaactgacctagtggagagtggggacgctgattcatgatcctctttattggattcaatggttcccccagttgctggagagaagaaagaaagatgagagatagctagtgtgtggagcgatgacagtcattggacttaggtggatggattagatgagggtggtctaagttgaaataaaatgtaaagttagctggtgttaagtaaaaagaatggttgaagaatggtctaatttgaaaacttgtaagaatacctagcccaaatagcaatttacacttttttttcagcacaactaaagggcatgttcaatttgatgcatttttaaccataccattttttagtaaagttgtcaaaaaaaatgtctacatttagtttgttgtcaaatttggttaatacataagaaatcatgtcaaaattttagcaatattggcatcttgccaaagttttggtaatattggcatcttgctaaaattttggcattgcaaaacttggtaaggtttattttggctacaatctgaacaggcccaaaattgggttgtccatgagccgacgggcccatgctttgctataccaactatagttttatcgtgtctagatggcatggttgggctagcctatttaaacagaatccaccaaatcccacctccgaaaatcaacgtcggcataccgcttcttgcatagaatgccatcatcctcaaccctaaggaacccaatcgcgcgaccacaaatccaacatccctacaacaatccaatacccaaatcgcaccacgcgctgcaagaaatcggtggaaacgaaatatggtggggagggggggagaagagaggaaatgaaggggaggataatttttacccaaggtacaactttagtgcgactccggagcatagtaaaaaaagagatcggcccgacggttgaaccgggaaaaaccagaaccagtccctagcatggttcaatttgtagaaaagatcgtctatgcatatgaaccagcgaaaaccggttagaccggatggttttatggtgaaccgtcttaaaaaccaaagcgagtcatatcgtaaactgtactagctacatagaaaaaaaattaaattcttggttgggcaattaagagtcaaccccaaaccttttgagaaaggatctgcatgcctatagagtatctccaacatgttatctaaatttgactctttacatgttcatttggccaacttgccaaaaatttggagagccaaatttatctttcaattcaacatgctctccatcatagcaatgggacccacttgtcagtgtctatctccttctcccttcttttctctgcacaatgctcccctcctcattcctcccacctaccaccgccgatagaggcggcgaacattgaaaccgctattccctcatcgattcctacgtgtcgatagcaggcgagcggatctgacggcggcagaggtgtcggtgaaaaacagtggtgacgaaaatgggcagtgacgacgaaaattggcgatggcgatggcaacattggaagggctagagatggggacgggggcacagggaggagctgcgtcaaggaggaggggcggcagaacaaccgtcgagccgccatcgttgtgccctgttcgtcgattcaaatcccatcgtgggggaaggattaggatgagaggcggcgacgcttgtcagctctgtccggtggggttgctattgaggaaaaggaggtggggtcgctgccgctaccattgcacccctctccaccgatcgacggacgcggtggacagagaggagaggcggctccgatgactgcataattgtggcggtggtggcggcggtggggggagaaggatctgaatatgtgacccacctttggcaagccaagaaggcttgctagatttagccagtcggggggttgatttggcaagcaggacgacaaaatctgttggagggtgttttttctcttcacttactaaattttagcttggagagtcaaatggccactctcttggagatgctgctcccacctaaccaactatgcaagaggatcttgtaggtgaggatagaaaaaactactttgagagtggattacaacttaaaaaataattaacaataaatcggcggttcgactggtggaccgatgaaccgacatgctcaccaggtgagtccctggtccatgtttttccaccaagttctggaggcctcatccacaatcttgctcatgggcgtcactaggcccggcgacatccggatgatagtagggtacactagccagtggaggtcacctggcggtgtacctgtctctagcagatatttaaaaattaaataaataaaacgccattttggagtgttacagttcaaacgcaatttaggcccggacagttcaatgtggcattactcctatggtagaacaacatcatggttttcactaagcaagtaaaatgcccgttctttcttttctttctaactcacaaaggaacttggcttttatttaagcctccttgaagcaaaggtcttctgaaggattttcataagaattgaactaaccccatgaaaatcctgtaaaattcatgagttccaaaggagccttctcatgacgaaatacaggatagacaaataaaaaatgaagagtgaccaataaaacatagtcatcttcattttacaagggcaatgcttggttggatagaatagagcaaaactatatgacaggctctagaccgtttcacacaaccaaacgcatcatcaaggaaaagaatgcacgaaatttgaaagctagtcagcatcatcagtaaataagattgggtcaataggttcacattttctcatgttgagattcaattcatggagaatcctacaagccccatgaaattcagggcaagaatcatccccgaagatgaaccgatgcacccgtcctcccacctcaacacaactctctcccgcaaccttcttcatccctccttccctcatcaccctccttgccttcgctgcctcgtcccatgatccaatttcgcagtagatgtttgaaaccatgacgtagttcccgcttctccggggctctagctccagcagtttgccctgcaccttgtcaatgatctcaatacagtccttggagctatgcagctggcaggctgccaataatgtcctccacacaactgggtcagcctcgactggcattcctacaacaaagtcataagcttcctggagaagaccgttgcggcctaggacatcaaccatggcgctgtagtgcgtcatcatcggcacaataccataaacatgctgcatttcgtggaagaaccggcgcccctcatcaaccaggccagcatggctacatgcacaaagcagaccaagaaatgtgacataattgggtatgatctttgagagtttcatcctgtcaaacagctccagcgcttcctgagccaaaccattctgcgcaaaccctacgatcatggcagtccatgtccagacattcctcgcgggcatcctctcgaacaagcgcagggcataactcaccgtggcacacttggagtacatgttcactgccgccgtcccaagctgaagcgtcatgtccagcctccgggaaacaacctgtccatgcgcccacttgccgagcgccaggttgcccagctcggccgcggcggacagcatgaccacgaacgtggtcgggtccggcacggaaccagcctctagcatctccgcgaacagctcgacgcacagctcgtggcggccgttgcccgcgcaggcggtgagcgcggtgttccaggacacgacggtccggcgcggcatttcgtcgaacacctgcacggcgcgctccagttgcccacaggccgagtacgcggccatgagcgcgttcgggacgtacaccaccgcggaggcgaggccgtccttgacggcctccgagtgcacggatccgacaacggggagggatcccggggcgaggcgcgcgagcgccttgaggacgtgcgggagcgtgtgcgcgtcggggcggagacccccgcggcggaggcgaaggaagagggcggcggcggtggaggggtccggcgaggaggcgagcgggggaaggaggaggttgaagaggtcgagggatggggaggggagggagaggaggagacggtgggcgaggtggaggtggggattgggcagcgaaatgaggcggcggaggaggacggggccgagggaggggaagcggccggaggtgaggagatgggcgtggatctgccggagatgggggacggtggtggcgccgccgccgccggcgatgagggcgtggaggtggagagcggccattccatggaggttgcgcggcggcgcgcgacggccgacggcgatttggtcgtgggggaaagcacacgctgcggttgctgttgggcctaacgggcccggcccgctcgatacttgcatctgcatcttttggaaaaagtacagcgaaggtccctcaacttgtcatcaagttacaaaatcgtccttgaactgcaaaaccggatatgacgtatcccccaacttataaaaccagtgtaaaataggtcccttggcagtttaacttcggttttatccgatgtggtagctgaatcagcgtgggacccacgtgtcagcctcttcttcccctcccctctccacctctcttcctctctccttccctctccacgggcagcgcccggcgaagaggagctaggcgcgggcgcgcggcaggccagtgcggcgggcgcgagcaacggccgacgggagaggagttgggccacggggtagcgggtgctcatcaggcggaggacgtcgatcgatggggatggccgcgccatggcctccttggctatggcggtccccatgaggccacaaacgacgatgactagaagggtagaacctgggaggaggtcgagcgcgggtctcctcaagcgatggcggcaggggctcctctctctctctcttcctctcgttcccttcaagcccatgacttcctcggcaagctcctccagccaccagccctcgacgggcacggcagcggtctcaatgggtggactcggcggagggtgtggtgtggacactgctcactctcctccagcggacggggattgtggcggcgagcggggtggaattgaaggcccttcaaagcttgtttggtaactcgagggaaggggattgagagtttacacgagagaattgataatgagattaagatgggaatttgatttttaatcccaatatcttgtttggtagaggttatggaaattgatagggagtttagttggagattagatcattaataaaaatggatgactgagatttgcttagattaagtaaaggaggaattccctcccaattacctgctcctacccacgtattgaaaaggagggagttccttcctcaattccccatccccatccccatcccaccaaaattcccatgtctcccaaccaaacaaaacacttaatagcctcatccctctaaactcccaatccctcctaaaaactccctccaaccaaactataggcgatgtgtttggtgggtcaactaggcggaggagacgatggggaagagaggaagggatggccaccaccttcccgcgcgctgatccgccgcccgccggtcgcgcccagctgctccccccgccgcctgcgcctgcccacgcgctgctctgccgcgcccagctgctcccccaccggccaccacccatgcagctgctcacccgccgccgctcgtggagaagagaggtgagaggaagagaggtagagatgggaggggaagaacaggctgacgtgtggggcccacgtgggttccacgct

SEQ ID NO: 83300 - DNA, 1491 bp, Oryza sativa
cccatgttggtctgctgggcgaggatttgggtgagaatggcgttggtatctggtggtgggggtggaggcgggggaggaggtggaggtgggttgccctgatggttgtggttgctgccttcaggttggttgccatcaccggtgttagcatttctcctggtcatcaccatctgaaaaccccacacagaaccagcaaacagagagagctgacaattaaagctaaccacccacgactaccataattcttaaatttattactgctattaaatgggttcattaaagttcaagttgcttaggcgaataaataaagacaggctccgacacagttacaccacacaccggcataaccgtgccccacacaacccaagaagacaaacgagaaagaacacacgcgcaagcctactaactgctcgtctaccgctgcgacgggccaggacggaaggtgagcaacagcgcatcctccgtgctaccaacgccggaggcttccccctcctggggaaccacgggcgcgggctcggcacgaggggtctcgacgaagcaagtccacgccagggactaacgaacaagctcaggcctggaggtgctcttgcgggcggtgatcttctggctgcggcagacgcggcgacgcttggggcggcagatctctccctgggcgatcttgagctgatgcagctgcgcctccaccgcgtctaggtccttcttgagctgcaggttctcctgacgcagctccaggatcttcaagttgttctcgaccatcccacggcgcaccatctgatggaagtcgatacgagccgcgtcgtacgcctccaccatgcgcgccaagtgcacgatggtagcgtcatcctccgagctagcatcccggaaggtggcgtggtcgcgggctcctccgcgacgagggtggtagcggtagggcgagtgctgcaactcgtccgggtagcgctggtgaagagtgccgatggcgaggagagcggcgctctggcaggcggcggggaaagagtctccacccgcggtgactgtcagcgaagtccgctcgggagagccagcgaggatcactgcagtgacctcccaagcagcgtggggctctgcatcgtccccctcctgctccggaagcggcctggcctggtagtccactccatgtggataccccaggaccacgcacatgccccgcagctccaagacgaaaccagtcatgtccaaaccacgacgggtgacgctgccggccatctacaaacaaaaacaaaaagaaaagcaacattttaaaggttagatttttggcgataaatgaagcagcaagacagagagagactagaggattttcacaaataagaagggattttatttttgaaaatattgctaaggcttgggatctacggctcgtcctagggtcaaggggggctctgataccaacttgtcacgaccggaaataacccaacgggcattccttacgtgcgtgcattaatccttgtcccaggaggcaaggtacaccaaaagttg

SEQ ID NO: 83301 - DNA, 1855 bp, Oryza sativa
agttgtcagtctgctttggttggaaaacctgtatctccaattctcctcaccatcaccaaggaacttgttgtgttcctaggcgttttgttatctttcatgttatatctcaaaagtaacttatgtccctctgttattgtagcatattccaaaaataaatggcgatattccttctgccattgaagcctttgcagatcaccaaagactgcttgacaggtaaatagccctgtagtatatttttaactgtatttccaaatctacgaccgatagaatgtgaacctcatggcagcttttgtatgttcagtgttagtaatgtgagtcaccataggtgtttcacttaatgttgcttctaaaatttgactcatggcacgatgtgatttcttatttaggttggtgctgtatgatctggctgaagtcaaggttaaaggagacaggaattgccaggtatacttaaaatatctagccatttcccttttccttaattttactacatgttgtacttatctcttttagcatgtgtcttttactcagttccgagcattgtcagatcaaatgtaccacaccaccgaacaccacaggtttgttcgtcagcaagtagtgaaacaggttagtgttggtgcagtcatcatgttttcttgttagaactctacttgtccatgctcatgtttcccttttgaactgttccacagcttgagtcttatcctgaaatttatgcgggttatgtccctatggattatagggaatatctgaagaagatgacagagtaagtaattgctctttttgtaacaagaaaatctttgttatagtgtaacattatgcatttaaaatttgttgccacaaaatcgaccagggatggagagtggggtgaccatgttacgcttcaggctgctgccgacttggtaaacaagatgtttcctcacttcctgagttgttaaataaaaattgctgtcttgtacattggccatattatgaagtatacagatcaatagttctttgtattggacagtatggttgtagattcattaattgacaaataatcaaaagaaataatgctattttctgtggtttttattttggtaaccagcatgtctcaacagctatattgcaatcttgtgcatcttaggattatgtgaatgatctagggatgttgtatgtcgatccttgttataaatgtgaaactcaagtatccgcattggtttttgcagtatggtgtaaagataaccctgctgacatcatgcagagataccttttacattgaagttcttcctgctgaccagaaaccaaaaggaggtagcctttttttttggcaattgaatttttactgcaattaatatactaactgcactgttcttagttgatttgcctagtaggtcatacttacttgagtagatgtgtatctgatgtatttctgtttatttttgttttctcccaaaacccagagatatgcattagtttttgggctgaggtgcactacgattcggtatatgcagaaaaaggtacagtttgtcgttttgatacagtgttcttctaggagtactagtatctctttggcaggttgatgctgtagctcatgtgtgcaagttgtggtgcagccagttgatccagttccgttacaacctagtcgtcggcgaggaactgcgacgcccggcgagcaggaagaacttttattctagagaattgagagaaaagcagaaggggagagagagagagagagagagagagagagattgttttcttacattttcaacttgtatatatacgctacagcagctggagatttatatagtcagcactcgtttgccctctgggccccacacagtagactcacacaactaatacgctttctttacttgaagat

SEQ ID NO: 83302 - DNA, 2631 bp, Oryza sativa
  unsure (1)..(2631): unsure at all n locations
atcactctctgtgctccctcatctgggtctttgtcaaaaattccttcgttgggtgtgtgttcatatcggttcaatgttctaatttgtccctctgcatacatcattccagttcggatgcattgtatctatcgctccctgcacagcctcacaaccttcatacatctacagttctttttgttcttgtgtttagcctttaaaggtttaaagcatctcgatttcgaggcaagatttgtctcctcgaacggaatgtccactatcccccttgttaaaaagatggaattttcttcattacaggatgtcgggtcgagggaagaagaagaatggagtgtccttcaatattccttttacactgccgattttcacccgattgacttaggtcttgttcgtttctccaactagacggtgatgaaattttgaatactcatgacacgctttttaaactactaaacggtatgtttcgtgcgaaaactttctatatgaaagttgttttaaaatgtcagattagtatatttttcaagtttataataattaaaactcaattaattacacgttattaccatttcgttttatgtgaaacacttaatctttatcttcatcttcagtagattcaaacaacacctcattattttgtacatgaagagtgaacaaagaaagatacttcgtgtaagaatggtactagaaacaaggtttctgaactttgtgtggatgccagcattaatgcttatgctttaggttcaaatttaatgtttcccatgatttattcattgattagattgctgccaattgtttgcgccccatttttgacgtgattttctggggaaatcctaacagtatgatactatgctaacactttgatttggtatgatgttctgccatgttcatagttcaggaaaaacaaatttgttcagtcgaaaacagtattatgcatatgatggcccacagataaataagaggcacagagtggaatgtcgtgtggcggtgtgggccacgcaagtccatctacgaatcggatccacggaagtacacggactccgaatcggatcctctccatctctctatttattggggcccgccttcaagggagatttgcttcccatcctgtccaacagatcactaattttgcataccgccatagttttgccgtgcatagatcgatcgatcatggcggacgacatgccgcccgccgtcgacgatgacctccaggagctcatcgacgagctgatggaggacgatgccgaggaccgagagcacgaggaaatctcggnacagcgctgtctgaagccaccgagtaccttgtggaccccgaccctccctcgccggagcaggtgggatgggcggaaggtgcagtgatctccgcccagtcggcggcggataacatggcgtcctatgtgctcgatctcaggagggctctggccgtgttcgccgggacagggaggcccgaggaggcggtgctcaggaagcacgtcgcgtgggccgacgcgcgccgcgcggaggcggtggagatcgcctccgccgcgcggcgcttgctggagaaggagctcaggtgcatggcggcgagagaccaccccgtcattccggagcttgcggcgctgatcaccgccatgcgcgtgtccaccaaatcactggtcctgcaggactccggcggtgatgccgtccgtagccgcaaggccgggttgttggccagcgcgatcaagttcgaggacgccgtggtggagaagatgaccgtgttgaaggagaagctcacgcgtggcgccgccgccttcgcgggggagggggagatcgtgcaggcgctgcagaagcacgccgcgacggccgaggcggagattgcggaatcacaagcgttctctgcggtcttgttagccgatgccaaccgagcagcaagtcccgtcgtcgtcgtgcataagaggccgacgccggagacggagaaggagcaggatcaggagccgccacgacagaggcgccgcacaggagacagtgccgcacaagactagcgagctcatgtcgatcgccacttaatttgtcattattagttagtaggtagattaccatgtgcttttttttttgtcagctgttaatctagatcttgtacgcgcaatggaattacggcgggctagtaaactgatcagggctactaaagaaatttgctgaatcttgccgaacgtgtacagtaaactgacgaacaaatgcagagaacgaaaaactatcgagagtttgtgctccgaactatcgacagccttttctgatttctcttcttctccttttattagattagatctattgggagtttgttacatgcataacaatcaacgactttacctgatccaatctcagctcggtcggctaaccgaaaacaaacgatgcggctactctagcccgatggtgatctgaacccggtcagccacttattattacatgcatgactaagtaaaaacagatagaaaaaagaacaagctagactagaatgtgcaagagtatacgacaaatccatcagagataacccctcacatactccctcgcctcgcttatgcgattctcccccaatggattagcagggctgtctgctggtcttaagttttctccaaccaaaaagagacacaatgtgccagtgccactactaagcattcagcgccc

SEQ ID NO: 83303 - DNA, 713 bp, Oryza sativa
  unsure (1)..(713): unsure at all n locations
agcgagcactgtcaaatggtcgctctggtcaaaggtgagcttcacctccgaccagtgcgccttccgagccgcttcgtgggttgggacggtggctagaagctctcgccttatggccttgaagcctcggcgggaggtgtgagcgcaagccccccctccccncaggtcgagcgtggcgacggttccctgaggtatctggaactccagatcctcgctgttatcaccatcatcggtgggggccttcttcttcgcttcccctcgtcggtcatcggctggggtcgcgggggctttgccctctcgtcgaccctaccgcttctcctcatcggcttcccggaaccgctcggccaaaattcttgactgagcggcagtcggcgagactgtgctgataagtgttgtgcaccaagcaccacttgtctgccgaccggccctcaccggatggagcagtggagcttggcttatcgccggtggcctttcccttgcacggggcccatgagggcccatcagctgcaaggacatggccctcatcatcggagcgggccggtttccttttgcccctcctatctcaccgcttagagcggggaacagactgggggggtagccgcagccgccgcaccggtgccgggggagttccaggcccacgcctccttccaagccaccttgtccgccagctcgaacagctcggcggtggtcttgggatcttggaggggcgcaggaat

SEQ ID NO: 83304 - DNA, 5918 bp, Oryza sativa
tagagccatggaggatcatcggggacgtccaagtcaaggtggaggcccaaaccaagtcgacgtcgggtgcaattcggagtccaggaccagtctgcactaaaacgggcgcccaggtcgcatacgtgctcggattggggcgttctttatatggatggaaagctaagaagataaaatttccaatggttttggtcccacgtccaaattcttttcgagtcaatgggaattgaccgaacaagttgacatccagaatctgtcccggtgctgcgtcaccgtatttgggcctttggcccgtgtatcgtgttggaacccattagggttgcgtcgagaggggtttgcacgaccctaaactctatatatcagtacccaccgccatctttaggtttttgggttttgcttagattaatctgtcgagaatagtttcgccgctagatcggtttataagaccccaactcgtgagcttaatcattcatctgcaattttggttgttttctatcttgttcttgtttgtgttcttcgattggcaaatagggattagccttcttggcgaggtcatccgcgtttcggcacgggtgataaccataggagacgtggtgctgcgattgcggggctcaagagcgtacgcgttcaagaagccggatcgatttgtgtcgcgactccgctcaaatcgttgtttatcggaacctttcggaagattgggaaccctagtgcacatcaagtggtatcagagctctaggttcaccgtcaggttcgctcagtttctttgccctagattagtttttgtttttcgcaattatcctagagtctacagaaaagccaaaaaaaattttagttgttagttaccttaacctagaccgtgtttagcctttgcatgattctttttcaaagtccgtagtgttgagtttgagtcctagtttaagttcctgttgctggtctagtgcgtgttttagtctagtcgtgtgtttgtcctttgtaaccctagccgctacctttcaccgtgtgttagggttcatcctttgagagccgtttctgccatcataaacacccatccagatcaccacgcatcaccagaacaccctacaactccgctgccaccatatcccaattccaccgcataatagactaggttatatcccctctggaaaacctagccggaagccgaaacttcaaacagccataacttttgcatacggactcggaatcaggcaaaatttaacttttcggataagagaaaaaaattttacatctgtttctcccccctttagcgggtttggcgaatccaaaattccaaaatttggcttgcaaaattgtctgttcgagctcacaagttcctgcaccttgtttatagtggtttcagaaaaatccataggccacatatctactccgattgagctgtaacttggaggtgtgcctattttcgtgttctgaaaaaagaaaaaaaatatcaaaaaaaataaaagaaaaaaaaagaaaagttgatttccactagtgctttgagctcacgacgcgctccattgagcttatctgctagttcggttttgtagtttttgctgaaactcgccgaagcttgcctgcaagtccttctttgctgcttactggtgtcatttttcttgagccataattgttaccactactgtctaggacacgagtagaccagcaactaagggcaagtgacttgggatttttattcagcattactatatgtcattggattgtgtaccactcatatacatatatttggccttcctagctccacatattacttctggacagtacgtacaggttcttgatccctacaatcgctgactacgccttctaggtatcctttgctttgctggtaagaaccttataagagcttggttaggaactccatattgctgagaatcgttgagaggcaccactacacctgcgtagtagattattagggataaccttcaccgttttgtttctgttttggtgtttcaatgtcaggtaacaaaggtgagaagagtccccaggattttgctgattgtgtcagccaagagcaactacgaacactccaacaaaatactcaaaaggacatcacggaggccgttgcaaagtctgtccaagataccttcactaaaatcggcttcctgaaccacatggagaggttggacaagcggatatccacgctaactgatcgggtcgccgcgttggagacaccttccaatgaggaagtggtgagtggtgacaacgatgctcatcctgaagacacggtgtatgattccaatggctatattgacgcaccggctacaaggcaagcacggctatgacgtcgcctacgcacaaaccacacaggtatgggtggcactcgccaccaacaaggtaataataataatcgtgtgcccgatgatccttatgctaaggttaagtttaaaataccatctttttcgggatattatgatgctgagaaataccttgattgggagatgacagtagaacaaaagtttaatgcccaccttgtacccgagcaatatagagttagacaagccagtagtgagttcaaggattttgctattatgtggtgggctaggttatctgatgagggggtactacctactacttgggaagaacttaaggtagctatgcacgataggtttgttcctccatcttatcatagagatttacgcaagaaactgatgcgtttggaacaaggggataaatctgtacaggattactatgtgagctacaaaagggtgtgagacgctgtggcatagtggagggggtcgaggattctatttgtcgtttttattctggtttgagggagaaaattcagaacattgttgattataaggaatttaactctgtcaaccagttgtttcggtttgctatgcttgcagagaaggaattacaggggcgtgagcatcaaggcaagagcaaggcgagcacatacactccgcacacgatgccatctgcgggactgcccaaggccgtctcttttcgggcgtcctcccagccagtgggcaagcaaccagctgcatccggagcttctgcggcaccaaaaccatctccaccaccacgaccagcagagtcaggtaaaggttcctcgtaggtacccgccaagagtgcctcatctgtcgcctcgacgggacgcattcagtgctaccattgccaagggtttgggcatgtgtagaaagattgccctagtcaacgggcctatgttgctacagaagatggctacatcaccacctccgacgtggaagaggaagagggggaagaagaagaagttgaggatgaggatggcgaagtttttggtcgtgatgacacaacggactacaggaccatcattgtgcagcgggtgctcagcgcgcaggtacagcagcatgacaggttgcaatgccataatttgtttgagattttcttcgtcatcaacaaccgtcgtgcacgtgtgatcattgatggaggaagctgcaacaacttggtgagttctgatttggtcaagaagcttggcttgactacacgtacgcatccacacccttaccatattcagtggttaaacgattccggaagagcaaaggtaacacaggtttgtagggtttcgttttccattggctcatatgcagattctgttgattgcgatgtggtttctatgcaagcttgttcacttttactgggccgtctttgggaacatgataatgatgctacacaccatggtaggagtaataaatacacttttgtgcataatgggaagaaaattactttgctacctttgacccctgctgaaattgtagaagctgataaagagcgagctgctagtttgaaacttgatgaatctgaaaatcaacaagtggctaaatctgtttttccacctaaaaaggataagctttcacctagttctaaggctgagggaattaagttgaagggtggtgttatgcttgcaacgaaatgtgacattgctgaaatttcagatgatgatatgtgctatttcttgatatgcaaacaagccttggtttctttagatgatattgctagttcgatacctttcggaagatcgggaaccctagtacacatcatatagttatgaatatcttttaatgtgtaaaaatatatacacatatacaaagtttatatacgatgtatacaaagcttatataggacatatatgaactttgtatatgatgtatatgaactttgtatctcatatacatacgtatttaaaaaataaaaaaaaagaaattgcatcacatatacaaagtttgcatacgcatatacaaactttgcatatgtacgaatacaaactttgtattcatatatctaaaaaaacccaaaaaaacagaagagaaaccaaaaaaaaaggaaaaccaatcttaacagaaacaaaaaaaaaggaaaaaaaacagccaaccgaacagaaacagaaaacacggaaaagcaaaataaaaaaaaagaagggaaaagtctgtctcccgcgcggcgcgtccgccgccccctctccgcgccatagtataaaaactcggaccggagcttgacccggcggacctttcggttcaccggtccgccggtctgaccgatgaaccggcggttcaaccgcgattttttacgtataggtatagtgcatgtttgctagtagtcacaagtgatatacaacctcaacccccagacctgaggtcgattcccaagtatgcacccatttttgccaaaaagttcgaggtaccaatatgatatggaccatactgggcctctcattggcccattacaaaccttcactggtccaaccgtaggcggtttaatctccggttcaacacaaaaccgcccggttcagccggttcacagcggttcgaatgcatgtcggttccggttttttggttcaaccgccggaccggtccggttttttccactatgctccgcgcgcgacacgtgtccagtcgtgcggggaggaacgtgcgctgatcacccaatagccttctcgcagcaatggatcggaggctcggagcggcggaggcaacggcgtcggttgggttgggtgttcgcagatcccgactagcagtaaaattcagcgttccatggtgtatagcgcgtttcacaggggttccccttgggaacttccactgccgctcgatcaggcctttacggcccagatctcgcactcacacatggtaatccgcttccgcaggttcggagttcacggttcacgatgatcattgggaaatgggaagtttatgagcgctcacaatcctgcttagtttatactactatgactctcgcaggcttctatttgggctatcttctgatcttgattttctcctaacttgaaagagaaacaatgtgtagtaaactaaccagtgattgctagtatatggatcatgcggcttatggaaatccgagtgttttttactccatttctctgtttcctccgaaagatattcagttagtcctacacacgcggatcggattgtgtaaagaaaagaaaaaaaaaagaaagaaataaagaactagagctaatccgagtcagatacgctgtgcaagtatacaacatgtatatgcaactgaatacttaaatgatggtgatgtggaggggagaagagaagagagagaagcagtcatcacacctcatacaagactacaagaggcaacatccacacaaactctaagaaataaaaaaaaagaaaagaagaggggttgattggtggcaagtgtattagaccctgtttagatgggactaaaacttttaagtccctatcacatcggatgtttggacactaattataaatattaaatgtagactattaataaaacccatccataatcttggactaattcgcgagacgaatccattgagcctaattaatccataattagcctatgtgatgctacagtaaacattctctaattatgaattaattaggcttaaaaattttgtctcgtaaattagccaatgtgatactacagtatattaaatg

SEQ ID NO: 83305 - DNA, 747 bp, Oryza sativa
  unsure (1)..(747): unsure at all n locations
gcgggtncnnattgagttcgcccgcgtncgnnnnnnnnnnnnnnnnnnnnnnnnnnnnnnnntataaaattaccaagtataaacaactgtgggaattgttcaggtgtcagatgagcaaaggcaaatagagcagcactgacaagtgtgcaaacgcgggtcccataaatcggtgcgcacgctgaagtcatcgaatcaaagtgggttcgctatcttgggactgcagtagtcaaacacacaatggagctgctctaagggctttcgcagtatgcctaggtggtgtttgtcccgatttctcacgtcggagattctagtctgcctctccgttaccaaatgaagatccacggatcccttgaggcacgttcctcgttaggtttgtcgcaacaagacagggcatggctcgcacgttgcattagaagagggcgttgccctatgctgatgaggacatactccactattacccgctggcaaagacgcaaaaatcgggcggcgaccgtttgagcctctgaataatcccaccttgctttgtttagcttgggaggaggaagccaccttaaaagggagagccaccctttcccctatcggactagtcttttagggagattggacctttttccgagtgggtgtgcctatgaactgttggggtccgggcaaccttaagttattgggcctcggcaaaccccacctgggccggattgttatcctttggtatcagagcttggccctttgttaaggnggtgggaantgatg

SEQ ID NO: 83306 - DNA, 648 bp, Oryza sativa
aggtgaaagaatacatggagagtcaactatcaaaaataagttcttctaatgcagcaaccaagaagcacacgcatgttgacgaggttgtgaaacatcacataggcctgaaggatctgttttagatcccatctgtgtagccacaaagggtgcacctaggagaatgaaaggatgggatgagcatcggccaagattgtgcagtcgttgtcaccaaccaggccatgacattcgccgttgtccagaggcaaagcgagaagagtaagttgatgtttcatgttgtgtacaaatgatttgagtttggtgtgtttatgttatgtgcataacactagtatttctctttgtttgcgcacattactgcaaacacatattgagaatgggcaaatgaatgctttacatcgttgctgccaatctgtgctagtgtaatattaggttggttgcctcatgctagattgtcagattaatatatcctgtataaacttgtagcaaattcatgccacagaacacacctggttaattatatgtagacaagatttggcccttattgagagtctgaaaattgctgtaatattgtatgacataaatttacactgtttggtatgatttgttcaacaatgttctcattgctaaacatttaagatggttacatctttg

SEQ ID NO: 83307 - DNA, 844 bp, Oryza sativa
  unsure (1)..(844): unsure at all n locations
cgcccgtnnttgttgtanaacnnnnnnnnnnnnnnnnnnnnnnnnnnnnnnnnnnnnnnnnnnnnnnnnnnnnnnnnnnnnnnaaataggtttttagtcccggttggtgttactaaccgggactaaagatcatagggccctgacacagcctgacatggaatcaaccgggactaaaaatcatctttagtcccggctagagttaccaaccgggactaaagatgatttttagtcccgggtggtaacaacaaccgggactaaagatcttcctcttattaaccgggactaaaaatcatttttagtcccggtttttaatggaaccgggactattatggatatgggtcgaccgaccaaagatggtttctctaccagtggtaaaatcggatatgacgtatcccccaatttacaaaaccagtgcaaattatatccctcggtggttttgaccccggttttgtcagatgtggtagctgactcagcgtggaacccacgtgggccccacacgtcagcctgttcttcccctcccatctctacctctcttactctcacctctcttctccacgagcggcggcgggtgagcagctgcatgggtggtggccggtgggggagcagctgggcgcggcagagcagcgcgtgggcaggcgcaggcggcggggggagcatatgggcgcgaccggccggcggcggatcagcgcgcgggaaggtggtggccattcctttcctctcttccccatcgtctcctccgcctagttgacccaccaaacacatcgcctatagtttgggtggagggaagttttaggagggattgggagtttagagggatgaggcttataaagggtttggttgggtg

SEQ ID NO: 83308 - DNA, 850 bp, Oryza sativa
  unsure (1)..(850): unsure at all n locations
ccggtggcggccgcggacgttggggcgcatggttggtaagaaagagtgggaaggtttggtgggagcaacggtgaagttgaagtggagaggaaccgaacgacgtggtgctgccgtcgactcgggactccaacgttcgctgccgtcgttttgtcgcgtccatttcctctcctctggtgcaggtttcacctcgttttttcgtctctttcgaattttttttctcaaaccactatggttccttttttttctcttgattaagatacatgttttatctggtgttaacacgtttttccaaaccattaaattgtatattttatacgaaaactttatattgtatataaaaattactttaataattaaaacttaattgattatgatctaatgattttcttattttatatgtcagtactcaatctcatctaaacgcaaatggctgataggccacgtatatgtacttgtatccgtatcactatagtacgtatccatatctaatacggatacgtggcctatcagtcatatccgggtacttaaaaaaaacgtgcgccagtcgtctgtggtttcgatgtcggcaacggcgcgttctgcctcggtgacctccgagctaatgtcgggggtgttcgggctgaataaaaaaaataacctctttcactgatggctttgtcaggatatcgagaaaagtgccgggggtgccgaattcccaagtctggnggggctgctaagcagtgactaaaatnggggcgcactgggnggnngnnnnagcactacgacatacaaacaacgtactcaaactatggaacaagataccaaagcaaaacagaactaagtacgcaacgagatagcaagggtgggagga

SEQ ID NO: 83309 - DNA, 675 bp, Oryza sativa
aggcgcactgtctcatccgtgtcgtttgagaagcactcacttaaactttttagaaaagagttcaaataaaataaattgcgaaaacaacagcctctccttgaagcctgcattaaacacttatttccctggctttgctgagtacttccgtactcacccttgctctatataaatgatccccccccagttgctgaagaagatgaagtggatcctgctgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaacatgactgtacttctactctataataaagagacctctgttgctgtgatactctgtctccctgtgataccagcactgtttcctgggactggtatcgattagcaggttaatttggagcgtcacgggctagttccggtcgggactagttcggggcgtgacattgaggagataccatgaggtaccaaattttacactaattttgagtacctcatggtacctcatagtacctagatactaagaggtaccaaatttacaataagaggtaccaaatttacaataagaaaagtggtaccttatggtacctccttaagt

SEQ ID NO: 83310 - DNA, 1505 bp, Oryza sativa
gtcaaactttatgcaagctatttaagatttgaaattttgcgccatgctgctatagatgcatgaattttatgaaaattttgtgagattatcaaaattttatgaattttattattatctctacacaatatttgaaaatatcgtaccactcggtatatatgcacctattaatgtgggtagaaaaatattgaaatgttgaaataaacggtgcatgtattttcccacagttgccaccagtatatattacatatataaatactgaaataaacagcttagcatccaggcatctttcatctttggctctttggtgatagactactgcttcattattcaatttcatttcatataatatatagtacttgcatgttgattagaagatcttcttcttgttgcttctgttgtttcttgtaaatatgcatgacttctttttttgtttgttttcatacttgggcatcaattatttttctattattatagtgctcacagattatgacgatttcatcacgtcaatctgatatcattcggttctcactagatcttcccagctggaagtagaaaatgcacactttgttatcttttactaagaaattactggttggcaatacatgtcaaagatttatcttgaccttgctactagggtaattcaatttgcaataatccgtagaataatttaactccctaatatataggtttgcattggatgggaagaaaatgactgccgaatctatgatggagtaagcaaaaattaacaagaatttatatgatcgatacaaggacaatcgatctcggctggcccacaaatttcaggtgtgaagtcatcagtcgcatgtttagccaaaatctggagagaccacttgacacacgcaattaatatattccccagtacagtctaaagaaccaatatatattatttgatacatatgttaatatatatactgatgtgactgacaaatagacaaacgagattaaattgtgggttttacaatacctgaatcatccttaagaagcaaaggattatacagcagtgactgatggtgattgattcaacggtgacttttggcgatatgttctgattaaggtcgtccatgcatcaatatcgtatcctgacaagtacgtgtatcacataattcttcactagcttgatttttttatgttgttacttagtaatatactacatctttttctaatatataataccgtttaccttttagcgttcgtttgatcattcatctttcttatcatgaatattcacaaacataaaaaatataagtcatatttaaagaaaccttaattgtaaatcaaatcacaacaaaataaatattaattacatatttttttatataagtaaggttaaaaaatcgattgtatttttaaaagttaacaatatcatatattaaaaattatagtcggagtaatataagctagccccatatatatatatatatatatatatatatatatatatatatagagagagagagagagagagagagagagagagagagaga

SEQ ID NO: 83311 - DNA, 736 bp, Oryza sativa
  unsure (1)..(736): unsure at all n locations
cgctgtcaggatgaacacatcttgctnnnnnnnnnnnnnnnnnnnnnnnnnnnnnnnnnnnnnnnnnnnnnnnnnnnnnnctgcaggatggggaggccgccgtgctgcgacaaggtcggggtgaagaaggggccatggacgccggaggaggacctgatgctggtctcctacatccaggagcacggcgccggcaactggcgcgccgtgccgacgaacaccggtgcgtgttcttgcgttcttgatcgatcgatcggcgagagatccgagatttttgttttcatctgtgcgcgtcgcgtgtgcaggtataaggattatagtttagtgttctttttgtaagcacacttgtgactcatcgcattaaaatgctgggacatgtgttaccatttgcataagctgagcaataccattatgtgtggacttggacttatcttatctgtactgatttagcattgcattgcttttgatgttatggaaacatcgtttatatatctttttactattcaactgagagttatgacatatgaactatgaataattcctgtttctgctgcaacatttgctgattgaggaacttgcatgcagaaaggtggagcttaaatcattagtgccccatttatctcgtaccaaggactttggtgcctcattttgtgaaaataagaaatttctgtgagctgcttcgaaactgtcctactgtaggtttcatggtcttgaattcgtctgcgtanggttttctaat

SEQ ID NO: 83312 - DNA, 3995 bp, Oryza sativa
ctagttaacaccgttaagtgtaaaaactaacggaagtgctacatagggaagaaaaattttagaagtgcctagataggaaacttttgaagtttaggtgctatagagggaagaacaattttttttatgctagatagggaattttttcaaaaatcaacttctatcactctacctactccagcatataaaacgataagttttatccttaaataccttttacctacctattacttttactactttttctaataatgaggagtattttcatcatttttacttcccactattttcttcttggaagtctaggagttgatattttgtgggatggagggagtactgtacgggtgacaagtgacaaacagttcgaaagtttccaaagtttaatattggactccgctacactgctgtacccaggttacaagaaggtagtacaaaattaacgtagaatattattccctatgtttcgaaaagaacccaattctgaatttaaatttggagtttttttttaaaaaagaatttaaatatggacatatagtctgtttagtagagctccaactcctaaatttagcttcagaagttgggtttggagtgaagttgtggagcagcttaaactgttccacctctgtagtttattttgtgagagcgtttcacctagcttcgctcttattttggatagagctaaaactgtttagctgagttctagctcctggacaggtggaggcgtggagcgggagttagagctatgccaaacaggctcgtagtgtatattcaaatataaactcagtattatatttttttacgggcaattgtaaatttaccaatgctttgaattgttattttaaaactgccactagaaaattacaaaaataccactggaactatcattcgagtgtcatccttgcaaaattgaaaaaactagttgcaaatttgcaaatgcctcattttttttaagacagtgggagtactcttgagctattacaattaaaggctagcgaccgttgatctgataaaaactttactgaattattgattatgtctcttggtgaacatgcttaccaagggaaatgtttcgccagcaaacacgtaccaagcaaagaaaatcgtacgcccattggaagtagaagtggaaaagatgcatgcgtgtccagtgatcacatcttaggccattcattgtgggcctccgtggtatccagcctcaccagcaaaaggagaatattcgctgccacgtactcaatctacatagcattctcaagttcgcgtagctaaagttggctacgggttcctcgtcaggtttgaaggagggacccatgcttgacctccgcgctatcagcgaaaggaaagagaggaaagagacctcgtcagcatccccgcactccacgccgctgagctcgctactccgctcgggagaggccgctcgacgccgaaccggactaccccattctacgctgcagcagctgccagaggaggagggggaaagcgcggcggaggagatgagaaggggacagggaggcgtcagagaagtggaggcgctcaaggtcgaggccgacgtcgattcagagtcggcgccgtcgccgctagggctggctagcacctgtgtcgcgtgccgtcaccgctagggctgcgcccagcactggcatcgtgcgccgtcgctcggagctacctccgcccgccgcaactgcgtcgcctcgttgccgtgcccattctgcgccgccgcttgtcgtggtcccccgccactagatcctgccgccccgccgctcagcgttgctcgagggagagaggaggggtggtgtgccgagccgccccgctactaggggtgggcagaataagaccgaaccgaagaaccgagaccgaaaagaccgagaccgaaaaattcattctcaactattgaaagaccgaaatatattcggtttattcggtcatgggcctcaattaaccgaattgaccgaaataacctaattaggcccaacagatctagttggcccaataagcccactaataagaaaccctaggggcaggtgtgtcacaagcattgacgcatcgtttcatccccatccatcgtggagcggtgttgtcccaactcccgtctccatcccatccacatcctccttcgctccatcgccgggcgcagcttccgcctccagccggcgcgccgcctccaccgccgggcgtcgcctccagccggcgcgccttcgcctccaccgcctggcgccacctccagctggcccggcgccgcctccactaattgttgatttgctttgcttttgctgtttttacagatagttttgttgatttgctttgtttttgctgtttttaaggttagttcggtctatgaccgagaccgaactgaactaaccgaagaccgatttgctcggtcctgagatttgttggagaccgatcggtcttgagattataaagaccgaattttcaaaaagaccgatgtaccgaaccgaatttttcggttagaccgaatgcccacccctaccggctgcttcgagccgctccgctgccgattgggctgctcggtgccggcgtcgtgtcggttctgcccgactctctgcggtggggaaaggaagagacgggataggggaaagtgtaaagtgaaaaggtggtattggtgggacccactatacgctacttgtgtattgtggtctcgtggagtttgcactgtgtaacatgtggctaatattgtttttggtctagttgacataggaggtccaccaaaatttggggacgcactctgaacgaccataaaccgcaaagagtacgatgtcttaagtcagttgcctggtatgtaaaatagtaaaaagctaaaagctaaataataaaagtgactaagcctctcatcgtttcttctatggctaattaataagctacgaaaaaaatgaccgaagcataaaaacataatatatgattagacttttcttatacatgttctttccgatttaaaaatcaatgttggaaaatacaccgcgatgaatagctttaaaataagctctaaaaattagattcaaaactcaaattaaatttcgttgcaactgataagccaacaaccaaagtaaaataagtttcaaaattcaaaattagctagtatgccttataaaaagcctgaaagaggaatacaagaaagctgcaaggctcgatcaatctctcatggatagagacacataacaaattatcaatcttgcctccggcgccggtgatgcgtatggcttctcgatctcggctgtggtgacatcgtcgtcgcgttcacctcatgggtgttcccacagatcgatgtctcatgttaagagcttggattgacctcgcggagcaactgggagccaaataaggacaggccgtacatgagtagaaataaacaattaatataacacatcgtacattcatattcccttcgtcttaaaatatacgtaagggactttaagggtctgtttggttgccctcaccaaggttggcccgcaccagtccatgcaaattcctgatgtttggttgcctgcttgggcctcccagcctgtccacgcgaatgcaaaaaaaagcccctcagccaggcccgacagaaacggccgattcccacttcgctgctcggcctggctcgactgatgtacaccgctgcacccgcgcctgcacccgcgcgtgcaactcacggaggatggggtcactgttgcttcccagaatcgctccctccccgcctcacttctccctctcgcgaaaaaactagggtttaccctagctctgacgacggcgaggcgcggcgcggcactgctctcgtcgtcactccggtcgcgagcggcggccctctcctccgactccggctcttctccatcagttcctcccccggcgtcggtcatcctccctctcgtttgccggctctctccgtcgtgcccccctgttccaccatcactctccgttgagcaccagggtaagttcatggatggttgttcgtcgcccattgcaaggttgggcatcctcttccctgtccgtccttccccagttttttctcc

SEQ ID NO: 83313 - DNA, 23006 bp, Oryza sativa
ttcttttgatttaatgtaacacggtaaatataacatgccgatccactcttttgaaaaaaataataattaccctcttgtggtttcacttgtcattaattaacttaagtaattaataaccaatatcatgtacaggcaagtctggaaactaaagaggacagaaccgtcttttctcctgctagttaacactgttaagtgcaaaaactaacggaagtgctacataggctacacagggaaggaaaattttagaaatgtcttgggaacttttgaagtttaggtgttatagagggaagagcaacttttttttttttgctagatagggaattttctcttgattttttgtgagataaaatttaaacttcagaaattaagttttttgggatcgagggagtacgtacgtgtagctttacatcaggcaacatcaggttcattatgaatgttttcaggtggatctgaagcgtatccgacattgtctatcattccattgaaattgttgtcttcagccgtaccatctaatacggatgtgtttaattctttgggtgtaaagttttggaagtatacggatatatatttgaattactaaactgtagactaataacaaaataaattataaattccgcctgtaaactgcgatacgaatttattaagtctaattaatccgtcattagcaattgtttactgtagcatcacattgtcaaatcatagcataattaggctcaaaagattcgtctcgcaatttatatataaactgtgtaattgatttttttccccacatttaataccctatacatgtgtctaaatatttgatgtgatgttcttggcaaaatatttaaatctaaacatacatcaatattctcctcttcttcatgctcagtccaactaacgaattctcgttaggcataaaaccccttaaaattaacggactgtagatcaatcttttgttatggaactgtaccgattctgattcctacggtccaatgagagacgatcttctttcatgcttggaattaatttggaacgttgatcatctaacgctccatgataaaagatccatggaaggacaacaaatgcattccacgctctcttgttcgaaccacgtatattcagctccgattcatttgatctgctgcctgcatacaaagcgttaaaaagaccatccaaaatcaaatggatttgaaaccggcggctcacacagaaatgaaccgacggtaatctgacggttccgataggaagttttgtggtagttagtaaaaatataaagtcttatcttaatatgggcctgtttagttcgcaaaatgaaaatttttgggtgtcacatcggacgtttgaccgaatatcggaaagagtttttggacacgaatgaaaaaataatttcataacttacttggaaaccgcgagacgaatctttttagcctaattaatccaccattagcacatgtaggttactgtagcacttatgactaatcatggactaattagactcaaaatattcgtctcgcgatttcctccctaactgtgcaattagttttccttttaatctatatttaatatttcatgcatgtgtccaaagattcgatgtgatgttttttggaaaaactttttggaactaaaccgggccaatatttctcgctgcttcaacgttatgagttaaatgctcccataacctcgagtatttttatttatgttttcttgactcagtagtcgtattcttattggggcatagatcggagatgtaaatcatttctattattaaaaaatgagttaaatgagaatgctccttttttaacaaaggaagtttacagtatttttttaaaaaaatattttaattcttgtgcaatacattcatctaaaaatccttcgttccaaagaggccaactttgagagagagaaaaaaatcagaaccacacaggaaataaattaaatcacatagtgaggaggactgagttttgttacaatgttaaataaataaaaataaaaataattgtattggagttgcaaacaagaagattttcactttggctagtcttcttaacatgaattgtgcgcagagtttgacacttgatgactgaggaaattcgagaatcgagaccgacagagctgatttgggcctagataggtccacgaaccacgatggcccaaattatagcccaaccatacccagaagagggagccagcgcacaagcctagatagacccgagccgaggaaatcagccagctcgcgcggcagccgacgcgcgacgacggcggcgccccggcgagcgcgcgcgcagcacacacggcggtcgcaggccatcccatcaccgaggctggcatcagcggcggcgcgcgctcgcggcccggtgctgatctcttgcggcgaccgatgttttggttcgctggcgcgcgagctgcggcgccgaggcatggcggctggtgtggtgtgattggccggcggccggggacgccctattgcggggcacgctgccggagatacggcgaggtccatgtggcgcggcgcggtagctagggttccgagagtagccgggacacaaaggcagctatgatatgaggtgcgccccctttggccctaacctttgcaatttgtgcctatctgtctgctttgatctatcatcttgtttggtgcgaatcaggcggtgtgagattgatgcgtgcgtccgtctctactcttatttgcccttgattgtgctaattttgtactattgggttcatgtccaaacttgaggttttgcaatctgacacaaatctagctttgacgattgcctagcttcgatcggaatactagtgcaaattagttgaggtcctaccatttaattggtcctaccatagatgtattcaacttcttttggaagaacttgacatgaccgctgcctaaaactttaatagatgtacaagatgcaaatgaaaatggaaaaggtagtagctctgtataaccattgtcatttaaatacaacactagctaccatcctgctgatgctttatttcatacaccatgtatgcttgagaatatatgcttgatcttaaggatttcggcagaaacttgccccatttcccatcggtccttaggagatgcagcagagcagcatagacctattctgaccaatggaatgatgcaattctgcatcactgttgttatgttcatttcaccttgtagcatcctgggatcaacaatctcataggtattcttgggaaaagctcttgcaacatgttcatgaaggcttgtaccattattgattttttcatcagtaggactactccctgttatcatttccaataaaatcacaccgaagctgtagacatcacccttggttgatatcacttcactcatgccatactctgcatttaatttatgaatgtaataaattagatattttatatgtcctgtctccacaattctatgaagaacaaaaagagttggccattatgaatatggttatctcacctggtgggatgtatcctatagatccctttaggcaagccaaagattttgaacttccttcatatgcatttgaggtattgtttagacatcttgctaggccaaagtcactgacataagcaatcatgtcaaggtccaaaaggatattgcttggcttcaagtcacaatgtactagcggagatgcacattggttatgcagatagtccaaagcaaatgctacatccaaggctatattgattctttggttaaaagtcagagttttcctctcactgtgttcatgagcccttggatgtagccaagtgtccaagttcccgttggccatatattggaacacaagggctttgaagtctgccccattggaatccactgaagagcacagagtgatgatttttacaagatttcgatggcgaatgtttcttagagcttcacactccacactaaagctcctttggcccccataaattccaaggttaaatactttgatggcaacctcatcttgctgacggtctagattacctttgtaaaccgtcccaaacgatcctgtgccaattaaattggcagaactgaacctatctgtagcctttacaatgtcttgatatgttatgtttttcacatggtcattaatttgttggcaatgtgggtttgcttgcatctccttcattccataaattctcacaacataggatagaatgattataacagcaatgatagctggtatcagtatctctaggactagaaccaagatcttgagtttccttttcctctcagccaaaacagaacaagaaggaataccaacttttggaacgcttgtacacaaatgattatttccttcaattgatactgcattgtcaatgtcgaaaacgccacccgttggaatgactccatcaaaattgttgaaggataaattgaggtcatgtagggaactcagcaagttgaggaactgtgggattttcccagacaaattattccgagatatatccatctcttttatacttactaatttcataaaagattgcggaatacctcctacaaagaagttgctttgtatctcaagatactccagagtcacacactggccaagggaggatgggatctctccagacaacatgttgtttgagattccaagtttgttcaaattaatgagatttccaacttcgtctggcattcctccagtcaagtaattgtgtgacaagttcatctcttgagaaagcgaagtaattttgaatattatacttggtatattcccatctaatgagttgtgagcaaggttgagtatctggagttgagtacattgccctatacttgaaggtattcttccactgaagttgttcccatccaattttatatctgtcaactgaactaggttgccaaaaacgtcagggatatggcctgagagcttattttgtgcaaatgatagaacagttaagttgttcagatttccaattgtttgtggtatagtaccagtgaaaagattgtaatccataaacaatatactgagactctttagattacctatttctggcggtatcggtccatagattttgttatttcttagccataatccctcaagattgctagaaagattgccgattgaacttggcaaaattccttggaagctgttcccatctaacatcagttgagtcaatttagagcaattcgagagtgatgtcataaagctccaatcgcccggttctagcatgttgtatgacacatcaagttcttccaaattcggtaatgatccaaagaatggcacgagtccagtgaaactgttattacctaggtagagcatctctaggtggtaggcattgagaagtgaagctggaattgggccaacaaacttgtttgccgggaggatcaagccctgaatttttgtaagtgtgtagccaatatcagagggtaatcttcccacgagcgagttgtttcccatagcaagaaatgtcagggatgaaatgttgaagagagatggtggaactagaccagacaagttgttcacactcatggtcagtatctctagtgttcggatatgacctaagctctctggaatgctaccaactaaattgttcttagaaaggcgaagttcaagtagggaagaaaggttacctagtgagggcggtattgttcctgagatgcaattgtcccttaaggaaatatatttaatgggggaggacatggccgcaatagcgggtatagaaccaacaaagctgttttgttgtaggaaaatggcggtaagtgatgaagtattgaatagagactttgggacttctccactaagattattgctcatgagcctaagtacttggagagatgagctgtttgccaaggactctggtatgcttcctgtgatatcattattcccaagatcaacatatctgagagaaaagctgctgcctagagatggtggtatttcatctgtgagcctgttgctagtgaggaccagtgcttgcagcttagaaagattcccaaaagcagaggagattctaccttgcaaattgtttctgctgagattaatatcctgaagatgtatgcatttgcctaggctagctgggattgcaccttggaaggaattgcttgacaaatctaggatttcaatttgggaatatgaagaaagttgagatggaatgttaccttctaaagagttcatgctgaggttgaggttcctgagttttctcaggaggccaagcttgggtggtatgctgccatggaggctgttgtttgacagttgaagtgtcataagagaggtcaggttggcaatgcaaggtgatatggtgcccgtgatgccttctgatgagagatctattgcaatgacccggggaggacttcgtgagctgcaggtgactccatcccagttgcagaaattcaaggatgtgttgctccatgaggatagaactctagatggaccagagagctgagacttgaagcaaaggagagcctgtctatcgtcagtttcattgcagatggctaacgatatgctgcaaaagatgaagtgacaaagaacccatgcgatgtttggagacaggacactcgaagaggccattgctgttaattccaactatcaacaagagaccttctccgcaaatggctgatcaaatgttttgttggtagtccaagatatagtggcaaggaacaaggaagatgcacaaccagatttgctacctggtgtttgttcaaaacagaaaacctctatccaacactgtcagcaaagcaccttgtaattgagttgcttggaaagggtctagaaaactggaaagtgaaatgtggcatgcaatggaattactagactggtcgttcttggtaggccttttggcactcacacaatcccccatttagttattctgaaactacaagctgatgcccaagatttttgactcttcaggttgccacttaccttcctacatctgctagcctcctagtcctaaagaaaaactaaccccgactagctatgattctcgaatactggtgccatgtgaacgcacaccttattcctgaagagaaatatcgatagatgtgattcttcttgagttcccagggaatataatggatctctgatgatctatctgtctagccaacaaagaaataacctttacaatggctatatattctggagacattgggtagctgaactgaacagccttgtgccttgccggactagctacaacgaatggcattcgccgacagctccgccgcctccgctttcccggcgtccgcttcagccggcgatcctccagctgcaccggtggccgttccaggcggcaaccttccagctgctccggtcgtcaatcctcctgctgcaaagtctccagcagccgctccaggtaaagctaagctactgccccacacaaattgcttccatattttctctctgtatacacatattcattattctcttggtgtttttgttattgatttgtgatatgattaatattggtttggcacttaacggtgatgtgctgcagatccgccgatggatccgagtgacgagggtcgttacttccctacacaccggcttcctgagtatctgaagaatcatccctgagagactacagggacgtgctgggagaaccgtcctccattaccagaagattgtcgagtcgtcgtcaagctgcaagcattgctaactgctagagcagttacctacctactggatactgcgttacatctacgtgtaccgcaggatagattgtaatgttgttttcagatactccggatactgtgaccagtgaataaatcccaggcattagcccggtttctgctagggtttgtgcaattgtagacaacagtcttgtacaataaagcacagcaggaaggctgccaaaatataatatgtacatggttcattgtccatcagtctttgttattgagtgtttttgttgtcttggacgtgattttttcaggcttcagctagctctgagccgctgatgtgcggctgcccgcgcgccaaccctatacgtatataactatatacttatacgtataaaatctaaacgtattagcatacatataaattttatatgtatatacatatacgtgtgtatatatatatatatatatatatatatatatatatatatatatatatatatatatatatatatataggacactcatatggggcaccatggtgcccgggcaccatggtatcaaatacacaaaatcactcaaatttttcaaaattttcaaattgtgagtatatacctagttataataactcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttgaactagttagtaaagtagctaatgttaatatctaagtaattgaaaaagtttcatactcatttgaattaggtatatacttaatttcaacaatggtgcccgggcaccatggagcaccaaacaaatttactatatatatatatatatatatatatatatatatatatatatatatataaagatacatgtactgtataaatgttttggtacaaacataaactttgtataaatacggctaaagggaaaaaagcctgctaaaaaagaaaaacaaaatgcccaatttggcctgtgaaaataaattgggtcggcccgcttaaaaaacaaaagccatccatggaaaaaaaaaaaccaaaaatggaaaaggctaaatcccataggccgaaagaggaatgggccaactgaccgcgtggatcagatcgcgcttcatcagccgctgattgcaacaaatctactttgaatccctcaaataaaggtctaatctaattcgtatctctcaaccgcaaaaccaaatatctcgaacctccacctattaaaaccggtgtaaactgacgggacaggtggcagtgacgacctcggtctcctcctcatggatgctcacgacagtgggctccggtgccgcttgccaccggatgccacagcgctcgccatggatgaagctgcagcctcgtcgcccttaaccggctagccgacgagggagacccacccgtcctcaatctccttctagaggaggattgtggtgacgggctccggtgccgcatacttcttcatccctatttctttctcctccactcttctttcccttctccatcatctcttcacctacatctccccctggtatggcattcatctcctcacataagtggcgccgcacgatggagactgcgtccaccttcgtaatgcctcctgcctcctagccccctcgagctccttcatcactgttgtcctactgtcacccgcctttgttctcttctcgaactcctgccgccttgccaccgctgagatacgggggcaatacaacttcctcaagctcctccgtcactgtcgccttctcctcaacctcccgtcgccatggcaccatgccacccactcttgctgctgctgaatccataagattagggacgaaggagagagagagagtggggagaaagaaagggagagaggatgatatgtgggacctatatgccgactcagccggttagcaaaaccaccgagatagtaattttgtactggttttaatagttgggatttaagatttctggtattatggttaaaggatactaattagattgacgtacgagggagtcacgtggaattactccactgctgattagcgtttcgcctgaggtagtaaggttgggctgggcacttcagagctgagaatatgacaccgggccttcactgctgcacagcttacgtgggcctagagaggtccacgagatacgggcccaaccactagagcgcaccgcacgcaagcccggatagagcccaccgaggaagtcagccagctagagcggcagccggcgacggcggcgcctcagcgagcacggagcccacggcggcagcaggccatcccctcaccgtgggctggcacacagcagtggcgcacgctcgtcgccggtgctgctctctgcggcgaccaatgcttgctctgctggggcgagcgccggtgaggacatggcggctggtgtagtaggccggcggggatgccctctatgccggcgacagcgaggcccatgcgagtatgtggcggccgcgctcgagagggagcggcgcggcagctaggaggtgcgcccctatcctatcctatgaatgtttgatctataatctaattttgtgcgatttacccggtgtgagattgatctggatgcctccgtctccaatcttatttaccttccattgggctaattttgttcatgcccgaggttttgcaatctgacccaaaactaagcttctgcaaataccaaattggacttgatccgagagtagttgtgcaaatcggttgaggtcttaccatttgcttgatgctcatggaaatactcaacttttttagtttttgatgaagaacttggctggagcgctacctaaagttttaatagatgtacaagaataaccataaattagcaataaaaaaaacttccccaacgcccgcgtcgctcgccccagggcgacacaagcggcgacaccgcgcacgccgccacaaacttctcctcctcccctccgcctcgccgccgcccgagcagctgccggcaaagccgcgcggcggcaaggacggcggcggcggggccttctccctctctcgagaagcgcggccggggcaccggcgggacccgagcgaagcggacggcggcgacagtgtccggcgccatctgggccggatgcggcggatccggctccgccggaggtggatttggccttatcgcggccagatcgggaggggcgtgccgctcctgacaggaggcggcgaccgcgaccgttggtggggggggggggggacgacagatccggccactctggcggcggatccagtccccctggatggctgcggccggcgggcggaggtggccgacgccgaggaggtttgcggcggaaggcagtggcgacggcgaccgacggagtcgagagggcggcgacagcagccgacggagacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccacctcaatctcaccgaatttatttctgcgacgatgacgacgcgttgctgctgcggccgattctccgcgacgtgcgctgctgctccttccccggcggcgtcgacgacgaggccaatcagatcgatactccgatccgaaaaatcacaccggtggatgtgtgattagtagatcgatctccaatgctctgatagcacttgttatgaaaatagatgcacaatggagacacaaattttacgtggaaaacccttacgggaaaaaccacgggcgccgatcactataaaggaattggatacaaatgcaagggatacattgggctatcgcaccctctctgtgcggcttacaaaggatatatatataggagaaatctaggagtcctaatagaaaactaatcctataaagtagagtcctgttagataactaatccgaatatattgtgggcccaaaatttgaatcacatatttaacaattggtttgtgatataccccctccatctatttttgatagtcatatttccaaatctggaaaatttatttttgataggtatatttcaattcaacaacctataatcttaatgactttctcggatttaatacatgacccttcattcttccacacttgattggttatatggacattgagaaatgtaaatattaatgaatcacttgattacgagaaatgactagtaacatgtttaaatggatgataagtagaattacttatccttggtctatgtgccaagatgaaatatgactataaaaaaaatagatggaaggagtaattaatattggtttggcatttaacggtgatgtgctgcagatccaccaatggatccgagcgacgaggatcgttacttccctacacaccggcttcctgagtatctgaagaatcatccctgagagactacagggacgtgctgggagaaccgtcctccattaccagaagattgttgagtcgtcgtcaagctgcaagcattgctaactgctagagcagctacctactggctactgcgttacgtgtacgtgtaccgcaggatagatttgtaatgttgttttcagatactccggattatttgacaggaaggattaatagcttattactgcataataccgcaccgaagatgttataaaattaaagctgacaccgaaatcaagtaggtgtagtggctaatccacatattcacttataggtgaaaatttcaagacttattttgatctataaatgagtttcgtggatgagtcacttacacggttacatctatttgttgacaaattttcttaatttgataaatgtaattatggtacaatactacaatcacgataaatataattatagtataattgtattataacttacatgtaacttgtatgtaacttttgaaaactccttcgtagcatgctattttcatgaaatcgaagttgtgggactgaattctctcacatgtatgtacgctgcgtttcttttttccttctttgcctacctgaatattgaaagaaatctagttggttcaaaattttgtgaaatttacgtatgagtatgagttatattatagttacatgtaacttacactataattatatctatcaaattttttatagaaaatttatcgataaatatatagcaaaattttactatattgtagccgaaagcacaaaggttaggcacttccgaattgagaatttgagaccggcctacactgcgacacagcttacatgggcccagagaggtccacgagaggccggcccaagtccattttctcctgtggtaacaatagcccatgaaattcattcatagcccaataccgaggaagtcagccatctcaggccagcggcagccggcgacggcggcgcctcggcgagcacgtagcagccacacggcggcagcaggccatcccctcgccgcggctggcatcagcattcagcagtggcgcacggccgccgccggtgctgctctctgcggcgaccaatgcttggtctgctggcgcgagcggcggcgaggacatggcggctggtgtagtaggtcggtgtggggatgcgccggcgacggcgaggcccatgtggcggccgcgctcgagagggagcggcgcggcagctaggaggtgcgcccctatcctatcctatgtatgtatatctatctgcttgatctatcatctgattttgtatcggggtcatgtccaaactcgagattttgcaatctgacccaaatccagcttctgcaaatacctaattggccttgatcggagactagctgtgcaaaccgattgaggtcttaccatttgctaggccaactttttttttctttttcgaaaaacatggctagagcgctgcgtaaaatcttaatggatgtacaagaataaacttacaggatccaaatgaaatggaaaaaggtagctcggtacaaccagtatcatttaagtagaacactagctatatcgtcttgctgatgctttgtttcacgcaccatgtatgcttgacaattcatgcttgatcttaaggatttcggcagaaacttgtcccatttcccaccggtcattaggagatgccacggagcagcaaagacctatcctaaccaatggaatgatgcaattctgcatcactgttgttaccttgatttctccttgtagcatcgtgggatcaacaatctcactggtattcttggggaaagctcttgcaacatgttcatgaaggcttgtaccgttattgaatttttcatccgtaggactgctccctgttaccatttctaatagaagaacaccgaagctgtagacatcacccttggttgatatcacttcactcatgccatactctgcatttaatttatgaatgcaataaattagagaatatatatatgtccagtctcagaattatatgaagaacaaatgagttggccattatgaatatggttatctcacctggtgggatgtaccctatagatccttttaggcaagtcaaactttttgaacttccttcatattcatttgcagtaatgtttagacatcttgctaggccaaagtcgctcacatacgcaatcatgtcaaggtctaaaaggatattgcttggcttcaagtcacaatgtactatcggagatgcacattggttatgcagatagtccaaagcaaatgctacatccaatgctatattgattctttggctaaaagtcagagttttcctcttgctgtgttcatgggcccttggatgtagccatgtgtccaagttcccattggccttgtagtggaacacaagggctttaaagtcagccccactagaatccactgaacagcagagtgtgatgattttgacaagatttcgatggcgaatgtttcttagggcttcacactccacactaaagctcctttgtgccccacatgtaccaagattaaatactttgatggcaacttcatcttgctgaggttctagattacctttataaaccgtcccaaacgatcctgtgccaattaaattagtagaactgaacctatctgtagcctttacaatgtcttgatatgttatgttcttcatgtgctcactaattagttggcaatgtgggtttgcttgcatctccttccttcgataaattctcacaacataagatagaatgattatagcaacaacaatagctggtattagtatctctaggactagaaccaagatcttgagtttccttttccggtcagtcaaaacagaacaaaaaggaatacctccttttggaactcttgtacacaaatgatcatttccttcaagcgacactgcagcattaatgtcgaatacaccaccccttggaactactccatcaaaattattataagataaattgagggaatgtagggagctcaatgatgtaaggaactctggaatatttccagacaaattgttctgagatatgtccatcctttttatgcttactaagttcacgaaagattgtggtatacttcctacaaagaagttgttttgaatctcgagatactccagaaccacacactggccaagggaggatgggattttgccggacaacatgttgtttgagattacaagtctgttcaaatgaatgagatttccaacttcgtttggtatttctccagacaagtaattgtgtgataagtccatctcttcagaaagggaagaaatttcaaatattttacttggtatattcccatctaatgagttgtgagcaatattgagtatctggagttgagtacactggcttatacttgcaggtatttttccactgaagttattcccatccaatttcagatctgtcaactgacttaagttgccaaaaatatcagggatatgacctgagagcttattttgtgcaaatgatagaacgaccaaactgttcatgtttccaattgttggtggtatattaccggtgaaaacattgtaatccataaacaatctattgaggctcttcaaattacctatttctgatggtatgggcccaaagaatttgttattttttagccataacgcctcaagattgctagaaagattgccaattgaacttggcaaatttccttgtaagttgttcccatctaacatcagtttagtcaatctagagcaattcgaaagtgatgtcatgaagccccaatcacctggttctagcatgttgtatgacacatcaagttcgtttaaatttggcaatgatccgaagaacgggatgagcccagtgaaactgtttttaccaaggtaaagcatctctaggtggtaggcattgagaagagaagctggaattgggccaacaaacttgtttgttgagaggatcaagccctgaattttcggaagtgtgtagcctatatcggagggtaatcttcccgtaagtgagttgtttgccatggcaagaaatatcagggacgacatgttaaagatagatggtggaactaggccagacaagttgttcacattcaaggccaacatttctagtgtttgaatatgacctaagctctctgggatgttgccaactaaattgttctcattaaggcgaaggctaagtagggaagaaaggttagctagtgaggaaggtattgctcctgagatatagttgttccttaaattgagatatttaattggggaagacttggcagtaacagcgggtatagaaccaacaaagctattctgttggaggcaaatggcaataagcgatgaagtattcaatagagacttcgggagttgtccactaagactattgctcattagtctaagtacttggagagatgaactgtttgccaaggattctggtatgcttcctgtgagagcattattgccaagatcaacatatctgagagaaacgctactgcctagaaatggtggtatgtcaccggtgagcctgtttctagcgaggaccagtgttttcagcttaggaagattcccaaaagtagagggaatgctaccctgcaacttgtttctgctgagattaatctcctgaagatgtatgcatttacttaggctagctgggatctcaccttggattgaattgttccacaaacctaggatttctagttgggaacatgaagaaagttcagatgggatgttaccttctaaagagttcatgctgaggttgaggttgttgagttcactcagtaggccaagcctggatggtatgcttccatggaagctgttgtttgacagttgtagcgttgtaagggaggtaaggttggcgatgcaacgtgatatggtacctgtgatgccttcagatgcgaggtctattgcaatgacacggtgaggacgtcgcacactgcaggtgactccatcccagctgcagaaattcaaggatgtgttgctccatgaggataaagctctagatggaccagatagctgagacttgaagcaaaggagggcctgtctatcatattcagtttcattgcagatggctaacaatatggaacaaaagaaggtacagagataaagaacccatgcaacattttgagataaggcactaaaagaggccattgctgtcgattacaaccgtctgagaagagatcttctgtgcgaatggttgttcaaaaatggtactgttaattgttagtccaatatatggtggcaaggaactaggaagataaacagatgtactacctagtgtttgttcaaagttgaaaaccttttgtgaacgcttattacaacatggatggacatcttcttgtcaggaaagcaccttgcaattgagttggtcacttggttggatggaagggcatggaccaaactgaaagcgaggtgcgagaagtgagatgcactggaactagactggtcgctttttatatttggaaagttgcagttgctgaaccttttttttttttatccaaagttgctgaaccttttagcagagcactcgcagaacatatgcattcattcaggcttcccaattttttttcccaaaaacgtcacatcaaatctttggacacatgtatagagcattaaatatagataaaaacaaaaactaattgtacagtttacatgaaaatcgcgagacgaatgacgaatcttttgagtataattagtctatgattagccataagtactacagtaaccgacatgtgctaatgatggcttaattaggctcaaaagattagtctcgcggtttccaggcgagttatgaaattagttttttcattcatgtccgaaaatcccttccgacatcatgtccgaaaatcccttccgacatctggtcaaacatccgatgtgacatctaaaaattttcttttcgcgaactaaccacacccttagtttagagtttctgaagctacatctttcacacaatggttttttttgactcttcaggttcgccacaaccatcttgccaagaaaattcaaccacgactattattccgtgtacaggtgtaaacgcacaccttatttcctgaagaaaaatatcagcgcacgtgattcttcgacatccattggacgggtgcttgaaggcttgaagcataaatagatactcccttctacatcccatcatagtatgtgtcacatctaaccaaaacttcttatatttttattatttatctatttgtcttattaaaagaactaatacaagtatcgtttatttttgttataacttgttttaatcaaacatcgtgctgaaagtcaacggtaccatctatttaaaaaaaaaatgagggagtatcctctctatatcgaaccatgcaaagacacactcacgcacccttgggctatatattctggatgcactcatcgctgaacagcgtatgctctccagtttccaccggcctacctagatcgggagaatggctgacagctccgccgcctcccccattccggtggcctattcatccggtgatcctccgtctgcgacgccggtgcccgttccaggcagtgatcttccagctgctccggccgccaagtctcaagaagcctctccagctggtatctaacaacaccccatacaaaactgtttctacattttctgcaaatatatggagtacatgtgtattgctgctcttggtctatttttgttattgatttctgctagtcagtagttcaccactacatgcttatgtgatgcagttccggtgatcgatcctagcaaagaggagcgtatgggttctgggcatccacttcccgggggtaaagattaaatacactgggcacagggacgtgttaaaaccgttctcctacatcgaatgtccggaactgccttacgtgtactgtgcaccgtgagattgtgatgttgtttcagataatttcagacactatgatcagggaataaatccccactggcgttaggctagttactgctagggataatgcagatcaggctgtgcaattgtagacaattgtcttgtatcaataaagtgcagccagttggtgccaaagtatacctctctacatgcctcagattgttcagcacttcttctgtattgatttttatgtgatatcttcagctagcgctgatgtagcgagtcggcgaccagcgaccactactttcgtaccgcatcagcagcaaagtacgacctccgccggttacaaatatatggcatttgatttttctttttacgatctttgagttgtaactttatccataatgattttttacaataacttcatatacatatagtaataagattgtgacattataaaagttactatcgagggagttgataaatatcgattttagaggtcgatattgtagctgaggagcacaaataaaactcagcccatagcaactgagtagcacaaatactagtagtacagcttaacccgtactacttgattccattccaacatgttacaacttttttcgccgggaaggctgaaggaggccatccaagtatattaagaaggaataaagttacaaaaaaattctggacagagactgtcgaggtcggaggtgcattgaaatgcataaccaaagccacatgctaatcacacaagcacagcccactgagagaaaaacctagcaccgagatgacccccgctatttgtggccgatcgccgccgggccaacgacaacaccacaaagacgagactctaaaagcgatgcctccaaggaggtcacgacatcaaggatgccgccatcgcccatctaaggagatgtggttttcacctagagaaaactagccaagggagaaaggtatccttgccagcgccctcaagggggttacgacgcccaaaagcgtagacgctgccagcccgatgaatcatcaggcgaggctttcacccggaaacccttcaaccttgcttgagatccatcgcccatcaactcagaaaccatctgacaagcagatcagcacgaggcctccaccacaccgcgccggcgcccctccaccggccgaccaccacaacatgttacaactacaacgagatttaatccatcctaagataaacagatctggatagaacctcatcctagttatacattttgggaactgaggaagcagtcgagaaggtggacttctttccattatttgactggatgatagcccctgatttaatcaagcccagatagagccaagccgagagacagagacgaccccacgccggcggaccgggctccctccgcaggaacgccggcgctcggtggcagctcgaactccgagagtagcaggtacgcgcaaccccacgtatgcctgtcaatccatccggacgtgtggcgagatcgatccatgtagggttccgctgtcgcagcctcttccgattaagcgaatttcatgtctggattcgaggtttagtccccaaatccagattctgtagacatctgattaattagctttgtctggataccaattgcatagatggattgcgctctaaccgcttggaattgttcttttaggaatatcccactcacgataattaaagaaaaatgagacattgctaatctttaagataatagattaaataacccggcctctacatccacttggatgtacacagcacatgagacatgctaatgcccaaatgaatgcttccttctgcaaatgtcacaaacggaaatggactgaaaaaagggggaaaacataagatggtacattggtattcttctttacatccatctctgttgctagctacaatcctggcaaatctcttccttcttctagtatagccgtcatcctaggctgtgctcgctcctgagtcacctttccccttgcgctcacagctgttgtagcagggactggtgctcgcgccaacaatgcaaatgtttctcttctcttcattcaccatctatctttgataacgcatgcttgattccaaggatctcagtacaaacttgtcccatttcgcatcggtgtttgggtgaagtcatggagcaagagagtcctattctgaccaacagaataacgcaactctgcagcacctcagttgcatcgatctcatcttgtagcatggtgggatcaacaaccttgaatgtatctttgggaaagttactagcgacaagatcacgcaggcttgtaccgtcattaaatatttcttctgtcggactaatatttgtgaccatttccagaagaagcactccaaaactatagacgtcaccctttgttgatctctcttcgctcatgccatactctgcagttaaattaaaaataagtataaaattagataataggcacagcaaattgttttgcatgggtctaagaaaaacaaaaaaagaacaactttattttaaaaaagctatctcacctggtgggatgtatccgattgatccttttaggcaatacaaacttgttaaactatcttgatctgaatttgatcttgtgcatatgaatcttgctagaccgaaatcactgacatatgcaaccatgtcagggcctaaaagaatgttgcttggcttcaagtcgcaatgtacgagtggagttgcacaacggttgtgaagataatccagagcaaatgctatgtctaaagctatattgatcctctggcataatgtcagaaaatttctttgactatgctcatgttcctttggatgtaaccacatttgaaggttcccgttttggatgtattcaaataccaaggccctaaattctgcccctgtagaatccactgaagagcacacagtgatgactttgacaagatttctatggcggacattttttagggcttcacactctgcagcaaagctcctatgtgctccgtatgtgctaaggttaaaaatcttgatggctacttgatcttgtcggaattccagattgcccttgtaaaccgttccaaatgatcctgatccaatcaaattagcggaggaaaacccatttgtggccttcacaatgtcttgatatgtaatcttctccatgtccccattgaatagtcgcaagtgcggctcttgttgcattgacttcctcgaattttgaggcactctcttccttgaacgaatcattagaaaacacaaaatggtgataacaacaacaacaactggtgtaactattttgaaagctagaaccaataacctgtgcacccttcccctgtccaccaatgcagaacaaaaaggtatacctttcaatggtgcccttgcacataaacgatcatttccttcaattgagatcacactagtgtccagaaaaacaccaaaacttggaagtggtccataaaaattgttgaaggataaattaagattaattagagacttgaaggacgcaaggaactctgggatttttccagacaacttgttatgagaaatatctaatttattgatgctttgcaattttgcaaaagattctggaattatcccttcaaggaaattactttgcagctcaagagattcaagaatcacacactgaccaagagcggatgggatgttaccagacaacctattgtttgagatgctaagtttgttaagattaataagattgccaacttcttgtggtattcctccagacaagtaattgtgtgacaaatccaaatgttcagaaagagaaaagattttgaagatatgaactggtatagtcccatgaagtgaattgtgagcaaggttgagtgttttgagttgagcgcagtgatgtatactctcaggtatacttccactcaagttatttccatcaagattcagttcattcagctgaacaaggttacctatagtaccagggatttgcccagacagtctgttttgtgcaaaggacaggaatacgaggttgtgtaaatatccaattgttggtggtatattaccagttaaataattgtaatccatgtacaacatattcaaactcttaaggttgccgatccctggtggtataagccaggaaatttggttatttcttagccacaagtactcaagactactcgaaaggttaccaatcgaacttggtaggttcccttgaagattattcccatccagcatcagttcagtcaatctggagcaatttgagagtgatgagacaaagctccagtcatttgcttctagcatgttgtatgccatgtcaagtttggtcagattctgcaatgatccaaataatggaatgggcccacataagctattatttgcaaggg

SEQ ID NO: 83314 - DNA, 8097 bp, Oryza sativa
gcatgcctgcaggtcgactctagaagatccccattcctaacagaaataaggacaaatcaccatatgagatatggattggtagaaaaccatcactttcttatttgcgcacatgggggtgcttggcgaaagtcaatgtaccaataacgaagaagcgcaaacttgaacctaagactgtggactgtgtttttctgggatatgctcatcatagcattgcctatagatttttaatagttaaatccgaggtaccggacatgcatgttggtacaattatggagtgtcatgatgctaccttctttgagagctttttcccaatgaaggatatacatagtggttcgaaccaaccctctgaaataattcccagttcaatcacaccaccagaacaaactgaacatacacatgaacttgtctctgaggaggatgtcagtgaagctcctcgaaggagtaagagataaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatgtatcaacctgatgggtttgtagttgaaggtcaagaaggcaaagtatgcaaattgttgaagtctttgtatagtctgaaacaagctcctaagcaatggcatgagaaatttgacaaaacattgacatctgcaggcttttcagtcaatgaggcagataaatgtgtgtactatcgccatggtgggggtgagggagttattttgtgcttgtatgttgacgacatactgatatttgggacaaatcttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatattgaatcgttttggctacattgatagtaagccttctccaacaccttatgatcctagcttgttgcttcgcaagaacaagagaattgctaggaattaactggaatactcccaaatcattggctcgttaatgtatctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcgaagatcccgtgaattagatcctgggaagaacaaaccattaataaactagaggagagtaccaatatatataccctctccaagtgaagatgcatatactctcgtgagctgcaaggcaggttggctatgccttaatgagttctgttggctttaattagcgaagatgttgtccttcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttaagtgaaacttgcttgcacaagacttgcaattcaaggcgtagtccattgttcaagttgtgagtaagtgtagcttggagttctaggtggatgttcaaccttaattggtctccatcgaaccgctggtatataaacagtatattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagccacttgaagcatgtgtggtggagagaagaggggaaacacacgagcgctcgctcgcctcgcctggccgggctgggccgggcagggcaggcggcgcgcgtgcacgacgtacgcgtcgaatggtccgaaaaattggctcctcacccttgcgcagatgcagcctccttttgcagttttgttttgctgcaaattcggatttgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcaacgattgcgaaatcaatctagggtttgcctcctactctgtactgcgccgtcgctcgtagactactccatcccgctcgccggcgtgcaccggcgatcgggagagcaggtctccggaacctctgccttcgacgtcctgcaccgggagaaggcggcaataaggttttttgggaagcgcttcgcgcgactactccctgtttgttcgcgacggctcgccttcctcttcgctcgcgtgtttcatgtcttcgtagacacctgcgaaaagtttcgaccaagcaaccggtctttccgtcacctcggtacgtgttcaatatgttgcgcatatttgatctgttcatgttatactgtgtagtttacatgtatagatctaatgatgcgttcatgctagttttcatctgtaatgtcatgatttatttatggaatagattaaatcattatatatctataatctcaacatttggtttgtctcaaacacgaagagctgaaaatgcttctttgattgcgatgacttcagcgtaaacatcttgcattgctgggcgatcttttggtgtctccatggagcatgagataccaagtttagcaagttgcatgacgcagctcaacattccagtcatgacatgattttcagggtcacaattattctcggtatcttcttcaatgttgaatatgtaaacgtcttcaactccttacaggaaggatcagatgcttgcttgactttattcctcttcttcagtagaatgagcgctaaacatgatgttagagccagacaaatagctataggtcctactatcttaagtattttattggtgtgctttccctttgatggctttacattgcagagtggtaactgtagcaatggatatgtaccacataacttcttgttcccttggataaaaacctcacttgcattctgaaatatcccttcagttggtacctgtccttcaaaatcattgaaggacaaattgagaagcttcatggacccaaaggattccatgaattcaggtattttaccagatagattgttctgagaaagatctaactcaacaatgcctcttaaatttatgaaagaatcaggaattcgtccatcaagaaggttcccttccatacggagagagcttaagtggacacagtcgccaagagcagagggaatttgtcctgacagtcggttattggaaatatttagaatatcaagattgatcgagccaccaatctctgatggtatttctccatcgagttggttgtgagacaagtccaaccattcagaaagagaggaaagagtaacgagttcctctggtatgctactatcaaagctgttacaagacaggtttaaagcttctagattcttgcaactccctaaggagctaggaatcggtccactcaaattattttcctgtaagtagagctcacttagatgacttagattaccaaatgaagttggaatttgtcctgaaattttgttttgggataagcttaggataaacaagtttagcagatttccaagtgaatctggaagatttccagtaagtagatttttttccatataaagaagcgtaaggcttgtgagtttctctatctcttgaggtatggtaccggatatttcatttcctgttagcagcaacacctgtaagcttgttgaaagttttgcgatggaacttggtagggttcctttgaggatgtttttgtccaggcataattgaaccaactgtctactagttatcaatgaggataagaaagaccagtctccagcttctagtcgattcatcccgagattcaattccatcaagtcaggcaggttcccaaaagaaggaataataccatggaatgcattgtcacgaagattaatcacttggagattttttgcaatgcctagtgaagtggggatctgcccttggaattgatttccttgcaagatcagtgttttgatatttggaagggtatatcctatgttatctggaatttctccaatgagtttattagtgcccatgccaaggtatacgagattagacatgttgtacagagaagccggaactgtccctgacaagttgttatatgtcaagtccagttcttgcaagtttggtattctgcttaaactagatggaatggttccctggaagttgttctgtgaaaggtagagtatttcaagggaggagaggttttctatagaggaaggtatgctacctgagagattgttttgggataagctgagataccacagtggtgaggagatatttgagattggtgggatagacccaacaaagttattaactgcaaggcttatgagattaagtgacgagctattaaaaagagcaaaaggaatctcgccgccaagacgattattagttaaatcaagcaatatgagtgatgaactattagctaggagaggtgggatgcctccagtgaggctgttatttgtgagaatgaccacattcagaaaagagttacttccaagtgagaaaggaatattgccgcttaggttgttatttgaaagatataaaactgaaaggttggagagtgtacctaatccttctgggattactccttgaagtttattgtcaaacaagcagatagcttgaagatttgagcatttgttcatgcttgaggggatctcaccatcaatcgagttatttgagatatcaatgatctgaaggttagagcatgaagacagagcctctggtatcgtgccagtgaggccattagaggtgaggttcaggtaggtgaggcgacgcaaatgaccaatttcaggtggaatgttgccagtcaactgattaaatggaaggtggattattgtcaagaaagtaagattaccaatgcaaggtggtatttggccatggaggttggatgactctaggttcaattcagtgactcgagatgtgtggctcttgctacaagtgacaccgggccattgacagtattgcgaagaatcatttctccaggaagccatgactccggcattgtcattgagatggagcttgaggcaaagcagagcctgaaaatcggtagtatctgatgcatcatggagtggtgcagtgggaactagggagaatgcagtgatgagaaagaatgagaagcatgccaataagattgtgaccagaacagggatgctgtgggagcccaaaggcgccatcagttttgctaatgagaattacaatgtgagcaacaggtgtttcttacttgggtacgttgcaaactgaagctgtctggtgtagtggttgttgtgctaatgtacatgaatttatagaccagcagcaacaccataagcaaggcaattgtaatggccaagtggtggagattggccgtactccggcatatacggcaggacctagacttagacgctcatggctttggcccagcttaagatttgtgcttgaactttgcttcggcactttgtagctcaattgggagctgagattaacagttgccacttaaaatatgcaactcatatgtcatgttgtagtgatgttatcaagtgcatcgatccatgtatctgtctgttactgcagtctacattgctaacttagcgtatactctggggtttcactgttctctcgtcgagacaagcaaattaattggacaaagtaactaagataactgcctaactagagcattagaattgtcctgatcttgcatgagaaagcaacttttacaagtgtaagatgtttttactctatattctaaaggtttggttgcagggagttagcaataatgtcagttttttcccaaacacaaccaggctagcaagctagttagagtgtctattctattgctaatccaaactgatattcggacgaagtagtcgtcagcgtttcccttaatgaaacaagcacagtgacagtagtgttcaccgttcactgtctgactctgaaagtctaattgtaaactcagctcgtcaatttttcagtcgaattgcactgaaaaatatcatcttcttcagtcagcagtcaaatgacccgaactaatacggcaatgtatatgcgtagtacatagaatagttcctttaaatctgttcacagatgtctcatcgaaaaaactgaaatctgttcacatattcaaagacttcaaacttgactctgacttcaattactctccatgctttgcttggttgccagaaatctacagttcgggtggatcatctaagtgaaattaaaacgggatagagaacagggttagaaattctggaacgaaattttagaaatttcggtcattttggatacgatattatttcgaccgaattttttattttttttaattttttcatgaattttggtaatatttgttcaaattcaactaaatgttgtttaaaatttcagaaatttcggaccgaaatttccgaatcggtgagcaccgatccaatcggctaaaccgatgggtttaaccctgatagagaaaggattatggccttccggtgatctgtgagtcgactagctaattcgtagtgacagcatgacaaattgacaatagcgtgccaccgtggtagactcgtcccatacatgtttggatgggagcggccggccggcgggcggcgacgccgtgcaagactcggcagtaacaagtatgctctgctgacgaatgtagtcccaccaaatcaggagtcctccactgcacgccatgcacactagtggagaaaccgtctttggtcggtcgcccgaaatccacaatagtctcggttccactaaaaaccgggactaaagacggttggtggctacagcgggcatatttgatcggttggtgttaccaatcgggactaaaaatgatttttagttccggttctaaatctgtcaggccttgtcaggccccctgagatcaccaaccgggactaaagataagggatctttaatcccggttgataacatcaaccgggaataaagcgtatgcaccagcccacgcagaagcgcatgcgtagcccctctctctctatcttccatccttatctctttttcttctccttccttatctccatcctctccatccttctccttccat

SEQ ID NO: 83315 - DNA, 3214 bp, Oryza sativa
ttaagcatgacataagtatttttgtatttgtataaaaaatttaaataagatgaatggtcaaacgttggttaaaaagtcaacggcgtcatacattaaaatacggagggagtataatggtatactatttcgtatttccggtaaaaatatgagctcatttagatgagaaatacaaataaaagtcacggacaaccctgcgatacaaattctgtactctatgtttgactttttcttttcatgtaggtgtcaaacatatagctggaaatatgtttgagagcgtacctaatggagatgcaattttcttgaaggtaagatgaataactagacgtaacatccatttccccttttattgagtatttaaatgttaactataagatagcatggtccccatattaattactatttatcttacgttcataaaaatctatgtgcactgacacaagatgtgtaaaacactattccattatcttaaaatttaaaaagaaattatcgatagcacaagccgatccataggtataatatatacttccttcgtccctaaataattgacgccgttaaattttttaaacatgtttggccgtttatattacccaaaaacttttatgaatatattcaaaaacttgagtagtattagtatatttaacaataaatcaaatgatagaaaagaattaataattacttaaaactttttaaataagatgaacggtcaaacatgttatactatttgttggtccattctttcataaaatgaactatgtttcattttggaagagcaaaggtgcgaaacttagttcattactttactttaaagtaggttgggtttaagacaaaggagtgagtccggctaacaccgtaccaaccctgaaaagtatatatgcattatattttaaagaaactaattatggtcagtttaacatataatacctcaagtcattctaatattttccacattcatattgatgttaatgaatctaaatataacttcaatatgaatgtgaaaaatgctagaataacttatattgtgaaacgagtcgataaataaccaactaacgtggcttgaatatatgtgcatgcagtcgatgctccacctacataacgatgaggactgcatcaagatcctcaagaagtgccaccaagcactcacacacaacgggaaggtgattgctgttgagatacttctcccagcgattccagagccggtcccaacagcacaaaacccattccggatggacatgatcatgctcaacaatcactggggaggaaaggagaggacggaaccagagtttgctaagctagccgtggaatgtggctacaccggtgtatttcaagcaacctatattttcgctaactattgggctcttgagttcagcaagtagttcttcaaaatcatgttaatttggttttatatttattatgtatttcaataagtatatatggcaaagagtaattccgatgccatgcaaatggtttgaaattgtttttacttgtgtaataaaaatataaattaccccctataaatcgaacatcgtactgcaaatggctcatatatatatatatatatatatatatatatatatatatatatatatatatatgtatgtatgtatgtatacatgtacatatattatgtatatgtatatgtacatatgtatacgtatatgtatatgtatatgtatatacgtatatgtatgtatatgtatgtatatacatatatatagatatatgtatgtatatatatacatacatatatgtatgtatatatatgtatgtacatatatacatacatacatacatacatacatacatcatatatatatatacatatatatatatacatatatatatatatatatatatatatatatatatatatatatatatacacacacacacacacacacacacacacacacacacacaccaacgagcggtgaagtttgacactcaactataataagtatgccctaatatgtatggtggcaatcagctgcaacatcataaatctctttatactcctattcctatatactggaataatattatactacagcagttcaagcaacaagctagaaaaaaagtaacaaactcagcgtaaaagtggaattgttacaaggatcagttaaatttgatcaagttaattacagtgtgaatgaattaatttaactggcgacgacagtttcagccttttatggcggtaggtgtgaaatctttttcctgtgtacacacgatccaacggctgttcgtctatatatagtttagcatgtacacatgcataagcataatgcatacgtacatgcgcgtgcacgtcatcaatgcatcgatttcatgctggatgatattccctccgttccacgttttgatctcttaatataaaaatccatttacatccgtatgaatttggacacgtggtatattgtaaatagacccatatataaatttattcaaaacctaaccaaaacacttataatttaaaatagagaaagtaatattaatatatagcaactgctatttaatgtttgttaacaaagatctggtcaaaattttaaagatgtgactgtcgatagtttatcaaatgattagtttaaaaagaaagtaaatggcacgtgtagatttatcttaaaaaatattattataaattatttcctccgtttcacaatgtaagtcattctaacatttttcacattcatattgatatcatgaatctagatagatatacattgtgaaacggagggagtattagattctataaacttatttaataaaaaatcagtcaaaattccaaaagttggtcttgtccttcatgtctgacttgtgactataggagtatatatagagtagtcattccattgtaaaaataaaccaatatggagtaataaatcaatagtactacacaaactcgattggtttatttttgagcggaggaggtatatataatatatatttgcattgatcagtgatctagtaactgacatttctattcaatatgagaagatggacagcccatttaatccgtttgtttgttgattaattaacggattccatgtcgtcgacaaaaagtaaggagaaaaatataataaaaccttaataaataaatgattgggcttgttaatgggcttcctcttcctgggcctgagcggtggcgcgcttgggccgccggcccatctcgtctcatctcccccgtcgccgtcgagctcgacggggaccgactcgttatcca

SEQ ID NO: 83316 - DNA, 2287 bp, Oryza sativa
taaccacacaggggatggtcctcaagccggcaaccttcccatgtgtgtaccacactccgtcttcgtaaaactgagagacgtagtctatggagagcggattgtgagtgtgctcctcatgcaagtcatctccaaagtccaagcgaatactgaggagccgccagaattgcctcctagagatagaacactgaagggtgtcggacatccacttcatctcactatagtctccagccacccacactgtagcatagaactgtcggattaaatcttcattgtagtcttgtttgagagtcacaatccgtcaatgccaacagtcttgaagagatcctgcaagccctcaaactctggagtctcattgatgtctctccaagaaatccacttatgctctgcaaaagctttccctgcataaacttgctcatacacactcttttggaaagcggtgtgaaaacggggattccgggtgtcccgaggcctcaaaaactgatcatggtgcctcaaaatggtatactgcgatggattcctcatgttcacaacaaactggatggagggatcaatgtgcatatcatcacttccttcatcctcatcctctccacttccactgacatcatctccactttcctcctcactagccccctcaacattggcctcaacctcttcatcactttgagcgtactcatctccgcttgactcctcactcacgggatcgggcgtgggctcacgacgactatgacgagtgcggggaggcatttgctgtcaaagagcaaaggatatgggatattagcaataacttttagaagacactatgtttaggcgaaaaggaaactgcacactgcatgtcaggggcggtcagaccgaagtccagcggccggtcagaccggtggataacggccggtcagaccgccgtccacatgtcggtcagaccgtcggccgagctcggtcagaccgtcgaccgctgaccgagctcgatcagaccacctctgacaagtgcacaagaaaatcccttttaccatcacatacaaatgactctaaaaatatttgctacatcaagattgcacaagattggaactagaacatcaaaggattggacctatttcatcaagattggaacaactacccatagccctagggtgaaatagatcgatttgagagaatgcacaagaggaagagtgatttaccggttggaggagttgaatcacaccaagaaactaccctctattggtgcaaatcgaagaacacctcgtgcttcacctagggttccatgccatggatcaaaaactcaacaaaaacacgaactgatacatggaatagagagaggaagcggaggagaatcacttacggtgtaaccggagagaaatccacggtcaaaccgaggggatttggtggaggaaagagttagggtttaaggggaggtgagagagagagagagagagtttttcgagttggggatgaatggggatgagataggagagggtaggtgcgggatggagaagaaaaaggggcaaaactgcctaggcccacctcagccggtcagaccggccctatgtggccggtcagaccaccgcacctggccagtcagaccgcgcatatagcgccggtcagaccgccaggccccctgccggctgtgcacagcccttgcacaagccggcaaccccacacaataaaattcaacaagaaatttgattttttaaagcaatctttgaaatgtgtgagtataaatattgctaaccacccataatatttaaaaattataatgatttgcaacaaaactcacttaagtgctaggaggtgaccttttatggtatataggggtttttgggctaaattgtttttcaaataacttttgaaatatttggtttttgaatatgatttgaataccaaaaacatttcaaatcctcctctttaccaactttgttttgaaacttttctcaaattctctctcaatctcattttggaggaaaatctcattttggccaaaaataagaatatagtttcttcaaaagagggccaaaagggcattttcatttaaaaatcattttccttgcaatgtgaggcttggaaaacatataggaaaccttttgaaacattttccaagagatagttttcaaattacattgattttacaaaagttttgacttatgttgacttgggcattttgaaaatactactagcaccactagttgatttgctcacatataaagggaagtagagcacatgcaagagtgcaaaactcccccttaatgtgacatgctccattttcgcaatgaagaatttagtggcaacaaatccaaag

SEQ ID NO: 83317 - DNA, 900 bp, Oryza sativa
  unsure (1)..(900): unsure at all n locations
cctcatcttgtctatatctattttatgtttctttgtttagattcagatttttcttattatttttaccnacccccccccccagatgcncnntttgatgattgtagctcctccgnnnccagcnncnnnagacncgaggaaaacggcaccccaatcttaaacgnngaaaattatggtaagtgtgttgtgtctgacaactaaaacatgtcaatagcgtggacattagctttctgttctcaactggacatttggtgttcgcgaggatttttagttctattttctttatttgtttcatattgctcatcttcgagtgacagtgcttgccattaggtaaatattatgcatgaatgcatctgaaattactgttgcttagtcctttgtcctttgtctttattcttcatcattgatcatggtcagtgtaatggtgcagaatattattggagtagaagctgctcaagaccttattcaggagtacttgcagaggaggggttacattgatccattgaagggcaatgaaaacctacaatcatcaaatcttcagccttatgtgaagccttctgctgaagctgggcctacccaaaccaagaagcagacacgcacacaaaaagatgcagcagcatcttcttctggccagagttccaaggatcaaccagagactactgaaccccgagttgcttcaagagaggttcaaaaaagaaagcagtaaaggccatctcccttgctgagcagcgaaggttctattgtcttcaagcaagggaaaccttgttcatgccaagcacgccaacacaaccttgttagcaactggttattatgtggcaaaaatgtgtgtgaacaagaggntgaaggaccatgcaatttttgtgtgcacttgttctatggaagcagcacatattgctgtttaaa

SEQ ID NO: 83318 - DNA, 642 bp, Oryza sativa
tctctatcccggcctctctccaaaccaccacctcacctcctcttcctcctcctccccttgcctctccgctcctccccctcgccgccaccgtcaccaacacagccgccaccgcacttgtaggagcaacgtgtcatctccggcggcggcaacaggggcgctaattctatgccgggggtgacggcggctatggcgtggggcgagcgtggagcctgattgacgacaacctggacgttgacgggggcttgtcctcgcctgaaccgacgacggggacgcgtccatgctaggggcaacaacggtgtgggtgagcaacccctcctctctgccccttcccaccggcgcttggggcggccaaatccgatgcctcccaacccagctccacgccctcttcggcccaacgcgacgtgcgaagcaacttctccacgatgatgagtgcaggttactccacgacgtgcggatggacttcattttttttctgatttgtttatcttgtacttttacctttgatgcatgcaaataatttgtgtcatggattttgattggagtgatggaattcttcaattgagccaaaaattgctttgattcgtgatgcagatggatgtgggatggatggatggcgatatgtacatgtgggataggagctgc

SEQ ID NO: 83319 - DNA, 657 bp, Oryza sativa
ccactaaaatcaagatttttatgtggtttcttcacaagaaagtaattctaacgaaaggtaacctggctaaaagaaaataggggggagacaaacattgttctttctgctatgcacaacaaacaatccaacatcttttctttgagtgtcatgtcgctcagtttgtttggagacgtgtgttttttgtttttaatatccccccggcccaccccataacgccaaaaacatttttggtaattggcttagagaggtatctaggtccattaagaagatgattctaatttgagctagcgctgtatgttggtcaatttggcgttgtcacaatgataaagtttttaatggtaaacaattatctaaccctatacaggttatcttcatatcttcctactggctccacttctggtctacaatgctaccacaggaggagcaggatactatgcgcaatggtgctatactcttggaatcggtagccaagggtctcttatttcactatgggtggcgtagttccataagaattgctagctaaaatattttatgtgatttaacgctagttaataataaatgggagttggggatttgtcccatcaccttatttctcattttgatttacttttatcttacctttttattactattaaacttatggttgtgtgtcttata

SEQ ID NO: 83320 - DNA, 645 bp, Oryza sativa
cttccaattttgatgtgaattaaacacacccttaggcgtcacattgtgacacgctgacagccggagctcggcattggcattgaagacgacatggacatggatggatggaagcgatacagtgcaggcccccgacactagtgccacaagtttcttctcccggtgtccacacctgcatctgcactgactggcgtacatggatggcccacgcatgcagggtaacctttttgtcaactcaaaccgtgcagacttgcaaaaaaaatgcgagcaaattgcaaacaaatttgcaatgcatgtgagaaggaaggaattggccaaagcagaattgcaggaaaaggtctcaccggctgccattgcaaattccatgcaaaaccttccttccccctttcaaacgcagagcccgcccacagcccactttgcatgcttcactttcacaccaccactgcctttaggctgtgttcagaggttgatgttgggtgctaatttctcacgcacgtagaatggaatgattcattaaagcatgattaattaagtattaactcttttttaaaaaaaattaattaacatgattttaaaacaattttcatataaaacttttctttaaaaaagaaaaaaacacaccatatagcagtttggtaagcatgcact

SEQ ID NO: 83321 - DNA, 3590 bp, Oryza sativa
  unsure (1)..(3590): unsure at all n locations
accttctctgtgcgcgagttcctccgcgaccagtcaggctgtgcgtgggaccgccgaacctgggtcctccaaaactggagtgcgtcgctccaggtccatcctccaccctagcgccgcgccgcgtgctccctccgcacggtgagccgagcagctgacaagcgggtcccacccgggaccgcgcgtggtgagcccggtccaccggactctctctctccttccaccgcgcgcgcgcgtcttgggccgccttgggccaccttcttgggccggccggcccgttaagatcagccgagccgccctttctctcgggccgcgccctatccgcccgagggaagtctatattccctccctctccctttttcttttcttttcttttccaaaaaggatttaattaaatccttttcctttagaccaaaaatccaataatcttagaaattcaatatcttccccaccgtaaatccgtttgactccgttcaacttccaaaattccccaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctctggatctcgagcaaggcaagccacctttgaacatcttgagcctatacttgaaatttaattatattgcttgcaaaatattatgcattgataggatcacacttaatctgttgttccgtctgcaaggcagattggcggacctgcctaatttgttgcatttgatccttcctttgttaattgttataccatgtccccttgtaaccacccagttgcgcctcgatattcgtgcactctgtgcgagtatcgacggtcgccttcaaacttaaaatctgagaaacaacttgggtaaaacttgggttttacaaaagacttggaaaacccgacacctgggtcggtgcttgcgaactaaatgaatttctaaaaccgcggaccggggaacataccgggtgtacggttttcccgctcccgcacttaaggaccgattccttggaattacatccgaacataggacaagtgcgaccacatgggtggaatgggacacccctggctgagtaactagcttatcaggggagccatgatgccgagagacatgtggattcgccggggtggtgtcagagaggacccctgggcttcctggcacagtatggtctaggacctaacctgttgttggtctgggacccctctcgtcggcatatggtaagcctgtgtcggctttggaaatgccttgtcatgaaagcttggaggtctcccgacgtggctgatccccacgggctgggtgatccgggttagtaatatcgtgtgggtaaagtgtaccccctctgcagaggttaacaaactgttcgaacagccgtgcccacggtcatgggcggatgtgaggtgattcctagcgtagttttgtttgacaactgcttgtgaaattactgttgtgaaaaagggttcgatgtttggaaaatcagcagctgacgggatcagctagttcgtggtggccacttgaaaagttgttggcccgggtggccgtttgaaaaactgttggccgggtgccaaccttgttctaagatctaaagattgatacattgcacatactctgaccggacgggacgcactgtctcaaccgtgtcgtttgagaagcactcacctagatgtttttagaaaagagttcaaataaaatcaattacgaaaacaacagccttcccttgaagcctgcattaaacacttatttcccctggcttgctgagtactcccgtactcacccttgctctatataaataccccccagttgctgatgaagatgaagcggaccctgctgatgaggagttcttccaggagcaagccggttacgatgacttttagggtttcggcctagttcccaagtcgcgcctgtgttgtttggtccaagtcccggcttccgtttcccttttgtaatgcagttgtgagctcgggatctgtccacagcccaacatgactgtactcctactctataataaagagacctctgttgctgtgatattctatcctcctgtgataccagcactgtttcctgggactggtatcgattaacaggttaatttggagcgtcacgggctaattccagtcgggactagctcggggcgtgacatagagtatactcatgtctcttgttatatttttaatacaatgtaattattttaggtgtgtcgaccgagtttttctctcttttattaaaacaatgtattgtctttttcgtgctaaaaaattcctacaattttttaaatttgaaagtgtggacaaagagggcagctgggcctcacagttaaccacatttaagacgcacgcacagaaaagatcttcttcaacattgcatcatccaccctgtcgattgaatgctgaaaacaacaattccagcttgggcataattacaggatttcaaacttactttattaagtacattgttttgtaatggcaactaacccgatatgtacattggccgttgaaaaccacacatccacaaatctaataaaacgcaattaaacatcatcctgtcgtacattcagcgtgattataaaataatgcaaagaggctgatatttttaacctgatgatgatcagatcacattacgagcactgcatgaaccatcaaaaagatcatcttgaattagtcagggtatcagagaaagccaggttacggatggctatataggacaaattaacacggcgataattacatagtgcgacgcatgcttttgcacatgattctctaaagaagaagaagaaaaagaaatgctcagcgatgccatcggctaagctaataatatagttaatctaaccaatttttggctaacactatagtctaattattaatcattggtgatctggtgtgactcgaccagagcattttccggttgcatccgacgtagatccttcggctggtagctgatcgtaactagtaggtgtagtacatgttcgatcgatatctgtacttgttttttttcagaggaaagaaagtgagatccagctaactagtattatagtacttttaaaagtattttttatatatatgctatcagtttgttagcttttgcttgttgctaaattaaattattgtagcctgtaatggggaaaattattagcatttatttacaggttgtttatttgtgcagatcaattggtgttcttgtcctgcagacagatcaaatgattttttttatgagagaataattgattagtttaatttgctacggcagatcttcctcttaagaaaaattgacctcattatcatttctttaatataagtcccataatacaatctttgaagaatcaatattactaactatataaccaatcattagatattctcttatcattagtgtatagcagaaaaatgtacagattacctgctagctgaatagatggcaacgttatcagccgtatcaggcaaaaataattccatcatgggggtttgatgaattggtcaggaactttgaagggannnnnnnnnnnnnnnnnnnnnnnnnnnnnnnnnnaaacggaggtgcatntcatttcatcgcg

SEQ ID NO: 83322 - DNA, 1762 bp, Oryza sativa
gcgcgccaccgcggcggagaaggccatccggctgctgctcaagtcgccggccgtgtcgccgtcgtcgtcgccgaagaagtcggcctcgccgccgtcgccgccgccgccgcaggaggcgaagaaggagtacccgcctgacctgacgctgcccgacctcaagagcggactgttcagcaccgacgagttccgcatgtacagcttcaaggtgaagccgtgctcccgcgcctactcccatgactggaccgagtgccccttcgtccaccccggcgagaacgcgcgccgccgcgaccctcgccgctactcctacagctgcgtgccttgcccggagttccgcaagggcggctcgtgccgcaagggcgacgcgtgcgagtacgcccatggcgtgttcgagtgctggctccacccggcgcagtacaggacgcgcctctgcaaggacgaggtcggctgcgcgcgccgcatctgcttcttcgcccacaagcccgacgagctccgcgccgtcaacccctccgccgtgtccgtcggcatgcagcccaccgtatcgtcgccgcgctcctcgccgcccaacgggctcgacatggcggcggcggcggcggcgatgatgagccccgcctggccgtcgtccccagcgagccgcctcaagacggcgctcggcgcgcgggagctcgacttcgacctcgagatgctcgcgctggaccagtaccagcagaagctgttcgacaaggtgtccggcgcgccgtcgccgagggcgagctggggcgccgcggcgaacggcctcgccaccgcgtcgccggcgagggccgtgccggactacaccgacctgctcggctccgtcgacccggccatgctgtcccagctccacgcgctgtccctcaagcaggccggcgacatgcccgcgtacagctccatggcggacaccacgcagatgcacatgccgacctcgccgatggtgggcggcgcgaacaccgcgttcgggctggaccactccatggcgaaggcgatcatgagctcccgcgcctcggcgttcgccaagcgcagccagagcttcatcgaccgcggaggccgcgccccggcggcgcgttcgctcatgtcgccggcgacgaccggcgcgccgtccattctctcggactggggctcgccggacggcaagctggactggggcgtccagggcgacgagctgcacaagctccgcaagtcggcgtcgttcgcgttccgcggccaatccgccatgccggtggcgacgcacgccgcggcggcggagccggacgtgtcatgggtgaactctcttgtcaaggacggccacgccgccggcgacatattcgcgcagtggccggagcaggagcagatggtggcatgatcatcagaggctcatagcaacctagctaaccaaaaaaaaagaagttctttctttcaattaatttttccccttcgtttgcttaatttgattcaaatgagatggttttttagtacatatttaagctgttcgcaaataatattgttcatcaacaaagaagcatgtatacccaaagggagctctagattgatgaagaacagctgatatttactctattaatttttgcccctctctttgggttttataaaatagttgtatacaagaattccaacaagagtttttattttactcgatatatattcatatatatctttgggcatcagtaagattttgatccatgtgctgtctgtcttatgttattaaccatgcaagattcatgttgttcatcaggaacatatgcttattatcagc

SEQ ID NO: 83323 - DNA, 17129 bp, Oryza sativa
ctgttggctcaagcccggcccgtgagcccccgaacccattcatcatcccactagcgttagcgtaggcggaatagcatcctagggcgcacgcgtcacgccccgtccctcctcccccatctctcctctctcgaggaactcaatcacgcacaaaaattaccagattacccccaaccccatcatctccgatctctctctccaccgcggcgtctctctctctctctcctcccccacccccaaccaccacttcctccatcaccaaagcgccgctccctcgccgtcgccgccacctccgccgccgccgccggtgccggtcgtcgaggcgggaggactcctccccgcgcgccgcgctcgatccgtccgctccccagtacgcccgaggtgaggcccgtccccttcgattggttccttccttcgctctcacttttcccttccccccagtctggaatcccggcgactgaccccccctgtttcgatctccgtgcgcgggggagcggtcgatccggtcggtgaatgcggccggggttagctttgggtcgccccgctgctggtggcttgtcgagagtggataggccctagggttcatgtgtgactttttgcggcgcgccaatccgtagtaagcatgaacacactgataggttctctcttttttttttgcgaagtttgttgagatttagaagagagtttaggttacaaatacgacattaatcccgcaagcagctgccccggggtaaaagattactagcatcccgtccaggacgagcctgactaccccactgataggttcaaccggcgtatggaacctcgaggataggttctctttgtgtatagaacacactgataggttctcttcgtgtatggattatccaacgggggatggattgagccttccattggacgtttggctctgtgtgctggttgctagattggatttagaatatgagagtcatgaatcgtgttgcattattatactagtgaaatggattgtttcttcactgagctatgtgtttcctacagtgatgcatcttctataagctatcgcgattgtttctttaacagattaagcgtggtagttgctatgttatgtatcaagagagaaggaaaccttcacgcatatatgtggttttaatggttaatgtttgcaatgttcttgaggcatacagttcgtacacatggagattctttaccgattgtttagaacaaccgagttagttcaagcaatgcatatataaagcttgaaatggaccttttatgttctgctctgtagtgggaacacatgcactgtgagtgatcttggattctgggatcaggcttacatgatcatttcgtttcctcccattcttttgatttcagtgtcaggaggatatgactatgttaggtcattttggcgtgttctaatgttgttattatgcagaatagaactctgcaacttgtcgttcagcattttcttgtcccaaacatatttcacttacctgtagcatctagacaatgttctaatcttttgatgtttttatctcagaaacaaggagaaaagttaaatacctaccgttgtatggtttaccattgtactctttctgtagcttcttgatcactaaatatttacatttacagtttctgaacctgtgttatgcttgctgcaattcaacgcagactgatttaatagcagttagactctatcatacatctttcaaaaaaaatttctttctggaagttttctcaatgaactacttacatatctgtggttttttgacttggtacagggcagtgatactctgctgcttagttgggtgcagtgtgcactacaagtctacaacaatggagcttgacagtctaagagaggcgtttgatcgagttattgaaaaacgtgcttcctcttctgctaaagctcaggaagttattgatcagatagtgagtgaagttgagcaggcaatcacgaagatgcagatgatgaatacagattccatgggtactgctgaccattcatccatcctggcagaattgaaagccaagttgaatgaattggcgccactaaatcaactagaaggttgtcaaaaggaattgaatgttgcacttagcaaatatctcaagctgctcgagaagtctttcagtccagacatatcgaaagcatatcgaaatgtggattttgaggccagtactataaacagcataatagcaaatcatttctaccgccagggcctttttgatcttggagactcatttgtccgtgagtgtggtgaatcagatggggcacacttgaaactacaattccaagagatgtattcaattcttgaagcaatgcaagttagaaacctccaacctgctctcagttgggctgccaagaaccatgatcagcttttgcagaatggttcaatgcttgagttgaaacttcatcagcttcagtttgttgagatactaacaaaaggaagtagagatgaggctttaaagtatgcaagaactcacttagtgccctttgcatccttgcacaaggcagagatccaaaagctaatggcctgccttctctgggctgataggcttgatcagtccccttatgccgaattcatgtcatcgactcattgggagaagctagcagaggagcttacccatcaattctgcagtcttttggggcaatctagtgagagcccacttggtgtggcagtatcagctggctttcaaggacttccaaccttgctgaagctaacgacagtgatggctgccaaaaaacaggagtggcaggcgatgaaacaactgccagtacccatagatatcggaccagaattccagtaccactctgtctttgtatgtccggtgctcagagagcagtcgagtgatgaaaaccctccaatgctgatgccctgcggacacgttgtgtcgaaacaatcgataatgaagctatcaaagagcagctccagacccttcaaatgcccatactgtccctcagaggctgttgcttctcagtgcaagcagctacatttctgaatgttctttccctgctcagatatgtttatacacgtgttaatttatgttcctgtggcacccatccaataactaccttgtaatataatcctgtatgttaatgaacattctagtgctgtctctggatgttaatctgtacagttgcaaattcctgttcgttttatcaaattatatctctggcatgactgaacagaaaataagtgctactagtcactctggcagtcttagggcttatgattgtgtattggttttacagccatgtagatcggtcaaatcatgtgtaaaattggcagtgagcctttctgtttaagtttcctgctaaacatggtaatgaacatttatctggccaattgataccgaatagattgctgctattagcttatctttttataagcattttgtgttgttagtaacttagcatgtcttttgttagcaattagggttcgatccatatgcttgtctgctaatactttgtaaattcattaaaaaaataaaatactacttctgttttaaaatataaacgatgttgttgacttttagacatttgtctatttgtcttattaaaaaaatagaaaaaaatacataattatggagtatatttattttgttatgagttgttttatctcattttgttatgagttatttttatcactataaatattttaagtataatttatattttacgtatttaaaaaattaaacaatatgaatggttaaacgcgtgctcaaaagctaatggctttatttattgaaaaacggaggggcatgaagatcgaacaaatcatactggttaatcgcttaacaaattcttggctccgcgccgtgtaatgtaccaattctctgttattagtaacagtacgcaggtcatccatctagaaaaatgaaaatgacaaaaaaaaaaaggtaaaagaaagtagtaataaggatctttcaaagagaaaaaaagaaaaaaaaaagaagaaaaagctcgccgtgccccgtcaccgtcttttttacctccgtgtctacttgtgcttgattgacggttgtgattttttttaaaaaaaagaaaaaaaaagctcgctgtggtccgtccatccaccgcacggccggcgacaccggcgattgccagggctcgtcggcgagcggcggtgccggccgaggtgctgggctgctagcgcgagacgaagcggaacgagctgtggcggcgaaacgcggccgccgaggcccaactgtccaagcagcggcagcacgcgggcggcgccacaaccagggcttccgcgaccatgaggtacacgctcattcactcatccgtctgtctgattgatttgtggttgggattttgggctggattaggctgcgctagctagatcgatctgaatgtgcatccatctacactctgctctacttctgattgggcgaatttcgcgcttgattcatgcccgaatcggatgtctcggtcccaatctgacacaaaatcagcctctagaacatccagttggcttcaatctgatgctagttgtgctaatcgatttagctctggttgcttgaactgcgcttgtagttattcaatttgaagagttaaaaggaatgtggcacgaatgctaatgccactaattatgttggttcaaaaaaaaaaagggaaaagaaaagctactaatatgttacattactattcttctatacatgaaattgccaaatcttaatttgcctcatctgacacccatgtttgaggctgcatgtttgattctaagaatcatggtagaaacctgccccatttctggccgctctctaggcaatgccattgaacatgagagtcctattttaaccaatggaacgaaacacctctccatcatatcggctacactgatatcatcttgtagcattgtgggatcaacaacctcgtgagtattatcgggcaatgctctatcaacaaaatcatgcagggttgtgtcaccattaaaattttcatcggtaggactgctacctgttaccatttctaagagaaggattccaaagctgtagacatcacccttggttgagatatcttcgttcataccatactctgcattcagatttatagaaatcataaaattagaaaccagacaccatgtgtaccataaatagaatgaacaacttacaaattagcttatctcacccggtggaatatatccaatagatccttttagacaagccaagcttgttgatatatctttatgtgcattcgatcttgtgtatacaaatcttgctaggccaaagtcactgacgtgtgcaaccatgtcactatccaacagaatattgcttggcttcaaatcacaatgtactaatggcaattcacactggttatgaagataatccaaagcaaatgctacatccaaggcgatattaattctctgtcttaaagtcagaacctttgtttgactactatgttcatgggattttggatgtaaccacatatctagattcccatttggaaaatatgggaacactatagccttgaagtctgccccagttgaatccacagaagaacatagagtaataattttcacgagatttcggtggcggacattttgtagggtttcacactcggcaacaaagctcttattagatccatggatatcaaggttaaaaatcttgatggcgatatgttcttcctgaagatgcagattgcccttttctttgaaaggaaaatgcagattgcccttataaactgtaccaaatgatcctgagccaagtaagttagttgaagagaatctatttgtggcctttagaacatcttcatatgttatgttcctgtgctcattcagctgttgtacatgtggctctgcttgcattctcttcatacaaataatttttgcaaggcataataaagtgaaagtgatagcaacaattggtattactatcgttaggactagaaccaatgacctactatggttccttttcttgtcaaccaattttgaacaaagaggcatacctgtcgttggagtttctgtgcacagatggtcatttccttcaattgacaccacactagcattggcaaaaataccactgcttggcaccactccatgaaaattattgaatgataagttgagaacttgcaaagaacgcaacaacgttagaaactgtggaatttctcccgataagttgttatgagatatatccatcaccttgatgcctaacatgttcacaaatgtttgcggaatgcttcctacaaagaagttgctttgcatctcaagatactctagaaccacgcattgactaagagtggatgggatatctccagacaatctgttgtatgaaatgataagcttattcagattgacaaggttgcctacttcatctgatatgcttccggacaagtaattgtatgacaagtctaacaccattgaaagtgaagaaattttaaagattgtctctggtattgttccatttagtgaattgtgagcaaggttgagtatttcgagttgagtacaataccctatactcagaggtatgcttccactcaagttgttcctatccaaatttagataattcagctgaacaagtttcccaatgttgtctgggatttgaccagagagtctgttttgagcaaaggacagaatgcctaatttgtgcaaatttccgattgttagagatatatttccagtcaattgattgtaatccatgtacaactcagtgaggctcttaagattgccgatctcttgtggtataggtccggaaattttattatttcttagccacaaccgttggagactactagatagattgccaacagaacttggcaggtttccttgaagattgttcccatccaacatcagcttagtcaatcttgtgcaatttgaaagtgacgagataaagccccagtcgcctgcttctagcatgttgtatgccacatcaaggtcctccaagtttgtcagtgatccaaaggatggcatgattccagttaacttgttttcagctaggtaaagcatttgtagatgggttgaattgagaagagaggttggaattgagcccttaaacttgtttgctaatagaatcaagccttcaatgtttgggagtgtatagccgatctctaaaggtaatcttccggtgagtgagttatttgccacagtaagaaatgtcagggatgacatattgaagaggggtggtggaattgtcccagagaaattgttcaaagtcaacatcaatgtctgtagcgttggaatatgtcctaagctctctggtatgctcccatctaaacaattctgtgaaaggcgaagataaagtagggaggaaaggttccccagagaggaaggtattgttcctgtgagacagttttctcctaaatcaagatattgaacttgtggagagacggttttaacaggtggtatagaaccggaaaaattgttctggttgaggtaaatgccgttaagtgacaacgtgttgagtagagcctttgggagttctccactgagactattgctattgagaatgagttgttggagagatgaactattcaacatgggctttgggatccctccggtaagagcattcttcccaagattgacatatgtgagtgtaaggctactgcccaaagagggtggtatgtcacctgaaagtctgttgtttgccaggaaaagtacactcagtttaggaaggtccccaaaagcagaggggatgctcccttggagcttgttgttgccaaggagaatttgttgaagatgcacacattgacttagactaggtggaatctcaccttgcagggaattgttctgcagatctaggatctgaagttgtgaacatgaagagagttctgatggtatgttaccttccagagagttcatgctgaggtcgaggttctggagttcgttcaggaagccaagctcagacggtatgccgccatggaagctattgtttgatagttgcagccttgtaagagaggtgatgttggcaatacaaggtgatattgagcctatgatgccttcggatgggagatcaatggcgataacacggcgaggagctctcctgctgcatgtgactccatgccagttgcagggtaacaaggatgcattgttccatgaggctagaactccagttggacctgagagctgcgacttgaagcaaaggagagcgtctcgatcagtctcagtttcatcactgatggctaatggctggaagaaaaggaaatgaaatataagatggcaaatgacgcctgtagagaagactctcaaagcagccattgctgttcgtttttgagagaatggtgggaacttggaggatggcatgatgcatgcttttgtagaagttggaactgaacatgcttcaattatcccagtaaaaaaagttactttttttaaggaagtctaaaaagtggcttgaattgtttgggagtaattggagtaaacgcttgtacaagtcactgtgagggtacaaagtctgagctaaattatttggaaggttaacaaaaaagggtcgataatcacttccacatccgtgatccatcgacgattcggcacaccaatacgtgtgagttgaaatttactgtaactcatctttccaaataattgttattgtacaccattaatcttcaaacttttgacaactcattttctttaaaggttttctaaatacttaattaaaattaccatattattaataaagcatattaaattctaaacatattcattaaactctactttatattattataactatttaagagctatcagtactcgaagttgaaacgaaggaagcacaaattgttcatattacgtattggatcgttgaaccagattatttgtcccatactttaaaagtacattattttaaaaataatatcttttactgttttgtctagatcactttaagttagttgttaagtttatttattaaaatatttactttatcactatacttaaatagataatccgtgacaacaatctatccaataatttatttcaaactgagccactagtcttttccttttggtcctatgatccttactgaagtggagtaggagtactactcagtatactaagtactgttagtactccctccatttaaaaaatataaagggcctcatcttttcgcttatgcttatgtttatcagccaaaatttgaattttcaaccttaaatttggttttcatcgaagtttatttttcagcctttgcttttagatcgctaagaacacatattaaaagtttattcacaatttactttttagtctgcaaatatgccgtttggcttattccacaaataaacgaaacaatggggctgaaagagttttggttggatgagatacatcagtttgtccagattcgtaatagtaggatatgtcctaaccaaaactctttatattttggcagtggcgaacccaaagggtagtccatgtaggcccaggactaccctagaatttggcctagaaaagactagatattcatttttcttggcccatcaaaaaagtatggcctaacaaaaaaaaccctaaggggctgtttgggagagctcctctacaaaaaaaatgagctcctctccaggaaatcttctccaccgggagctcctggagctagcacctgtttgggtaataatacatatggtccagctccagatttggtaggaggagtgaaaggactgttttgcccatggatcttgtatggatgttgattactaatatatagtgatgtttaatatttctcacagccataacaataataaaaaataaaatatattacaaaatagacttgttgcaagacgatacaagtagctatttcaagaacggtacaaaattagctcgaatagctaatttttttataataaaaaataaaaaaattataaaatagacttttttcaagacgatgcaagcacctatttcaatcctgctgcgagaggtaatgttgcagcaaaacgcgaaaacggccacgatcgagctacacagtagactggagagcgcacagtcacagtgcaaagcaacacgcatggcaatgctgctactgtactagggaattgcacctccgagtagctaatttttttatcgtaatatttattttacatcttaatggaacacatgcaaatctgccgcaattgagaaacgagttgggagcaaaatccgcacaaggtaccacattttaatcaaaggttcataattgaagtccaacaaagatacattatcatcttatgtcttacaaatctagcgccaagaaattgataaagcggtggctagttcatcacggaagagatccatagttcctgcacttctttcgggagttgactcatcagatgccgttcgaggaactgcgtatttgttgtaccgttctggtattgttggaataaaattagggtcacgatcaaacctagcaaaatcaggatcctcacctccatgctcacgaatgtaattatgaaggaccatagcagccacaacaatcattttttgcttgtacatggggtagcacggcatcttgtacagaatttgccacttcatttttagtaatccaaatgatcgctcaataacattgcggatggaagagtgcacacgattgaatttttccattggagtattgggttccatacctctgtgccactctggtaaatggtatctctcacctttgtatggagcaagataaccgggacgattaggatatcctgcgtcaacaacatagtatttgcctacaaaagatagcatagtatgattattgatacattttagtaacacatgcacagttagcacaaatagagagcataatacaagtgtggtaccttgtggaggatgagggaagaatttttcatccactcttaatgcattgtataaaacacttgtgtcatgcatagctcccggttgacccgttgcaacataagtaaaacgcatgtcaaagtcacaaacggcaagcacattttgagtgggaattccagtttttccaatatatctaacttgctcatcaggtgacaatgacacacggatatgagttccatcaagagcaccaatacaatctttgaaatggggaaaagttcttctatcatctcttatcctcttatgaaccgaacgaaaattgggatcttttggtcgaatgtaatcttttgccatggccatcaaagaatttaaaacctcatcaaattttctactaatggtttcaccagaatgtttgaacctattttgagctctcctattggactcatttccaccacatgtaaacagaaacattgcaagcatctcatgagtactcatatgcagggatggttcgagtccatacctttgcaccaacaaatcatttaggtccaaaaaaagatctgtgttcatacgaagctgtgaatgacattcaccaggagtccgcaatgtctctagcaaccatcccatgccactaagaattgatgtccttggtggatttttgtgaaggtacatatcagcataaacttgagctatttgggcaccacctaaaacaagtttccagaacaaggtcaccatcagtagagtcccctgactcactctcactttcactgtcagtcacctgcaggccaaaaaaaaagagaacaacacttgttagatcacagcacttgttacaaatagtataaaaaataaacttaacatatattatatctgtagacgccatcacagcacttgttaaattatactaattaacttaacacaatcacagaaaaaaaaaaacttcatccaagtgacatcaatctgtagatgccatttcttttcccagccttcatccaaatccattcaatcagacaaacaagcatgagtctaacagtactattattacaccaaatccattacaaatatttcaaatgggagaaattatgaaataacaagaaggcctgcataacagcaagtatggatcatgctccatacttggcattgtactttctcctaagccaattaaacctaaactctttatttggtagggtcataaacatgtccctttggtcctttttgacaaataactctatagcaataaaatgctcatcactaccataatctgccccacaatccaaaactagatccatgatttgttgcacggttacttcatttgacttttttgatgtgaaagaggaggctgactcagcaatcttggtgatttgttcttgaataacaagtgctgtccctatctttgatttcttgcctttgtcaagaacagcccgagatcttctctttccaataccaatggaaggagaaacctcatggcactcctgggcctcgtcattcatttcctccatgggggtctcttggacctcttcatcatcaactacaagattatcttcctggacctcctcagtcatgtgctcaggtatgatggggttctcactcataggattccaatgatcggatgcatcattaataatgtcagaaaacataatgttaaggtcatctacattctgcaagggtttcttcctaaacttgccgcatccaggaatatcctattcaatttcaaccatgaaacaatgtgttagaagcaagctaattctagttaataattaaggggcaggtataaagctaattcaccttttttgcctttctccaccactcatcatccattacaatcacacctcttgagtgatcccatcctgttccagtttgctgcctcattaatttttgccatgccacaaaatcaggcttcatcttatcccacttattcctgagctgtcgcttactcaactcaattccagttatttggcgaaacaactggatcacttcgtcatagcctacggagttcaaatgggtatttggcctatttcctttcaccacttgttgggcaaacaattgacaaacaatggtagtatgctcatcaatccattccattgaatcaccctgtccagtcaaattagagattttatagttttcaagatgcaaataaatggacgattttagctttctgaaataaaaaatatatcacataacagaaggtaatacttcatccatatgcttatggttttgactacaacccaaattagctagcttcttcatatcatacacgaagcacatgaggttataccattggatgtcatccaaatatcagacaagtaattacctggttcgtcgctccagtacgcgggggacgagcttgctgctgggcagcgccggtcggctgggacccgcgccccagtgcgacgccggcgggtgagcagccgcgccccacggcggctccggcggcagggctgccgtgccccaggatggctccgacagcgggaggcgggcagccgcgccccagggctgctccggcagcaggaggcgggtgcagggcggctccggcagcgggaggcgggcagccgcgcccctggccgcgccactggccggcagcaggaggcgggcagccgcgcccctggccggttgcgggaggagggaagccgcgcccgtggccatgctccagtccggcgcccatggtcatctcggcggccgggacttcctcctctaggccggatccatcttggacagaggcggatccagccatctcggtggcggcggctctagggttggcggcggcggcgatctgcctgcagactcggcggcgctctggtggaatcatttttttcacgaatgaggaacgggaacggggcggtactgtggaatagaagcgaatcgttttttttaaccaatggcaatggtgggtaattttttaccatctccatgaggacatatgactccaggttttggtggagtaccccttgaggagctccagaatattcctagagatggagctgcgatttaagagccagagctactccactactcgtgtttggcaaaaaaaacttggagatggagctattttcttggagaggagtcctgccaaacagcccctaactctccagtcctggcctctcattctccgtctctccctgtctcctagtccactcccgacggcaccactgcgctagcacggcagtcggcagcaacgccatcgctccggcgctcccgtgtggtcacgtcccgcgaggctacgacggtgcagtggcactccgcctctcaccggcgcgccctggcctgggcctgctcgccttccatcgtgactcgcgccgtggcgccgcgtctagccggcgacctcccacccgatgtgcgcgccccgccatggcgccgctggcttcgcgcgctcgcgccctctccgcccctcgccggcgcgccctagccttggcggctgggcctgcccaccttagcgccttcccgtcgcgactcgcgccgccgcgctgtgtcccgcatgaccgtgtccaactggcggccttccgcccgacgcgcgtgcccgccgtggcgccgccagcgcccggcgtcactccctcttcgatgagcagtgagcacttcctcagcccctccccccattctagagttctagtagtagtagacgaccagtactatccccttcaataatcaagttttagatttctagtcgtatgccatatcaatagattaccacaaaattgtgtgcaacaataaaaatcatatgacatttttacatggtttgatggttgtcaggagattgaggcatatggataagaaagcattgcgttacttttccagaagcatgaagcaaaaaaagttgcatcttgtgatctaccaatcccaccagtggatgaagggtcgtctgttcctgctgtagttgatgctccaattgatgaagacacaatttacattgtcatttaggtaagatttaaacttatttgttattttttatttgtattgaaccatttaaagttatataccgtatcgtttaccagattttatgtcgaatcatattgtattgtatttggatttttttttctaggtctaccctagattcaaattctgggtccgccaattttgggatggagggattactgaataacaaactaatctaggattgacttggcgaaatctgttagtcaatgctaatgccactcgatggagcatgcgccaaattattttgcagccatcgtccaggcctccagggcttcaaacattgataacgagatgccaatcacatttaacctgattgatttttctcccgaaaagaagactttgactgaccgtactaatgttgttctcacgatctaaacgcgtggtttctagtactccaaccaattcgttacttctcatttaatgtcgtaagtaaacttttttttatctttatccattaatttcattcgaaaagacctacacttaaatatttttaattttttatcactatttgcataggttttaagatttatttaaatatcaaggttttaaatttcaagcaaaaaatcatgaattttttttaaatattttaaaagtttgataatggtatcatgtatggcttttaaaaaaagctcaacttaaaatacgactcatgtaaagagaaataaagaagagtgatgtgtggtggggattttttttttttttttggggagggtggtgttgttaaaatgagaacatagtagtttagagcgcttaattaagtgataaaatgaaacagttcagaaggagtaaaatagatttagtatttctcatggtgaatctaaagaaacacatgataaactatataagttattgaagcatatgataaatgataaagatataaatgttttgactaagacaaataaggttgtgttcggtagctacgattggatacctttcccctgctgatgaaaaattcgcatccggctgatggtgccaaatctgcgtttacgtgaactatgtggaaacacatgaaggcctgagagatttgcttagctctagtgcaggtcctaaattttgatgagatgcgggcatgccagttagtttgatcctgtaactgacaagatatataaattgatgatcaaatagccgaccagctaacaaactgatgtaatgatgctagcagatatcgataggggtctgagatattgattctgacacttggataaatgacgatataaatataatggaaaaacttgagcaatcaaccaatcaaccaatgataatataagagtaaattttggaaaactacaactctagtgacaaaactatcagtttgctgcaacattagcgacatgtttcagtttgctgtaataatagcgtgggaaattattacaaaactgcaacagttatatgctgctacagttgtcacctagtatatatattgatatgtggagatagattacagggaccccgaatctacatatttatacccatcggtagatattagtccttattggacaagacacaaacattcctatagataaaataaaagatacaagtcatgatcgggctctaaataatctttcctgaaaataaaaggaaataagtaactctacctaattaatagataaactgtcatgtcgcatcgtccttgaactcagtctcttttagataagtttcttttaattgattaattttctgaaccgaatccatcgagaatctaactgttggtgactgatgtttccatcgacctattccagaactctgaagcgaatattgactctaggctgatgataattttcggggcataccaacttttggcgttgacaccctcctagcatgtaaaaacggagcaaccaagggggctgctatataatggaatcctgttgggacgggatgatatctaaccggtatcaggcgatacttgcgaggtatcaggtgatatctacaagatatcagacgatttctatcatgtatcatgtgatacttgcgaagtatcaggtgatacttgccaggtatcatgcgattcttatcatgtagaaggtgatacttgcgaggtatcaggcgatacctaccagatatcaggtgatttctactgggtattagaagccgacgaccactaccgccctccctcccttggctccagccaccaccatcgctccctttcctggctccagccatcgccgtctctccctccccggggtccggccaccgctatcgccgcccctccgtcccctggctccggccaccgctgcccctcctctcttcgtcgatgtctcccctgccgccggcttggccgcgatgcgccgctgcctcgacacgacgcagacgaggtcctcgatgccgcgggagcttaatgcgcagggctcatcgccgatggccgtgtccacatctcgccgagcgggtcctcttccccggccctcgccggcagccacctcctcctcacggctaaggcgcttagctctctctcctctttgataggcaagggggtgaaagggatcccgtcccgtcctgatggaatccctgaaatttttacattttggtcctttttgaaaacttattttacaaatagacccc

SEQ ID NO: 83324 - DNA, 9360 bp, Oryza sativa
atgatcttacctctaaatatttaggctgggacttaaccgatcagagatgggagaaaaatatttgctcccggttagtaacttcaaccgggactaaatatagatctttacttctgggtgttactaccaactgggactaaagtgataatctttagtcccggttagtagtatcaaccgggactaaagatccttggtcccctgacatggctctgacagggtataaatcgggattaaagatcaaaatttttataaccgagactaaaaacaatttttagtcccggtttttactagatctgggactattgtagaaatcagccgaccgagcaaagatcatttctccagtaggatctgagtcattctattcactataattaaattaacaatcataacctacatcgtatatatttaaatgcaacgtgcgtattactaaaatatattttatataaaagtttaaaacaaatcaattaaatatattttcagctttataatattttatatttaattaatcttgcactaatgacttgcgtcatttcatgtgtcctggataagctcagtcatagaactagatcaaacaaagcctaagtagaagatatatgacatcggtatggtgtgaaaagaatatatacgatccttaatttttaaaaattatactaatagagaaaacacataatacatgaaaatagattcatgataaatttaatgatatcattttgacatatcattactttttacgtagggagtggataacttttgagaattgctagtatcacaattagagttgtttttatttttaaaaatgcaagtataatttaactattatataatatatatagttaatttatttttgtttttcattggtgtttcgacgacatgcgcctaattagaaactcaaaattacgtatatttgtacacgtaataaaggcatagttaatatgggcagtttccagttccaagtgagaaagaaaagaaaaaaaaagaaaagaaaaataatgtcagtaattcgcccggtgtgcatacgtacgtacgtacgtttttttaaatacctactaacgtacttatgtgcacgtacggcaatttaattggagataaatttaatcggtccaccatattaaatgaaaatcgatggctagatgtttttttagacattctataattattagaacgccacatggcggtctaggagcgtttttaggggtcctatgtagcggcttaggagggtttgtaggaagtttaatggacttttagtatataataatagaaatagaagatagatagataatagatagatatctcctagtttttcaaggtatctttaaatacggggatccttcatactccaccattttatacgaataaagagaaataacaagtttatatctactaccttgacgtgttcttattctttgatccaaagaaaaatcgcaaaattctaaatgtcaccccaaacttgagatcctccctgtaagattatttgttgttaatacccgtcttctaatttatcttggtttgcgacccaaaccaaggtaataaatattgtttattttgtgacccgaatcaagcataccactaaggtaaattttgctacaggatatttcaaatttgtgcattttactggtagaaaccgtaaaaatgtgtcatggctagaacacccttaaaacctagtaatttgctagagaacactctcgaatcaatcagagagaaactcttcaagatgagaatgcccctagggacaaaagcttgaggctggagagaagatgcaatttaatataagctagcgatttacttggtatgatggcagatttcgagttgcacaattttcaaatttttttttactccaacgctatgtttaaagcatatggcccgggggcattctcatctatttgaataatttctctctacaattgagatgaaagtatcctctagcaaattactaatttcctaggatgccactactacctaaaccctcatacgggacaacttaatggtactggtttatctaaaaccgacacttatgatcccttcccacccctcgaacgtgtctacaattaaaagccaacatctttgatccctcataagtgccggttcattaaaaaaccagcactaataaaaatcaacacctataactctgctataattgtcgattaatagaaaaccggcatcaataattattagtattggtgtttttgaatggcgtgggtgtgagtgcgaccatgagaggagagatcatctttttttgtttaagtcgccgtttccactgagtaccctcctctccccatcattatccactccaagtctcatcacctctccgtctcgaagacctctacggcgtgggttgggagagggggaggaggggcccgccaacgatctctccagcgcaggcggcgtctgcctcttcttcaaccctcatccttgctcgcctcgaccaacacgcctcctcttctttgttgtagccgcgcaccggtcctcttcacccacggcgctcctctccgccgatgcagctgtagccgtcgatggtcctgttcatccatggcgtctcctcctcttcaccactgcagccactgacaacccgcatctcctcctcctctcttggggctggtcagatccatcatgagcacggtggctggaggattcatcgctgcgaccacaggcgacccgctcaacgacggcagcaacggcgacggtggtgttcttctatgtgtgattttgatcttctctctttctgtagactctaggatagcattgaatgttgattttgtttttcaatgttgattttgtgattgtgttaccggggtgatgggatgatggtgatctcagtggtgatcgggagctgctcgaagcatcgacttgaatcgagctagccttttttttttatccatggaacctcaaaggtgccagttctaaaactggcacctttgtttctcctcatcagtgcatcctactaggtatcggctaggaaatccaacacctatacatggcggtttaccagtcggcaccaatttactttttttaaagtgtcttttaatcattacccgttttttgatatctaccaacaaattacataaattttaggtgttctgtaccaaaaaccttggtgctatggttgattttgggttgcagattaaacaatatttaactgcagcccaaagaggagagtaggttgtcatatgggcctgtttgggggagcttctagcagctgcagcttctactagaatctccagttgtcagaagctcccccaaacagtccagctttttacccagattctgagaatctgtagttgtagaatctgaaaaatgaactagaagccagaagctgggttttccagcttctccagattctcaccagctagcttctcagcagctgcttctcaaaatcttaagctccccccaaacaggccctatcttaagcttctcagcattgtagcgtgggtgtggtccagatttgttgagcgagatattttatattttgacactctagaaaatgagttttgataattttatacaatggcccagtcatagactgagatggccctacttgtcatcgtcacaagtgttaattttaatggaagtaacaattagtaacgtattgttattgaatggacaactacgtcacgtcgaaagacgtggttatctcaactgtggttggaaagggaaacgattgtattacttagtgaaaattttttggatccccctattacatgaccctagggggctatttatagccccattacaggttctccctcttagggtttaggttttacaggggaatttacatggttacccttatgatagggacattattaggggtacacagtgtcctttacatgtttgggcccctattggcctaggtagcttggcccattcatcttggtgaagccctccgagagtgcgatggcccgctgggccttctcatgtgtggtttgatgcttggcgaagcctatgtcttcgccccaaagccttcgcacgtaccgctttcgcccgggtgcccatccgacgaggtctcttccagcccatacggttctctcttcgaccttcgccgcttgcctccggtctgagcttgttgcctaagctttttggtttcggtaggtccggccgaaggcccttcgtggtgtacctccaacacgtatagagcgtcgaaacatcaaattttattttgttgcactggtggagaaaccatctttggtcggttgaccaaatttcacaatagtcccggttgtaataaaaaccggactaaaaattatttttagtcccagttcaaaaggttagagctacttttttatctttagtcccggttcaaagaacaacaggagatgttagacccctctattatctttagtcccggttggtgttaccaaccgagactaaagatctatttttagtcccggttggtaataccaaccggcaaaaagatcagcatgcgcggcggagagaatgaggcgtgcgagagatcgaggaggtggaggcgacatcaattaataagttctatctcctcctctctcaccttatctcttcctcctcttcaccccatctcttcctcttcctcctctcctcattctcttcatctcctctcctccccattgcggcggcggctgggtggcggtggatccggaaggggaggcgaccggccaccgccggatccgaagggggaggcggccgggcggcggcctcgcgtgaagggccggcgcggaggccggtgcggcggcacgcgatggaggccggcactgctgcgtggattttttttcttttttccttaatgtatgattcgttctgtgttgaatgtgtgattcgatctgtgttgttgttgtgaatgatttggggatgaactattatgcgaatgatttgggataaactattgcggtgaatgatgtaaatgatttgttgtgaatgtttgatctgatatatttggacaaagaacagtgaaaaagaaagagagaaaagaaaaaaaaaacctccagtcaggactaaactaaagatcaatctttaatcccgggtatttgaaccgggactaaagatagtgatctttagtctcggattcttactgccggttggaaaaccaggactatagagggttaccgaccgggagtaaaaagggtttctccaccagtgttgggctggttttttacgagccagatcggggttgctattgacgtcaggcccatctcagaaacacacaaagcgataatcctttttatttttttcaaatgctctcgcagacagactgggcaatggccggcggcttgtttatgatttttggttcatccgtacgcctcaccattggctgctcccaacctcctcctgcctctcccttcctccatcggccagaggaatccagcgagggcgttgcgggcggcgcggtactggcttcaaatggggatttagggcatccctcgatgatatatatggtcagtgaatcatctctcatgttgcaatttttcccctgccctgtttctacacatgttaagtttgctctagattttggctcagttcgattacagcttgctatttgggattttctctaaccagcaaacaaaataaaactggcatcttgtgtttgaagccatgtgaaaaagagacaaaaaaatctgtatcaaacacgcatcaattagaacatatagacaactaagcttagccggatagagaatttctaatggtgatttttattccaggatatgcttaattgcttaccacttctattacacgataaacccaaattgatagctaaacagatttcactacatgcaaatagttctcgaaggaaaacaaattcctgtgaagctaaaggatatgaaagcctatgccattatgcaccgtagtaacatatggacatcagtaacaatttggtgttggaattaatgaatgggccttagcccactcgaagattaattctttggaaaatcacaaaagcccacctcatgggatggcatgcatgtggagtttagtaccaccttacttattctaggagagggggacctccttaaaagggaggatgtcctcctaaccacttgaagcatgtgtggtggagagaagaggggaaacacacgcgcgcgctcgctcgcctcgcccgggtagggcaggcggcgcgcgtgcacgacgtacgcgtcgaatggtccgaaaaattgactcctcacccttgcgcagatgcagcctccttttgcagttttgttttgctgcaaattcggatttgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcaacgattgcgaaatcaatctagggtttgcctcctactctgtactgcgccgtcgctcgtagactactccatcccgctcgccggcgtgcaccggcgatcgggagagcaggtctccggaacctctgcctttgacgtcctgcaccgggagaaggcggcaataaggttttttaggaagcgcttcgcgcgactgctccctgtttgttcgcgacggctcgccttcctcttcgctcgcgtgtttcatgtcttcgtagacacctgcgaaaagtttcgaccaagcaaccggtctttccgtcacctcggtatgtgttcaatatgttgcgcatatttgatctgttcatgttatactgtgtagtttacatgtatagatctaatgatgcgttcattctagttttcatctgtaatatcatgatttatttatggaatagattaaatcattatatgtctataatctcaacaatccaaaaaccttattataggcactgtgattttactatggctggttttgccgatgcactgagaccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgttctgtagtcgaacaggctcatgagatagaaaccatggctaaggaactcgaactccttaagtgtgtcttacccgacaaatttgtggccgggtgcattattgcaaaactacctccatcttggagaagtttcggtactgcactcaaacacaagagacaggaatactccgttgaggggttgattgcgtctcttgatgttgaggagaaaactcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctagaaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaaatagtcgtgtctaaacatggatattttattggtaaaggttatgagtgcggaggcctgttccgcttttccctttctgatttctgcaataagtctgtgaaccatatttatggcactgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacagggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgagaaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagaattcctaacagaaataaggacaaaacaccatatgagatatggattggtagaaaaccatcactttcttatttgcgcacatgggggtgcttggcgaaagtcaatgtaccaataacgaagaagcgcaaacttgaacctaagactgtggactgtgtttttctgggatatgctcatcatagcattgcctatagatttttaatagttaaatccgaggtaccggacatgcatgttggtacaattatggagtgtcatgatgctaccttctttgagagctttttcccaatgaaggatatacatagtggttcgaaccaaccctctgaaataattcccagttcaatcacaccaccagaacaaactgaacatacacatgaacttgtctctgaggaggatgtcagtgaagctcctcgaaggagtaagagataaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaag

SEQ ID NO: 83325 - DNA, 756 bp, Oryza sativa
ccctatttgttttctgtttgttgttcgtgctcagcactaatgattgacaaaacaaaatccagggaaggtgtgactgctgttgaggaacctgtggactgcccaaatgtctcagaaatttcctgcaaatatgctctgatgttccaagactttctgcagtcatcaagcttgcctgtgtggaacagagttgataattgtggattttggcgtcaattcacagtatgatctctcaaagcttttcaactctttcagtgggtgcttatatgttcatttcctgttggtatattatacactttatttgaactattttagttctgggataataatttctcagactatggctgctgtataggttcgggagggaagatgtcaagctcaagctgttgcacagaatgcagaaaaccaaatatcagaagtcatgcttattgttcaggtagtacctcattctcaaatagatggtgctttagaatgtgctctatcaaacctcataaacttttggtggagaatataaaaaattaatacattaagacttctcatgtcaaaatgacattagtagatctgtgacatctgtcatgaaaaatatatttttagtagttgtgaaaaacataatactataataagtactggttcaaaggtgcgtgacaagggaacagaaggattgtaacatcaagaatcaaaatgcattgtatactacgagtcctgtagatcacatcagtgcaatacatgttcctactggcaggattgtctgacttcctatgt

SEQ ID NO: 83326 - DNA, 5592 bp, Oryza sativa
  unsure (1)..(5592): unsure at all n locations
gtgtgattgatttgcnnnnnnnnnnnnnnnnnnnnnnnnnnnnnnnnnnnnnnnnnnnnnnnnnnnnnnnnnnnnnnnnnnnnnntgtaccccggcgggattaagcggacgatggtgaggcacacgcccgggttttcgaccatccgccacgcgtacgcgagcccctcccggtcgtcgggcccgccgaagaagaggagcgcgacgtggtgcacggccgccatcctcgccgcggcggcgctgaggccgcggtcgacgaggatgccgacggagcacggcgccgacgcgaggatgctctcgttgaagccccggagcgacgcgttgatgggctccatgccgccgtccaccgtctgctgcttgtggaacgggagcacgatgagcgagacgtgcttgtcctccgccagcacgcacacgtcctcgtgcatcgtctggtacggcgacaccgccgtgagcgcctgcaccgacacgccgccgaccatctcctcgtagctctcgaacgcgttgaagatgtggtcgctggcgccgcccgggttcgacgccgagtggtgcgcggcgagcatgttggaggcgcggccggtgagctcgacgaggtggagcgcgtagatgaagatcggcgagcgcttcgtcgggttggagagctcgagcagcgagatgatcgacggcacgttgcgggtggtgtgcacgcacgccagcatccggagctccgcgtcgtgcttcgaccgctgcaggttccgccgcttgtacccgaccagccgccgcgccggccggtacaccgtcgtcaccaccggcgtgaccagcgccgtcatggccaccgacaccagcaccatcacggcgaacgactcgtcgtcgagcacctccttgtccctcccgatgttgaggacgatcatctcgacgaggcccctggtgttcatgaggaaccccagggcgacgccgtcgcggaacgtcatggtgtaggagacggcgatgaggatggtgcccatgatcttggcgaagctggccatgacgaacacgagcacgaggaggcccacggtgatggggtcccggaccttggtcacgttcgtgcggaggccactgatggcgaagaagagcggcaggaggaggccggtgacgaagtcctcgagcttctcgattagcacgacgccgagcgggccgctcggcatgacgaggccgtacacgaacgcgccgaacacggagtggatgccgatggcgtcggtgcagacgccggcgaccatgacgccggtgaggatgagcgtgatgtgcacgtcgccgatggcctccccctcggggacgcggcggacgatccaccacatgagcgggcggacgacgtagaagcaggcgagcacgaaggccaccccggcgatgagcacccagagggaggagaaggccgaactgttgacctctgagatggcgatggcgagcgcgaggaggatccaggcgcacatgtcgttgacgatggcggcggacatggcgatccggccgaggtcggagttgagcagcttgacctcggcgaggatgcgcgccagcaccgggaacgcggtgacggagagcgcgacgccgaggaagagcaggaaggaggcctggtgcacgttcttggacacctggtgccggaagatgaacgacgtcgccgtgccgatgcagaacggcagcgccatgccggcgacggcgatgatgagcgccttcttccccgacctcctgatggtgttcacgtccatctcgaggccgaccaggaagaggaagtagaggagccccaggtgcgccaccgtctccagcgtcagcaagctccgctccgggaacactttcaccgcccacgtcgaaacctgccccatcaccgacggccccagtatcacgccagcctgcatcaccaccacgacgacgacggcggcgacacagttaaccaatcgaccaatgagaatagaacaatggcggcggcgaaggtggcgggcgacgtacgaggatctccgcgatgacgcgaggctggcggaagggcttgaggaggatgacgaggaggcgggtggtggcgacgatgatggcgacctggaggaggaagagggggagggagaagtcaagaggggaggcgccctgccagatgccgtaggcggtgaccatcatcggggagtagcagacgaccgcgccggcgccggtgccggccttgccacgcgacatctgggacgcggaggtggcgttcttgatgagcgggaccgcgccgcccgtgccccccgccgccgccgccgccccactcatgatcggggccatctcggcgcatcggcgcgtcgacgagagagagagagagagagagagtataagctggtggcgcgcggcggtggctgtgagcttctcgttttcgtccggctccccgtggcgcgtgcgatccgatccccacactgcctaattttgacgtgccctggccgtcgcagctaaaccagttgaagtgaaagctgcatgttcactatcacaaaagtgtataggccggcccacccgtattttgcggcccaaattttcgtgggctggtttgggtctcgatccaaatacaggtgggtgggcctaaatgggccgagttcactgtactgtttacccatgatagggaaaatatgtagtactccctctgttttatatattatactagtataaacatgcacgtacaatgtacgtttcataatatatatatatatatattaatatttgtaatattgtaccaaccaaatttatacatctcgtcgagacacaaacaaaacaaacaataggaaacattaatgataatgtggagaggtggtgccatcgtaccaactcactctcagttccatcatacgtgcatgtgcggccatgccaactgcctacattcctccacatataacttgcttctttatgcccatatccatcactacaactagttaacaacttataataataatgctgatatagtctcatctctgcatatcaaccaacatacaacagaagttgcacaaatttaggggaaagaaaaaatgttaaccaattttttatcggaaaggctatatggctatcgcatgtttttgttaggctgtatcattcgttttttggtcccttggattttgtttgagattcgtgctatctagacttttgttttcttttgtatgtgggcttttgattattgtaagttcgggcttccatacgtgggctaaatgggcttctttttttttttacatttttgtgggacccactttgtgttgccgacagagagagatttttttgtgagagtgtgttaatggtgggacccacatacactattcaaattttgaaatccgcaccggagagagagattgtctgaatcagactagagagagagagtgtgtgagagattcattttgctttttgcctttttcctcatcgtctcgtccggcgatttcggcggagatttcgtcggcgacttcgggaggcgacgacgggcgtaagctacgccgcggcgtggattcgtgcaggctacgtcgctgtcacgcccgaaaattcactagtaatttccgaacttatttgtgcataaaatcctcgtccaggaatcagccgaggtacacaaactgacaatttaatatacagattcatcaaattaactaaaacgataaatacttacttaagaggcacttagtcctcaccatgaagaaaactgcagcggaaaataaaatctagcgaagctccagctccactcccacaggcagctcagctggggtataagccaaacgtcttctcctcctagatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaaataaaacagtggagtaattaatcagaaattttaatcaacactgaacaacacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagccccacaacatgtcaccatgtgcctcaataccaccacggtacctcggaaaggagttgtgacaataccccttgcacaacacaatccaccacagcgcacctttcctggatcataatcacccccttataaacaaggcatggactccccagcgacccccgtgggcttatcttcgccacttctcagtctggtgctccgcaatgaatcatgctatacaaaaagtaaagccgttgcccacgcttgcttgtggctggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataataatgagtcataagtaatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatactttcggcgcactcacgaaccttcgcaacgacggaaacgacaagctaacacgcaaaacgaagaaaaagactaataaaaaccaaataaacaatacataaaaagtaaacaaacatgtagatcataattttagatgaattatgagacttgaacggcctcattctgacttcatatgaatttattatgaattttacaagattaaatctaattaaagcccatttaaaaagaattaaataaatttaattcaatttatggataattttaatatgtagatctttattttatacaacttttgcaacttgaaccacattaaactgagttacaatgaattagttatgaattttcaaagattaaatcggattaaaacacttatatggattttaattgaattatgacgcaataatgaattatttttgaaaaggaaaagggaattattgcgtcatcaaaggcggtccgggtgcacgggacggtctaaggaaacgaacggccgagatcgattctatccaaaacgggcggccgagatcaacttgatctaccgcggttcacgggacaaggcgacgatgacatcagcggtgacgtcagcgatgatgtcatcaccggcgacggctcggccttgcgcgctcgtcggcgaacgacggcgcaacgacgcaaacggaggacaccaacgggtagaggacaaccacgggccggaact

SEQ ID NO: 83327 - DNA, 14460 bp, Oryza sativa
  unsure (1)..(14460): unsure at all n locations
atatccttgatttgtcttaaattttactatgtttcataaaaccatataacagaaactagttgtcaaatgtgtgttttggaaactgcgttgatggtacaaaatgctactcattttatgacacgagggagtatacccagcaacaactgctaccatatttaccatacacagttgggacaataacaatacactcaagaacagggaactcacagtatcagcaaggtgcattggacagaacattttaatacatggaggtggttccttttttgtttggcatgtgctcaatggtggaagcattctcctatcatacagtcgtgcaaatgcatcactgcataaacatcaagttgtaaagtaatgttattcaggtttagaaagcttagaatggatcaatgtataagagtaagttaggtcaccttccaccaacaaggagctgatggggacgaacagtgctgatatcacaagacttcagtgccaatggctgtctgggaatatcagctaaagatttctttgctccccatcgtagatctagctgccacacagaaaacaaaaatagaaccaagcatgcaacttagcaactataccagtcaattttatagcccgtgtttaccttaatactctatttagttaattatccttacaattccaggattcacaaaaacaaaaggtacagtgcagttaccaagcctagaaggtaaaagtgggagccacaacatgatcatcataaggctgaaatgattgtacaatcatagtccaacaaaaggcagcattatgggttcatccacatggtaataggaaatggtgtacagatcaatccttaaaaagtaaatctcaattgcatgctggctcaagagttcacgaaacaataatgagacaccatttatattttttggtaaatattttcttctagtcattaaggacctccacgtaattatttatagtgctaaagattacaggtagactgcaatatggaatcatacaaggctactgagttgggctcttattagattattcctagtggtaaccaataaatctgtaacagaataacatttaaacgaaataacaaaaatactcccaaaggtaaaatttatcatgatatgaggttattaaggaccaaacaatttatcaacctagacaaagttgcaatgttagacgttattagttgaaccaaattttgtcaaagggtggatgactcacaagcacattacggcattcctgattagtagatcttgcacgaggacaggaactgcactcccgaaaatcatgctgtcttagagttccatcctcacttgcactccagactatattagggttaccaatttcaacctgcatatagcaaacaatacaaaaaattaaataattgaagaccaggcagaggcttataataattgggtagaaatctcaatccacaagaaactagagcacatctatatttgtgtaaagacttaagtgcagagcatcattttctccttctaaatcaagatgatacaatgcaaatataaacttctttcatgctcacttaagtgcagaacatcattcacaaattacaaaagacctatgtcaagatgatgcaatgcaaagataacacttctttcatgctctagagattcaaattccaaaggtcatctcaacatggaatcttacagctaatttcttgatcctccttgagtggcattggtaaactgctgatggttccatagaaatttctacaggcctttttccacttaaacgggacaaattaaaaacacgaacctgcaaaagaatcagcaactctctcagaaaaaggatcctaaaaataactggtaccagaatagcagacagatgagaacaacttctataaagatcatacctctgcatctcctgctcctgagactattacttcatcagatgtttcagggacaaattttgtgcaaaatatgtttgctgaatgacccgtatcaatgtcatgcaacaactctcgattagcataactccagatgccgatctgcaggtagatgttcatacagcacttaactcaatcaagcataaaagtgtctgattttactaatccaagcatatgccaaagaaaagagaaagccagccacagaggttactaactacaaactcgtgtcgcctgctgagcaacaccccttttgcaacaaaattgtctaatacagttcatataataattccctatagttacagcttaacaaatagtttaacttgatagaaataaaggaagacaaatcattgcaaacctcttatgtttgacaaacaactaaagagttcatgtgctaccatattctttgagccgaaaaggtctactagatgatgattaccatagcaatttagccatataaaggtggcacgacagggcattcagaagccagagagagagagagagagagagagagagagagagaaggggtgcaaatatctcaaaacaatgtttaacatagtgttggggagaattagagttcaagtgctaactactgaagataacatgacacaagaataaagaatctagcaaagtcagacccaaccatacttaattttagaaacttactctagtgtcatctgaacctgatagcagaagtgagccctttgaattccatgcaatagcattgacacaacctaggtgaccctgttatatagcatggagaaaacagagacggtcaatgtaaaaaaagcaagagaactctagcactttttcttttgaacagctatacaatttccaatacaggaacaacaagagggccaagtgccaaatgtccttgtgtgaaaatcagtagaacaagaagaaaaaagtagtcgtgtacctccatttccttctccaaagcaagcctttgtactagagaagaatggaattgcactctcttattaatgtcctggaaaagaagtcgttactagcttctaaacattttagctacaggcctacaacacatatagtgataccatgatcaacatatgcatcacgcatcacaaaatgcaagaccaaagaagaaacattattaatgcaagaggccaagtgccaaaagctgggttgaaggtcctcaacttctccaccgggtcgcctccatgtttttcacctctgttcacccctattatacatcgactcactggcaggtcattcaccttagaacttctcatctatcctaaattctcaaccaacggaagaagcaatcaagtgcactcatagcagatgcagattacaacaactcgagcaattgatagcccaaaccccttcccctgacgctacggatttaattcgcgcaacaagctaccaaaacaacagaaggctcaaacagccacggatattacccccaatccataaacccttgaaactctcaaacgggtcgaggaacatagctccaaaaaaacgcgaacctagagctccagcctccagccctcgcgaacataccacaaaacacctcgccacgcgttcctactcgaccgattcgtccgcccccgcgaacccctccaccgcacagagcaccccccaacgaatcgacccccaattcgccccgtaccaaaaagctatccacaaatgcaacgaaccctagcacgcgataggggagggggagaggcgtcccgggccatcccgagggtgaggagggggggggggtgcttacagcggtgccgtggagacttcgggcttgcaggaggtcggtgacgccgccgtccgagaagcgccaccgcgccttctccgccgccgcgtggtccatctccatctccgtcgaccggcgatctagcaggggaagaaggccagacctcgcagcctcttcgccgccgccggctgcgcgcgcgcccccgatcgccgtgggcggttttggggacgcttctggaagctttttgcgcctttcagcttccaaggtacggaatgggggtggaggtgtgcggggtcagtgttccagagagagagagatggagagaggggaaggagggagccagggaggtgttgcttttgcctcgctggcgtgggggtgtggggcccactgacgcgtggagcgagaggatggatagacgtggcctgtcaggtggggccagactatcgcacggtcgcaccagtgctaatccttctttttcattgtgaaattagccagccgaggaatggcttttcgccaaattcttttgaaattctttaggattttctcaagatatgggaatttaaaacaattttaacatgggatttaacctgttttgacgaatttcgttgtgcctctcttttctgatttctgaatttttatgtgattaatccagacgattgtttctagagtttcctggtatttttctaatcatagaatttattatagtaaaacgcacttgaatcctactttttttttctttatgcgtttctaatgaatccttagtatctcaactttaaaccatcggttattagcttattattattagtttttcatcttttaaaactgcttcatatttcatatttcatatttatattttattctgatcccaagccgggatggtgtttttgcattttagttagcaatttaaaattaatcatagggtgcgtgagagaagaggaaaaatgagacaaggtaggtatactaggctgtaataatttctttgtgcttttgtttattatttattaatcatatattgatgccatcaccatttttgtccatgtgtactccacgtagggacatcacatagtcgaaaatcaccttggtttgggttcagaaacgaaatgtaaaaggtgaccaatagtgaaccatgtcatagttaaggggcggaaatcggatcaaggtcataattataagagaccaaatatagtctttccttaattgattacagtagtaaggttctgatatcaattgtaattattaaaacctgtctggctctgctgcaaattataatccaaaactgatttgaattttagaagtaaacttaaaggttttctacatcccttctattgcttctgttttcatgataactaatccagacttcgtggtacttccagaggtagcgacagccgacagaactacaaaaaaggcagaaggcaacctggtaaaagaaacggtgacgacctctagaagggagaagaatggcttggctcaatcaaaagcattagaccaactcattgcaaacaaattaagcaaacagctgcatgaggaacactatcccttgatttatctcacttcaaaacttctctatttgattctggttctgcagatatgtacagggcaatgggctttttcagtagttcagttgcgacactgataagttaatacaaaggtaatgtacacaacgaaacatcgagatgaggggagagacacctcgccctttttacaacgggagaagcaaaagcatctacaaagggaaccacctggtcacattgccaatctacctgcaaaattgtgttgtaacgccgaatcgaatattacctctgttccatgagtttaagttttcgccagctcaggctgtcaggtggtgagggtatgttcttaatatcttgatcgtgttccaccatcatgattgaaattcagcacaggggtctaccgaactatcaatttcctcagctttctttccactagtaaatgcctttgaatgaatatctcaagctatgcacgtgcttctacaaaggcaagcttaatgccaaggtctcagtttcttcagagtcgatgctgtatgacagcctctggaaagcagttgcaaatgccctgtatgaccattagagtcagtaatgaagtctgcggttggttcttggtaatgcactctaggtaaaaagattaccacttagaagttagaactcaacttacatgttatgacggtataagtacaacagttactcatttgaatagctgtcggcgaagtctttaattcttctcttgatagtctgggggaggacaggaaatagaaacaaaatcagcatggatacgtcagaaacccaagtaaaaacaaatcaacacaaaggcaaatggcagagttaactaccgaaggacacacacctgcaactcttcgtgaagcagtgaaaagaccttcttcatcaatttatgcctctgtaggatatatggtccacaatcaaaccaggataaactttatattaatagtaaagtatcaaataaaatttcagtagatgatacattcttgatcaattgcctccccaatctaactaaaagtttaatatcaaactgcgatgcaaggagaaatttgaacatggatatgcgaagtggaaggggtaacccctttcaaattggtggagaagaataaattgaagttaggcatgtactaacaataattgagctgtaatgattatatagggaaaggcaggaagaagacatactgtgcccgattcatgatacatgtctctgattctttccataatgttataatacagatccttatctctttctttagcgacattaagatcctcctgaacctttaggaattcagatctgtacaaaaaatatgtcagttacagaaggagattacatgaacaattgaacagacaacaatggagtactgagggtacttaaaataagaaaatttacacctaagaaaataatattacgggactttaaaataagaaaattattgcataccgagttttctcaatctgaatgtttaagtaggagtaaactttgtatttctcagtgtactcctgaacataatctttgtatctgaaaaagaagataatatgttagttttttattcacaaacaacaaaagaaacaaaatttcaaaaatcacacattacttattggcatggagtatctacaacggtttacggtatgcgatttagacaaaattatccattacttattggcatggagtatctctagaatgcatattcgacaaaataacactgctcaaatgcgaaattaatcgtaccacctataaacctgtacaattccagacaacagatatgatgggtcactggtcgtaagcagtctgaaacagtcagtaaaatattcatatggacctcaaatatcaccagtaaagttcaaagaaggaaacttaatggacaatggatgtgggctatagaccaggtaatccatcatttgaatacgaaatttcatggtttggcattctaacatcctaggcatagaggaactgcttcaatccatttttggttgttaaacaaaattcaagtaataatactggcaaaataattataataaaaacaacagcgggaaggatattgtaacttactgtgagaaatcttttattggacctttcagttctggttcctctttatcatactttgagaagaataaattatcttcatctgaagaactgtcccttctctttctacttgcatcattctcaatcaaagagttgttcctacttctttcctcattttctgctggggaaattgatttctgtgttctagagcctatggcattcctactaccattctgaggaagcttgggggtagttttccctatcttctttggacctacttgatctagcattccaacctgaacccttgtttcccttttcccgggtttttctcctggctgatctggatgtaatatgaccacaggaactggattatcaggttttgacaattgctgactttgtggaacatttcctctttgttgaggcctattattatcaaaatcatatccagatgccttcttggggaatccttcctgatttatattacctccaataccaaattctcgaggtgatggtttcctctgatcttgagaagaggatagagaaccctttctgtttgccatactgggaatggagtatcacattagctaatttaccatcaagtgattttgaagaactatttctttcaaattgcttctttgccctcccagtctcattttccagagaagcctcacgaaattcacccaactcgagatctgaaagctctctctggagcactttttttccatgaggtgaactctcggcattatttctttgcaaatttgatggctgaccattactttcattggaatcaggaaacggcataacaccatcatatccaacatttcctttagcacttttagctgaaaccatggaattcacgtcaatgttagcatctttggaacgactgagcattttatcctcaacttgggttcccccatatctagctttttttcttgtggcagaatcatcagagtcatcaaaattggcatatgggtcttcagcgtgcgaaactcttccaaggttaccatccaaactattccaaggcttctgaaccttatctgcctttttcttagaaattgacttctcaaccttatcttgtgttctctcagagtgcattgcttggttaagtacatttgggctttgatttatcttttgcaaatttccagaagccaaatgtcttactttcacagcagggctgctatcatgtgcatgaagatcactatgtgcatcccagctaacattccctgtctccttactcagcttctcattcacatgtttgtcaagaggtaaagtttgtctctgttctgataatgaactagtagttcctaaataatcagccttggcccttttggcacttccagacattacactcgagttctcattggcagagcatcttttcaacttgggtttggcacctttctcgttgatcctatcctgaccatgatttgatccatcctttgatactgactttctcctactgccatgatgttttgtagattggctggtttcttccttgggtaggttttcactacttggtgctaaagggtcaccaaaaaggtcctcataagacatttcatttgcagcgtacttgctatcaattctactaggatctatgctggtatttaccatgttcttgcttccaggaatttctggtggcttctctaagtggctcgcatcgaagctatcagttggtacagctgtgtatgctgactcattattgttgtcattaaaattgttcaaatcaatgtgtggggatgcgctcttataatccagatttgttccaatatctattagctcatcatcgccatctagtgcagtcaaatctcttggcaatgaagataatttaagttcatctgctgcttttctgtgtgctcctcctttatcatcatcacttgtaatatccacaaatgcatctgatccttccttgctgcttgaagaagcatcactgtcactgtcactactgctcccactgccacttgcagcgcttctgctttggctcccactgtcacttccactgtcactgctttcactgtcactatcactaccgcttccactctcactagatgagccagctttaccatcactgtcattattgactttttcatctcgggcagcagaaactggggagcctccaatgtcaatcctctcaaatatatcaggatcatccatttttaagcttggaccagcttcctcagtgttgtcatcaatagatctgttacatacatcaacagatgactgttaaggtgcttgggagagataattacaaaaacacaggaaaaataattgaacaaaactaaggagaaatcttcattaaaacaatacccatttgtcacagtaaaacaaggaattgaatttgtaggagaaaaaaaatttacattccactgcaaggtgcataccttttagagctttctgcctctaatccaggtttgagcaaatacctccctggcgcttggaaaattgcaatctgcaaggataatagtgtattaggtatgcaacataacatagagctgatgtttcgttaatggagaagatgtagtggtgagtaatgtactaatgtttgccactcacattcttgatgatactatctattttctttgaagcattcggaaatacatctgcaacagctttctccaggccctgcatatatttcaacaaatgttgtaaatgataattgctcatggagcaaacctttcttaattaagtaaacatgtatacaaaaccaagacatctatctggctatgaatattcaagaatatgatgtacagaaatgagaccaagaactatgaaatttaaaaagatcgaccaataaattaaaatgccacttaaagcttcaaagaactgaagctatcactaatagggggaaggggggcgctttattttactagtgatacccatataagtttggaaaaatccgcttgactcaatttttcaaccacgtataaaaccatttaatcttcacgcttccaattctcaacaccatttgaaaaataccctcatagaccaaagggagtcaccatggcactgagtgatggggtcaccagcaatggtgtcatcttacccaaggatcaccaccaaaattacctctttgaacatcccatcgccatctgtgtgtgattggagacttggaataacgattaaaaatggcatgagtatgtaacaaatgaaccatatggaagcatgagctattcacagcatccctgctacccactacaaaactgcatctgtgtgctacaacagtagcagcggtggcatgtagcaagtcaccacagagccacaattgtgcataacactatgcacgcaccacacacacacacagggggagagagagagagtacctttaaattcattccttttggattttctgaaagtacagatatcaagagacttcgcagctcatttgtattatcatcagtacttgcagaaacaacacttgctcgacgacttgttccttgagacaccctatttggggttgatttctcgactttactattttcatctttattcaaatcgaatggtgttatgacttcattatttacatctgatccggtaggaactgaaggaatgctcggtccaggttgctcaggagaaagcgctggtgaagtggagaaatttgcttttggtacactattagacagcttcactttggaaactgatttggttggagcaataacagcagctggagtaggccaatggaaaacatatgccgttaaatatttgctaatgcaaggttttcttagcggaagaacatgcgtagatgtaaaaagaaataaaacaatacaaatgagagggtcaaacaagactcaaacctggattcttcttgtaaaattctttcttctgcttccagttcatcctccgcatattacctgaaagagataatacattagattatatagcccaagatctaacaaaaagtttaggcattacagactctaattaactttaggcaaagaacagaaaacaagttcagagccattgtaggctcatagctgttgcacctaaagatataaaggatatttacaccgtacagaatactgatccagtgcaagtaattgagctcagttatatactgatgtgtacaaaatagttatatatacatatttcaaatacaaatgcaaaattgaggtagaaaatgaaatcataatccatggtgaaaaggaaacaaataatagttcaaagcaagatctaacaaaaagtttaggcattacagactctaattaactttaggcaaagaacagaaaacaagttcagaaccattgttggctcatagctgttgcacctaaagatataaaggatatttacaccatacagaatactgatccagtgcaagtaattgagctcagttatatactgatgtgtacaaaatagttatatatacatatttcaaatacatatgcaaaataaaggtagaaaatgaaatcataatccatggtgaaaaggaaacaaataatagttcaaagcacaaaccttcaacagcagcagcagccattgacttggcctgactcttaacagatggatttgcagggtccagcacaatcgatctataacaggcaaaatcacaacatgttaaaaccatacataaaatcataaaacagaaactttgagggaaaaatctatttatcgggtgatcattaatcagtagaccaagagagttattgaacagggaaagcagacaaactttcgagattttgagagacgctcagcctcctctgagcgcattttcacaaggttctttgctgattcatccaaaatacgctgcacattcaccttgcgccacgcagagccacattcaagaagcaatccatttccatcctctccactctgacgttcttcataaatatcacataattcaccacgttcagaagcccatgtaaatttaaattctttgccaccaacatctataatctggtaggaaaagaacctgtcaatactcaactcaacaaatgaaatgggcaacactatttgccatattgaagctattttactcgatacattaatttagttgggctaatctagtactccctccaggctgataatacttgtcgttttagacaacggtgaggaaaaactttagaatctttgattatgaatcatttttaaaatatttgtctttcaaatatggtgactacatgtatatattagtcttaaaaagtactttaataagatcatatatttgttaacacttctatacatattataatgaaaaataatggtcaaagttgttttttttagaaaccgtgtccttgtccaaaacgacaagtattatcaacccggagggagtattgttaaaaaccatacaacggttgcaaaactcactagcgattaccttagtattccctttgtatgcaggaaataaacatgcatccatttcatgaaacatgaatcacattgtgctagtgccaaattagtgaaccagtatcttctcaaccaactttcaaagcctaaaagggtataactattttgaaatagaaatagctaacaaatgtaaaaccataagcttatcttgtcaaaacaagacaaagatagcaaaagaaattattgatgtatccaagcagcatgctggattttttttttagaaaacaaagcaaaacagttgaactaggatccataaatgtcagtgatgagacgtaaagctacagtttcactggagtaacatgtcatgtgaacaagaaagttaggaacacaaagggtcttgacaggaaaggagatttggagttttggagttcctatttgagattagtgaaccctactggagccaaatacatagttgggtgattctacgcttctttagtacaaaaccaagtaaatggttttgaagaaaagaaatatatataactgctcattagaaattaaacaaaaaataataatttgatatacccaaaaaacaatcaaagaccatagataaaagatgtacatgagctttatatgccattcctagcagctaacggttacaaaagtagggcccaacaatgcaattccacaaaattaatacttccgcatggatcatcattcccaaagaactttgagcaaccataaacagcataaaatatccaaattcatcctagccaaatagtggaagcctcaaataatgatttgctcacagtgatctgaccaaagaaatgcaaaatacacaaacaaaactccttgccattggtgcatataccaaaagaaatcatacggtttattcccatcaagccaaggagacatgtgcccaagtaaaaccaaactaaaacatgaactgccaatttataaaatcactcaataatgaacaggcaggggctggatttgaacaatcctatacaaaacttgaaggtaaaatgaatggcatatcgacaggaccagaataagcaatggacgagctcacactcaagagagtaccatataacatcacaagtgaaatttaagtatttaacgatcctaacaacatttgggataacacagcatcatgccaaaacgattcagagcatctcaagcaccaggcagtaaaattgagcaaatataaatgcaaattacacagtgaactaacctaaactcaggaacgatgttacaggaaaaccaaaaactggtattccagatgaaaataatctcgagttatgaacttaagacacatatgccataacaagcaaaatttagaaatcagttaggttttaacttcagaagaaactcgcggggacagaacttgacgacggagtgagatggagggagggaggggagggaagctcacgttctccgaggagttgtacatgttagggttgaacttgatgcgagcgccgctgcccgattcctcggcacgccggatctcgtcgacgaggtcaggggtcagccttatgattgccgcgaaggccggcgggccactggactccaggctgaacgactcctcccgcccggccgcctgcgccgccgcggccgccgccacggccgccgagcttgtacatcgtcccccgcggcaagcggcgccgccggcggggagggggggggtcctttggggctcgaaggcggagagtagcgaagacgccgaagaggagggcgcagaaatcgtataagttttccttttgtatttttcccgtttttagtttggattttggagtattttttattttctatttgtgttttgttgtttgggttggatccccttttccgtttataagttcaagcacaatagtaccaactagtattaccaattgtaaactttgacaggaccaaaagggaaatcactcgcagtaagttaaattaccatagagaaatcacggttgcacgacactcttcaccccttgaacacaaaccatacgacacatatactccctccttccctagatgtttgacgacgttgacttttttaaatatgtttgaccgntcgtnttattca

SEQ ID NO: 83328 - DNA, 1055 bp, Oryza sativa
tatcgatgtattaaaattgacggcacaaagcaaagagaaagaagacggtaaaactagtgctttaatttagaattgatcgatgtgtagggcgattaaatttgctagtttattttctagtttcgccgtactattaagaggggtaatgacctagcaaagagatgattaaattgctacattaggtcattgcattttcacttgtgctcactttttcatcacacacacaaaaactcacctttgctttcactgagctcggcctgaccaggggcggtcagaccggccacatagtggcggtctgaccggcatgccctggccggtctgaccggcctcacaacggcggtctgaccggcccgtaaggccggtctgaccggcggcacatgcccggacagaccggccccctggaggccgggatgctgctacttgggatggccgatacagagccgacggagccgtattcggtcagaccgagccgaggccgatctgaccgcccactcaacgccggtctgaccggccaggcagatggggccctctgacagcactacaacggctagttttctagccgttgcagagtagcacggtctgaccggccatatacctccggtcagaccggcagagcacaaagttgggggatttcgcccccaatagctagttttggtggatgggagtataaatactcccccaccaacagcaaggggactcttttggcacccaattcaattgcatacacccctttcatctctctgacacccacttgagttttgtgttcatccatctagtgtgttagaggtttgatctagccataaatcaagtgcatttgcttccattgtagagctagtgtggcacttgattgatcatctccatgccgggtcattgcttgttactcttggaggttgccgcctcctagacggcttgtggaggagttgcccggtgacctctccgagaagattgtggaggaggcccggcgccggtttgtgagtggtttggagttcaccaccttcggagtgaaggaagaactaccctagtgatcgaggcttgggtagtcctctctgtgggcgggc

SEQ ID NO: 83329 - DNA, 6322 bp, Oryza sativa
  unsure (1)..(6322): unsure at all n locations
acgcgtgactganaccttgatgcacttcnnnnnnnnnnnnnnnnnnnnnnnnnnnnnnnnnnnnnnnnnnnnnnnnnnnnagaaaagtcgatccgaatcgagctcaaatccgtcgatttccaaacgtaattgaccgaagtttctataagagaaaaggaagaggagatcgaggagattatttcccctcaaacgatttcaccggaaacggaaaggatcgaccggattggaaagcggcggcggctagggtttcggccggcagcggcgcgaggaggaagacgggcccgacaggtggggcccacctgtcagcgggagagagagagagaggagagcggtggcttggttgcgggccgacttgggccagggagggagagagaaagagagaggttttgggccggctttcggcccaaagccaaaaggaggatttaaaaacatttttctatttaaattattcatgaaatgatattccattgattaaaaatacttccttggctcaaataaatcccagaaaaatctaggaactatagaatcaagtaaagtatttaacaaaattttatctaacccaattttatattgagatttagcaaattagatcttctcttttaagatcatttctaattattccttttaaacaacaatttataatttaaggatttttaaacaagaaaagctcttaacaattataattagatcattattgatcaaataattactgaactgttctttgtatcatttaggaattgagctctgaaaaatccgagaaaatttcagagagttgacttaatcatggagaatttaataaaaattaaatccatccatgctttatatttaggaaattttatttcccacatttaacttcacttgtaaattaatgaacatttaatataaattctaataataatttattaaataatttataaatcctgaaacaaaaatcaggatgtgacagtcgcggcagtgattccactagagtttgcggtgtgggcttctccatcttgtcctcgagctcctcctcctccttttctccggtgagtatgttttgattcttctccagcttcatttgttagcttgctgctcgattcgttgttgttttgctccgctagttgtgctccttttgccgacggagagagagagagagttatagaaggagaggttgacgatttcgtcgtctcgttctcatcgtctccggcgacgcggcggcgatttagcgaggcgacaaggctgctcttcggcgagccgactcggtgtctgctgctgttgtggaggtgtcgcaccgtcgattgcgcaagattattccagtggctttcctttttgttttttttccttttttgttcatttccatctcctatttagcatgctacatgctgttgtggagctaaaaagtaatgatctgacccggaaggtcggtacatttccaattgagctgttgaaaagcatctcttaagtcgatttgagacgcaagtctctttttgacccaaacttaaaaagaaataaatcacttagtgatttcaaaaatgttttcaaacaaaagatttgcaaaacaaccttgcctctcttccaagcttgcattaaacacctaagtccccgtgacttgctgagtatgaaagcactcaccttgctctatataaatatatatagttcctccgccttgaagtaaagatgaagtgaagtgaagattagggtttcgtcctggttcccagctgtcgcctgtggtgttgggtgttagaccgttggttccgctgctgctgctgttgctggtgtttcctcgtctgtgtcttcggttgtattctcaggctgtcttgagctgcaacctaagttaaggtaaataagtcctctatttattttaaggatttgcaatgattcatatttgtcaccgtgggtaccagcactatgtcctgggactggtactgagatcgcggtttcgtaggaagtggttcgcgccgttattcctacgacacgctcctgtcaggtgccgttgtacggcggtgccggattagggtgtgacagcatagtgagcgcatagggcagatgtgttgttcgcgcggtgcctctgttagcgtggggaggatgtggtggcggggattgcgcgggcgatggacgatggatggattagatgcggtctgggtgatttcaccggatggatggatgagattagattagatgacggacggacggtagggattgatccgggtgatttggcatgtaggattggaggggtacaactcctcctttttatattagtatagataagtcgtttaactttggtcaaagtcaaactactttaagtttgactaagtttatagataaatataataatatttacaataccaaattagtttcatcaaatcaataattgattatattttcaaaataaatttgtttcgggttgaaaatgttactctttttttctacaaatttgataaaacttgaaacattttgactttaaccaaagtcaaaacgacttataacttgaaatggaggaagtacaaattatatatgtggtgaaaacctagaaactatcgttggattaaaaaatgaaggcccgatatttgtccagatcatcaaaaaaaaaaaaacaacccccaacatttttactcatgattgaatttgcgagtaaaatttttattgtttggtgacatgaataaatcttagacgttcatatttaaattcaaaggcagttttctagatttcgaatatatatatatatatatatatatatatatatatatatatatatgtgtgtgtgtgtgtgtatggtttgcactatatattttcccattgacattcgttgtagccgttggtaaaaaaaaaaaaaacagttttatagaccagtcaagggacccagtggagtcaggtctaagttgtcgatcggtccggcgcgacggcggctgacgcgagaagattttttgaaggaaggagaaaaaaaaacgaagagagggtgttgtacgcggacgactcaatcggttagctcgcttcgtcgtccaccgtctccctcggtcaccgtcgccgcgcacgactcccatccatggcgatcgagctctgcccatttaagcccggggcgcctctcttcgaggacttgcaaacgcttgctgcaaggattggatcctctggcttctgttgatttggggagcttttcatcgtctcgaccgaacgggcagccgtcgagatcgaggaaggaggagatcgaagggcaaagtgatttggcagcggtggacatggatgtgaggtttgggcccgaggagcaaatcgtgtggccggcttctgttcttgctgggatcctcatgtgcgcagcggtaagttgttccatcgatctcttccattgcttagctagatacgagagtgcattcccagtaagtcctactttgatttgtagaggaaacataagatacttagaggatttcaatattgtacaaaagaaattgaagaaattcctatgaaggcctttgaaatcaatcttttttaaaaaaaaaaatcctacgaaatggacaatattatagagatttagaaaaattaaaaagagctccaacttttttgaaaatttcctttgactatatttcttttatctcctactgcctaatcaaacaacctgttttgcaatcatgtgtgttttttctatttctccttttttttaatcgtgcgttacaaaatagccctaaaattttgctacaaatttgcatcttcacggtaaagctaaactgcctaaagtgtattttctctagtgagatgagcaatcccatcttgtatttacctttttagaggtcgaactactaaatcaggtttcggtttttcgttataaaaagaaaatttgtgaaatgttcctcagtactgatattaatttatgcatttctatcatccaacttttgagatccaaaaagggcaaagtatcaccatcaatctgcacttgacttccatagctcagtctttctgcttggaacgtcccaccttttcttcttcttctttttttaatgtaggaagaatagtattattcgactgtaaaaactcttgcaatgtatgcagaccagccattacaagtactgaacctaacttctgcagagagcaaagcaactaatagtgacagcttagttggactcgtagacgtttgttgaatgcaatctagccttgatactccctccgttcccaaaaacttgtcaccaaacactattcacaatcaaactttgactaatctttttcccctaattaatttataaaacaattcaaaatatattatattatcaaattaccttatgtgaaaaatataatcacacaattttccatcataagagaatctaacattttttaaaatattcgggaatggaaggagttgctacttgggtgatacatggtgttaaaaatatgaatgaattattacttttttttactgaatatgagtgaattatgaatcactactccttttcaattttgaagactacttatgtcagcatttagtaccacacagtcgaggaggtagccaacggaatcgtgccgtcaataatgcttaaggaccagattacctttataatttgtgaattcctccatcaccaatacggattagtatgtgaagagatataccagattacctttttcattttttttttacttgtcaaaaggctaggtaggtagcttgagaagtacatgcatggtaaatggtaacaagaaaacatagggaaaaaaagaggagggatcaattgttcctgagcctacatgatgaattcattctgcattatattttgtattatgccactgaggcactgactagcttctactccattcttataggtatatgatataactcgtgaagttagctcccggtgctacaagggttataatggactgaatgaattgcacaaacttgagtggaacaacaggtgattaattggagcttgcttgtttttctctttctttttctttgacaggtctttttcaataaatctttgacaggttcttattatcgactaattgcagtattatctaaaaatcaactaacagtagcgatgcatattcacttctcttcatgctagtaattacaactcgtttatccatgttttaggggattctctaccttccacgcattagttgctgctgtagtctctttttatctgctggtgatatctgacctcttcagtaaggacgtccatggtgccatcataattgatcgaaaatcatggatgtctgatgccatgtttggtgtaagtttgcagccctacgcatccaggaaaccatggagaaaagagagaaagatatctgtcccaaaatgtctgaaattttaattattggcaggtatccctgggctacttcttgacagatttgttgatgatcctctggcatttcccttctctaggaggaaaggaatatgtaagtgttaatgttctgagttgtccctttttcttttactacaatttgaggtgacacaagttaacaatctattctgattgtattgatatgttcagctcttgcatcatggattgtccatgtatgcaatctctcttgctctgttgagtggcaaaggacacgtgtacatcctcatggtcctcatcactgaagcaaccacacccttcgtgaacctcagatggtaatactcattcagttttcccaaattgctcattaatcatcttgcttgttcatgtctgagatcacaattattcatgcattctttctgaaaatgcaggtaccttgatcttgcaggccggaaggactccaagctttacctgtacaacggggtggcactgtttgctggatggctggtataatttctctttgtaaatgtttccatgcaccaaccaattcatcttttgttcatcaaaaaacacgcctgaattttcatctaaaggactgccaataagtaaacaacaaaaaaaacagaattgaattttcatataaaagactaagccgatagtaaataacaacaaaaacaaaacatgcctgaatttttttgagtgctcagacatggaatggaagctgcaattatttatttaagtgtgcgtccgacaagatttgaacttgagacttgtagctccaataccttattgagtttttttttttaaactaaccataccttattgagttgcatataacctacaattcaacccaaatattaaaacgatgaaaaaaaactaacaattcacttatacctcaagtgataccgatcttcttgttcttgtatgcaggttgctcgcgtcatactgttcgtatacttcttcgctcatgtgtaccttcacttcgaccaggtaatcataatcaaccaatcgtcttctctttaaggttcacctttgtgacaggctgttgntaaattagctcctgcctgttcgattaatttgcccgtgaggca

SEQ ID NO: 83330 - DNA, 3757 bp, Oryza sativa
ctgttatgctgtcctcagttttctgcatatgctccaatatatagaagttttacaaaaatcatgtatctgaacatttagtttatcacatccacatgtatcttgaatagcatgggattacatccactacgcatgttttccaccactaccattagtacactatgtatatttcttgaactaattaccatctattaatagtgatgtccaagatagtagatagcagagttatgcacattgtagcaccagagcggtatgtggccttgaaagcagccttgagatttgagaatggtttaacaattcaaaaaagataaacacctcttagagtggatcttctcttccatttgtactctggagcaatgcatcttagagtggagcttctgtcaagttcatccatttggactttggagcaatgcccaaaagtctgtgtggggcagttccctttaacctgaggcctattgcttgtttagaattttacagttttatagaagtgattaaattatattccacaaaataaaaagaaaaaaataaagaggaaacgactgcactggagtacactaagagctgtgtgcatgatgtactgtaacaaaaataattatttgtgacctttgctcatgcagatcagcaaccagaagaagaaaacaggtgttatcgctcctaagcgtttcatacaacgactgaagaaacaaaatgagatttttcgcagctatatgcaccaggtaacattttttgaatggtgcatttgccaatgtttattctgtggttttaagcaaaaatgtgatcacgctatgatctcttgctctggcccttaggattaagtcagttggccccaggcggatttctgcacaatttgttgttgtgacttgtgaacaactctgtggtctgtgcatttcttcttgatgttttgtaggatagatgtgtagcattaaatccattgtatctatattaattatttacaataagcagcttactctagattgacagaacctaaaaataagtaggagggatacctactacaagcctatcttaggtgcttctacaaacttctttttaccgggcccggctgaatgaggtgctcctacaaactgagaatatgaatgttggatgtgatatgtatgcagtagactttacatgtactttaggttctggatgaatgaacatattccattaaccccctcgcatactgagaggtcatgtgtaagtgtaagggataacaccgccttgagtctatctaaatctggtattccccaaaaaagagtatatctaaatctgaccatcttgatatccctcatagaccacatgtgaatttgcaagatagcacttaagatgtatctacataaggatgagatactataaatggcaaactgttaatggtgtagaattggcttggtcccagtccttttattcagagtccatctttattttgtttagttgtcaatagcatcctgagttgtttggctaacttaagcattgtagaatacctataatatatgtgtatttatgccaattctatggtactttactatttttgtggatattatctttttgatctatatactcgggagctcaccatggactgaaaatactatttgtattttacaggatgcacatgaatttctgaattttttgcttaatgagctagttgacatcctagagaaagaatctaaagttgttgcagaaccttgtgaaaattcctctttgaaaaagaattcaaacgggcctataaatgttcaactcaatggtactaaaaaagaaccagttcctactttggtccacaaatgcttccaggtgagtttctatccgtttctgccaatatgtttttttgcatgtgcaagtgcactccaattttagtgcttgctacagtattggagatgagccctcttgttcttttcttttttggtagggcatattgactaatgaaacaagatgtctaagatgtgagactgtgactgatagagatgaaacgttttttgacctaagtctggatattgaacagaatagttcaattaccagctgtcttaaaaacttcagctcgactgagactctgaatgctgaggataagttcttctgtgacaaatgctgcaggtatgtcagtccctttgattttgtgttgctttctcatgtggtatcaatgtcatctagttgattcaattcagctgcatctgaactctaatcgtcagttattatctcttcctattttgcttgacaaaccaaacactagcacctgaagcgtctgggttaggaaatgtagcatgacttgaatgttaacgaaaactatgcgttttcctatcgtttgtcatattgactgtgatggaaattgttcgtaatttcagtttgcaagaagcacagaaaagaatgaagataaagaaaccaccaaacattcttgtaattcatctcaagcgcttcaagtatattgaacagcttggtcgctacaaaaagctatcatatcgagttgttttccctctggagcttaaacttatcaatactgttgacaactcagacttggaatattccctttttgctgtgctagttcatgttggaagtggaccaaatcatggccactatatcagcttagtgaagagccacaaccactggttgttcttcgacgacgagaatgttgagatgactgatgagtccatggtacagacattctttggctcagcacaagagttcagtggtaacactgataacggctacatactcttctatgaaagccttgctgaaaaaagttgatgtctctctcacatttttcgatagttatacagttatcattttattaccacactgcctgcacctgataatatagaagattcagtaattagaataagttgaatgaaagaccattcaactttagatattatatggtggaatctgcggtaggcaataaaagaaaatgacgagttttgtggaaggtgctatagcggcataaatccacaggtttcttgttttctgtttatttttctgttctttggtttatgcgtacaggttgtaccaatcctgggataatgtttatttaaagtttaccatgtataaaaatatgcttgtactggaagccgtttggctctgagtatttttttttttgtttagaaacataaagctgatatgcatggtattctccgtcatctttcttttctgactgcttttgcatattcgtttaccgttgtactgctttactccttcctctgtatttggccctcaccataagttttttgaagtctaaattcggagcagtttcatttttttaaaggaataagttcactttatatttcttaatttgtcgttgtctgaaatcattacatgaactgcaataccaaatataatgtgtacctaaactctggtgtatccgaggtcctagaaagtataatattggttttggttgacatggcaagtgaactcatgtgggcccacatatcagctggcaactcttatttataggagagtggtggggagaagggtggccactgatttggagaggggcggcaaccgacgggagggcgcaagcgagtggccactgatttgtagaggggcggcaaccgacgggagggcgcaagcggggtgtagcggggagaaggacaatcgtcgacttggagagaggcggagtcacggaggagccatcagacccggctcttcgtcactcactatcgcccagctcctctctcgccggccgctcgaggagccatgagaacaaggcttgtgtcgcctattgtcgcgtaactcctctctcgccggctaccagccttctccccgtcggtcgccgcgttga

SEQ ID NO: 83331 - DNA, 1241 bp, Oryza sativa
aatttctggagcatcctaatcactaaagagaattttggatggtcaaaaactgataatgcatcatctatctcgatcaaaccgagtcaacatatgactaattacttgaagaagctcaatcaagcaagtaaactaaataatgaatcaagaaacattggaaaaacatatatatacaaatgtaccatgttattatcactggtcatccactcattgaacgtgagaaactaagttgcatgggaccggcggcgctggtctagcggtgcaagggcagccccgggtagggctccggcggaagggggaaccaccacggcgtctgtaggggcacgatgcggtggcgtgcggcgtggagtcgcgaggaggcacggcagcgagtgaggtggtccgacgatggatgcatgaccagggtttgatctatcggaaagagaaaaaatttcgggggtcagcggatttttttcggaaatttcgtacgaaattttcaagcaaaattggggaaaattgacctacacctcaatggaacacagggcttggactgccgttgtcgtcgatgcaatgcgccggcgagtgcatccgccgctgttcaagccaacgggcggtagagccgctgctgtctttgtgagaggaagagcgaggaggcgacggggattggtgtggcgttgtcatcgcgcgctcgggggcggattcatctctctctcttgatggctggatctgacacggacatatattaaacttgttgttgttgatgggacgagcaaggcccacataagggttaattgggccgaagaaaggcgtcgggtgttaagggcagccgagctgattcgtatcgggttttagggttttcttcctcttctcttgcatcctcccatctcctctccggcggcggcggcgtcttgtgcgcgtgagaaagagaggagaagaagatggcgacgatcgtgaacacgacggaggaggagccgatgctggccgtggtgcgcttcaccgccgagctggcctgggcggacgccggcgccgacgtcgccgagccggaggtcacccgtctctgcgtcgaggcgcagcagcacatcctcgccgcccgctggctcgacatggcctccctcatgctcgcctccgccgacctcctcctccaatccacgcgcctccccgacaaggacaaaggttcttcccttccctctctctctcccctattgaatttgagaggctcatgtggctgctgctcatcctttccaattctagatctcgagtgcatc

SEQ ID NO: 83332 - DNA, 2189 bp, Oryza sativa
  unsure (1)..(2189): unsure at all n locations
ctgccgtccnnnnnaganacnnccagtctncncnnagantngggaattggtaccccattaaaagttttacaaaaataatttttcattttgaaaattgacagaagtggtcgcctaccgccctctaggagggggatttttaaaaatcgccatcccagagggcggcgaaagtgatgtggcagacggccgttcgctctcgggcgacggccgtcaacgaaatttgcaggcggcccccttgccgccctccgctagggcgattttgtactgtgcggggggccgcctgcaaatgggcggcggggggcctggaattttgcaggcggcccccttgccgccctgggggagggcgattttatactgtgctttatatttttgtataaatatcaatagttatcaaatctttttatattgaaaactatacaagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttgatagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggctccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttaggtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaattgacatttccttacatcctcctatgtacattcattttgggatagttaagttaatgatagtactgaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggacgctcacgccacgtggggagtcctaggggatttacgtgccattctaaagcctcagcagcaattcgacgttcatgctcatccttccgccttaggtagtccgatcttgtttcactacgtgggtaagcacgggttccgtcgttttgtgggttctccatgtctacccactcgatgaagttgcacattggacgatatgtctgcgtaagatgttacaattgtgtacgaagaagttagtttttttatccatttgaacttcgaatagatgaagcatacctgatcaaagttcgcgcattggaagaatctcctgcccccagtttgtatcatgagggaagacttgagtatgcatccatccccacaatcgcacaaaggacggtcacaccatggtggaaaccaaccagcaaagggatgcttcggccagttgagacgctcaagnaagggcgcttccattttgggttgtggggggctagggggaaagaagatatgaagagggtggcctttcggaatgggtcaatatatatagggtggttttcacggcaatataggtgaactcaatgagatacattattcattagaggggacaanaggatcaggggggggcgtgattcacttaggtg

SEQ ID NO: 83333 - DNA, 15847 bp, Oryza sativa
gtcgcccggtgagtcaagttttttttttattttttttaatttgtggtttgaatgttttgatctgtgaatgaatctatgaatcgatattgtgaatgaatctaggatgttgtgagtgagtatgtgactcgatgttgtcaatgaacctgtgaatcaatattgtgaatatatttgtgatgttgtgaataaatatgtgaatggatattgtgaatgaatttgtggtgaatccgtgaatcgtgctatggagttgtgatgtggatttggggtttgatttgatgatatgcataccactcgattcgggagaaaataaaaaagaaaaaaggaccagctgatggactgccgctaccctctctttagtcccggttggtaagatccctatctttagtcccggttgatgtcatcaaccgggactaaagatcgatctttagtcccggttttttcacccgggactaaagatagcgatctttagtcccggattggtagtcccggtttgaaaaccgggactacagggggttacgaaccgggactaaaaagcacttctccaccagtgatggtttcaccaagcatacataaatccatatactcagccaatgccctatgatagaattgttagagatgccgatcgaacacattacatgtctaacaaactcaacgtacagtataggatagttactcggcacacgtcgtaagtataggatgccggcgatcaccggccgacggccggtggctcgattacgcgcgataatccagctcgtgctgttggttcttgtgatcggcagtggcatcctcgtcgtgccggcggctgggggcacgggaagcagtggccatggtactctcccttcgttatgcaatttttagcatttaaaatatgtctaaaaatataacaattttctagcctacattattttctcaaccaatcatgactctctgccgtttaattttttttacctatattgttttttcgatcaataacaacccttcacaactaatttaatttcacaaacttcttaatacccgtttttaagcataaaactttttatatttcttaatattgtattcaagcctaaaaactttacagaggtagcataccattttctttgcatgttaatgtactccctccgtatcttaatatatgacgccgttaacttttttttatcaacatttgaccattcgccttattcaaattttttgtgtaaatataaaaatatttacgtcatacttaaaaaacatttgatgataaatcaagtcacaataaaataaatgataattacataaatttgttaaattaaaacgaatggtcaaagttagataaaaaatcaatggcatcatacattaaaatacggaggtagtacttttttttggtagcatttgtttggtttggggaccaagtgggatgggttagatctattctaattttttgggatggtatggttctagttgatttatggtatgggatggttatagttttttgtttggtaggaagggatcgaagtgggatgggatggacaactttgcacggaccattagtgtcgtctggctcccaatggctggggtgcagcagcgaacatggggacggtggagctcgtcggcgcgagcggcacacaggtgaaagagtggcggctagagggaggggagtcgacggcgttcgtggaggtggtggccagtcacaaaggcgaggcggcggcgggtcacggaggtggcgtccagtcgcggaggctaggcggcatccggatctaagaggagcagtgaccgctcatggaggagaggcggcggtgggtcgcggacgaatggcggcggtcacggaggtggaggcaggcgcggacgagcggcggtggtcgcggaggtggggcgatcgcggacgaggcggcggcgggtcacagactagcggctgcagtcacggatgtggcagcggtagcacattattcacattaccaattcacagcaatagttacattgacagaacatttacatagacagagagttctaattagtcatataaattgtccacactcacacttggatgcagaataaatattgacatacacataatttttagtcaatacaaattaaatcttcatggcttgcatgagatacaaattaaatctccatgaccaacacacggtgtctccggcacgaggaaagcagggcagcgcgcggtgaaaggcgacggagaactggtggccacggcggcgcacgcctagtgagcaaggctagggatccaatatggctgtggccgaatctggtgcctccgcgccggatttggcctaggtcaagtggccgacacggtaagatatggtcaggagggcagccgtacgtgggcttggcgcggctgaccggcaacaggcacagcaactcccatggccggccagtggtggtagaagggcagctgtgggcatagcgcggcggagggtgcagcacgagcggtgatggaaggaggcctgtcgtgtgcgtggaggccggcgatgagaactggccacccgcaccaacaatatgggttggtaccaatgttatgtcgagcatgagagctattggggtcgattcgtccaagctagctagctagccataccccccttcttctccatggacctcgtccactattatggttgattcccttccggtcatggggagctcttttggtgagacgccagcggtggcggtaatggaagaagatgttccagtgacaaagctccgtgggagttgcgacatggtggctgtgggaggtgacgataaggccgcgttggagactggcgggtctggactggccgacaatggggcactggtacggaggaaccgcattctagcaaaggttgttcagttggtgatgcactggtgtggcgacgataggtgtgggaagggtgttgcaggaaaaagcttagcccaggtttccctgagctgacaacgatgatgtctccgagcgccatgatcaccccttgggtcatcatcgagctgccaccctgccactccttaataggactctctaggtgaaaacctagtccaaatggacggacaatgatggcatctaagatgtcatgacctccctggaggtgttgcctaggaggtctttgttcctcgcctttgtagtcttttctcaacttgtcctatgtggcttattggttgtcgttatctggttggtgcgagggatgagttggtattcttctctcttgctctctccctcatcaaccactctacttagggatgatcgggaactcatctattatttttttggtggaatctatgtcggtggggtgtttgagacccccttgcaggtctagccctgattctaggggtggccggcttggtgcaactgccttatcttggattttgtagggagctcttagcacgcggttgcgatgtgtttgttttgtttcctgattataatcttttaagattgtaattttgtacttatttttatgctacataaatatgaaattttgttctatctagcgtagatcgttccaaaaaagttcaaaaaaaaagagatttgaaatctgggggtgggacaagctactgtagcatagctgaattttgtgcagtaatccttgaatggtgaagcgttcattcaagaacatcaacttctcaatatgtggctaaacctaaattaaggagctcggaactacctggacaagagtcaagaaagacaatgaaattaaagatttatatctcttttatctgttttgaaaagaaaacaaaaagaataactagttaactacattagttttaaaatataatctgtttttgcacgtttttccaaaataaaaatctgaaaaatatacgggaatgtgcgcttctaggcacagtcgcacagattactgtacgtgtggcaccctgccggccggtatcagctgagtaattatggcgtgctcagtgaccctcgagtcacccacgcgcacggcggctcaggggcgaaccctagccgccgccgccgccacccaccctcctcctctctttgcctcgccaccgccggagtttgccgccggtcaaccggtgtcatatccagatttttttgtttcaggatttataaattatctaataaattattaatagaatttaaattaaatgttctttaatttacaagtgaagttaaatgtgggaaataaaatttcctaaatataaagcatggatggatttaatttttattaaattctccatgtttaagtcaactctctgaaattttctcggatttttcagagctcaattcctaaatgatacgaagaacagttcagtaattatttgatcaataatgatctaattataattgttaagagcttttcttgtttaaaaatccttaaattataaattgttgtttaaaaggaattattagaaatgattttaaaagcttaaaagagaagatctaattttaatttgttaaatctcaatataaaatggggccagataaaatttcattaaatactttgcttaattctataattcctagatttttctgggatttatttgagctaaggaagtatttttaataaatggaattgcatttcatgaataatttaaattgaaaaaggttttaaaagtctgttttggctttgggccgaaagccggcccaaaacctctctctttctctctccctccccggcccagtcggcccagtccgcgccgccgctctcttctctctctcagtcgctgacaagtggggcccgtctgtcggggtcgtcgtcctcctcgcgtcggccgccgcccgaaaccctagccgagccgctccgccgccgctttccaatccggtcgcccctttccttctccggccgaattgatagaggggaaacaatcttcgggatctcctctacctttcctcctttggaatcttcgcctatttcggtttggaaactcgtggattcgaggtcgaatcggatcggtctctttcctccgaaccccgatctttccttcgccgtctcagccgccgtgggccttcgccgtcgcctccgagcccctttaaaaggatccccggtgtctcctctacccgccgccaccctcgcctttgtctctcgccgtcggaagcgccctagcgccgtgagaccttgtgccgccgccgtcgccgccgctccagccgtgcgccgccgtcgctccagccgtcgccgtcgctcggggaggtcgtcatcgtggtcgccaagtcgccgccgtcctcgtccgccccttcgccgccgccgaagaccgccggagcaccgccgtcaccgtcgacccgaagaccgccgccgtttcttcctcgtcgccggcgctgtccgttgctcttccgccgcttctttggtcaccggtgagttcgccgcgtcgccctctacccgttggtgccctccgttcgcgtcgccgcgccgtcgttcgccggcgagcatgcaagcccgagccgccgagccgccgccgccggtggtgacgtcatcgctgacgtcatcgtcgccctctcccgtgagccggtcgtggaccgttggatctcggccgtccgttttggatagggttgatctcggccgttcgttcccgtgaactgcctccgtgcgcccggtccaccgcaaaccctagccgctgacgcaataatcctccttttccttttcaaaaataattcattattgcgtcataattcaattaaaattcatataagtgttttaatccgatttaatctttaaaaattcataactaattcattgtaactcagtttaatgtggttcaagttgcaaaagttgtataaaataaagatctacatattaaaattgtccataaattgaattaaatttatttaattctttttaaatgggctttaattatatttaatcttgtaaaattcataataaattcatttgaagtcagaatgaggccgttcaagtctcataattcatctaaaattatgatctacatgtttgtttactttttatgtattgtttatttggtttttattagtcttttttcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccctgggttattataacttgactagttgggctttatatattggttcagctagatattagatatgattgcttagccatgcttagaaacattagcacactattgggataacttatgactcactattatttaatgatggcttaatgatagttcacgatggtcaatcgtgattggttaaataattacttgccaactaaaatatggtaaaggtgggttgtgagcacatggttttgagagtcgtgctcatgacaattaaggaccggttcgcgagctactattgtgaaacattaaccatgccaaccacaagccagcgtgggcaacggctttaccttttgtataacatggttcattgcggggcaccagactgagaagtggcggagataagcccacgggggtcgctggggagtccatgccttgtttataagggggtgactatgatccgggaatggtgcgctgcggtggattgtgttatgcaaggggtaatgtcacagcccctttccgaggtaccatggtggtaatgaggcacatggtgacatgatgtggggctgtgtcttgtgggtacagtggtacacctctggccagagtaaaactattcgaatagccgtgcctgcggttatgggcgggttgagcaatgttttttgtgattagtctcacacctctcacaataattatagatgttatacctggtaataatttgcttagctcctggtttggagattagatctgtacagccgggtatggttgttcaggatggttgggcctgtacagcatgggtgtgctgttcagtgttgattaaaatttctgattaattactctactgttttagtactcttaactccttgctaaatgctgctttcgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggcgaagacgtttggcttataccccagttgagctgcctgtgggagtggagccggagcttcgctagattttattttccgctgcagttttcttcatggtgaggactaagtgcctcttaagtaagtatatatcgttttagttaatttgatgaatctgtatattaaattgtcagtttgtgtacctcggctgattcctggacgaggattttatgcacaaataagttcggaaattactagtgaatttccgggcgtgacaaccgggcggggagccgagatggcggtggcggggccataccgcggcgacgcgccgtctccggcgcgagggaggcggggcaaagcgcggcgaggaaggtggggcagagccgggcggagtgtggcgcgccggtgggcgagggaggccggggatccggcaccgcggtggccggatctggccgcacggcgcagggctgcggctgcagtggcgcgagggctgcgcggcggtggacggggcggtggcgcgagggccgcgcggcggcggaggaggcggcgttgcgagggccacgcggcggcagaggcggcggcacgagggccacgcggcagcggaggcggcgtcagcgcgagggccacgcggcggcggcggcggcggtgacagcgccggctccagtgcaagaacgagaatgacgccgatgccgatgcctcgcggggttgtgacgacgccggtgacgtcctgctcgccgctccggcagaggcagcgcagggaacgcccgcttggcggtgtgtccttgcctctctccggcctgttgtgtgcgggaaggagccgtggaatggtggactgggctagctggttgccgaggagatgacagggtggttcggcaacgactgttgtgtggggcggtggtggcaatggatgaaatcgctggcaaaagccttgcttagcccttggctggcgtgacgacgacgatgtctttggcgtcgttcccttgttagaggcgtcgttatggcgtctttctccgtcgccatcaatctccaggtgaaaactgtgttccggtttccgaacaggcggtggcggcgtttcacgtcgtatccttcatgggggcatcgtcttggagaacactacccttgcatcgattgttgttggtgtactcctgcgtcagctcgaagcactagataccttggtttggcgaggccttctccttggctcctttcttgtattggtggcatccagcttctttgtttgtctctgtcaggtggagtcggagctgctacgtcgttggggtgcgacgatgcttggcaacgataacatttgcagtttctctctaggaatgttggtgttgccagtacaagttttggcgtctcaggggctttggctgatgtccaaagtgtgagctcggtgttgttttgctcgtttggtggtgcctccaatgatattacgatcaccgtgaagtcgaagctgcttggtcgttggacggcaagctcggcaacgatgacatgcgctttgtgatgtcaaagtcgtgtgccacttcttcagcatctcgatgtcgatgttcgtctttggattccgccgtggtagtttggctagaagttgtgtagtgctccgtgtgctgtgtggtttgtaccggccacggttgagggacttggcgagtttctactcgccaagtggttgtatttttctttttctgtaaccctgtctgggtttttactcctgcttaattgaaatataattggcagttctcttgccggtttagtttaaaaaaaaaaattatggcgtgctcaactcttcacgtacatgttctgccgattacagcagaacagcagccagcaggtgttctcctggtctgatctccagcagtagtagtaagagagtatagcaaactgcaaacacactgataatcaataggcgatgatcgatcgactgatcgagcgctggccgtgcgtgcgatgacagtagtgcggttctgctccccgcgtctccttctgctgtcgctacttgttgtaactactgtcataaagaccaacaaatagacacagtccaattttgaaatgttaaattgaattaaatatccaataattaattcgttagatctcactagccggaaacgttcaagtcgcgcgtttcgcataatctccagcgcgtttacaccttggtatctatactacttaagaaaaacagtgacggtgacaatgaatctatcaccccacatagcctcattggaaattttcaaaattatcctttgacttccaaatattaaggtgaatgttccctatagtaaaacgaggatggataatacatctcatagaaaacatattttttatttgtttcaaacaatatctatatctatactatctatattattttaaaagaaggtaggtgttgtagcagtcaatctgccaccccacctacccacattgtaaattttgcaaattactctttgaacctcttaatatcaagatgaatgtttcctatagcaaaacaaggataaatgtgtacaacatttcatgaaaatatatttttattaatttcagacaatattataatttatttttcttctatccgtggcggacccaagattggttcaaggcccgagccagcccatatggagatttaggccttatttgttgtttacatggtgaaaaaattatcatcttaatggaccttcacacctagaccttggatcacggcccaggtggcccaaggcctaggtccatcccagtcttcttccggttccaatagcaacaagcttcactatatacaaaatacaagtcacaagttgctggttggcatctataaggatctcatcggtgtctattctaaaacctcatcactgttgactaactgttactggttggaaaatccgatctttatgtgggtttttcaaccattgcctattatactttagtggcataaatcataatctcccccccccccctaaatatgtacaaaccctagcctatgtctagtttgaagatatagtcatacagacataatccatatgtaggagtaattatctagagcccgtcaccgataataactattggtggcgggcttatgtttaggtccgattgagattatctttgtaatctttgttggcccttaaacataagcatttaattttcagtgatatgtgggccgtctatctaaaactcgtagtaactgcatgacaatagcgttccaccgtggtagactcgtcccgtgcatgtttggacgggagcggccggccggcggcgacgccgtgcaagactcggcagtaacaagtatgctctgctgacgaatgtagtccaccaaatcttagtcgtccactgcacgccatggtttcacgaggcatgcataaatctatccaccgatcagccaatggctgaatacattacatgtctaacaagctcaacaatcagtaagcatttataaagatagtttttctagactgaattatactttattccatcttttattactaaaatttcactgtggattatcctttagttaatatttttattttagagtaagtaaggttatctttgcactttgcaccatattaaatcacttctctatatctatgctctcatctagcaaagaatagcctaaggagtaagattacggtgtataggtgccaacgtgttcaagatctttgatgtgtgttgttgcaagaactcaacaagtgtatgtctagtgctcctgtatccaatgtgcccaaacaagagcggtttttacatatttatacgcgagtatataagagaaaattccttcggtgcccctagccctacaaaggatcttgagtggctggccagtgggccagcccttggccttttggcaacttcacaggtggtaggaaggagacacccattaaggaagcagtgctgatttccgagggagcccgctattacccgggtaaagacatgctctgggtaatagcagactcttcgtctggtcatcatcaacagtgtcagaggtagttgggacgcatggtgcgcatttattccaacccactagcgtctgattcctgacttgagccgctgggggcatattgagactttattcgcccccggcagcgcggcaagctccagaagcctccggactccgaagtctctagccacctccggagtacctttgccgggctccagaagccctccgggttccaaagctcgagatgcctttcgaagccccgtaacccttggatactacggcctcccggatcacccctggaaccctcctggcggtctccgagccttgccaggctccggagctcttggcctccgcgggagctgtttctcctctccgggacccctccgtagcctccggagccgggggctaaagtggcatcgacccacggtcatctccccggggaggatgattctccggagtgctgtagcccttcggaggctgacccctcaatccggagccattccccaacaatgtgcttaaggaaagtttttcggatggtagtctagagtaaaacaaagaaaaaacataattcaaactgaaaagattagcttaaaatgtttgtttgaagcgaaactctgataataaaatgtgacattatattaaaggcaattcaattttctaaaagtaaaaaccggctatatttctcgaaataaatgcagggtcgtggagccacgaggacacccttcctcgtccccgataagacgacgaagagacacgattgtggtactcctactcgcctccgtgagttctatatatatatatgctgctcgcctgaacatctggcttgttagtttgtaaaccatcagtaatatatatagcagcagatagttataccatcaccagctcggcacacgtcgtacaggatgccggcgatcaccggccgacggccggtggctcgattacgcgcgataatccagctcgtgctgctggttcttgtgatcggcagtggcatcctcgtcgtgccggcggctgggagcaccggcaaaaccggcggcacgggaagcagtggcaatggtacgtacagtacttgctacatcttaaaatataaaaacatttagcattcaaaacttatattaaaatatgacaacttttcgatctatgttgttttctcaaccgatcaaaacactccctcaattattttctttacctatatcgtttccttaatcactaacaacccttcgtcattaatttaagagcaaatttcactttgggccaccttttgttaccgatatttcactttggaccaccatttaagtaatattttcactttggactagataaacctgcctttgtttcactttggaccacccgactctcttctcaagcatatgaaccatctcgattacatcgtctctctactcgttaatgaactaccacagctatatgtaagactatttcttcgacatattacaagttggatgtagattgataaaaaagtaagggtggtccaaagtgaaataaagataaaaatacccggtctaaagtgaaaacattagtcctaaggtggtccaaagcgaaacatcagtaataaaaggtagcccaaagtaaaattaactcttaatttaatttcacatatatactctttttagggagaatttgaaccatgctacacaaattttgcatgccaccctgacccatatgtcattgactcatatgggtcttacatatcattgagatatgggtggcatatctcaaattttgcaaatatagggtggcatggttccaacaaaacccatattgaagcctaaaacttcttatatttcttaatacctaataccttattcaagcataaaaacttcttatattttagtttagaacagaggtagtgtaccattttctttacctgttagccatgtatactttatttaatttggtttctcctagtttatatatggcttgcttactttttttttttttgtgtgtgcaggtcgaccaactggtacgggtggtccgtctaccgcatcaccgtacaggacatatggcagacgggttagtgcggttagtggtttcagcgtaggctagccatgacaggtctcggagggcaatggccgcaggcggcggtgacgaatgctcgtgtcttaattagcacagaagggcacacgagagcagcaggcgcgtatgtcgcatgtctggttcattcgttatatgaaaactatctgaattcaccgtcgaaaattgtgccgtcatatataccgatacgtagctcagtttgttgactagtttctgtaataagatgaatttactattcacggtgtgtagaactgtagattaactatatatatgtgactgcaggctgaaatttattttgatttcagccgaatttctcaccggacgatgctaccatgggttggaaatttcggactgaaatttccgaaatttcggtcatttcggaccactctgatatgatattatttcggccaaaatttttaatatttgttaaaatttaacaaaattttattcaaaatttcaaaaatttcaagctgaaattttggtatttcggtgatgtccaatcaaatcggctaaaccaataggtttaaccctgctaccttgtgctcattccgagcagcctcctgttcgctacacgcacttcatctgttgttttgtcatgttaatgggttgaaaatccattaagctgttttgtcatgtttaacaaaagcccagaacactgttatgttttcctaccacttgtgttttatcaatgaggacataaaattcagagggcaaaatgacgacataattttgcaaatctgaactagaaagaacccaaaacttctgaattcacgagtacaaattatactaccaatacaacagaaacttggataatatggcttgacaggggtctgcgtgctgctccaattgatccccgcaacaccgatcagccgtatcatctcccaacgatcttcttcagccatcagtgtcatgttgttcagagcataattaagtaatggtgaactcttactcagccactatgcattcttgtagacaataattagcagctcaatgcgtgaaaacaatgttatgaataattgtcaaagataagtgtttgttaaaaatacggttatgtgtttctaaacagtgaacaacgtggtggctagcattgtgaggccggtcagaccgggtggctgccaccagtcagaccggtggtgttggtgcgatctgaccgagtagcccgatggtcagaccagtagattccaagagggagtaggttttcggttgttttcatggaatttctataaagatttcttcatgtttatgacttctagatggtttctattcgtatgtgatactattctatgctaatgtgagtcaatttggtatgaacttgtacttggacatggaatttctttgttattcatgtataggtgttgcttgaggctacgggagtatagccgatgatagatcgggactagattttggagaagttgagatccagacggtcaaggatatcacatgggatgctcatgctagagagcaatgcacacggaggtaaatgtttccatatatatgtcatacacgtgtgcattgtgcgcttatggaaagaggagttaaatttggaaagattggagtgtggatgttgttttcctgatttggtaggtttcctatatgattgggagtcctagttatagttggattcttggccaggggcatctacattgtggatataaatagaagatgggttgatgctagaagatattaactctttgggagaaaaaaattagggtttgcttcgaggtttcaattctagttcgtgaattgagagatgggtactttagatgcaccttgtaaacacatattgatgcaataaagttgatttatcttcaaaagcatcttcggtgtgtttttctctggaccccgacagtctaaccgacggcataggagtggtcagaccggtggcggtgataatatgggctggtagcaacgttgtgtcgagcatgcgtgttagtggggccggttcatccaaactagctagctagccataccccacttcttctacagggagctctctactactattgttgattccttcacggtcatggggagctctttcggtgagacggtagtggtgggggttggggaataagacgttccaatgacaaagctatgtgggagttgcggatggtgggctatgggaggtcacgatgatggccatgttggagaccggtgggtttggactggacgacagtgtggcaccattgtggcagaaccgcagtctagcaaaggttgttcggttggtggagaaccgaggtggcgaagataggtgcgggaagggtgctgcaggaaaaagcttagctcagggtttccctgagctggcaacaatgacatctttgagcgccatgatcgccccttggggcgttgttgagctaccaccctcccactccttggcaggactctccaggtgaaaatctagtccagatggatagtcaacggtggtgcctaaggtgtcatgacctccccgaagacgttgcctaggaggtctttcactactacaaaaaagacaacaggtgaaacttgggaacctcacaaaggtaccggttttcccaacaggtacctttgagattccacgaaaaaaaaagttggctcgatgcatcagctcgattcgagccaagaagctcccttcaccccgaccaatgaaagaacattcaagaacacaaagaacactaagtcactaatcacatactaattccttcttggaatcgaatcaaccacactttacccccccaaaattaaccacaatcatcatcattgaatcacaaaaggaataatagaatcacaacaacaacaacatctaaaaa

SEQ ID NO: 83334 - DNA, 9873 bp, Oryza sativa
gcacaaatcacaatgccaaaagtccatcacatagtccatcacatattccacacatcaaacaatgccaaaagtccatcacatattccacacatcaaacaatgccaaaagtccatcacatatcccacacatcaaacaatgccaaaagtccatcctatattccacacatgaaacaatgtcaaaagtccatcacatagtcctcacatagtccatcacattttatatcacatagtgcaccacatatgtcatactaccaaccaatagattaacttcatacaaatcacttcttccgttggcgccgaattgcttgcgagcccggagtgtacctacatttgaaaatccaatgtttaaaacattttaaaaacaaaataagggaaatcaaataacatttgagaatggtaagctcattttacctctttttcgctgcccgagtggatcgcaagttgtattgcgtgggttgcgtcccttgaggcgcgtcgggaagctgcgacatgtctatatgcgacatgtctatctcctcggcgtctggtgcgacgtagtcctcatcctcctcgtcctcatcgtcatcgtcgtcgctaggtggagccggcgccttcccctttctcctcccttgcttaatgcgtgacgaggacgagccaccaactccttcacgctcttctatcctgatggagtgtcgagcggtacttggacgcgcggatagaggtagtggtggtggtagtctccgcggttggtacacgtcgtccaatccaaccgacctgcaacctaatcttgctgcaagtttctggcacctttgacgaactttctgcatttcaaaaaaaaacaagaagtttgttaggcataactcaagtaatgcaaagtgctaaataaattttacctctaaaacattgcggagtgtgttctccgtgtcctcaccacccctcggagcttggagggcatgccccatttcattcacactcctgaggagctctctcgactgaaagcgtgagaagatatatgttagggtctagggtgcaaatggaaataactttgacaaatgcaagaaaacttacgcctctgtctctaagtggggcgtgctccatttgatatccaactctagtctggacatcatagggattccgcccctcatcggagtcgcggtcatcctctatgtcggcttccgttcaagtagggcggaggaacagtctatatgtcctatgcagccaacgaaggtactctgagaaaatatgattttggtgtatagtctcgatgtacctgtcattccttccggctgtcctccattcatcaatgtatctattatgctctagcccccagtctttcaccttctttgttctcaccctgtcatacctagacaagtagaaggtgatgaaacaatagtgagcatcgacaagggttaaatggtacaaaattgaacattgacaatgaaagcaaacaaagataagaaatatttacttgggtaattcaactccagttgagatgtcctctaccggccaatcttgtttcttcccgaactgtcgcatgacacggtgcggaaggtggtactcaactgcccagaaacaaatcaatgggcactggtacatgaaatagtcagagtttcgattgcacatcgagttcagggtcaggcttgaagcctcatttgtgtggtatggtaaccactcaatctgcaaaagttgaagagatgtcgttggttagtatctcaattaaagaagtaaatgtctaactagaagtgatattggaagtacttacatgttgaggctgtaagcagtccatctcattgacataatgcttatatgccacatcccggtgagcatgtgcagtggcagtactctcaaaaaggtaggccactgtcttctccatatctggctcattgtagggccaaggagtgaagctttgcctccacttaggccttccaaccggtagtcttaaccacatccacagctgaatcaatagcacacaaccactcatgttggatgatggtgcctgacgacaacaggcctcacagagctctctatatgtccacgccaacactgttgagccccaacggaaacggcctagatcaccaaggttggcgaccaaaggaatccatatcgccgaagcaatgtcacccccagcatcaggaaacagaacccctcccaacaagtgcaagatgtatgcacgggcataacactcaacacgccatggctcagcgtcgtcgtcaagatgtgagaagttctgactcagccaagacaggggtattccattctgcttcttcttccccccttgcccctgctcaatgttcagtggaatgccaaacagctgctccacttgtgcacgccatccaggagtctctgtcctgcccgtcacggcatgcccccgtaatgggagggccaagatcatagccacatcctgtagagtgatggtcatctcaccactggggaggtggaagctgtgtgtctcaggcctccatctgtccacaagtgctgtcaacgcaggagcgttgaacactggcattcctctgctcacgaccaaggccaccccgagcaacccggccgcccttaggtacgggatgtacctatcgtcgaacactggaggggcatgagctctgactcagagcggttgaagtacctgcattagcaattgtaaatcaattagttaatataatgtcaaatacacgctaccgatacatatgcacaagtgaatcaatgccgattcataccctccccgcctcgatcgcagcctcgcgatgacgggcctcatagtacgcctccaaggctgggtaagtcggcggttgtccctcctcggccatcctacatgaaaaagtaataaattcaccgttagttaccaatgtgacatacattaaaagaaaatgaatgcgagaacatgagtaggaaaacaaaatatttacctccctaacacttatattttttttggacttcttcttttttggacgcttaggacacttagttttcttgtgaccctcctggtgacacaacgagcatctattttgcaccggcgcagcatcaagttgaacgcatgaaggtggtttccttccagaaccacccagacccgagtccatttcattcttgaatcgtttcgatctcctcttccctcttgttttaatcttcaaatttgggtcagcaacaaattcttcaccatcgtacggtggccactgtgtggggtcgaggtatggctcaaagcgacttgcccatgtgttcacaacgtgtaacgccccgattttcgttcgggattaaaaatcattaaataatgcattttctagaaattaaataaaatttaaatcaatttaatcaagtgaaaatatggaggaaattaaattttcctttaaaaattattggccgggaatattttgtaatattctttgcgccctaacatactctccagaattttccgtgagttttcggagctcaagaagtatttttaaagtcacaaagatcatttaactcaatttaaataaaaaaagaaaacaaataaaatcccctcccctcccttttgggcttggcccaagccttcccctcctctcccgtgggccgcgcgcctcctccctctctcggccggcccgcgccttgtgaaagtctactttacgtcccctggtttccctcctctctctccatccggccgacaggtgggaccgtgggccccacccgtcagctcctcctcctacctctcgccggccaaccccaactgccattgccggccacgtcgccgcaaaatccggcgcccacccgcaccagagctcgcatccaacgacgtgggcacgatcacctccacgtcttccaccatttcccccactcgtcccacaaaaaccagtgctggccgagccgccaccaccccacgtcggcgccccactttccccgcaacgccggcccactccccctcgaaatccgccgcttcccggccctctcctcgtccccttgagctataaaatcaatccccgtggcctcctcttcctttttccccattttcccgagtccccccgccctctaccgtgctctccacaccgatccccatcgccgccgctcgccggcgatctccagccgcgcgccaccgctgctccacccaccggcgcgccaatccgccaccaccgtcggcttcgcgtcgccgtgccgcagcccggcctctactccatttcccctctccgcctccggaacaccgccgcctcgtgcaccacctctctccccctccgccgccgacttcagccgcccaccatcgtcgctctcgtcgtcgccgcacctcgccattcgcaccatcggcatcgccgtgccgagctccaccccggcatccactccgttctcccttccacccccgcagcgccatttccaccgtcgacccgagctttaccaccgcctaccgcctatggctgcctctagccgccatcctcaaccacctcaagccgcgccactgcctctgttagatccaccaccgcgagggcaagcccggccgcccatccctttttcccttccaccaccagaaccacctccccaccacgccaccctaccggccacctttttccgcctccggtcgccattcgccatcaccccggctgccgccgcgacgcgccagccgcatcgcctccctcgccgcgtcacgctcttccccggccgccgctcgaccgacaccttccaccgccgggagcccctccgtgttgtcgacccgaggagcaccgccgcctccctccgccggctgctctcgccgtcgccgtgcccctcgatgagctccgccacctccctctccctctctgcctccgcttcctcttgccgcttcccacgctgcgcgccgccgccctctgtggtcgatcgggccagccccggctgtgcccgtgctcggccatcgctctcctcagccgcccgatcggcttggccgacctgggccatccaacccgtggaccggcggtggaccgtccttgtggtcccggtccacggtggaccgcctcctcgtctcgctgacgtgtggggcccgcctatcggcgccggcctcacttgatgacgtcagcggcagcctttttcctttgtaaaaatatttaataattgcgcaataattcgtaataattctagaaattcatataaatggctcaaaacttctaaaattcatatctaattcattcgaactccgaattgagccattcaacttgcaaaattcatctaaaattgagctctacatgtttgtttactttttatgtactgtttccttggtttttattaaagtttttcctcgttttgcgtgccagcgtgtagaatccgtcgtttcggaagtccgcggtcgcgaggaaaagagtctggaagattgtttcgaagaagcaaggcaagtcacacattccccttgtgcattttgatcctaatttacaaatgttttatcgtttgcaaataaaattgcatgtcttgctaattacatgggatccgggtattacctatctgctcgcttgtgctatgtttacttgatatctgttctttgtcaaccttgggtaataaatcgactagctcatgttacttatgtgacctagctagaactttatgcttagccatgcttaattaccactagctcagttgatgggataattacagtattagacctttttagtatcagaatgagctgcgtgctcaagacatctggccatgtttcatggtcgtaattatccaactaaaatgcgactgaatggtgggttgtgggtgcatggttttgatggtcgcgcccatggcagttaaggaccggttcgcgggaaaccctggaagaattcctcgtactttccacaagccagcgtgggcaacggctgggcttgtagtgtagctttcctctagctgacgcatccaggcaagggtgggcgtgatgtagcggggcgggccctgcgacggcctctgtcgcttccggattcacctaggcacgagaggggactgcccgttgcccgctggggacaggggtgaaacctgaggtgtggtgtgcttggctagagggggttatgcgaagggtcctgtcacggcctctttccggtatgtcgtggtggcatgtcggcgcacggtaacgtgtcgtgaggctgtgtcttgtgggtacagttgtacacctctgatcagagtaaaactattcgaatagccgtacccgcggttatgggcggttcaccagattcaccgtgattagtcccaccctaataaatcgacccaatgcactgtagttcaggtgggttggttgagcctgttcaacgtggtgtagcgttgatcagtggatatttaatgctactttaattactcaatagttttactgctttgctcaataaaatgttttacaaccgcctttatgcaaatagccacaaaccgtccttgtatccccttgcacgtctgcatcattggtgtggcttgctgagtatggtggttgtactcagccttgctattatttccccttttcagaagtgtagtgcttctgagctgaagacgaagttagaagaccaaaactcagaccccagttgagttttgcctgtggagtggagctgaagccccgctaggatcgtctttttccgctgctgctgcgtttgtttcggtataaggactaagtgcctcttctgtaagtattttacgctttatttacgtttggaactatatattacttgtcgttttgtgtaccctggctggtcctggacagggatttaatacacaaaatagtctggaaatttgggctaaatttttgggcgtgacacaacggctcttgaagagaactgatatggcattcggttgggagattcctcatcaattgtatgaatcagataaacgtgtataagatgtgagcaaggcatatggtagagcaatggcctttggcaagaacatgagttcccctcaccttcaactttgaaggctcttgcgctgaatctaacaccaccacgcgttataccacccctctctgtgacctcgtatgtctttttctgcttatcgaaacaccttgcagtgtgtttgttcgccttacttttttgcaccttcatcttactatcaaccttggtggaccaacgctgccctaactggacttgcttcaaagcttcatcatgtttgttcacaaagtagtcattgcacttcatgaacgtaaatgatactatggccatcactggaagcttatgaacaccaactagcacgctattgaactgttcggccatgttggttgtcatgtaaccccaccggcggccatttctatcgtatgcacgagaccacttatctttatccaacaacttatcttcaaaccatttacgaggaccttcgggaatacgctgccttagtgcctcaacatccctctcaaatatccacttctcgtcaatctgacatattcttaggagctcttttgtctgatgcttgtccgcaccggccttgtggaaattagcactgaagtccctcatgcaccaccggtggtgaaccggtggcaatcctggaacaggagtcgtcatggcattcattataccagcatgtcgatctgagataatacaaacctccctatgcggcccaaccacaacccgtcggacaagatcgataaaccagcaccagtctcgtgaattctctttctccaccaaggcaaaagctaaaggtacaagttggtcctccgcatcagctgataatgcagtcatcaaggcaccaccgtatttcccagttaggaaggttgcatctatagctagtattggcctacaatgcttaaaaacctcaatgaaggaccaaagcaccagaatgcacgcataaaaattttcttggtcactccatcaatgttgacaaccctatcaggatgagtatcgatgtggtagaccatactgggattcctctgcttaatggcttgcagcaaagtgggcaaacggacatacgcttcaccccattcaccgtaaatgagcttcatagcctcctctcgtgccctccaagccttgccatacttcaccctatactggaaaacctcaaatatatacaaagctaacacagaagcagagagtgtaggttgcagttttatggcattgcataacctatttgctatgaactttgatgtcagctgccggtggctccctgaaccttcggcagtagcacaactatgttccttacctacccgtgatatcctccacgtgccactagacctcttagttgcatggaccttctatttgcaccgtgggttttcacatttaacagtgtacctcctatttgcggcagaattgacaacacggtatggacgatggtgcacgatggcgtactcctggagccatagcttcattgcgaccatggatgggaactctaaaccctttctgagaccatccacctgaaatggttctgacaactgatctaggttgatgccgccatctagtagtgcaccatgggcatgtgttaggtccctaaactcaggaatgtccggcttcctcccaaacaccttctcaaacgcacaacattcctctaatgctaacttggcattattagtaagtggaggaaatggacggtcatcatcagagtcttcagcaaattcaacatcatattgctcaacacttgcctcctcgtcaacatcatctctattgacttctactgagacagaatcgtgaccaccacttaattcgacatcaaagtaatcatctggattcacatattggcctgctacttctgtcgggtattcagggttgactccatacgacgaccaatgaacactcgccgacaaatgttcacttagatcaagcccctctggtactaactcccttttcatctccctcgctgcatccacatcatcagtaccgcaatgtctctttgatggtcctgcctcccataaattatttccaagcaaaggtctcttcttctctccttccccctccaagtcttctcgtaccaactcagtcttacttgcaccccctccacgacgagaataatatgtcacaaaattcttctcaacgtaatgataagaaggagatttgtttagatccaaattttctacggtacgaactaactttgatgcaaacacctctagagatctaaactgagactcttttaccaaatcaaagtaaacttcccattccaactgacctatcacatttaatatatacttatgcccttgaccaatatcgtatctcccataaaaacgaatctccacattatcctcggtccatccaagaacttctttcactcgtgaccttagttcatctagagttgggtaggtgggaaacaaaatggtcttcaatgacatatcctcaaactcaacatgtgcaccaacataaggttccaccactctatcaccgtagtaaacacgaataagtctatccatctacaccaaaacatcaaatgtaactttgcaacgaaaattaaatcttcattcctaaacgtagtccaaaccgacatattataaccaatgcataacttaaattgtcctaaagctactactccaaaaaaatatttaatccacctacaactatcaacaagtttactagtgcattacacatcgaaatattacaaatactccgtcatacaacccaacctagttctagttaactataatcaatttatataatgcaaccaaaattttcaccttcatataattaatggttaaaagtttaacctatagactatagcatcaagtccatcaaattaaaattactttcatgcctcaaccataatttttcatccatccatccaaccaaaccatccaaaaattaacattaccacatatatggttaaaaaaatcgtgacaccaatgagtacattgcaaacatgtagcactacaacaagccaatcctaagaacaaatgctaaaaatcacaaatttgggtaaaaaaggggttctagggttacccaccgatctacaaattcaaccaataaaaacgaaaaaaaagaggggtgaatgaaggagtctactttctcttcgatttccaaaaaaaaatcccgcgaaaaacgagttcaaatggagtgaa

SEQ ID NO: 83335 - DNA, 37589 bp, Oryza sativa
  unsure (1)..(37589): unsure at all n locations
cacggcggccgtgccgcagcatcgccaggacggagaagagtcgtgtcgcgtcgagtcgccggactctagtggtgtctgagctattgggcgtggcggcggcggccgcggggcgagcgggcgagcactggctggcagtcgactacggcctagagccagcggggggagtgggcgagcacgggccggcggccgacgatggtgtgtggccagcgtggggccggcgggaggtgggcgacaaccactagagagaagaaggagaggagagaggctgacgggtgggatccacattgctttccacggtggcacaatacggtggcacgccacgtaggtgaaagtggcaaatagttaagaaattacctctctccagtgataaattattaagtgcaaatctaagaggagcattttgataattggcaaatcttaaagtgacaaatagttaaattccctgccaccggtgattcctctccacttcactgttcctctcctcagctcgtccctttttcctgctgctgttggtgttgccctgctcatactatggatagagtttcctttctgcgctgtggatttaacattttttttttttgggaaagttcaccagttcttctcaagacgtgaaatctccttctctttttttttttgtggggttctgatttttttttttttgatcgtggttctctctcccttttttttttccaggtatcttgagcggagggtgcacgcaaatgagaaaacgggaattcgaaagatcgttttttttttccagcggctaacatatgtgaccgaagcaacaaaaactaattttaagataagggtttaatttgcattgctattcttacctatacaaaacctaaaaccagatgacaaaactgagcaaaaagttataaaattagttacagtttacaagccgaagctaaaacaaatatgaaaacgctgcaagagggctcggtcgatcgatcttgcatatgtactacacgtcgatagacaccagataaatcatttcttgcctccttcccggtgatgcatctcttctccggtgccgagacccagcattgtttacagattacaatcaggaaattaaactggttgtggtgtgttccgcagcaggttcatgttcagagctttgagcgaccttgcagattaacctggacccaaattaattaagaaccggtcatacatagggatacaggtaactaacccacgaatctacttataaatcaacataaatggattattttgatcaataaatagtttcgcgtgttaatcacttactcccttaatcataacatgactgaaaataaaacaattaaacggtacattgtacatacactcattgtgacatattgcaagcgaacctgctggccttaccttgagaagaacgagcaggggggtgttaaggatcaggaaacgagtccacaggtgaatgctgttgatcttgaccaggattacggcttggaggccctggaccaactggcaaccaaacaagatcagaaccaatcacacatgaatatgcaaataattaaacacatcatgtacacacacgaattgtggcacagatgtatgcaatcgcgaattaattaattacccagaggctgatgaggagggtgtttaggatcaggaaatgagtcaacaggtgagtcatgaggaccaaactgcggagcaactggcagccaaacaagaaccgatcgatatatcacacatgagagaaaataaacagtgttgtaacagatactagcatagacaagcgtatatatgttacctcgatgactaggaggagggtttttaggatcaggtattgggtcacgagggccatgtcggcttggatcatcatcggatggcgtaactggcagccaaagcggaaccaaattatgcagtgcatcattagtattcattccgtcttaaaatatactcccctgttcctaaatatttgatgccattaacttttttaaacatatttaaccgttcatcttattcaaaaaaatttaaataattattaattcttttcctatcatttgatttattgttaaatatatacttttatgtatacatatagttttacatattttacaaaaagtttttaaataatacgaaatgttaaacatgttttaaaaaatcaacggcgcgtcaaatatttaggaacggagagagtactagcgtattaaagccgttacctgcaggaggaggctttgactcgctgctgggtggtaggggacggaccacggcgtggatggtcagttctatgcttaaccctggagaggctggaggcgcgacggccgccgccgtaggggtgacggccggaggatcgccggcaggagcggccgccggcggagtggccgccacggcgtcgctgatgacgacgggtgccatcttactctgcattttcttttggttggctgtactgtagtctgtactggagcacacgcgagataactgatcagttgcttataaggctatttatacatgcgttaataactctcatatatatatctccatcggatcagtttcccatgacaccgtcacaccatggaacctagacgagtggcgtgcgtttacaccaggaatgtgatgtggcatagacttcaagctcagagtcagaaagtactccctggagaaaacaaatgtggcatagacttccaattttcaaagttcagagtcagaaactcggtggtgaaaagatatggtttgtcgggggaggtgctgtcctgcggtcaactatcaagtggtttgctcgtgcgtcagcctaaaactcaataaattcagatttcatggcgtcattcaatctcacaaattagccccactagttacgcggtggatcacgagcgttcacatctatattttcagattattctttattttagagaaagaaatgcttgcatatacacaatacgcataactcttatccacgataccctaccaataccggtttagtaaaaaccggcactaataggggtttttttttttttgtcccatggacttgtgcacgcactggcaagagaaaaaagggtattgataatatcacatcattatatatcgctggattgctagtcgaaccgtcactaaatacttctattctagtttttttttaaaaaaaactaacatagtaaaataactattcgtgttggtttttaggaataactgataaaaaaacgagccgagtgacaacggggctaagccgagccgagtgagggaaaaaatcttgaagtgtcaacccatcgctctctccttctctccctcttctcactagtaagtagtagtcccctcatcctctcctccgtgagcagcggccccctccctctctccttatgctgcattggcacccccccctctctccttggatctaccaccacagctgcagatcgatgcctctcccaggtatcttttttttttggtttgtagacgtgaattagtgccggttaaggatttcctttttttgttggtgaacacgaattactaccgattctaggaaccaacactattgggggatggccccgggcatcctccggagcccatagtgagtgacctcactccacctagggagccccaacctacgcgtcggtgacattgggctagctccagcccgaaaggacgaaccaatgtctcctcaagatgataagctaggcaccctccgaaaacccaaaggcttcgaataactatcaatgcttaacaagacaaggagcattcaatacttccacctaccaaccacctagttctaggacttcgagtggttgggttgcaatcaaggacctggaaatcttaggcccatccttgccaagatctgctaggatgctaggatccgcaaagctctattgacccaccaacataatgggccaccaagggcggccccctcaggaattagccccctgccccgaggagggggccacttgtcaatcgcccactagccaaggctacccggagccgtactaagaaccagctttgtaattccccatgtcataaaccctgttatataaacaagtaaccatgcctttgagcggcaggttgttcaataagtctatttcgctcatctcatacacacaagtctatttcgctcaactcatacacagagaactattggatttcgttccaacagcctccccccaacccaaccactccccctcccccacccccagcacccccgcggtccacaatgctactccctccatcctaatatatagggcgtacctgccctgaacgcagagaccaaggatgcgtacccgttttgctcgtccaacgtgcaacgcttcgcttcacgcgcagccctcgaccttcacgcgcagttgtgctgggagagagagagaagcctttttaactaaccaaactgataagcaaatattgcatgcgtgtaaacgggagtgtgagtcttgaatgcttgtatgcatatgtatgggaacgaggaaaactttaatgcttgcatgcgtttaaacggctgccgaggaggtgccatacgtcctatattttaggatggagggagtagtgttgtagttccgattagggaaatgatacttatgagggtttctatggttttctaaacattccgaacttgagaccgccacatcatcctcctatgtcaccatggggaggagaatgcatggaagggtgggagggagagaatccagttgggcagtggcttccatgcaagagagataatagagggagaggagccgcggcagaaaagagggagtaacacgggagagggagagaatggagtggaggagaccatatgggggatttggctcgtgcaattgattggccagcttcaaccgatttcactattggtcaggtagaggtagtatcactgtcaatttttaacgtgaaccagcaacaaaattatttttgatggtgattataaataaactggcagtgacgaaaggagttggactgatggctctttactagcgaatgcaatttgcatttgcaaaccgcattgtattagttgcacacttgcacttccagacaaattaaatcacattaggaagcggtcaatcactgcctccagacccagatcgatcacacaatctttgaagttgtgttttatttattcattgctcagaaaggatgaagccgtgtgtccatatttggtttactagcagcctagcaggactgcacgaggtcaagttgtttgctcttggcttggtcaaaataacccagtggatagacttctcactctgtattgaaccgtgaagcttgtaaaagaaagagacaggttcagaataatgaaatcagtacgtagtttcattgtgataatgaccagaaaaaggctattttctatatggccagcgtggatggacgactcaattttgcgttgtctcttttcagttacacggaagacaacacatctgtaatacacatcattacacatggactgatggacacaacatttacttagctgcgagggcacctcttaacatacacacacacacacaaaaacatttattaagaagaaattgtaaatgtgttgggattaaatacaagacctcgggttaaaatcatacacctcttgctactattctatcaagtcacacgctaaataaatgtgacttctagcaaatcactaacatcactaatattggtggctgcaggacttaaacattaatgaccacattacatgactgaagcttttgcatcaattccaacaaaatgtccaaaacttatattgttcaaccaaaatcagtttagtttgcaatatgtatttttttactatttattaattgcattagtagaaaatttatttattattacattatcaatactagtgttagaagacatacatgaacatacaattggaaataatataatttgatcctaggtagtagttgctaactacttcctaaaagaaaaaataataataatttgcggactgcatagtctgacttctccattgttcatggtagcaactggcaactattcaagttgcaaagagaacatatctagtcagaacacccccttagtccccaactacgtaaataactcaattgcaaggcttacttggcaactattgccacttcatattatacaagcttcaacgactacgagccccaagtaacttgtttttgaaagaaaacctccaagtaatttaagcagtacagaaataaataataaatggtaggtaaaatagtccatgggttgaatggaagccaacagacctgaggtgaactacaaaagcgtgtattcatggatcatccaagtccccacagtgtcatggattactagaaacctgatgcaatacagagtatttatgcatcacagtgcagctattgcaaagcaagtttttatctccatagaaacttagccacagagaagcaatggcctgtttgggtgtcctgtcttcaggcattgtatggctttctctgttcaccatctttgtcagtataccattagctaccagtgatgatcatgaaaatgatcgacaaactctcctttgcttcaagtcccagctctcaggtccaacaggagtactagattcatggagcaatgcatccttggagttctgcagttggcatggtgttacttgcagtacacaatctccccgtcgtgtcgcttcaatagacttggcatcagaaggcatctctggcttcatatcaccctgcattgccaacctcaccttccttacaaggttgcaactatcaaacaatagcttccatggcagcataccatctgagctcggcctactcagccaactcaacaccctcaacctcagcacgaacgctctagaaggtaacattccttctgaactttcttcgtgctcccaacttgaaatcctagatttgtcaaacaatttcatccaaggtgaaataccagctagcctaagtcaatgcaatcatcttaaagatattgacctcagcaagaacaagctcaaggggatgatcccttctgattttgggaacttgccaaagatgcaaataattgttctcgccagcaataggctcaccggcgacataccaccatctttaggaagtggccattcactcacatatgttgatcttgggagcaatgatctcacagggagcatcccagagtccttggtgaacagttcatctcttcaagtacttgtcctcacaagcaatacccttagtggagaactccctaaggctttgttcaactcctcatctcttattgctatttacctcgacgagaatagttttgttggttctataccacctgctactgccatttctctccctttaaaatatctttacttaggcggtaacaaactatcaggaacaataccttcctccttaggaaatctttcctccttacttgatctgagccttacacggaacaatttagtcgggaacgtcccagatagtttaggtcttattccaaaactagatctgctgaacttgaatgcaaacaacttaattgggcatgttccatcatctatcttcaacatgtcatccctgacaattctaaccatggcaaacaactcactcataggggaattaccatcaaacttaggttacacactcccaaacattgaaacattagttctgtccaataataggttcaaaggattcatcccacctactcttctgaatgcttccgacctgagtttgctttacatgcgcaataatagtcttactgggctcattccattctttggatcattgaaaaatttgaaggaacttatgctgtcatacaacaagctggaagcagctgactggagctttatttcttcactatcaaattgctccaaattgactaaactattgatagatgggaacaatctcaaaggcaaactgccccactccattggcaatctttccagtagtctcaagtggttgtggataagagacaacaaaatttctgggaatataccaccagagataggcaatctaaagagcttagaaatgttgtacatggattacaatcttttgacgggtgatatacccccaacgattggaaatttgcacaacttggttgttctagccattgcccaaaacaaattatcaggtcaaatccctgatacgattggcaaccttgttaagctaactgacctgaagttggatcggaataactttagtggaggaatacctgtgactctagagcattgtactcaactggaaatactcaaccttgcccataattcactagatgggagaataccaaaccagatcttcaaaatttcctccttttcccaggagttggacctgtcacacaactacttatatggaggaataccagaggaagttggcaatctcattaatctgaaaaaacttagcatctcagacaacaggttgtccggcaacattccatccactctcggccagtgtgttgttctggagtctcttgagatgcaaagcaacttgtttgcaggaagcataccaaattcttttgagaacttggtaggcatccagaagttagatatttcacggaacaacatgtctggaaaaataccagattttcttggaaacttcagtttactatatgatctcaatttatcattcaacaattttgatggagaagttccagcaaacggtatttttcgtaatgctagtgtggtatcaatggaaggtaataatggcttgtgtgcaagaacattaatagaaggtatacctctttgctcaacacaagttcacaggaaaagaagacacaagtctctggttctagtcctagtgatagtaataccaattatttctattgctatcatttgtttaagctttgctgtatttctttggaggaagagaatacaggtgaagccaaatttgccacagtgtaatgagcataagttgaagaatataacatatgaggacattgccaaggcgacgaatatgttttctccagataacttaattggctcaggatcatttgcaatggtttataagggtaatctagagcttcaggaagacgaagttgctatcaagatttttaaccttggtacatatggagcacataagagcttcattgcagagtgtgaaacactaagaaatgtccgccatcgaaatcttgtgaaaatagtgactttatgttcttcagtggatgccactggggcagacttcaaagccctggtgttccaatacatgcgaaatgggaacctagacacatggctacatccaaaggctcatgaacttagtcaaagaaaggctctaaatatttgccaaagagttaatatagccttggatgtggcgtttgcattagattatcttcataaccagtgtgcaactccactaatacattgtgacttaaagccaagcaatattcttttggacctcgacatggttgcatatgtcagtgactttggcctagcaagatttatatgcaatagattgactgccaatcaagatacctcgacaagtttgccttgcctaaaaggatcaatcggatacattccgccaggtagagatgagcttctaaactttttggcttaatttgttctttattatatacttgtatgaaagcagagcctagcatctagttttataacgtctgtaaatctgatgcagagtatggcatgagcaaggatatctcaaccaagggtgatgtctacagttttggaatacttttgttagaaattattactgggagaagcccaactgatgaaatatttaatggaagcacaactctgcatgaatttgttgacagagcatttcccaacaatatcagcaaggtaattgatccaacaatgctacaagatgacctggaagcaactgatgtaatggagaattgtatcattccgttgatcaaaataggcctatcttgttctatgccactgccaaaagaacgaccggaaatgggacaagtttctaccatgattcttgaaatcaagaacgcagcctcacacaggcatgcttgattaagctaagacctggcaggtcctgtttcatgtatagacgaagagtgatttcatagtccttgaagaggtacaggaggtaacatattttctaatgtaaaatttggtacctctcggtaccgtactactaaatattttggtacctcttggtgcctctcaaggactataaaatttctcgtagaacaatgcaccaatataacatcacgtggatatttctttatgaatgcagaatggttagcgacattattggaagatttggtggtagcacgggcatccctactctttgaatgttgaaaccttttatggtttgttctgtgcgacttattccttcatcgtctaatctctatgaaaaaaaaactaggccgttttcgtgaactgatgagaggaattgggagaaaaaagttaagacattgcaacagaggagagaagagtggacgtacagtagcagagaagagaagtgaagattaggaaggcaccagagacaacaagcatccaggtgtgccacaaatagttgcctgtaaatcagagctcaaggacattagggaaaaaattggacagattagagagagcatacagtatatgccaaatatatagacaaaggcgcaatgcatgaatatataaaagcatttataatcaagatttacaaatccgatcccaatagaagtgtggatgcctcgccgcgaaatccgcggtgtcgaccatggcctagtgggcacctgtgcaggaggagaatgcagcaaggaacagtttggtcaggtagttccatggcagggagaatacatggattgagattgggggctcaccgttgtccctgttcgcaattcaccatcgccggctcaccatagcgagctgcagagaaaggggggtaaatccggggggcgaggccccagggggagagggtagccagccgcgggcgtcggcggaagtggagcggaatgcggaagccggaagagctgccggcggcggaggattcatcagccgccgcggtcgtcttcttcttccgtccgctagcctagccatcctgtacggaggggcggcgatgtacgggacgagggagcagcgttggagtagagaaacaggacaaaacggacaatacgacattcctccatccttaagggccctttgaatcgcatggtagaaaaaacagagaaataggaaaaacacatgattctaacagaaattgaagtgtaaaacagagtattgcaagacacagtgaaaatccaggaatggtcgtttgattgaagcgcaggaaaaacgcagaaatcggatgagagagatagactcaaaagaaattttccaaaaggttggagctcttgccaaatttcctccaaaatccacatgcaatgtgccattccataggaatttcataggatttgaaaaacttcaatcttttgaatcaaagggccaaataggaaaatttcctataggatttgaatcctatgaaattcctacataaatcctttgattcaaaggagccctaaaactttgaccatgacagaatacgcaaagctccttaaaacttgtttgcaaggccgatgttatcaaatacatgttatcgactctaatattgaagaggaaaattagaaagtggatttttgacttgacataatttgatctcagaaaatgaatcatctaaggcagtcaaggggcaagctatagccaattttattgttgagcatcgtaatgactaaatcggcttggttgatatagttccttggacattgtttttctatggatcggtttgcactcatggttatggtatcggtttggtaatcatatcgcctagggaggcaagttttgagtttgcctatactattaaaccttatgtaaataataatcaggcttagtatgaatcagttctcaaaatattacaattgttgaaagaggttgaagccgatactgttaaaatcatgggcgattctttgttggtcattagccaattagccggagagtatgagtgcaagaatgacacgttgatgatctacaataagaagtgccgggaattgatggatagttttcggttggtgacaatgaagcatgtttctcgagagcaaaatgctaaagctaatgatttggctcaggaggcatcaggatacaagccgatgacgaaaaatattgagatagaagtcgttacaattgcagccgatgattggaggtataatgtatttcattatttgaagaatccttctcaatctgcttcaaggaaattactgtcaaagtgaggttgttgaaaggctttgccgtggcaagtctcattcgttgggacgtaggctcatgtgttgggaaagtagcggagtacgggtaaagtgtacatccactgcagtgtgagtaaaccaaatctattcgaatagccgtgctcgcggatattgaaccccgagacatgtattacacttggctagactctaaattcttagggcctgtttgggggagctttagattctgagaagcagctgtttggtagccagcttctgagaatctggaaaagctctaaaatccagcttctccagcttctggcttcttagttcatttttcagaatcagtaactacatattctcagaagctgtggactgtttggggcagcttctagcagaagcagcttttgggaaaagctgcagatgggacaagctcccccaaacagggccttaaactaaatgggtgggatgttgcatgatgattttatactagtggatcaacttctcgagaggcgagaaggggtagaccccagaaaaccatgacgaccagtggtaggaagctatccttgggaacacaatggaaggtggacataaccgtcgttgtttaatgaacaatggagttaaagcttgatcagtttatgctaggtcttaggtttgtgcactgatatttgaaaactcagctttacgcaaagtaaccatagccactccttgtattatcctgtacattacggcattttgtgtggtggcttgctgagtacttttgtactcattgttactctatatatcttttagcagagtgttgaagagaagcccttgttagtacgcttgcgtacctaacaagataatcggagtgcggttccattttaggtctcgttccccagtcgactgcttgtagcatgtcaaccgggcccttgtatattattttgtcttccgctgttgttctctgatagatgttggcctgcctggccctaatgtaagcatttaactctcttagcctgaattcattcgtgatatattatgattcggttatgtatgtgtgtactaactactgatttagggattggtactgaagaacacataagatttctgattttcaaaatcgggggtcgacaaagggggatgaaggggaagaaagggggaggtggaggagatcgagaaaatgagaggagaggaggaggagaagaggaggggataaggacgaggcagcgcgcgcggctcgaggcagggattttcgtgatttttttaactttggtcctggttggtataaacaaccgggactaaagataaaaatgtgcatgtgtgttttcaaatcggtaataaatatatttttagtcccagtttttactcaaatcgggactaatgtgatttttgagtgacccaacaaagatcatttctccagtagtgaaataagggcatgtacaacggtctttattagtggtctctctattgccatgcaagtaaatttaatggcatggaagaaagagaaatgagtatggttgttatgcatgacaacggctcagaatcgactcttaacatttattagagcaaattttctaagaaaaagtattttaatacattaatgattagatatcatattatcttaaactgttttcgtacactagtctctagataacgtagtgatcatatccgactctatctttgtacatgccctaagccctcctctatcagaattctggatccgccacatagaagaatggaaggtgatgacacgccatcgatctctcttctataccaaatagaaagggagaaaggtatggtagagtacaaaatgcaggcattagcgaccatttggtgctgatgttttatttcctgggctaaacgccattagcgttaagcttgtcactaacactaaggcctagttctttttctcaactccaaatttcaactttcttgtttttttgttagtacacttttcaaactattaaatgatatgtttttataaaaaaaagtttctatatagaagttgttttaaaaaatcaaataaatctattttttcaatttttttttaataattagtacttaattaattatgtgctaataaattttctcgtttcacatgcactgaaaaatatcaccaagtttgggcgcagctgcccccgttaggaattccccagctagattcatgttggcctctccaacacccaagtcacaagtaattaataacattactgtccacatatatataaatcggaccaagtttacatatatggcatataaatcacgggagtttcctcatcttggacgaagtggataggccggcgcttccatatccctcttccacggtttctaccagacgcgacgtgggaagtggaaggtcaccttttgtcttcatcagtgacggagctagaaaatcttcacatcaagtgctgaactgataggagtttaaatatttccataaattacatggtatttttaagattataacgagcaattaaggattatggaaccaggcataaggtcagtggcggatccatagtgtaagcattgatttcagctgacaccaataacttctcgctaatctctttgctaatacactctagaaacaagaattatatgtattgacatcactatatttgagtagtgacctcaatgactctattttctggatccgccgctgcataaggctgaaggcctactgccccataattgtttccgcccctggtcgacgacgccggctacgtctttattctctgtcccaaccgcgcagaggcggggttgggattgtcatgggggacctgggggacctgggggaggatgtcgaggatcaggagggttgtgaatcgggtcaatagtaggcgtgtgtggaatacctgatgcagcaccaaggaaggataaataaattcactattaaatgggaaatcaaacaaatgaagaagaaatatatggagccatatatacgtgggaagacaatgatgtactagcattcgaaggaggaatagaaaaattcagttacatttacgtacaagctgcaggagtaataatgacatgtaatccttccgtactcgtaaagaaagttgtttaggataatgtttaagtcaaactttaggattataaattataaatagtacttgttgagtttgaaaatgtaaaaaatacttcctccatctatttttgatagtcatatttcatcttgatacacagactaaggataagtaattctacttatcatctatttaaacatgctactagtcattactcataaacaagtgattcattaatatttacatttctcgatgcgcatagagccaatcttgtgtggaagaatggagagtcacgcattaaatccgagaaagccattaagataataggttgtttaattgaaatatgcctatcgaaaataaatttttcagatttagaaatatgactatcaaaagtagatggagggagtatatgaatatatttgtcttgaaaaatactttcataaaagtatacatatatcactttttaataaatatttttatagaaacaagaagtcaaagttatgttttggagaccgtgtcgttgtccaaaacgatatacgctacagttgcaaaattctagtaattaatacgtatatcaaaagtcataaatctcacttaagaaataattaatgaaaagttcatgtaggttccagctatcctaccccgtggagcacgatcactgtcatgggatggtgcagccggaggaggaggaggattgttgatggcagcggcggcaggacagctgacggcggcaactggaggctgagctgccgatggagagccgcaatcactagcagcggctggatgctcagtgtcccgacgagcaggcggcggatcgccgccggcgccgcagccgttaataagtgacattacggtctgttgctctgggtgagtgacggctgatgagtggctagctgagttatagatggaactttgccgtatcagacgagtcagttgtcaacgcggctagacaagtctcctgtagaaaccacacgcgttcagatcgtgaaaataacatcatgtaacattggccggacaaatgttatagttggccgggccaatgcagtgcatggtggagattggagaatggtgacatctcgttatcaatgtctgaactcacgggtattgaattgtcaaatttgtctgaactcactaccattgaatacatttcgtcacatacttttgattacacttggtttttcagaaaaaaatatatttaaatatttaaaagatgtcatattagtaaagtgtattgcgtcctaagagcacccgcaatggtaaagtaaggtgctatctataaaacatgtgcatctcagcaatatactagattaatagtaaaccacctcaatagtaagtctacatgggtatctatagctctctcatgtattgcctcgtttttctctattgactatctctaagttagtagatagctttgctctctctctcttcatttaagatcttccatgtagaaaaatatgctgacatggatctcttgcagagagcctatagatattgtgggtaccctaagcataaaaataaattttccatgcaccgtagtataatcatttcaatttggaaaaaagtttaaattacgctctaaataattgcagcagtatgaattatatcccctaaactacaaaaccatacatattacatcccaaactttttaaaccggacgaataaccccctaaatcaatccggagtggttttgctcctacctaacacacaaatggcaatccagacagcttaataataataatcatctatttagaaacgaggggagtagtacaagtagccaaagtttgaattggcttatgaaagttattttaaaacataaaaggagtacattctaattctgtcggctcccaattattttttaagaagaaattgtaagcgtgctggggattaaacaatgaacacaggaccttggggttgaaaccacacatcccttgctattgcactatccagtgcatatcacagtgtatctgtataatgaatcttcaatggatggcatgtgtgaaagggaatatcgactcttgttaaccttccaggcaattgaattggtgggagaagacgacgacttgtacagctgatcaaaagcatttactccaactgctttctaaataattcacgcaactgataaaagcatctccagttccagcttgaataaaaactagatcagctttagagcttagaacagcaatggcctatttgagggttgtctctattggttgcctttatctatttgatttcttatgcttcctaccaatagccatgagtgaccaaactgagacagatcgacacgctctcctttgcttcaagtcgcagctctcaggtccaactgtagttctagcctcatggagcaacgcatccttggagcattgcaactggcatggagtcacatgcagcatgagagttcctcgccgtgttatcgccattgatctcccatccgaaggcatcataggcccaatatcaccttgtattgccaacatcacctctcttacaaggctgcaactatcaaacaatagtttccatggtggcataccgtctgagctcggcctcctgaaccaactcagaaaccttaacctcagcaggaattccctagaaggtaacataccatcagaactctcttcatgttcacaacttcagatcctagatctgcagagcaattccctgcaaggagagattccaccaagtctaagtcaatgtgttcatcttgaaagaattttccttgccaacaacaagctccaagggagaatcccctctgcttttggggaccttcctaaactgcgtgtacttttcctggctaacaacagactttcaggtgacataccaccctctttgggtagcagccttacgctcacatatgtctgacggagctcgtggctcctcaccgggagaccgcacaggcccccctttgctagttcggccgggggcttagggtgaaatctcaagctctctcggtatgtggaaagatcgcgagccaggaagaaacgcgagacacgggcgatgtatacaggttcgggccgctgggaagcgtaataccctactcctgtgttttggtggatctgtgtatgaaccagctacaaaagtctcaaacagccccccctccagccctccaaaatcctccttttatatctcaaggggataccacatgcacctctccctttccaaactggactgttcttctcttcataaatggacggagatcggtacggttgctgtccgagtgcccttctgacgggacggcccatacctacccccacttccgccggaaacaggtgcgacgtgggattatggctgtctgtggatgacgcgaccagtgtcagaccggtcacagatcagtcatctttgtccaccacgcgtcagcttagcaacgtgcatgttcgcccttcttcatgtaacattttgcctgtaatggttgggatgaagcctggtatatatctgaccgggggtaacgtgccatctctaagaggcaacacgctagctccggctagagacgagtgcctagaggctctcgtcttgacgggatggggcgaggcgtgcgtcagaccgccagtcgccacctaacccgtgatctgaccggtctgtgactggtcacagaccggataaaggaacgcgctgcactgcgctgcatgcagcgtgacacgcttgaccagaccgcaataaatgcggttagatgagccctgccgtgttcacctaacccatatatgtgacgcaaaaacccacaaggggtcggggcgcctcggccctcggggccgggacaggagtcacccgacccccctcggggaaatcaggaggagggcggacacctcaccctcgggcccgacgtccccgagggtgccaggccacgtgggcgattatgtctgcctcaagcctctggtctcgatactcccggtcccatatcaccgacaatgtcaatcttgggaacaatgctctcaccggaggggtaccaaagcccatgttaaatagttcatctttgcaacaactcattctcaatagcaatagtctcagtggagaactcccaaaggctctactcaacacgttgtcacttatcagcatttacctcaaccagaacaatttttccggttctataccacctgttaaaaccgtgtctccacaagttcaatatcttgatttaggagaaaactgtctcacaggaacaataccttcctctgttgggaacctttcctccctactttatcttcgtctttcacagaattgtttagatgggagcataccagagagcttaggacatattccaacactagaagaattgaacttgaatttaaacaacttttctggagcagttccaccatctctcttcaatatgtcatccctgacatctctggtggcggcaaataactcactcaccggaagattacctctagacatcggctatacactcccaaacattgaaggcttaattctttcagcaaataagtttaagggctcaatcccaacttcccttctcaatttaacccatctacaaatgctatacctagctgacaacaagttaactgggatcatgccatcctttggatcactgacaaacttggaggaccttgacgtggcatacaacatgctagaagcaggcgactggggctttatctcgtcactttcaaattgcacaagattgactaagctgatgttggatgggaacaatcttcaaggaaatctgccaagttctgtaggcaatctgtctagtgatctccaaagattgtggctaacaaataataaaatttccggacctataccacaagagataggcaatcttaagagcctcactgaattgtacatggattacaatcaattgtcagaaaaaatacctctaacaatcggaaatttgcgcaaattaggcaaactgtcctttgctcgaaacagactctctggtcaaatcccagatgacattgggaaacttgttcagctgaataatctaaatttggattggaacaacttgagtggaagcatacctgtgagtatagggtattgtactcaactcgaaatactcaaccttgctcacaattcactagatggaacaataccagagacgatctttaaaatttcttcactttcaatagtgttagacttgtcatacaattacttgtccggaagcatatcagatgaagtaggcaaccttgtcagtctgaataagctcatcatttcatacaacagattgtctggagatatcccatccactcttagtcaatgcgtggttctagagtatcttgagatgcaaagcaatttctttgtaggaagcattccgcaaacatttgtgaacatggtaggcatcaaggtgatggatatatctcataacaatttatcaggagaaattccacagtttctaacgttgttacattctttgcaagttctcaacttatcattcaataattttgatggagcagtgccaaccagtggtatttttgccaatgctagtgtggtatcaattgaaggaaatgattatctgtgcacaaaaactccaatgagaggtgtgcctctttgttcaaaatcggttgacaagaaaaggaaccataggtcattggttctagtcctaacgacagtaataccaattgttgctatcactttcactttgttatgccttgcaaaatatatttggacgaagagaatgcaagcagagccacatgtacaacagctgaatgagcacaggaacataacgtatgaagatgttctaaaggccacaaatagattctcttcaactaacttacttggctcaggatcatttggaacagtttataagggcaatctgcatcttcctttcaaagaaaaggacaatctgcatcttcaggaagaacatatcgccatcaagatttttaaccttgatatccatggatctaataagagctttgttgccgagtgtgaaaccctacaaaatgtccgccaccgaaatctcgtgaaaattattactctatgctcttctgtggattcaactggggcagacttcaaggctatagtgttcccatattttccaaatgggaacctagatatgtggttacatccaaaatcccatgaacatattagtcaaacaaaggtgctgactttaagacaaagaattaatatagccttggatgtagcacttgctttggattatcttcataaccagtgtgaattgccattagtacattgtgatttgaagccaagcaatattctgttggatagtgacatggttgcacacgtcagtgactttggcttagcaagatttgtatacactagatcaaacgcacatcaatatacatcaacaagcttggcttgtctaaaaggatctattggatatattccaccaggtgagataagctaatttttaagttgataattctgtttaatgatacacgtggtgtctggtttctaattttatgacttctgtaaatctaaatgcagagtatggcatgagcaaagatatctcaaccaagggtgatgtctacagcttcggaatccttctcttagaaatggtaacaggtagtagtcctattgatgaaaaatttaatggtggcactaccctgcatgaatttgttgatgcagcattgtccaatagcattcacgaggttgttgatcccacaatgctacaagatgatgtcagtgtagccgatgtaatggagaggtgtgtcattccattggttaaaataggcctctcatgttcaatggcattgcctagagagcggccagaaatggggcaagtttctaacatgattcttcgaatcaagcatgcagcctcaaacatgagcgtcaaatgaggcaaattaagatttggcaatttcatgtatggaagaataatgtaatgtaacatatttgtagcttttgttttgttttctaatccaatgtagttagtgttcaaatgaggcaaattaagatttggcaatttcatgtatggaagaataatataatgtaacatatttgtagcttttgtgttgttttctaatccaatcaatgtagttagtggtgttagcattcgccacattcctcttaattcttcaaattgaatatttctaccagcacagttcaagccaccagagctcagtcgatttgcagaactagcatcagaccaaaccaagtggatttggtgtcagttagtaccaaatcaggcgtgaatccaatccagggcaaaattcgcccaatcaagagcagggtggagaggggatgcacacagattgatctcccgcagcctaatccagcccaaaatcccacaataaaccaatcagagagacgggtgaatgagcacgtacctcctagccgcggaagccctagttgccgcgacggcccgcttccttcccaatcccaagcgccgcccgccttctgccgccgcttggacctcggcaaccccagcactcggctggcactgcgccggtaaccggtcgccgcgctttcaccatgggcggcgattcgccgacgagccatggcgattgccgttgtcgccggcggggtgcgcgggtgggtggatgggcggaccacaggagtaaatcaggaaataagttcacggagatgcgagattttctaagttcccttaaccgcaaaaccagaaatcttcgcccctcaactttacaaaaccgtctaatttggtcccaaggcagtacacatggctagttttgatgatgtggcatcctagtcagcaaaaatatttaaataaatatgtggggcccacatgtcagtgagagaaaatgatgtgggcccaacaactctcttttttttttttctttttctcttctcttctcaacttctcagctctcacgtgcaggcgggaagatggcggccgacggcggagcgggcgcggttgccggcgcagcgggcgctgcggcgcgcggggaagaagcgggaaagggggagaggaggcggccggctcgaccgcccgcgacggagggagcggcancnggcgngngctctctccccatccggagccacggcgggttagcaagcgaacggcgtactcgctatcgccagccacgccgcctccacggcgccgcgcacctcctcggcgcgacaccggcagaggatgcagaggagagcggccggggtggacgcgtgcgccgatgggagcgccgggagagggctcgacgacgagcaagcggatgggcaggccgtcgatgctcgctgccgcttcgcctgcctccggaacgcgccgcggaacccgccacggaacgcgcgtctgtccagccgacgcatcgcctccggcgtccgctccttcggcggcaccgtccccagctgcctcgtctgcctccggccgccgccgttgtcgtaatgaaacacccattaattagtttgcacgctgcatgcagctagctagccaaccggattcatggggttgtccaccatgccctgcccgaccatgggctggtccaacacgggaggaggccgtgcttctccagctgcccacgcagcccgacgccgctgaacatcagcagctgcaggccgctcagcatcagcagctgcaggctccccagcgtcccggtgtggtcgcgtgcgccgatgggagcaccgggagagggctcggcggcgagcgggagaatgggcagggaaggttcgagctacggcctgcaggtggctgcggccgccgcccgctgcaggctccgctctccgccgctccgcgtgcctgctcgcccgccgtcgccgctagtagccgcgctcgcccgtcgctgcctgccgcctgcttcgctctccaacgctccatctacctgcttgtccaccgtcggcactcgcagccacgcttgcccgccgctgctcgtcttgcctgcttcgcagccgccgactccgctctccgccgccgcggcgactgctgcagctctcccctctgcggcaagaaaaggaaaagagaagaagaaaggcagcgtttggctaatgggatggggaaatcatttcccacccatcaaaaggcatctttaaattctaaccattcattctctctctttcatttaatcctaacccttcattcatttcccaatctcagtcccaccctccatttcccattatccaaacacacccaaagagaaaggaagaggatgatgctgacaagtgggcccttactatttccttctcacttacacgtgggtcccacattattatttttattttttttgctgactaggatgccacatcagcgaaactggacgtctatactgcctagggactgtttttgaacggttttacataattgaggggtacacatttctggttttgtggttaagggactttaaaaaaatctcgatgttaagttgagggacctcgggtgaacttattccgagtaaatcaccatctttctgcagccaagggcccatttgccgtaaggcctagaaagccacgtcgtttgtggtggaatgggctggaacggcatcaacaactgtaggctatcggtaacgaatccataataaaaattattatagattgatattctaatgatataaattagctagacttatataatctgccctaggtactaggtacagtgaatcaggaaagtgtacataggtacaccactgaaggctactacatatggcggttgacggagagatttcatcacatagcatttattacgatgcgaagaagggaaagataacctaaagggagcggatgcacaaatgatcagcattcgtttgatctccgtattatcttacagagagcataatatcgcaagtatggttgtaatgttaactatagaataattacatgaaactaatacaaataactcaaacaaatattttactatatcatagcgaattcattccaatagttgtgatctaaattattgtttagcctaagccaaaggtggctacgacaaaagatagtaaaagaaaaacatttgcaaaaaggagtaaaggacatgagtgcgcaatatggctcccaagctagcctgccgaaaggggccaccgtagaaaaactggtcaccaacaatagatgtgaaggtgtagatattctcattggtggagaagccaatcaaatcattctctgccgaccaagctcgtccttgcccatcaatgaactgaaggtttttcgtggatactgccatattgccaccgtcaactgccatgtaaccattgcccataggaggtggaagaggtgttggttgaaaagttacattagtaactacaatgcctccaaaccacatattgatggcagagtaagatagacttttgaagaatgacaaagggatgcgcccgacgagttcaggatgcttgttattaaacccatagtgcaccaaccaatcccctgatgccatatcctgcacatcattatcaaagagaaaatagattaaacttttttttcttgttctcgcgtaggagtatcatctactgataaacaggattaatttatggattgatgaaaaccaaccttgaatactttaagtgtgatgtattgcttggctccatttggttgtgagataccagggattgggtcgccaggacgtatgtatgcgcccctctcgggtcgaaaaccagggcagtcttcgtccatatgggagggatctgttaacggagagctaagatccgacgtcttttttaaagagataaatgattatttttagtagcagcaagagtatcactaaacagaatacaaaaggtcgaatattatggatgtgtaaataaaaccacctaccttgcaatagaggtcaaaaacagggcgttcatcacctggtttgacctacgaggatagttaaacgatcaactagaaactgatgctatgatctttaagagaaaaatagggacaagaactaagaaaccttccctccaaccaatctgaaatacttctaaactggatgctggggcatcaccattatcagttatgatccaaactgaaccataactgaccaattggcctggggttaacgagaagccataaacatccatcgttgctataaatccatagcgcacttcatatgtgtttgttatgtacccagtcctctgggaaataaacaacaagttagttacataaataagtaaaaataacaagaaaattatttttcctctaaacttttccctatccctttcatgcttttgagttttgtcatctctcttgtatgccctggagttctcattttgaaccactctatccattcagttagttgaaaagcttcttataaaataattactaaggcgaaagcttcagtcatagttaattgaatgagagtcgttttacaaatcgaagataaaaattttaaaagaatcgcaatcaaatttaatgaaatttcaaagagcaaaaattcaacaaataataatttgcttttcctatgtttcctctacttagaaaccagaaatttctacttttaaaacaacttcaaccaaaattttaatatatctccatagcgagagatggtcaaataccatttaaaattttatcaattttaaaaataatttcaaaattaaaatttgcagtaatataattatctcctttgtttttaatctaaaattgtttttgccttaagaagtatacctttcaagttagcctctatgtaaggaggtagtcattaaaaaaatctaacgacaactaatggaatggggacagagtagatcaaaacgaaaactcataggtataggcatataaaggagatgataaaacttaggggtatggacagaacagcgcaaagatttcagggcacacaaagaattttctcaaatataacaccgtatggcaggcaatattaattcttgtatgtcaatctatttactagtataacactagaaagagatgactaaaatgaaccaccatatacgctctatcataactacttaaaaaattcgcaactttctgatcgtcacatccatatgtccgtgtcatgcgagcgtcttcccctgtcttcctagcgcagtcagtttccgtggcacatacaccacgcaacaggccgcaagcgatcaagcccataagctgtccgtctgcatcatcctcaaatcttaggttcctccatctcatgcgacgccctatcctattcagtctcatgttcttatcctcgcgacgcacaacatctaaccgaagatccttcaagaagggttctgctgcgtgtatcaatcttcattgcggttatcaaccaagtatgaaaatggaacagctggtaagaaacatgttccgcaagacgtcgtggaaatatgctcaggaaagcaggacatcaacgaacataatttaataaattttaaaaattatctttaaccatatagcaacacacgggccattttcctagtgagcataaatattactacattaatataaaaatagatacacgtagctaattataatgggatcagattataacgggtttgatcaattaatgcaattatatccaaactacaattatgtctatagcaaaacgtgatatgtatgtccaatgcaataatactatttgcaaaaataaatattagtcttgatccatgcaaacgggttcgtttcaagtaaagaactgacctcattacccttctcatgaatgatgtagtatccgttaacgagctctttgcagaccgctgttcctcccattgcaccaacacatttgccctgatgaaccaatcccaagagtatatatgatttgtagatagaaatataaacagatcgatactgcttgcaagccgcttccattgccaaatgcagaggaaagaagcaggaagcaggtcagaagaacgccgacgaagagaactatggccatctcggtggtcaataataataggtggtcgtagtatgattcgaggctttcgatctgtatatataggtgcaacaagcaccggtgttgtgaggaataattgtcgtgtatcttttttacatggaaggtgttttaagaaagaatatgtatctttccttcgaaagaaaagttgttcacgaaagaaaacaaactgtccttaattgactaatatatttatatatgtgtgtatattttttagataatggaaaaaattccagcatttgctttaaagaatatatgtgggtatatagactatagcaaggaaaattatagaagttcggggagctgttactcccttcctatccctttcatggctctaacatgcctcttataaaccaggccaactagctaagtggctgacaatgggaacattttttttaaaaaaaaattaagccaataagaatttttaaaaatttaaatttaaaattaatttaaggatatttttaacgtattttttttcaaaatatgtatatataatttttacttatgaattttggagaaaacatattttttaaagcgtgaagtaaataatccagtgaataagcgaaagggcttataacctagtggttacaagagcctcagtagcacctaagatcctgtgttcgactccccatgggagcgaattttctaggatttaggcgttgtacccgtcgacagcgaggcgtctgtggtaacttcgtcaacgctgtcgtttgtggtaacttcgtcaatctcaaggatttgtcggcccagtgttcgaagatgcatatagagatagggtttgtgtgcgcgcgtttataggagtgagtgcgcttgcgttgttagtatctgtgttgtactgtgtaattctaaaaaaataatctagtgaataagctaaaaagaaggcatttgtaagttgtgacgatgcaaaggaagggagataacgtagaagagagggatgcatgcatgcattgacatccattgatcctgcactatcttatggtcagcttaatatggaatatcttaagtattaagtacaattgtaatgtttaacagtgttacggataagacatatctcctttacgtggatttatagtgtacggagatactacatatctaatattatacggaaaagtatattcaaatatggaaataaaacgagtcaaaaaggaaactactttcatgggaatagaagacttaaaagtctgactcggaaaaggcaaggtcttctcggcctaaaagtctgactcggaaaaggaaaggtctcctcagcccatatcctaatatggttctttaagttctacttggagaagaagacgcccgaccatataaatataccacctcctaggaggagagagcatcgaatcacaaccttaactagacccacattaagatacagccaggaggaagacaagccctaatcattgacatctactcatctagacatactcgacgtatcctagttggcgggttagaatagctaacttgctcccactgtaatcaatatgatactctccacacacacacatactcacatacatatatatattattgtgaaggaaaagaaagattaatgcatcataagtgcggcgcccgatcgccacgtggacattccagatcaatccaaagggatcagacggccacagcaaggaaagtccccactggccattccaaccaagaggtggcggcacatgaagcctgatggtcgccgacgacgaccatccaacacgagagtgggatgcggcgaaggaagctagggagggagaaggagtgcttaccgagcgcatgcgaggtagataggacgaagggagcacgctgatggcgaaggccctcgggttggcgacaatggtagcggtacggttctagtctgcgagcgaggagtagtagttgggtgcctcttcatgctgggcacaagaagaggggttaggggatcttagggtgggtagaaactgcggagaaggacgaccgggggccggtaccgagggcggtgctcaccttgctcaaagaggatggagtttcgattgtatttggcgaaggcaaagaggcaccgaggtacgtggagagctttcgaagccagcggagcaggcagagcagcctgacatggctctaatcgctagcggtagatggctggaggcggcaatcgacagtggtaactcgggctcatggagaaagaggcattctggtggcctctgacttcaaagcaggggacaccagcctacggcgtggcacggctagtcacagctgcaagaggcagctggatgcggcgaagctcacatgacgtggtgaggagaaggttataggcacggggagctcgagcgcgagtaggaaaatgagagagggaggtggaagggccttgatgtggcctagagggggagaggatgaataggttgtcacgcccagaaatttaacccaaatttccagactattttgcgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaattccatcttcagctcagaagcactacacttctaaaaagggggaataatagcaaggctgagtacaaccaccgtgctcagcaagccacaccaacgatgccgacgtgcaaggggatacaaggaggggtttgtggctatttgcagaaaggcagttgtaaaacactttattgagcaaaacagtaaaacggttgggtaattaaagtaatattgaatctccactgatcaacgctacaccacgttgaacaggcccaaccaacccatctgaaccacagtgtattgggtcgatttattaagatgggactaatcacggtgaatctgatcgatcgcccataaccgcgggcacggctattcgaatagttttactctggccagaggtgcacaactgtacccacaagacacaacccaccgacatgtcaccgcgtcatcatgtgcccatgaagcacacgtcaccatgtcgagtgattgtgacgagatccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggcaagcgctgtaagtcttacagggtttcccgtgaaccggtccttaattgccatgggtgcgactcacaaaaccatgcacccacagcccaccattcagttgcattttagttggataattacgaccatgaaacatggccagatgtcacgagcacgcagctcaacaagatactaggatgtctaatactgcaattatcccatcgactgagctagtggtaattaagcatggctaagcatatagttctagctaggtcacataagtaacacgagctagtcaatttatcacccaaggttgacaaaggatagatatcaagtaaacatggcacaagcgagcagataggtaaaccctgaccccgtgtaattagcaaaacatgcatatttatttgtaaacggtaaaacatttataaattgggatcaacatgctcaaggggaatgtgtgacttgccttgcttcttcacttggattttctgaactcttttcctcgcgaccgcggacttccgaaacgacggaaactacacgctggcacgcaaaacgaggaaaaactctaataaaaaccaagaaaacagtacataaaaagtaaacaaacatgtagagcttaattttagatgaattttgcaagttgaatggctcaattcggagttcgaatgaattagatatgaattttagaagttttgagccatttaaatgaatttctagaattaaactcgatttattgcgcaattattatttatttttccaaaggaaaagagggttgctgacgtcatcaacggggaggggcggcgccggcaagcgggccccaccggtcagcggcacaagggcgccggtccaccgtggaccgggaccaccgaggcggttcaccgccggtccacgggaaccgacggcccggatcggcccaaagccgatcggacggccacgaggcggcgcggctgggcacggtcacggctcaaagccggccagccgagtgatggcgcacggcagcgcggccaccggcgacgacggccgacgacggcgcggggagcggcagcgcatgcgggcggtggcggcgcacgctagggagcggcggcgcggcgcggtaaggtgaggaggcagccggctgcccggcacagccggcagcggcgcggagcgcggcggcggcgacccggtcggacggccaccggcgacggcggcgcgtcgcgagcaggcacaggaggtggccgacgaaggggaggaaggggagagggaggggagtgctcaccgagcggcacgacggcaaacgggcggccgacggcaaggaacggcggcggcgaggctcctcgggaagacagcgcgacggagctccggcaacgggcgtcgctcaggaaggggcggacgggctcggcctcggtctgaggaaaatcaaggaggggctagggaggtgagaactggtgcgaggtaagcggaaacgactgccgacctcgacaatacgaggaggagctcaccggcgacgaggaaggtggagctcgggcggatttccggcgaagagggccagtggccgaggatctccccgtccctgcggagccgagggaggcgacgacgcgggttggcgaggaccgaagcggcgttgcgacgcggctggaggtggccatggtgagggagagaggtggtgcgcgtggcggcggcgttccggaggcgaaatgggaaaatggagtagggaccggggtggagctcggcggggcgatgccggcggtggcggcggcacggcgcggtggtggctggagcggcgaggagcggcggctggagctcgtcggtgagcggcggcgatgggagcagcgaggggagctcgggagagcgcgcgggagggggcggcgagttggggaaatggatgaggggaggccggggtacacttttataggccccggagggggagatcgtggccgagtggggcggcaacggccggcgaagtggcgaggcatcgtgggatcgtggggggcaatactggcgccggtttttggggaaaaacgggggaggaggtggaggagaggtgtggcttccggtcccacgcgagagagggctcgaggaggccgggaatggcggtgacgtgggcggttttcggcggccatggcggcaacggcagctgccgacctgaggttggggatgacaggtggggtccacgggtcccacctgtcggagagagagggagggagaggccggctggggaggcaaaacagacttgagggagagagagagccgagcgggccgagggagggggccggcccgagagggagagaaagggggcgcgcgggccgcgggagagaaaggaggggttgggccgaaaggggcccaaagagaggaaggaggattttaattgttttctttttattttaattgatacaatgatctttgtgctattaaaactatttctcgagctccgaaaatttgcggaaaaatccggagagtattttagggcacaaagaatattacaaaatattcttggccaatgatttttaattccctcaataattcacttgattaagttgatttaacttttatttaatttctagaaaatgcattattaattgatttttaaacccgaacgaaaatcggggcgttacataggtgttcctaaaaatattataacttcatagcatattagaataaacaaaaatttcggttcaaatcagaactttcggtatgggatcagaagttctggtctcaaccaaaatgttcgatggataaaacataatctatgaaattgtagctcaaatagacaatatgtatatgaaacaaaaggtgacaaacaagatatctaaataagatatatggctaccaactagatcaaataagaatacaaatagaccgtgcaaaaataagcttaagcataatattagtaaaggcaagaaagggcaaaccaaaagagaagacatgtgatttatttcctgatgttcggatctactgttcctacgtttttgttgagggccataaaggctaggtctctttcaaattttacactcctagacttcacttttgatttcttccattgcaaaggtggaatcgaaaccttcacaatctttttgtggtacaccacaaccttgggtgctcaccggtgacacctagccatctaggaggccttagtctccaaaagtaatgaattcaacaattattttttggggacgaatctagagttatttagatttatcgaatattttactaggggtcatgcatggtgatgtaaattttatatatgcatacatgactatctgagaagttcaaacagaggcaatcaagtaaacacgttaggtgaagaaagtaaagctaacaacatggtcacaactcaacctcgccaggaaacgagctcaatcggccggcaacaaatacaaacctatgaaaacagaactacaacgataataatgtttgattttaaaaattctaatgataataaagagtaggggtgacaggtgggctgtaaaggaatagtgtggcataagttgaggtgacttctaaaaactttaaaaacgaactccaatgatgattaggttcgattttttaaattccaatgaaaatgaagatatggaccatgggcggcggtggttgacgcaacttataaaaactataaaaacgtaaaccctaacgagaatcaggttcaatttattctaatgataataaagaggagagacgacaagctgattgtaaagtagtagggcagtgtcgattgacggaatctccagaaactataagacgaaacaagagagaggaaatgtttgatttttaaggtcacaagaacaataaatagaaatggtggcgagccagacaagcagtggagtagcaatggttggtgtgacttcttaaaaactacaaaattataaacataattatgataaggtccaattttttgaatgatgtgacaacgagttgactatttaatacattttaaagaaaatgatgtctaaatagatagataattttgtatcaggtgatataattacgcgggccaccatacttttttccagggcctgcaaggtttacagtgtaaatggcataaatcacgggagctccttcttggatgaagcagatagaccacgaccggagcttccatcctcttctaccggacgagtatgagaaggatcgtccttagagctggtgactttgtcatgtacgtcgccggcgatgccttcattctctgtcacagcggcgtggagattgtgcgagggcgggcctgggggctcaatgggtttctcaggaccttcgtgaatgggctctccagaaggggaaaccccgtgttgaccatccgatgcaactgcaacaccaaggattcactgattaaacatgaaatcaacaaaagaagtaaaaatatatatatatacggacgctcatgtgggatatcatattagagctccaaaggggacatataagtatttgtcgctttttaagatgcgataattaaggatttgtcactcactgtccatagcatgtgggtccagtggtaaatcctttttcaccacttgtaagggttgtcagtatcccgattcgtatcgtagtatcttacgatacaacgattctaccaagccgaaacgataccgattccacctagtatcctaatttttatagtatcgcgatcctactattcattactacacgatcctaagaaatcttagatggtatcctaattctacgatccctacgatactacaaaatattatttaaaataacatggtttgaaaataatgtaaataaatatactcaaatttgtataaaaatcagttaaatatatcaaaaccaacgtggtttctcttgataaatatctctatttgcatgacatatatcattacgacattttttatatagattggctatatataactaatataaatattaattaaacttaaaaaaaatctcataatatcccgatactacgatacgatactactttgagtaaaacgatactacctggtatcccgatcctaacaaccttgcttgtaaaaagagtggcaaatagttaattatttcctccaaaggtgaagagaaaaaaaatccagttacagtactgaacatccagaaggagtacctacataatctctccattccaaaatataaagtaactttaaaatgatgttaagtcaaatatttttgactttaactattaataacaaaaatataaaaaagatcaatcatgtgagaatgatgttactagaattatcactaaacaaacaacataaatatgttactctatttatttaaaataatatatttttataaatattatcggtcaaagtagtatatcggagacagtgataagtccaaaaatatttgtactctaggacgaaggcactaactatataaatttactagaccgcaccatgatgccacgggaaggtggcatgcaaaattgtattatatgacttctcgtgatgacttcttcttatagttatatagacactaagagtgacatcgatcatatatttataaatatatataccccatccatctcaaaatatatattagcattgattttttataacgttgaaccattcaccctattaaaaaaatataagtataatttattttgttataacttatattttcaaaaagtttggtgtgatggcatgaaatgaggctacagcggcgtgactttttcgaaaacatcacagagtttcactacatatatgcatagatgcatagtttgaggaaaacttcagtgctacaaagaaataaacataaaactattatacagagaaaattatatatgcactcttccttttttttaaacatctcttgtgtacgtaagtacatacgtacatagagaggtattatagttcgtttttagatagtatatatctaatctaatggtttaatggttgaaagtaatggatgtactgatttaagtgtaaattgatggccatatatttttttcttaatttttttctaattcattagatctatcatgtgacatcttaagtgtgctggtaaaagtgtagaaatgtattactgatactgaccatctgtttgtagtcgactattgtttgttgtggtaattaggtgacatgctctactttacctactatttgttgatagttcctcacttagtatagtttgttaactttggtgcttgatgatataagtgctcgttggatttcagctaattattaggtgtggcttgccaaatgctggatagaacttacatacttttggattagtggtaacatacgattgatatattaggctaattcttattgacacggactattatatagtactacatattaaacgttttagtaaataagcaattagttctaaagtagtattcgattggctgctccttattggttgtaagcacataccccagtgatcgacccattgatctagaaattattacaaaagaaatatctttttataatagtatcttaatacaatccatccactactggagaagtgctcatctctcccggttcgcaaccccctttactcccgggtagcgaaccgggagggagaatccagaactaaagatgggtatatttagtcccggttgataacaacaaccgggagtaaaaaagaggggttgttgttatcaaccgggactaaagagagggtagcgggcaatcaagatggtccccttttcttttattttcttttttattttctcccgaatcgagtggcatgcacatccccaaatccccaaatcaaataacatcccaactccacatcacaaatctaaaagttactcatacacacaaat

SEQ ID NO: 83336 - DNA, 650 bp, Oryza sativa
agactggctaactctaaaaccatgggtcaccgtctgtctagcgtctaggtgaacactagatgtaattatcgattataattggtagttttttcactatatttataatcaaaatagtttactaatatcttatatccaaatctattcgattttatatggattaaaaataacagtcaaaagtcatgtgcctcggtccaaggtttatatgagtaacattaccgatgaaaactagatgattttttgcaaaaaaaaaaagagaaattcctgggtcgtcttggaaaaaaaaccactcaatttcttagtcaatttcaaaagaatccaagttggattttaaacttccaacaaaatttagttggatttcttcgatagtcaacagtttttcatgaaatctagaaaaacaacccgccttcattccatggttagaaatggttcggttttgtgaacctgcctcagttaaaagtcataaccgatactaacttttctatagggagtaacacactctttaacaaaatatttggccgcaatttctatcagcttttcaagactcgagccattggcgacatctttaccgtcgaattgagatagagataacgaagtaggtcggttattctttctcaaaaaaggaaaagatatatacacgtcagaattcccgg

SEQ ID NO: 83337 - DNA, 1037 bp, Oryza sativa
catcaactaaacactactacatttacatgttttacaaattagtttttatatattttttaatattatgtagtctaatattcgtttgaatcaagtaaataacatatatccaaataaatatgtacattttacttatagcaaagcatatgtatttttctagtaagttttaaaaacgtcatctaccggagggagtatgattttactcccatacctcctaaaaacttgttgggcactgttcatatcatagtgttaacctctcttattttagcagtagcttataaatattaaaaaaatacttatactgtcagagtatgttgcgcgtgcttaagtatagccatacgatttcgtttgaaaaattgataattaaaaaactaataagagttaaaattaaaaatcttatgggtagggaaaggaacatctgggagaagctagaagctgtctggagtgctggactgttagtcaatgcgcaagatgattgatcagttcagaataacccaattttagttgaatcaatcgatcgtgcccatgctgtcatcaacgaaagattgatgcacgcgacaagcaggcgacacgcccctcgcgagcgagttccatagttatacgtcaatgtcggatccattaaaaggtggcaaaaatgagcaggcgtaagctgatggacgcgtgccgatacattccccagtgatgatctgggaaagaaaaccgaacaaccacggagaattcatgccattcatttggcatttttctatacaaatctgtgggctgagtgtgattagcgatcgctgtcatgcagagacgtgaatagctcttcaaaatacagtactcgttgttctatacgtactgtgcttgtttggacaatttgttagctcaacggcttatctaccagactaccaccaaagtttgtaatgatctgcttttaatgcttttattatacgtccatgtcggatacattacaaggtgtggcgaagtttgatagtttttttgaccgttttgacctaggcgcaaaaacactgacgaagtgacaacatgtttcgcttagtaaa

SEQ ID NO: 83338 - DNA, 4075 bp, Oryza sativa
aaagctgaaatgcatattgccgcaagcagaacgcaacctgatagtgtagctcaagtgctcaactgaatcgattagagatgctccaagcctccaactcagcaacatatgtaagcaactaagcactaagtataataaaccatcaagaatgcaaaatcaataagttacaacacacgtcttaaataattaaatatggtcatgtcatatggcagggcgaggtgttccgataaatcaattgaataaatctatatactctgatgtacccactaaattccgcttgttgggataagcctactgttcaatgctcatccttctaatgtgcctatctatctttgactaagatcacaatttcactttaacactggaacatctacataactctctacaggccaccatgctactcaacaaattttcttggttccatcatcggatggaaaatctttattgctttcttcatcagatggaggtggcacaccaaatacccagtcaaggacattcaggtacttggaccgaaaaacttctctttcttgagcatagcagtgcatgatgatcgacgtagccatactgaataccaccacgtcggctcgttttatctgcagaattggagggcaaagtcctgcatcggtcatgcatgtgaaaaaactctcaatagctctcgcgaagcagtacagggctatctcgattcgcctgctcttcttctcaattagcagtgccagacctgtgggaaactgttgaaagagaatggttcaatagtccaaagctgattattatatactgaattcatgcgtctgcatttgcttaccgtggcaagtacaacgagtggagtattgcagctctggaagattctgaaaagcaggcacgtccatgccctgaaacagagaaggaaacatccagaattgtcatcccaagagaaaattgtactatctagatgtctactctaagaagataaactcaccatgcagaggcacagtacactgagaggaacaggcttgatctcgctgttcctagaagattcttccctattattgggtaaggcctgcatgttatgaggaatatagcacatttagagaaatcgggcctgttgcaaaaactagactaggcagcatgatagcttgcatagatagacagagtttacactatcaagggtactctttctaaacaggtcaaacttatctgacactgttattcttacatgcaccgcaattacccttgagatatcaagctcaattgatgaagtgtacttgtaagaccaaataccttttcaataaatcctgtcgatgaactacaagtgcaggaactaaatagaccggaacatagacaggtactgctcttccatatgcttgaaacaagaatgtaataaaatgccctgcacatgattgatttccatgcacaatctggattaaagagagaatacattagatcatggaaattttcaggttaacagacaggatgatgcgcgtgcacacacaaaaaacaaaaagaatttttttacataaaattgatgtatggattatatgcgtgaatgttgatacatgtaaaatatgatatgaacatgattcaaccataaggaacaacatgatactaagacatttgattatttgttgcacttaccgagcaagggactttcatatttggatctaactttaggtcaacacccacagacttgtagtacttctcaatacccgctaggttagagaaagcagtgtgattgactacttctttcacaccttgcagaatagtaagatccttcccaccatgcttatttagaaatgctttataagttgatggcaaactttcttgacttaaaatataggcagatctacataagaaaaaaatattaggcaaaagttaccctcacacactaccaaacatgcaccacaaaatggtgaacagcatatatacatggtactgaccgaaacccatgtgactcatgttatatttgataatataacagatcaattaataaattgtcatagcaagataataaggaattactaatgatcaagaaatcctagcgaattcttcattatataacagtctcaaataatgcattctttatatccatattaaaaaaatccagactaaaggattttagaccatttaaaaaacaaactacattctgttatcacatttcgtacagatgctatactaatttcaagctttgtactatgtactgtatatgagtatctcgtccaaggctccaagcaactccatccaatggatagctgtcagtacattgagttattgacaataggatctaagcaaaatccaaacatacgacatgcacaactactaccttctacagcctagatattcatagcaaatatgagagaacttacaaaatttgtgcagatgaaaggcacataaggaagatgtcaccatgcgaccaagtcaaaggcttgcaaatatttccaaatcttttgctctttattccacaacgggatgcaaggacagctgcacgcataagaatgtatattgccaagctagtatgttgtgtgcctggccctgtcaagagcatcgaaggaccagcaattaacccagccaataatgatctccaccttgctgttctgaagtagcaagagtatccagttatacattttcaattaaatactgaatggaaaaacaggggtagtacagtataatggaacagcacacattctgaggtgtaatgctgaattaagaagaaaaatacagccattcagcagtttgctgaatttgtattcagtgaaggctgacagaacgccaagcaacactggaacattttaaccaaaggcaaagccaatgtcccgttataatatatttgctcaaattatcgcagatttggtaacccatcatctgatctagatactagtagatgctatcatgcaaatttggcagcacagttcaccaccggccatcaccaaagctctcatgtttcctagcgaataacaaggagaggcagaggagtactaatttcaagcaactgcagggcttcagccagctgacctcttacggccccagatgccggcgatgcactcgtcgacggagacgtagcttccggcgaaggtccccaggaacaagccgtacctcaccgtctccttcagcgctagcaccaccgcctcctcgttggtcatggcgcccaccttcctgcacgcaccgcgccacaggaaaccgtaagtcacataagcagccacttcagctggggacagcggcaaagcgaaagcgaacgccgacctcgatctgggggaccggcgccggctgcggaggcggacgagcacggagaagagcgcgaggccgcccttgaggcccgcgccgatggtgaagcccttcgccgccgcctccacgcaccgccgcagccaccggagctcgccctccaccgccgccggcacggcggggaggtagtggccggcgcgcggggtgccccccggcgaggccgcggcgcacccgccgttggcagcgcatttgagttcctccggcgaggtgggggccatgagttcgccggagatgggatccccctccgcggagtaaagaggaagatgcctgcctctgcaactgcaactgcaacgctatgtggcccctgggcgcaagtcgcgagcgcaacgtgtggagaattcgccgaaatagtagtggctgctttgtgggccccaccaccctaactggacgtttacctctcaatctaacgctgcaggctgcagccacgagtccatgaccatgactgtcttgttcaacttcagcctgctaatttagtattttcttttcttgtttttcttaatattattttgagaattttattttccttgatgtaagttatatatatatatatatatatatatatatatatatatatatatatatatatatatatatatatatgatatatataggatatcttcgttaaaagaactcaaaatgacatttctgttctatagagaaggatttcgagtagaagatactacgaggattatgaggtagcaccaccgatttagtgtatggtgctttctataatcaataatatatgatgttttagaaaaaaaatctataggtttgtttggtttaataccctaccaaaaaattggtagtgccaggcattattatcttt

SEQ ID NO: 83339 - DNA, 8485 bp, Oryza sativa
  unsure (1)..(8485): unsure at all n locations
cgcctaatttcgttgataggtgagttcggtacgtatgatnaaccatagggtggtctctcttccctgccgaagttgtaacccctcagagacgactggtcgatcattttggttagtcttancataccctacaggattaatngncnccgaaaaaacagacaagtcattangcactaattaattgaatcgtaattattaaaagtttgaaaaatggatttatttgttttttatagcaacttatatatagaaaattttcgtacgaagcacactactttttaacagtttgagaagcgtgctaacgagtaccgaagaaaaaaaaatctttatcttgttagagtttagaaggagaccagcttttggactgaacggtttgcatcttgctcttgcgagcacgcagcaaccacgggcgcgttagtgcgttacgttggtacgctgcgtacgcacgtacgctaggagcaaacacggcgccggtattgccacagtgggggcagtggtgggctggtggccacttgttgctgctcgcggtcacggatcgcggcgaggctgggtctgttcgtggatatttagattttgagaagtggcgtgtgggaatttaaattgtgagaatatacaaaaaaaatcagttccatggactctgtaactatatcttctctgaacgaaaaaccgatttgtttaggagaaacttttgattctggagaagatgtaactgtctgaagctatcctaaacaaaccgatatctattttgggacgcggaatattttatcgattttctcgtggaatttcatatggaattcctacggttttttgagatgcatgtgttcattttcactcctatgaatctatgatcaactattaatcacttctgcttgctgaattattgcagtctgcggcaggataattaatggtttacgtcttcctgcactgtggttcagaatctagcttggtggcgatatcgtccccaagtcccatcactctaccaccaaaatgctgctacaattttgaagcattagaaattagttcaagatctacaagtttcagacttgaacttggcgtcagcaatttcttgtcacgcatgggcctagtttaggagagtaagcgggccgacatgataatgtttcatgggctgatctaaatgggcctacaggacccatagaagaacgggcctgaagaattgtttaggcagagaactgtcggtcgaaaatacagtaaaggcttcgcttttctagtcccaaataccctgttctgcgattgctagaattgtgaccttaatagcctataaattctattcgcgatagcactcgtaattccatctaataacaatttcgtaccgttagaaaacaatttcgtacccttaaaaaacatttcataccaaataggcagatccgctgatgctacaagttcaggaaaatggatggcgaatgcagattgcagataaacaatgtttggagggacgtctctccctccaaatctcagcgttcccggataaacatcctcttcgtgtctcaacatttactctcatttccccctttctttagagcagaaaaccatctgattactagtgaacaggttaacatggtgcttgtcaaaaggctgtgctactgaaaattgctgagcacttcagattagtaactaataaccatatcttgaccgtttagccggttcatctgctactgaaatatactcaatattctacaccatgcacataataggggaaaatcagggcagaataaattaagtggcatcaatagtagtcctacagaagaacaaacaacacaggacgaattatttactgtacgtttaaacttttttgtcacctttcaaccgatcagacaataacaagtatgaagaaagaaataaaaaatcatgtgcatctttcacagctagctgaaaagcctgaaaatgatgcgcagtgttatctcatctaagtttaaataaaccgagagcttgacatgccagattatgaaaatgcgaagaatactagaaatcagttatgatactatgtagcagcaactagaatcctgcttagatcgtcagaagagatgcagtagcttaccccagccccatcttggacagtcaacaagccactgaagcagacaacattcagttgcttgttgacaattcactgtcattcttaaatccatttgatgcagagaatacttaattcttactgctaattaagcacattatgcactaatgcaatccaaatcatggctcatgggtcttgtgatctcgtaggcttatcaaactaactgttccagatgcttaacagtccgattctaaccgagttaacactagtaatcaagcgaccaaccatgaaccatctcatgaacaattgaccaactattagacaaaatggtgctacaagttcagaaaaatgaatatgcagagaaacatcctctccgtgaatttaacaaatttaccactcattctgccctgtttgcagagcagaatatcctctaatcaatccttagtttgtacaaattgtcctctaatcagtactagtgaacatattaacaaaagcctgttatctctaaatgattttggcgaccaagaagccctctgctactaaattgtactcaacattctacatcatgcacacaatctaggaataaatcgtggcacagaaagtaaattcagcaccatcagtagtagcaatctatagaagaacaaatgacattcagacgatcatacaacatcgcatgatgaaagaaaacataaacgacctgcatctttcacatctagctgaaagcctgaaactgatctgtgaacagttaacaaactgaaatttggcttcggagaagaaattcagctacattgcaaatccatttcatgcaaagaattcttctatcaagaaaattaagcacggataattgggcacattttctcattgcattattattaactgcataaacaatgatgcatagactcaatccaagtactgaaagccaaaacgttgctgcattcatacaaatcatcagaccagagtccagagatcacatcacatgcattgcgttcatgcaagtctgactcagcaaggagaattatactgattgatcgagaattatcataccggatcaggaagactacatcatccacccaaacaagaggagaaggacatctcgaacaaatcaatagcgaatcatacctgtaccaggacgatcaaaactaacatgagcaatctcaggggagaagccacgccggcggtgagtagtccgacgggccttgctccggcaagaacttgtccacacgcggaacccccgccgcatccgccgccggtagccacttgccggtgtctctgcaggggtatttccccgcgacggcgcgagaagcgaacactgtcgactcgcggtagagcctcccgtcatccaggaagtagacgccctcgccgaactcgtcgcccggatagtcacccgcgtcgtacgatctggagcagcctcgcgcgacgaacagcatccgctcacccagcgactccagctccttccagccgtgcagggccttgttccgcttcctcggcggcggctgcaccatctcgaacaccttgaacgccgatgtcgtcggcggcgcggcaagaggagcaggaacgcgcctgaccaccatgaggagattgccgcgggactccaccaggtagcgagcaacgacgtctccgccataatcgcgccggccacgccagaagcgaagaatcaccctgggcgccatcttcatgttgccgtcgccgtcttcatggaaatcccgtgctgtgaaaacatggaggtcttcttctgcggtgaggaaaaggaaggctcccttgtggtgtatgacatcctccagagctggctcgtcgatggcaccagggccatgacccatcgccgcaacctgatcctgggaagcatttgctgactgcacgcgccaaaatgcgtgagtgcgtcgagcaacctggaagggccagtaggtgatgatggcggcggcgacccaatcctcgtcctccggtggccaaaaaagcgtcgcggcgagcatgatcacaccagtgttagggacagggccgtctggcccccccaattcagcagccgtcttgtccgggcggacaaaaaaagggaggttgaagcgcaactgatggtcgcggaggctgaggagcgtgttgcggcaggtctcgccgaggaagatccagccgccgtcgtaggcgccgaagcagcgcgcggcgcgcgcgccgtccgggacgccgaggccgtgcccgccgcagccgcggagggcgcacgagaaggaaggcccgtcggcgcgcgggacgaggatccacgggagcgggcggagatgcggcgcgttctgcagcggcttgacggcggcgcgccagtcgtggcagacgcgggccatggtgcggcggtcgacgaggcacgtgaggcggttgtggacaaggcgaagggcttccgccatgaagtcgcgcgcgggcgccgccgcgtccatgggaaagncgaaggcggagccggggcggggggcaaggcgtgaaggtgncggtggcaagggttggccgncggcgaagaaggtggaacgcgacgaggacgcttcgtcgttgtgcgccatgtttgaacttggcttctggaagcaggggaagagaggggaacagagtggattggtttggaagaagaagcagagaaggccagccttttgccagccgagcaagtggttgggcccaatttatagtgccggttttcttgggcctgaagtttggatcgctgctctttgctgagcgtttcttcttgggcctaaatgttttttttttttgagaacgtaaagttcggatgtacatatggtgcagaatcgtgtctagcagacaggagaaacaaatgggagcagggaaggttaacccttttttttttttttgagaaaaggcattcaagcaggttaacagttcagatggacagatggttattatcctacaggaaaaaaaaagagaaaaaaaagatagaaaaagttattggtccaatgaggtcatcatctttagtaacataggcacacatgttttctgtaggcgatatggttaatcttttcattagtgctgaactgaaggatgctcagttcacagctcgtcctttacagagagaaggggatgaggaaatgttgatacatacacaggatgcttatctctgaattccttgttcactttttctgaacttgtgcatcagtctgatggtacaacaaaaacactagattagacgctcgccaagccgtgcttttgccgaaaatatacagacatggcacccatccgacctcaaaacaaaaatatgcatggcagagctggcatcacaaacgaactcccagtttgaattttaaattcccggaaggtcacttatgaaaaagaaaaagtaaagccttcataaattttagcccatttatccgcctcaagatttggggcccaagaaagctggccctataaatgaggcccagtcccccatcccccttccaaaccaagcacatctcctccttcttccagaagcagaggaatccatcggttccattcctcctcctcgcctcgccaccggcaagccgcgcctccgcctctccaatggactcgccatggcgcgacctcgacgccgacgtgctcggattcatcctcaagcgtctcccgtgcctcgtcgaccggcgccgcatggcccgagtctgccgcaactggcgcgtcgccgtcaagcctgagcagccgcggccggggacgaggccgctcccatcgatcctcgtcccgcgcgccgacgggccttccttcgcgtgcgccctcgccggttgcgccacccacgccttccgccccccgctcccggccgacgcacgcaccgcgcgctacttcggcgcctacgacggtggctgggtcttcgtcgccttcggccaaatcctggactacgcgctactcagcctccgcaacggcacgcgattccacttccccgacacgggcacggacatggtggccgcgaccctctcttcgccaccggatgtacgatccacgcgttcatgtacgatccacgcgtgatgtacgatccacgcgttcatgtgttctggcgcatggagcatcaagttgtggagaaggcgactgctgttgagttcgtcaccacgtcagttctggaggatgtcatacaccacaagggaagcttccatttcctcaccagggaagaaaacctccatgtttttcctgtagcgggcttccacgaagacgacgacggcaatctggagataccgcccatggtggttcgccgcttctcgcgtggtgggcgagattacggcggagccatcgctgttcgttacctggtggagtccggcgagaatctcctcatggtcgtcaggctcgttcctcatcctccccaactgccgccggggacatgggcgttcaaggtgttcgagatggtgcatgagacgcccatcaacaacgacggggcaccatacgcttggaaggagctggaatcgctgggtgggcggatgttgttcgtcgcgcgaggctgctccagatcgtacgacgcggacaagtatccgggcgccgagttcaacgagggcgtctacttcctggatgacgggagactctacgatgaggcgttccaaatcttgaatccctttgcccagttcccctgcagcgacaacggcaagtggctgccgccggcggcggcggcggcggcggaggcggttaccggccgcgtggacaagctcttgccggagcaaggcccgtcgtactacacgccgccggtttggattctgccgtgagactgccatgttcttagttagattgtctgatgacttgttgtcgtgttgatatggtttgttgatttgtgcaatcgatgatgtgttctcgagatccatgtgtgcttgcaattgcttgatccatcatagcatctcttcagtactctgctattttcaccatgttagactaatgcagaaattgttggttctcatgactcagattgcattaattagtgaatcattatattgcaacgaacaatgattcagtgtgggggatcctgttcatgccaatttttcaggctaatcctcctcttccctcgccgaaagtcgcttaatcagcatccacagtgacagttatgctgaatcagcttgattcatgtcgaatttcccatgggtcaataacttgagactcgtattattttaattttctggagtctgtgagttcttatcactttttgtttattgagttccagactgaacagtaaagaatctgcaagtgatacatcgaagtcgtagtgaactgccaaaattttctcgtggttattgctggtgattaaccaaccaaccatctaaattttaccaacattttcttaccatcattcacaagatcctgagtgcaaattcagaaaaatgaacgggcaatgcagagataattatcctcctctccgcgtgtcaactttttctctcatttgatccactcttctgtagagcagggagggcagaagaacatcataatctgatcagtagttcagtactagtgaacagaataccatgacgcctaacatcaggctgtgttactgaagtaatgcctaaatgctgataactttgggtgaataaccatctgttaactgtttaaccattcttcacaacgttctaccttatgcaccgtcccgtactgccgaagcgccgccgccgtccgagaagggagaggcggtgtagcgaaaagaggggggggggggggaagggacgcggacgacgacgacgacatggagatggcgcggagctggaggggattgcctgcacgccgccgccgccgatccggtggggaagagaaaagtgagagaagggagagagagagagagggggaggaataaaggatgatatgtgggccccacatgtcagtaggtctcacatatatttttttaaaattttaatgctatataagcgtcacgtggcatgaagaccagatcaacacccccacgacaacaaaaccacccttcaaaattgctagagaattcaaattacactggtttcaatagttcggtcttacccgatattttagttaagggtcacgaattagatttgatgaacagttaaggaagttaaagtggatttttttccgaaggtaaaatgtctttctacatttgagcccattaatcttcctcacggggaagatgcacttgggggcttggggcccaagaaagctagccctataaatgaggcccagtctgatcgcatgctggcccacccaccctcttcttccaaaccaagccgtcatctccacccgcttccagaaggaattttttcgtttttagatttttttttaatatttacagaaataatctatcgaccaaaaaaattgcagaaatagcccctgccgcccaaatggtggccggcaagctgacgtagcagacggtgggtcgaccgcgccgtctgccgccgtcggccaaaattgcgattaggcccttgccgcccaacaagagggcggcaaggggctaattgtaattttggnnnnnnnnnnnnnnnnnnnnnnnnnnnnnnnnnnnnnnnnncgggtgatcacgtctcagggtcttatcactcg

SEQ ID NO: 83340 - DNA, 811 bp, Oryza sativa
tccgttggtcgtgtagacgctgcagcttcggaagatccgctcttcgtggaagttgaagccggtgtttgggaaagcgagcaaggcaagtcacatcatctttgaacatattgaatcccagtttgtaaaattatgttgatttaacttattgcattatcgctttatttaaattcccgcgttatcactgttttatttagccatgcctatttacctttgttacgaccttattattgttattgttattattaccttgttcaccctagaaccaacaaaaccccaactagtggacactctactcatggtaccactagtatgattttaggtagatgcttcgctatttaattaggtaacattaggtggttttacaactctagaccttgggaatattcatatcacctggacactgtggaattgttggagtattgtggaattggattcacaccgccccctctattcaaaatccccaaaagtggttttaggctgggctcggggtgcatggttttgatagtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggatacacgagctgcggcccggtagtcgagatgtcatggcacagggccggtgtcctgctgctaggggctcagtcctgcctgcctgtcccgggtgttccggccgtaggtgggattgggtcggtactcttgt

SEQ ID NO: 83341 - DNA, 721 bp, Oryza sativa
ctgcaatccataaaccacagtaggctggcacgtgggccatccacctatttattttctcggtttttattttctaatggaaatcatgctgtgtcattgacaagtggggccgacccttttgattaggggtaaaccgctccctttaatcaccgatgggtcccgcttgtcattgacagtaaacataatattgattttaattatattttctaatcatccggacccacgcgtcatagaatcggctaatcatcattagggagaggattactgtgcgctaactactatgtgggtcccacatggtttctctctctctcgttcttttctttcttccccgtcgtcttctacctctcgctcgcgacggagcagaggagcggcgtccgtgcggcgcggcggcccgagccggaacgactcggcgcacggtggggcgagcggcgcatcaccagatacccgccggcggcggcggcgaagcgcggcgactgcccggcgcgcggcgcgacggcgcgcagcggcgccgagatcccaaaagcggcggcggcacaatggaggccaatatgagcgcaaccaatgacgatttaaccatctagggtcctcatggagtatgtagaagcaaaaacctagcctaagttacattagaacgaggcccctccacgatgagctcggccatggtgcggtggcggccggagtcggcacggctacggcggcgcacaccccaaatcgagggggccgc

SEQ ID NO: 83342 - DNA, 2040 bp, Oryza sativa
gcagcagtgaaaaaaggaagtacccttaccggttccatcccctgcaagcattttaatcaaccttccagttcgtttctcccatatgaaccatctaccatcatcacttccgctagcaataaactcccctgttgtaagagaaacgcagcatagatgtgtttacgttattaaaatgaaccattttattccatggattttagaactcaaattaacccaagtgattctgtgtaacagttttagtcagttttacgtaaaatctaaaatttagtaagcactaaaaaggttcataattccatgtaacaaactccacaaggaaatatagccttcaggacaggggagaggagatgaagtgtctgataatctaatgttaagtcaatatgcaaagtagtatgttttaattaaaggtcagtgtatttctgttactagaaaatttgtcattaaaaatgcaagtggctcatggaaggacaaatacttcaagtaccactaagcaggaacgcaagaaggaacagcctaaccttgttcaccgagaaagctagcttgctttatatctgtccccacattgcagtgtgcaacatatctttgcttcatgtcaacggcaacttctggctgcattatataatgggaagatgatgttaaatccatgtaatatcagtggaatacatatatgaacagaaaaatatcccatattaggaacttcagacaaagcggtggcagaaaagaacaaacctgataggcagaatcaccattctgagtggactcagctgatccattttcaccagaatgttcgtcagtttgactatctcttctgtgaaatcttaaacttaaactaccccggacaaaacctggatcactatcacggctttcatcacctgatgctgatgtttcaaagtccaactccatttcatcatcataatctgaatcttctcgaccctcctgtgatgacgagccactggcatctgatctaaacagtagatcacttaatgagcgtaaccgcccatgtcgtgcatcagtgtaggtattccctacttgatcctttttattcttctcaagttcagctgttcgaacaaaataaacccatcatatattttggaagttacaatcagtaaaccaacataataatgcatctggtgcatcaatgcaaccaccaagccttaaatctgcaatacaggtcaattttagtttatgtgtttttttgtgagttgcgacttcatgacaacaactatctaacatgggggattaatagagggtaacttagctcagtgcaggcatgggaaccaatttcttcgtaactatttcacattatgttgtgtgtgggaaaaaaattgcctgtgtccgatatactatgtgctaacctgcaaaaagctgctcctttatattttccacttgcttcactgactgagaataaggtggaacaatagtatttaatgcatccacatattcagatgcctctttcagccttcctaactacaaattcccaacacatgttcgtaagagaaaaatgaaaatcaactgatttcagcacttcatttcaaagggcattagtcaatccatgtttctatgaattactcagcttacctgtaatagtgcttctgccatatacagatgcgcctgaaatgatctggaatctatacaccttgcactgttgcaatcccttatagccatgtatacatcatttttccacctcctctgtagatcaatatttaatgatccgtacgttttacacagatcagattttcaacaacagataaacaaaagcaggcaaacctttagatacaatcctgcccgagtacacaagcaatcatgcttcatgttatcatcaatattatggtccactgccagaagtattgtagagcatgcttcaaccccaagcatcaagttagtgcccatctcaagagattttgttgcaacttgcataagtttcttgaacgtatctacctgaaacgggtgccattaaaggcaaagcggttcaacatgtccagcagatcaagcaaacagtgtggtctgaattgcagagagagagagagagagcacaactcaccctac

SEQ ID NO: 83343 - DNA, 2210 bp, Oryza sativa
cagtggatcccccatcttactagtctgatctgctgttgccattgtgaacactcaaggtcacacgcaccaaaagtgaacagtgagcaggacatgtcaagaaagctgaaacgtaccaactaggcaatttgtgcatatcttagatataatggctagactgatgatacgctgacggagcaaaattcataggattgagtacttaattaattaaattgatgatggcatgcatgacaagatagagtttaaagggactagaaagcaagtttttaccctcgagcacaatcaaggaatcaagtgcagatggactaagcatgcatgttagttttaaaataaatactaattatttgttgttgtctatatatatatatatatatatatatatatatcttaccaaatgttagttacagaccctgcatgcatgatcacaaaacgaccgtccttcccacaacaaaatgttgtcgttactgaccacgcacgattgagtatgctggaagctactatcacatgcactaaagtaattaacagctaggggtggcagagcagtctaacacgtaattgatgtggctttcacttgaagatttcacatacatatatagtagcagtatgagcttaactactgtgtatttttatgtatatatgatttctctatcttagatagtactactttttaggcaagaatatatattaatttttgataaatgataattacagaatctcatgcaagcactacaaattaagcggtacaaatatatccaaacagatagttagctaatatatatgctgactaaaaaaacttaaaactacttaatcaagcggctaaactgcacaaataatattggcttgcaatttcttgacaaaaaatgaatgtgtacatgtataaacttgcattcatactctacttttctacccgtacacactgtgcagcagctggtccatggtttcataccatgcatgacgcaccctttactaggggcatgccatgcatgaccatgatgcatactatgacgcgcatttgacatcattagcgagcctgtcttaaactaatcaggcaggcaattagcgtcaccaacatatgcatggcgcattactcagcattatattgttgttctagtggctgttaattatggcttctacacctcaatctatctctcctctcaccacacacatggaggtcctgcatacataggcatattttcatgcagggcatcaattcccttcctccatgataagcaaagcaaagcaaacccaacccaacccaaccccaaagactgcacactgcacccccatcatgcatgcatatatgcattatatgtctagacatatatatcatatatatatatatatatatatatatatatatatatatatatatatatatatatatatatatatcctatggcgtagcttagctccatccacacatcttttttcttctctcaccaagagagaaacttttcagacgcaaatctctttaccatgcaactgaaaagcaggagagatctagcgagaccatgtcgcccaaaagctacacctctgcctgcgcacagagagagatatcgatctcctctgaaaagcagacataattaaggggagcacgtacacactacacacaccaccaccatttttttccctgcagagattctaccgatcatcttcaaaagaagagctagtggtggtcatggtggactcatggtgagaagagaggaaagaaagatagttagatagatagatagatagatagatagatagatagcacatcgattgatcatgcaaaggcatgcataaatgcatctccatccatgcgttggaaaagctagcagctagcttcagcttcctcctgaagcttgataagaccagagcttgcagatggcatgggctggatagatagctagtagagaaactaaagaattactaggaagatgtttgatgcatctcagttgcaaaacccttataatttcttgaccaacctctcattgtcttctacagagaaaagggaaaccctaacaaaagatgagatgagagaaagaccatggactgattgatcgatcactagaaacgaaacgactgatctaacataaatagcaaatgtatcgggccgggcgtggcgcgcgcgcttcgcggcagtgcatcgtcctgagcaatgaagaataatccaagaattatgatcgattcgatctccatttggaagaacacaacaagatcatcatcagcag

SEQ ID NO: 83344 - DNA, 1074 bp, Oryza sativa
taatctgtgaccctaaaccataaaaccggatatctcgaccccctaactcttaaaaccggtgcaatttgacaccctcggcggttttggagggcggtttcgctaacgtggcgcctacatggcagtattgactcggtcttctttccatgtggcgttgacgtggcgcttaaggtggcattacaaataaaaaaatatgtgtgggacccatttgtcattctcacacaaaaataaattgtgggacccactgacatgtgaggcctacatgtcatcctctctatcttcttcatcctccccctatctctctttttctctctgcgagcgtgggacgggggccattggcggcggcggacgggcgggagcttacggtagcggcgggagggtgggcgggcgagggccggatgtaacatcctaaaaatccttaataataatcactaaaattttgaactcttaaaaaaaaacttttgcatcatgctggtgttattcgtttctctgttgtaaaatgtattatttaagttaaatattgtgagaagacaaatatattgatatgacaagacaaatactaaaaccttaaatatgggaaaatagaaacatatgttggaattagaaaaattaattattaatatatggtgcaataaatcacaagattggaagtgttgaaatataggtaactatctaaaaaaaaggagattaaaccatctaaaaattattcacacaaaaaggtctaggaaaagccctaattgtgatttttctcgggccgctactgttcattgcgcgccaggtgttcgatttgtgtctaacctgaccaaacgcctgacgacgccctctccaaccgctgctgtgccgcgcgcctgccttcccgacccgtgcgccgcaccgggtcgcgccacgccgcgtgggcctgccgccgttcgagccgtcaaaaacccgccccaaagctgcgccgccacgagtgcccgcgtcatcccgtcccctcgcgcgttgaattcgggattgagtgataatggccgccacgacgaccccgcgtcaccctagggcatagtcctgcgccttccctatcgtaggccgttatcactgtcc

SEQ ID NO: 83345 - DNA, 1586 bp, Oryza sativa
aataaagttatatctacaggtggacgggattctccggataaaagttcttacctaagacttgatgggcgacggcggcctgtgatatctatgaagacgtcgtataggagatcatgttgatttccttgctcgcctccattcagggggtgtgtggcgacgttcttagatgttctcgtcgggttacatgagaagcgagtagatcttctctctcgcccttctctctacaacgtccaaaagtttgaaagcaatattatgctgtttgaaagcaatattatgctggagaagagcgaggcgataggtatgttcctcttcgaagggctgacgacgatcgggtacgcttagcgatgatcggttagcattagtcctatcctcaattccgttattggagtcgccaacgtgtaatggtgtgtttttctttctttctttcctgatcgtagcctcccagataataatcttcgtatttctccttgctatatcagcatgaaactttgcactatcttaggtgatggttgtttcaatatatatatatatatatatatatatatatatatatatatatatatatatatatatatatatatatatatgcatatgacttcaaatcactggtggagaaaaccttattagtcccggttcgtaaccccctgtagtttccggtttttaaaccaagactaccaatccgggactaaagatagcgagatcgctatctttcgtcccgggtgaaatagccgggactaaagatcgatctactttttttatatttgcatggccctgttgctgcatggtttatatatataatatgcatatatatgtttcaatacactaattttggttttcacttacatatacacgggcattttttagtatgattttagtaagattcatacatttacttgtctatataaaacattaatttttcaggattgtgtgcgctagtcacgaaaaaggtgcatggatttttcaggatcagattgaagcttcgggcgtggggtctgctttgttgaatcataatatagttcacgtaatcacgcctcgacaaatttatgataggtacagtaaacacaggcactcgtgcgcgttcctgggatgatgatggaccggggttgcagcttggtcgctgttgtacaacaccagagaaagcttcttccctgcgtgccattgccattgcagctggagaaacgtagtagtacagtgttgatagactctccgtgcaaccagaaagtatggctggtgctaccaattcagcaggctggcacagccttaccatgtactaggccgacaggacatgccagctgccggcagcgacgtcgtcgtgcgcaagagctcatgttcatcaccgaattgcttgccgctaaccttccgggaagaaggcggcgtgtgcagatgacgtaaggcagcacatggtcgatggttccgtcgctctcccactcgtgtacagccctttggaaactggaacgagcacatgctttccacacacacaacgacagagacacttctttggcctgtctgctgaaggaagcggacaacttacctgtttcgtgttctcaatatatatatatatatatatatatatatatatatatatatat

SEQ ID NO: 83346 - DNA, 5301 bp, Oryza sativa
ctcctcaactcatcatggaacgggaacgacgacgacgaccccctcgccgccgcaccaccgccctgccccccctgcatctgatccgtccccgcggcggcgacggcggcggcgccctcggtgcccttgaaccgggtgacgagattcttccacttggacttgcactgatcgggggtcctggcgaagccgagggcgtggaggcgcgccgaggcggcctcccagagcgccttgttgcgcttggtggagaggaaggagtggtcgaggtcggcgcggatggcgaggaaggcggcggtctcggcgtgggaccactgcgggaggcgctcccgctcgagcgacggcgggtcggcggggagcagcggcggcggcggcggaggaggaggtggggggagtgggtcgggggcgaagtggtggggcggggaggcgaggagtgggtggtaggggttggagaaggaggagttgaggtggtggaagggatccatggctatggcctccgcctcactagtgggaaatgcgaggaggaagtggagaagacgatcgagagagagagagagagagagagagagagagagatggaatagaatgggaagtcaagggttgggcggagaggagagagaggaaagagaagaggagaggaggaaatctgtttcaacgcggaaacggcttgctttcccactgcttttcttcccagatctggatcttctgcggtctagtactacggtccttggattctgggtatgacctcatgcccgtctagcctctagagatggaatgcacacaacacaatagtcaaacttgtttatttgtagatttcgatacacgtaataagaaacttgtttacaaacatctttacagtgagtgatgtggtaaaccctttctatttctaattgttttactgtttctacttaggatctcttttacggttaatctgtttaagagctaacggctaacaaaatggtttcaacctcacctaaaagggtgatgattaattaaagagatgaagcaggattcaagtcactccactttagagtatgctactagaaagttaaatttagcaattttgagtcatgttaaataagaccgtaaaatctatcggttgaaatattagttagtaaatgtttattaaagattttcttttaagtacatactagcattagacattagaattttagttagtaaatgcttctaaaaatatggtttgagtgatttccattttgttctaccttttcttacctaggttttattttggaccatcctttatctaattttttttactttgggctagttttttttatcaattttacaaagaccacacaattatgccaactatcacccctatttacaggcaaagctcatatcttctccggggagagattggatctggctatacaaaacaaaagcgttagtcaaaagtacaacaaaagattaaaaaaacataacacaaagtgatattaactttgggtaataaaagttgacccaaaataattaaatcaaaaatggttttgataatgggcatgttcggcaaccgtggctgcgttgtagcgtagccaacggcaacagtgctgcaagcatcagactaacatgtggctgctgctgccacgattgtggcctggccttccgaacacgcctaatatatgtggctatgctatgcgagtaatgattaaatatattcatcgaaagttatatcgatatcctaagcgttactttaaagcatgtgactagcgatggtgcacattaatatttttattttaaaaatataatatgtattgtctattatatcgtcattcataaatatagtaaagaggatccaagttatgtaattagacaaatacacagactggatcaccaaatattgttatggcaagatattgtagagagtttatgatatgtttggattgatagcttactaaattttaaaaatacaaaagaaaatatgtatagttaaaaatggtagggaagtgatgaacacatcctaagatggccacagagttgatgggttcataggggatgcggtggtggggtccaaggaagggtggggtgggtggggccgtggggggcggacgccgttttgcgtggagggtgtcgtcacgcggacgacagcgcggcgtaaccagcaaggccaaggaggagggggacacgtccgatccgatccgacggctgcgatggatcgatcgatccggcgatctagaggcttcgtagttcttgctttgccgcgaaggcttccgtttacgcgttccatttggcggctgtgttgtgtgctgtgctatgcaagccacaatacaaaacaagcccagcaaacgtccgttgtccatttggattgaacacatacgtatactacacacgtcctacaaacgtactcctctcgttgtaaaattaagtttatgtgttagattttttttatattattaaaccaagaaaagtaagtagctacggataccctacagccacactggtgtaatgcgtcttgctgtacgtgtaaggggttgtttagatcaggggtgtaaaattttgacgtgtcatatcggagtattatatagagtgttgtatggggtgtttgggcactaataaaaaaactaattacagaattcatcaagtaaaccgcgaaacgaatttattaaacctaattaatccgttattaccaaatatttactgtagtaccacattgtcaaattatgcagaaattaagcttaaaagattcgtctcgcaaattagtcgtaatctgtgcaattagttgtttttatcctatatttaatacttcatgcaggtgttcaaacgttcgatgtgacagggcgtaaaattttagggtgtaatctaaatatggcctaaatgattaacttgtaaacttatttatagatcaaagtagtgggttcgtgatttattttagtctatataaatagattttgtgagtttgccacttactccctctgtttaaaaaataacttaaatcctatagataatttttagatacacgtgtgtctatgtgtgtatagatttgtccctaagattttacttttactttttctttttaagaaaaaaacatgagggagtacaccgttacctgccatgctgcgataccgtcgttgcgatgcgatggccggccgtgtgcgtgttccaacggcgatggcgatacttctgtataaacagttgatctatcgtactcctagaggttattaaggttattaagattgatgccattttaaatcatatctttttttaagcaaggctattaaagatatacatatatttagtatttttactgaactttgataaatctcgttaaaatttgataatattattaatttatattaaaattttgaaatcgctaaaattagataaggcccttgtttagtttcaaattttttcttcaaacttctaacttttttatcacatcaaaacttttctacacataaactttcaacttttctgtcacatcgtttcaatttcaaataaatttttaattttagcgtgaattaaacacaccaaggtttatttttactgcaatcgctaaaatagtctcctggtaatttggtggcgacagactgacatgcatgcgcgtgcatgttgtacgtcaagtcatggatgatgaacttgtcatgtttgtagctggagtactccagattggcagctgacagcacacgcatgcgcatgcacacacgtaatctccggccggatgtccatttcccctttgttcctagatctcggcagtggttacttcgtatgccaaattttattagtatacgggtatatatttaaaatattaaatatagataaataataaaataaattacagattctgcctgaaaactgcgagacgaatttattaagcctaattaatttatcattagcaaagtaaatatttactgtagcatcacattgtcaaatcatgatgtaattaggctcaaaagattcatctcgcaatttacatgtaaactgtgtaatttgtttttttcgtccatatttaatgctctatacatatgtccaaatatttaatgtgactgaattttttgaagtttaaagggaactaacactgccctcatcacgtaggaatactcctctataggctgtgattagttccttggccaaaatctttttaagtacacggaaagtattaaatatagtctaataacaaaataaattatagattccgcctacaaactgcaagacgaatttattaagcctaattactccgtcattagcaaatgtttaatgtagcatcacattatcaaatcatagcgtaattaggctcaaaagattcgtctcacaatttacatgcatattgtgtaattgatttttttttcatccatatttaatacttcgtacatgtctccaaacattcgatgtgacgtttttagaaaaaaaataaatctatacacggccatgatacttctatccacatttatagtcaactttctacagtacggtgtagttctctggaaggacaacatgttgtggaaattccggcaggtcgagagagaaagatcagcatggccgtaccgtggagcgtgcattgcaagaatcaacaacataacaggattactattgaccaactaagggtaatcgtatcccagaaaccatctactcctattaattctcatacttatcatgacatatatatacactatgtatagtaactattaatcttattaatcttattataggtggtttcttctagctgcagagctttttatatagagaccaaagttggtttgggtcccctagcttttgaaaaaaaaatacattgagatccatggatctttgtactatcatacaaaatagcataattgtcatagttatagataccacatacctaatagtagttgactaaatctcattaggacccaccacataccatgtctgtcggtgacatgggaccggggatatcttgactagaggtttggggcagccgcggtcacccacgtggcctgaccccctcgggggggtcgggcccaagggtgatgaggccgcccctccctctatctccccgaggggtcgggccgctcccgttttgtccccgagggctggggcgccccgaccccctgagggtttggcgccacgtgtgtgggttaggtgagcacagcggcgctcacctaaccgcgtttattgcgggttggacgagcgccccacgccgcatttaatgcagcgcagcacactcgttcggtccgtgacaggtcacagtgtgtgaccggtcacagaccggtcagatcgcgggttaggtggcaacaggcggcctttcgcacgcctcgccccgtcccgtcggaatgatgagagcctctaggcactcgtccctagatggagccggcgtgggaa

SEQ ID NO: 83347 - DNA, 1701 bp, Oryza sativa
ggattcactaggttgattcatatggacacatgggagcatgtagagttggacagatggttattggtcctcccggccaaaaataaaaaagagaggaaaaagaaaaggagagatttattggtccaatgtgatcatcatctttagtaacacagatatgatggtaaaactacccgtacagattaacagatatgatgcctaccaacctaccatcagccatcaggctgtgttaccgaagaaatgctgatagtataacatcatctgatcagtactagtgatcatattaacacgctgcctatcatctgtgttactgaagaaatgctgataacttaggatctgaagaaatacctcttgactgaagaaatatactccacattttacattatgcacataacataggaacagatcctctgaagagaaaaaaaaaactagaatattagggaaggacctaatatcaaataattaggaggggtgaggctttgaatccaggtcgtctagcccaccaccttgtggagctagccggaagacccctgggcatttctcgatcctctgaagagtggcactagcctacctcagttcatcttggactgtcagcaagaaactcaaaacaggacgcagaagcaattcagattcactgcaaaaccgtttgatgcaaaacatacttctatcaggaaaactagccactgcaagtgacacattgcattgttattgactgcagcataacgatgtactaatgcaatccaagtcatgacgaacggcaaccattggaagcatattgcgttcttgattcactgcagcatcagatcacacaaattcatagtttcatactgcgttcacgattcatgtagttctgacttgaaaacattttctgctacaaaaggagaatttctccagcatcatagcaactaccaatccatgattatgacatcaaatctagactgaaactgcaactgttgactgaaactacactaatccatcgcagcaagaggagacgggacgggacaaagtacaacggctgcaaactaaaccacatctcggaggatcaaatcaacagcgaatcatacctgtaccaggacgatcaaaagtaacatgagcaatctcaggggagaagccaccccggcggtgagtagtccgacgggccttgctccggcaagaacttgtccacacgaggaacccccgccgcatccgccgccggtagccacttgccggtgtctctgcagggatatcgccgtcgccgccgccgagccgtgaacactgccgactcgcggtagagcctcccgtcatccaggaagtagacgccctcgccgaactcatcgcccggatagtcgcccgcgtcgtacgatctggagcagcctcgcgcgacgaacagcatccgcccacccagcgattccagctcgttccacgcgtacagggcctcgatgcgcgtccccgacggcggctccaccatctcgaacaccttgaacgcggacgtcctcggcggcgcgtgtagacgatcaggaacgcgcctgaccaccatgaggagattgccgcgggactccaccaggtagcggacaacgatgtctccgccataatcgcgcccacctcgcgagaagcgacgaatcgccctgggcgccatcttcatgttgcctttgccgtcttcatggaaaatcccgtactgcgaaaacatggaggtcttcctttgtgatgaggaaaaaggaaggccccctt

SEQ ID NO: 83348 - DNA, 4649 bp, Oryza sativa
  unsure (1)..(4649): unsure at all n locations
cgcatgtgcctgatnnnnnnnnnnnnnnnnnnnnnnnnnnnnnnnnnnnnnnnnnnnnnnnnnncatgtccgggcggacaaagaaggggaggcggaggcgcagctgaacgtcgcggaggctgaggagcttgtggcggaaggtctcgcggaaggcgaggaagagccagccaccgtcgtaggcgccgaagcagcgcgcggcgcgggcgtcgtgcgggacgccgaggccgtgtccgccgcagccgcggagggcgcacgagaaggaagggccgtcggcgcgcgggacgaggatccacgggagcgggcggcgatgcggcgcgtgctgcagcggcttgacggcgacgcgccagtcgtggcagacgcgggccatggtgcggcggtcgacgaggcacgtgaggcggttgtggacgaggcggagggcttccgccatgaagtcacgcgcgggcgccgccgcgtccatgggaaaggcgaaggcggaggcgggggccaggcgttatggtggcaagggttgggccgcggagaaggtggtggaacgcgacgaggacgcttcgtcgttgtgcgccatgtttgaacttggcttcttgaagcaggggaagagaggggaacagagtgaatgggaggttttgaagaagcagagaaggccaagccttttgccagccgagaaagtggttgggcccaatttatagtgccggttttcttgggcctgaagtttggatcgctgctctttgctgagcgtttcttcttgggcctaaatgttcccctttttttttagaacgtaaagtttggatgtacatggtgcagaatcgtgtgcgccatgtttgaacttggcttgtggaagcaggggaagagaagagacacagagtggcttggtttggaagaagaggcagagtcagagaaggccagcctcatggtggttggtgttcatgtcttcgatagttcgattgcattaggtaatgtttggttggtggaataggatgggatgggacgggatgggacgaacttacttttagaggtgttttgttgaggggcgagtggaatgggttggtctctagagaggaatattcctcccagatccgggacaaacccatccggcaaaattggccggacgagctcgtcccacttggacggagcacacagtgtctcctcggcgaccgccggcgctccgccacgaccgcctgccaccaccttcacgaccgccgacgctccttcacgaccgccgacgcttcttcacgaccccctgccttaacactggtcgccgccacgagcgagatgctcggcaccatcccgccactcatcgcgatgctcgacgagagcggctgcggtgatgtcgacgcggcgggctcgagtggcggcgaaacttggaggtagggagggcggcggcggcagatccaaaggagggggactcggcggcggcgaaactttaaggtagggagagcggtggcggcggatctggcgcaggggatctcccgatccagccgcggtgacgacggtgggccagcgggttgggtgctccggcggtggtggccgtcttgctgctgccgttgtgcttgatccggttgttccacgcgtggatgcaggtggcgcagtcaacggtcgttgacggtgatggcaaacagcgtccatcccatttctccctcatcccttcaaccaaacaaaaaaattgggattgtcccatcctacaaaccaaacatgtgagtggaatcatcccaaccccaaaattagggatgaatggtttcatcccatcccatctagtcccgaaaccaaacacatgcttagtggatcatcgtcgtgttgtagttagtaatgcattttctgcgatgtgtttactcaacattacttagcgttttttctgttaaaagaatgcattgcattgcatcaaaaccgatttgcagtgaagatcgatgaattgcttcttgagattggtttcagttgcttcaattctcaggatccatttaagcggatgctacatattaagttcataactattaatttgctgttcttctccacttatatcttttaaattactagaaaaaatgcatgtgcgttgcaacattgcaacaggtgaatgttattttaatcctattattgttatacgatttacatgggatgaaattcactgtgtgaattcgcttgaatatttttttagaaaatcatgagttataattaggagtccaactttactctcaagtgaccatacaagtttttttaaagaaattttttatatgacttcttttgtattttctaaagcaaacagacttaaaatccgactcaaacatggatatgtatttccaaaatagagcgaacttaataaccgattcaaatacggatgacttaccaaaataccggtaaaaacatcttcaatttttataatagtagagatagagatatattatttttaacatccgtttgacctattgtactccgctcaaaatatgtgataaaacaagtccaatatttaatatatttaaattattttaaaattgtattcttgttcttagctcttatagcagtgtagttactttagataccatgaaaagttactttcttacagcaatatagttatttctagtaacgtggggtaaatatttgcttttattttgtttttagagttactttcctctagcactgagttacttctaataccgtgaagagtaacttctatttctccagacttgcttttttttctagcaatatagttactctagtaatgttaaaagctacttctatttcttcaaagttttttctaatcccataaaaagtacttctatcttatcagttttacttccctctagaagtgtacttacatctaacaccataaaaagttacttctattctttttataaaaagattattttcttccaagtgtgtaattactttgaatacctaaagagttattttctatatgacgctaaattactctttacaaaatatttatagtgattacttccaaataaagaaaattactttctcctctcaatataattactttgtatttagttaggagtcttttctatattttacttcgcatagtttcttatttcaacatcattcaatatgtttcctttcaatgctactcaaaagtgccggttcgttaaaaaagtgctacacaaaacactagacatggcacccatccgacctcaaaacactaggcatgacgagttggcgtcacaaccgactcccctgttttagttttgaaattttttattaggattaggaattatcttagacgagaaaaattatcttagacgaggctgattcagagtaggaaaaattgcacacatcagtaggagactaggaggacatgatactgatcgtctgatccttctcgcattgggcgttcatggcctcgtgggctacataaaaggccatctaaaagcccatagagaataaatgaggcccattatacatttgagcccattaatctgcctcacgagggagatacacttggggcccaagaaagctagccctataaaagaggtccaaactgatcgcgtgctggcccacccaccttcttcttccaaacgaagccgtcatctccacccgcttccagaagcagaggaatcaatcccacacacacctcgccaccggcaagccgcgcctccgcctctcgccctcttcaatggacgcgccatggttcaacctcaacgccgacgtcctccgcctcgtccacaagcgccccccgtgcctcgtcgaccgccgccgcatggcccgagtctgccacaactggcgcgtcgccgtcaagccgcagccgcagccgcagccgccgccggggacgaggccgctcccgtcgatcctcgtcccgcgcgccgacgggccttgcttcgcgtgcgccctcgacggctgcgccacccacggccgcggacacccgctcccggccgaagcacgcgctgcgcgctacttcggcgcctacgacggtggctgggtcttcgtcgccttcggccgaattctggagtacgcgctactcagcctccgcaacggcacgcgattccacgtccccgacatgagcatgggcatggtggccgcgaccctctcttcgcctccgggcgacgaacgctgcgtcgccgccgccatcagccattcctgcatgatggacaatccacgaatccatgcattcgggatcctgaggcatcgagttgcggaggaggcgactcatgatcctgctgagttcgtcaccacgtcagttctggaggatgtcatacaccacaacaaagccttcaaattcctcacaagagaagaaaacctccatgtttttcctgtagcgggcttccacgaagacgtcaacggcaatcttgagataccgcccgtggaggttcatcgcttctcgcgtggcgggcgagattacggcggagccgtcgctgttcgctacctcgtggagtccggcgggaatctcctcatggtcgtcaggctcgtcaccgatcctcttctcttgccgacgaggacgtcggcgttcaaggtgttcgagatggtggagccaccgacgaggactcccatccacgacaaggagcccgcattcgcttggaaagagctggaatcgctgggtgggcggatgctgttcgtcgcgcgaggctgcttcagatcgtacagcaagaacaactaccccgacgctgatgtcaacgagggcgtctacttcttggatgatgggagactttacg

SEQ ID NO: 83349 - DNA, 4889 bp, Oryza sativa
  unsure (1)..(4889): unsure at all n locations
cagaatacccctgcaaagacancggcaagtggacgcggncggcggcgggtagcagcatggacaaggtcttccggagcaaggcccgttaacgtactcaccgctggctgggcttctcccctgagagtgctcatgttagtttcacctgtctgaaatgtgctatagtgtagtttcagtcaacagtttatggtttcggtcaagattggtgtgataattgtcggttggtacagttgctactatgctggagctacctagtaaattctccttttgtagcagaaatgcagtgtggtctgatgaattacatctatgcagcaatgatattgcagtcaatagtaatggaatgtgtaattttcagtgcttatttttcctgatagaagcatgttttgcatcaaatggattttacagtgaagctgaatttgcttctgcaccctgctttcagttgcttgctagcagtccaagatggagttagctgaattttcaatggctcccacacatttcataactttattatctattcacttttccataagttagctgaatttttaatgggcttctcaaattgctgctgggaaacatgcagattgtttctcttctctttcttcatactagttgtttcatagcaacttttttctttgagccagttctgaacttcagatatgacagttgttgattgtccggttacttcagtctgtgatgtttcgtccatgtgtgcagtgtacttgcaattgtttgatctgccataacatctcttcaatacttcacttcatgatttcagttgctgtccagaaaatggttggtgttaatggcttagattgcatatttgcagcagtgcttcggatcaaacggattttcagtttccgtataagaagtagatcgtttatctttgctttcttcataggactagttagttgctttatgatcagttgcatcggggtagtaaataatctaccttgtgttatttgttcttctgtaggaatagatcgtggcacgggaaaaacaaattcagtggtactatcagtatagtaccacacagatacatgtatgttgataactgtttcattaatcagttcactgctactgaacagaggatgttctgctcatttggtcatctgctctacaggaaaaattggttgctcatttggtcattctgaaattgtagcatagtctgatggtagtggtaccaccaaaaaaaagttcttcagacggttgtttcccctttctcagtacctatatggtaaaacgccaagcaatgcttttgccgagaatgacacattgacacccatctccctgcttgagttttgaaattttgattctgaataatttgtgttcacccggttgatgcagaatagcaatggtcaccctatttcagtatttctgtttcgttttactccgaaaaaatgcgtgttgaatttgagagattatgatacgagtacattggaatatgggttttgaaatatcgagcaggctggccctattggcccagtgaaaaagtaaaaccgtggggcccacgaaaactggcccaataaataatgcccagtctgatagcttcgttccccagcccaaccccctgcctcttccaaaccaaagccacccatctcccacctcccgcttcgagaaacagagcaatcaatcccacgcagccacatcgtcgcaatcgatcgcctcgcctcacctcgcttcgcttcctctccaatggagtcgctccaccacgacgtgatccgcctcatccacagccgcctgccgtgcctcgtcgaccgccgccgcatgggccgggtctgccacagttggcacctcgccgtcgcggagaggcagcgcagcaagctcccgtcgatcctcgtgccgcgcgcggacggcccgtccttcgcgtgcgccctcgccggctgctgcgccacccacggcttcgcccacccgctcaaggacgacgcgcgcgccgcgcgctacttcggcgcctacgacggcggctgggcgttcgtcgccttcggccacaccgtgggctacgcgctcctcagcctccgcgacggcgaccggctccacatccccgacatcggcatggccgtggtggccgccaccctctcctcaccgccggacgacgaacgctgcctcgccgccgccatcaacctctgcttcctgattgacgatctacgcactcacgcgttctggcccatgcggcgtcaatctgcggctgcgccggagaaggcggcgaaacctgcaaaggtcatcagcggccacgctctggaggatgtcgtacaccacgacgacgccttccatttcctcacgagagaagaaaacctccatgtttttccggtagcgggcttccgcgaagacgacgagggcaatctggagataccgcccgtggaggttcatcgcttctcgcgtggcgggcgagattacggccaaaacaacgctgttcgctacctggtggagtccggcgagaatctcctcatggtcgtcaggctcgttccccatcctccccaattgccgccgaggacgtcggcgttcaaggtgttcgagatggtggagccgccgctggggactcccatcaacaacgacgaggcaccatacgcctggaacgagctggaatcgctgggtgggcggatgctgttcgtcgcgcgaggctgctccagatcgtacgacgcgaacaacaatccgggctccgagttcagcgagggcgtctacttcctggatgacgggagactctacgacgaggagttgatgctcggtgagcccgatttccgggagtatccctgcagagacaccggcaagtggttgccagcggcggaggcgaatccccgagtggtcgagttcttgccggagcaagccccgtcgagctactcgccgccggcgtggcttctcccctgagattgccgtcgagctacaggtttttgcttgctgtcgattcgatcccccgagatgtggtttagcttgcagccgttgtactctgtcccgtctcctcttgctgcgatcgattagtgtagtttcagtccagatttgatgtcataatcgtggattggtacagctgctacaatgctggagcagtggagattgtacttggtaaattctcctcttctatcagaaagagtatgcaagccagaattacatgaataatgaatgcagtatattcaactcagcatgaatatgtgatctgatgaattctacatgaattacaatggttgccattcttggcttggatttcattagtcggtaagattgcaatgtgtaattttcagtgcttatttttcaggatagaagcatgttttgcatcaaatgtattttacagtgaagctgaatttgcttctgcagcctgctttcagttgcttgctgacagtgcaagatggacttggctgaattttcaatggctgctacacatgttcctaactgaattaactattcacttgttcataagttagctgaatttcagttgcttgctgacagtccaggatgggctgaggtagtgccactcttcagtggattttagcagaattttcgatggctgctacatattttcctaactcataatgtagcatgttaagtttaccaaattactgatacacatcggtttcagctagctgtgaaagatgccgatagtttacctgtttgttcttgatactagttgctcggttctgttgttgtataatcgtctgaatcttagtggagtactattgattctactgaatttatttactgcaccacaatgtattcctttattctgtgcataaggtagaacgttgtgtatgttttagtagcagaagaatggttaaacagttaacagatggttattaatccaaagttatcagcatttaggcattacttcagtaacacagcctgatgttaggcgtcatggtaatctgttcactagtactgaactactgatcagatgatgatgttcttctgccctccctgctctacagaagactggattaaatgagagaaaaagttgacacgcggagaggaggatgattatctctgcattgcccgttcatttttctgaatttgcatgcaggatcttgtgattgatggtaagaaattgttggtacaatttagatggttggttggttaatcaccagcattaaccacgagaaaattttggcagttcactacgactttgatgcatcacttgcagattctttactgttcagtctggaactcaataaacaaaaagtcataagaactcacagactccggaaaattaaaataacacgggtctcaagttattggtccatgggaaattcgacatgaatcaagctgattgagcataactgtcacggtagatgccatgctgattaagcgactttcgaagagggaagaggaggattagcctgaaaaattgaaaaattagcatgaacaggataatgatgcaatcccccagactgaatcattgttcgttgcaatataatgatgcaattaatgcaatctgagtcatgagaaccaacaatttctgcattagtctaacatggtgaaaatagcagagtactgaagagatgttatgatggatcaagcaattgcaggtacacatggatctcgagaacacatcatcgattaactggacaaatcaacaaccaccatatcagcacgacaacaagtcatcagacgatctaactaagaacatggcagtctcacggcagaatccaaaccggcgacgtgtagtacgacgggccttgctccggcaagagcttgtccacgcggncggtaacccgcttcgncgncgncgncggnggnggcggcagccacttgccgttgtcgctgcaggggtactggggaaggggattcacgaattgggacgcctcatcgtagagtcttccgtcatccaggaagtagacgcccttncttgaactcatcgcccggatacttgttcgcatcgtacgatctggagcaggctcgcgagacgaacagct

SEQ ID NO: 83350 - DNA, 44441 bp, Oryza sativa
ccggagattggcgcgctctcgagcctgagcattagccttgacctcagctcgaacaggttcaccggcgagctgccggatgagatgtccagcttgacgcagctgcagtcgctcgacctctccagcaatggcttgtatggcagcatctcagtgttgagtgggctcaccagcttgacatctctcaacatttcgtacaacaatttctccggcgcgatcccggtgacaccgttcttcaagacattgtcatcgagctcctacatcaacaatcccaacctctgcgagtcctacgacgggcacacttgtgcatcagacatggttcgcaggacggcactgaagaccgtcaagaccgtgatccttgtctgtgctgttctgggctcaatcactctgttgcttgttgtggtctggatcctgatcaacagaagcagaacactcgcgggcaagaaggcgatgagcatgtcggttgcgggtggcgatgacttctcgcacccgtggacgttcacgccgttccagaagctgaacttctgcgtcgataacatcttggagtgcctgagagatgagaatgtgatcggcaaaggttgctcaggtgttgtgtacagagctgagatgccgaatggggagatcatcgccgtgaagaagctgtggaagacatcgaaggaggagccaatcgacgcgttcgctgctgagattcagatattggggcacatcaggcaccggaacatcgtcaagctgcttggttactgctcaaacaagtatgttaagctcttgctctacaactacatccccaatggcaatctgcaacagctcctgaaggataacaggagcctggactgggatacccggtacaagatcgccgtcggcgcagcacaagggctggcctatctgcaccatgattgcgtcccggcgatactccaccgcgatgtcaagtgcaataatatactgcttgatacgaagtatgaggcatacttggctgactttgggctggccaagctgatgaactcccccaactatcatcatgctatgtcacgcatcgccggttcttatggatacattgctccaggcaagtgattcctacttcaagtatttatctgcatgctattttttcttcaaaatctagaaatatagtagtagtagaatgtagtgtacaagaccagcaacagttaatgccataggttaatgactctttgggtaatgctgttatctaagaaagaatctttgacctgcagttgcttctagtaatcttaaccttgctctgattccatgaccatgaccatgaccatgactagttgattgcttgtagcttaagcaggtgaaaccgatcagtctggctatctattaactgccattgcacaagtttctgaaatcacaagcatcaatgtccattgaagcttgttgacttatatactgtttgttgaaatgcctggcccaagattatgttgatatgcttaaaacatccaagaaatttatcctgacatacatttcctcattttcagagtatggctacaccacgaagatcaccgagaagagcgacgtgtacagctacggggtggtgctcctggagatcctgagcgggcggagcgcggtggaggcggtggtgggcgactccctccacatcgtggagtgggcgaagaagaagatggggagctacgagccagcggtgaacatcctggacccgaagctgcgcggcatgccggaccagctggtccaggagatgctgcagacgctggggatcgccatcttctgcgtgaacccggcgcccgcggagcggcccaccatgaaggaggtggtggccttcctcaaggaggtgaagtgctctcccgaggagtgggggaagatctcccagcagccgctcatcaagcccgggagccagcaaggttgacatgaacatcaagaacatggaacatgaacattgctgctggtgtagcagttgattcagtggctcagcaaggggttcaaggagtaggattttgataagatgcagcctagcttagcttgggttaggggggtggaaaaaaaatttcttgtacagctccaaatggcgttgcgttgcagctcattttggtgaactttgaatggggaaaaattccgcggttattttgtttgctcctgcaatacatcacaaaatctcaaatctatcttgggtatgatgaatatgatgcgaagaattaacatcagaatctgatcgcttcagctgaacagttgcctacagagtacaatacagattgctgtgagcctgtgactgtgagaagaacagttgcaacagtagctggaaggcggatagaggtggaaagtagagagagtacagacaaggcccatcgcccatgcatgacccggtgctccctcgacgccggcatctacggatcgagccggaagcggagacgcgtcaaacactcgccgttggctgggctgggcccctctcgtcgagcgcggttggtggcttggcatggccatactgctgtcattcgaccagtcactcgccgaattgctaggcgctgtagcggccgaagaggcgcgtgttgcatctgatctgcgggtggcggcggccacggtaagctggagttgcgtgggttggttacttggtaggttgttgactaatgggccgtatgggcctaaggccaactgtgttatgggctgtaccaagggacttgaatgggaaaagtataccggaggtccctgaacttgtcaccgagattaaaaaacgtccttgaaacgcaataccagacaccggcggtccccccaactatacaaaaccggtcacccaacgtccctcggtggttttgaccccggttttgatctacgtggcggctgagtcagcgtgggacccacgtgggccccacatgtcaggtgtccacaagaccaagtcaaattagccacgtagacgccacgtcagccaaaaccgttgtccgaaccgccgagggacctgatctgcactagttttgacagttgagggacccgttgtatctggttttgcggttaaaggatgaaaatcggatttgttgacaagttaagataccttagatgaatttattccatttacagcaccgctgacggcccctgtcgatattgagagcggccacgggctgggaagtaaggcggcaacaaatttgcattcaagcaacagttgactagtggagcaactatttttttccacgcacacacacatacttccccatccaaaagaaaacttaattacccagacgagttcaggaacagatatctatctctaattcatatataataaatataataaggtgattaaagtattaaaaaaatacatcaacagaaaaaatatacagtattacatgtgagctcgtaaaagaatgattaaccaatctttttatcatgtttgtagatggctttataatatattttcatacataatttatagattggttatatagtatcgaatgttaacgtttttggtttttatagcacttaaaggtactggttcactttaatagcacctaaagtttagcccatttcaatttttaacactttcctcaaatctcgattgtttttcatccgccttaaaaactacaatgatgcatttcgtttttaacctctctaatgacttatatcttttaaatagcatattattcttaaaaataatatgttatttaaaaacgagatcaatgttgaatatatataaaatattttattaatttaaaagtaatttataagcaacttagctatgtaatggaagtaactctctatagcatgaaaagtaattacgttataactgagttgaaataagaaattatgttgagtaaattcacaagcaaagtgtagagaagattttcaagtaaatatatttatgaaattaaattcaataaagcctaaaagtaattacataaatcataaaagtaacttagcataaaatagaagtaaattattacaacattagaattaaattcgttgtagggagaaaaatatggtctatctaaaaattaaatttaaagtccataaattatagaattgactaaaaacaataataaaaataatcaacacagagcattatgaatgtataaaaagtaatttagttaaatctaaaagcaatttatatatatgataaaagtaacttacgtatataataaaaacaatttacaaatataaatatttttttcatcgtaatataatcatgtaagatcttgttgtaaagattttaattgcaatgaacacgatggtgtaatcggattgtagatcggataagtaattcgagagaaaactttataaggggaaaaagacatgcatgtgtgcgtagtatacttctccactgctcgcacgatcgaacagctatgacacaacgtgcgcgatcgaatgaatctaagcagtgtcacgcgataagacaataacgagaggtttcgccaattagtttttgcgtaatatgattgatacacagactagagatcgatagaggagagaaaccaccgcttgtaaaaatcaagacccgtttaaaaaatggtataattcatagagcactgctgcacgtactaaatttttcttactttactaacaatcgtcaaattgtttgatttaggtagatagaagttaaaaaaacaaatctagatacactcatagcataaacatcagtgttattagcatacaagaatctagtaagaaaaagttagtccttatagccttttcctagttcaaaataacaccaatctataaagcagaacagcgtgtttcggagagaaaacaacacatggtttgtaaattatacgctcgtctgtaggggtgaaaacagggtaggtatttcccgcccacacgtccggccacattatttcgtgacaaattcgggtacgggacttttcacggatatcgggtccaaatacgggtccttttttatggatacgagatcgggttcggtaacatagtatctgacgaatacggattattcggtaaaaaattctggtatttcccggatattacccatattatgtttttgtgaagcacctttttgtactatgtattggttctactatgatgtattataccatgtttatttcctaaggtcctaatggcctaatataatcgtattacggatatatggaattgttaaatggttattgtctactccttccatcccaaaatataagcaattttatcaatgaatctggataaccatatgtccagatttatagacgaaagttgttatattttaggacggagatagtacgtgatatataagattgttggttcgacttgatatccgaataaatatccgtaaccgatagtgtacgtatccgttttggtacttattcgttccgtatttttgtcggacattatctgagtttgaatccgtattcgacactatccgtttccgacccgattccgattataaaatatggattaggatataggaggagtgagatctgaccgaacccgacccattttcaccccctactcgtctgagtcgtctcatcttgaaatctctaaaacgactccggcaaacaaacgagagcggaacacgaaataactgcaccccgcctccgcaccgcaccgcacccgaacccgtcccccgaaccatgcaatgcatgcgcccggttagccggaaaaaaaaaaaaaagaaaagaaacaaccggagtcctagtgtctcactgatacctgggccccacctgcctccgtacgcggtcgtaccggactaccgactctgacactgagccgtgggcccacctaccactccgccgccgatatatataaaccggcggcgagggctctgcaatccccagaaaaatccccacccggggtgaaaaaaaaaataaaggaaaaaaaaaacggagagaagagcgtcgtaacggaagaagtcggcgacgcgtcggcccaaaccctagacccgccgccaccgccgatccgcggttccttcgcaatggcgatccccacgccttcgccatcggtcgtagatcagccgtcccctcccgcgcctgcttccgccgccgcggcggcgtctcagccgctagccggcgatccggctcccgaggcggcggcggcggcggagggggcggggggtgatcagacggccccggcggccgccgccgccaccggcgcgtcgctgtacgtgggagacctggaggcgagcgtcggggaggaccagctcgtggcgctcttctcccaggtggcgcccgtcgcgtccgcctatgtgtgccgcgacatcgccggcggcagaaagtccttgggatacggctacgtcaacttcatgtcgcgtgaagacggttagttttttcctcctcttccttttacttctcattttgtcgggtgatcggcttcgattcgatcgtgggttcagaattctgatggtctgggtgtagtgatcggccttaacttgaagatttatttttcctgatgataaaagctttcggttaatttacgtgatcacttcgtatgggcacgggtcgatcaactgttcattatggaggtttatcgctttgtttagcttacggaggcctatctctttggttattattactagtttgtgtgtagtcgatctgctatatattgtacctattaattatctgtgtgcgagatgctgtaaattttgtttgtttaaattagttcgtttggagtagcatatacttattactgttgttatgataatattgtaagtttaattaatctgttatatttattttaattttttaatggggtgatcacttttgagtgtagggctgttggcaacgatgtattatatagtggagtacaatggttccatgttaattgtgagcattggattttttttttatgaaactatgtgttgtgataccttaatttgaatagaagggaaattctattttgtttagttttatactatgcatctttgtttgttttcgttgtattttgtatttcgagagtttgacacccgctaatatcaacttattaatttattatcaactctttaatttagtttgattgattgcagctacccgtgccatggaaaatctaaacttcaccgttgtcaatgggaagccaatcagagtcatgttttcgaatagggatccaactctgcgaaaaagtggacttgccaatgtgtttataaaaaatcttgaaccgaatattgacaacaagagtttgtatgaaatgttttcgtcttttggcacaatcctctccagtaaggttgccacagatttcaatggaaagtctaagggttatggatttatacaatttgagagcgagtcgtctgctaaggatgctatcaatggcctaaatggcatgttggctaatggacaaaaaatatttgttggattgttcatccgccggcaggagagagaacacactggagacgctaacaactttactaatgtatatgtgaaaaatttaccaaaacattttagtgataacgatttgctaaatgagttttcatcatttggtgcaattactagtgctattgtcatgagagatgcaaatggattgtcgagatgctttgggtttgtaaactttgagaaatcagaatgtgctagaaatgcagttaaaaatctcaatgggaagtccattggtgatatggtgttatatgttgcaagggctcagaaaaaatcagaaagacaagctgagttaaaagcgaaatttgagcatgacaaaaatcagaaatttgagaagcttcaaacagtcaatctatacttgaagaatttggatgatgacatcaatgatgagcatcttaggaagttgtttgaatgttttggtgaggtagcatcatgcaaggtatgttctctatttgttttactttgtttgatgttatgcttactgttagtgagttgtcatttgttttacgcttccatatataatgccaagttacaattgttgtaggtcatgcttgattcgcatggaaggagcaagggttgtggatttgtatcttttgcaactgttgaagacgctaacaatgctgtatgttaaaaaatgattcttttgtgctatcctcatactcccaattccatagttctaaatatttttcagtattatgcaattaatatttttaaaaatattatagattttaaaaatgaacgggaaaatggttgggaaaaagccattatatgttgccgtagctcaacggaaggaggagagaaaggcatttttagcggtatgtactaactctattacatttgaatttgatttttagggtaggttttgtacatcttgttatcttttcttgtgagttttgtaattcatgaaaaaaaaaactgaaagtacattttgtttcttaacattgacacttgatactaagtgtgctatgctaacattgaacttttccatgttacaaaggtcgtttgttaagcttgatattcatatcttctttgtttgccaggcacattttgctcgtgttagagccctagcaacaatggcacctacattagggccaaacattgctccccatcagttcaattttggccatggtgtgcctgccttgttcccaccaccaccacctgcaggctttgggttccaaccaaattttgttccaaacatgatgatgccatataacatgcaaaggcagcctggccagaggagtggtcctccgcatggaggaatgcctagacatctgcataatcctcaccaggtattcctgttggctaaatcattgtcatattttttttcttttttaacacaatagatccagcatctaattgtatccaattatcatatctacttatttttgctaatgttgtcaattactcgcaacttcagctactcccccgtttaaaattacttatcattctaggtgtctcttagtcaaacatgtttattttttaccattaatttttaaaaaacagtgtactttgacaagtaaattatatattatgaaggtattgaatctaaatccatgaatatcatgatgtcaaactacatgagtttagaaaaaatgattgtcaaaaactaaaatgtttgacttagaataagtctagaaagagaagtactaatttaaaatggagggagcaattaataattaactaggattcacttcacttaacatcgttgcttgttactttgtagatgtttcaccaaaatgccaaccagggcttcagacacatgccaaatcgtaggaatggtgtggccaacccagcaatgttgcatcagcaccatcgcttctctagcccaatgcagccaatgcaacaagctgtcaagcatgtggtgcccgtgggggaattgcaagctccaagcaataaccttcagacttccttggcttctgcgaacccggaacaacaacgagaggtatggatgtttatgctctgctttccgtacatgcttgaacaatttcacagattataaactatatactggtcatcaacatgtggaacagcattgcgaaataattcttatggtcaaacttcaatttttgaaaaacttatctaagtcaaatcagccatgttgtgaaacattgaatagatctggagcacgttttgttttacgttttgatgcatgttctcttacgcaattattgttacaaaagcatatgtagcgaatccgtttttcagtttagtcttttattgatgtatacagttagaaatccttgctatgaggatttttttctcaccttaaaattatactaaatttcacttctcgactatgtacagaccaagcttgattcttgccaatgtaggctatacaattattgataatgtggcaatttctagactacaatgattccttttacatcccagaactaacgtggtggtttaaagagagcattcaattagtataaaccatgacttgttatgaggttaacaaaagttttggtacacgacaaatcactattttgaattgttattaccttgctctgatttctattatagtcatgaaattcttgctctctgtaaaatccttctgagttgagatggttggacatagcatttttgttctcttattgacagttagactacaacttcaccaatgtttaatttttcccatttctgatgtacagattcttggcgacatgttgttcccgctcgtcgaacagctggtgaacgagaaagcttataaggtgactgggatgctgcttgagctggacaagactgaagttctgaacctcgtagagtctccagatactctccgggacaaggttgctgaggccatgaaggtgctggagttggaggctaccgccaccgccgccgccgccgccgccgcttcaggctccggcgacggcgacgccgccgcgccgtcctcctccagcgccgcctgagcggtgttggtggccggatgaattatcataataagatgaacttttgaagtcgtgtgttttggacttgggaactgtttagatgactgttcagtttatgactttagcagcttgcgtttgcagattatttggagtattggttatggttgtgtactctttatgtttattttttttctttttcatgtgatggtacactgtgtgtggatggttaattaggattttttgttgaaatggatccttatttcagactcaaaagttcggttcttttaaatgttttgctagttgttatttctcaaatatggtaatttgtgatgaaacataggtaattaggtactagtactgttttgtatgcaaaaccctgaaacttatgtgggttcctgtggaattcatgtctcctctttcgtttggtggagatgtaaatgctgtccccagatcaccataagtaatattggtccaataattttggtcttaattgctctagctggaatgttacaactttgagcaacaagaggaaaaaaacaagagaacttctatacacaaggaaaaggacgaacacacacacacctctcccacagcaaaatcgcaggaaaaggaacgaaacagcacaacaaactcacccttttacagcaaaatcgcaaccaatctgaaagtgaaattgcatctttttgcttgacccggagaagtgaaattgcccctcttttttgtgcttactcatccctgtgatctggtgctcaggctcaggctctcgctgcttgcccaaccgtcctgcacctgcatggagtactgcaggttccagaggacgtcctcaatggagggccggctgcttgtgtcactggcaatgcaattgagtgctatctcggccaccgtgctcagcgactcgacggcgaacgttccgcggatcgtcgggtccgccatgtctttcaataaatctgggtcttcagctatagcttcacttatctggttttgaggagtagtaaaaaggttaggtatttgctggtgtgaggtgtttttcactctgatgtgaaaccattctcaatttacctgagttttcagggagtccaggtcttttggggactctgttggcttgcctgtgattacttccagaagaattaggccgaactggtaaatgtcatccttgtccccttgttctgtgcttggcacgctacgagaagaaacaatcataatcattttagttcacaagttgagaaaattaatcagattgtcattcattctgaaaggtaggtcaggtggcatctctgagtttcaacaaccaatcatttaggttcagaaaaactgtcaactgttatagtttagcaagtgggagtgttattttccatctaaaaggacaccgtacctgccgagatcattgtcttcagatgtggcaaagggggattctgagaatatctgaaagataaacatggttacaacttagctatcaggttagcaagttaggagcttccccaataatttaaaattcgaacttaccttgccattcttgctagttgatatcaacgggaggttaaagttgctgattttggaagtgagtgtcttgtccagaagaatattttcgatgcttagatcattgtgtacaatgcccggagcagtcacatcatgcaaaaactggatccctctggcgacaccaatggcagcagaaacacgttggggccattttagcatctcacgcttcctccactctgcaccagccagtaaaaggataaattcacatacttgaagatatctagttatagtgcggtatatatgcatgatgtcataaaatataattaccggttagatgacttcttagggatccatttgttacgcattcagaaaggaggcataatgaactagcaatattaggattctcttgatcttcaacaatgcagtgaccgatgatgctaaccaaatggcggtgtcgaagtttagaaataatttccatgtattgggtcaggctctgaggggaatacttgggtttcagcttcaggcatctcagtgacactctagaaccatcttgaagctgaccgttgtaatgctatcagcaaaaaaggacaataagccacacatgaaaaataaaattttctagcagaaaacttgtactgaaaatatggccaaaggtcaatagatgacaaaaattggagtggcaaagcacttaagaacaaataaacagaacaggcataaatagctaaagttgtgtaaaccagttgaaaaggaagcttgaaggtaatgtgagccggtccatgtgttttttcctctttctttcttttgcaaaaatagcgcatgtataacgtacaataagccaataccttcaacatatactagaagcaaaatgatacttgatgcaagtgcacttatatatttttttttgtaaatattggtgaagaaaataatattattgatcctaagtacaatgcctcaaattaacatactttcaaatacttatcttaattaggacgttaaaagtaatcaagggcatcaaggttcttagttgcaggttaagtccaataaaaatgtattcttttatatatatttttacgagagtattcttttatattcacccagagccttttattcatcaaatttataaagtgtgacagaaaaaaatacaaaagatattgtagtccaaagtgtactctagtccattatgacttgagatgcagaggtctgcaatggattatttggaaagatggagatggatttctaaaatttacatttgagtttgctagcaggtacacatgctcaaaatatactccacacgaaaataaaggaagaaaaatgtgcatggcacatagcaatcttcttttgaaaattgaaatgcatattattcttcaaatggttaatatgagtggagtatcatttgtatgtgcatttattgctttgatttttcgcttgaagctcaaaatgacttcacttctgcataccttaacaacaggagaactcttgatcaagttggatgaaccaaagttgttggttgcttcttggagctcctcaagtgtatacacacggtaggctggtacttctagtgtattcacccttgcagcttgtgatgcatgccctatgacaatggacatcatgttacccaaccaaaaaagaataaaaatgatcatcctgcaaattgtttagtggtcactaaagccattgatcctagttgttttttcccccctttttctagtttgatgattgactttgctgcttttactttctcaaagtcttctttgaagcaaggaataaagatccagcccatgcttcagaactcatagtctaagcaagatccacactagctagctcacgcaaagcttcctaattatacttcacatttcactaaagtgagtagcctttattcacaccagaaacaatgcaatacaaaactaatcgtaattgcttctaattagtactagcacttcacttctttgtgttgcccctttctctatcactaatcatatatacctttcaatgaagcccatgcataatcttgtgtccccttttcataattaattcaactaagactaagtgcattgtaccaaattgaagtgcagaaaaacaaaataaaaacaaattaagcaaagcaaatgcatttctcctcttactcttttcagcaggagtaacaatcctctgtgtcaccttggccggcgccttgccgccgtccgccgccgccttcttcttcgccgccggcgtcgacgccagcggcgacttgggcaagacgctcacctccggattctgcctcctcgccctcctcagcacggccatcatcaccagcgcgatcagcgccgcgccggccacgacgccgccgacgatgccaagggccatccccacctggccgcccttcccgcccgacccctgctcgccgccggtcccctgcgccggcggcagcacggcggccagcgcgccggggttgcagtacgtgctcggccgctgcgacctggcgtcgcggaagcagttgcccgcgtcgagcaccgtgcgcgccgacgagttgccgcgcatgcacgccgggcgcgccccggcgagcaggttgtccgagacgtcgacgaacgccagcgcgtcggcgcacgccgtgctcgccggcagctgcccggcgagctggttgcgcgacaggtcgatgtgccgcagcgccgggagcgcgaagatggaggaagggatccacccctgcaggcggttgccggacacgtccaagaactggagctggcccagcgagctcatcgccgccggaatcctgccggtgaagttgttgtcggcgaggaccagccgcaccaccgcgttccccacctccgggaacgccgggccgagcctgttgtgtccgaggtcgagctcgtcgaggaacgcgagcccggagaggttgggcacggcgccattgagcctgttccgcgacagcacgaggctctgcagcgagtacatccgcgagaagtgctcggggacggcgccgtagaggcagttgccggtgaggttgagcacccgcagcgcctggaggcggtggagcttggcgcccgggagctcgccccagacgccgagcgacgcgagcgtgaggcgcgacagcgccgggagccgggtgagcgtggtgaagagcgcgtcggcggagaagttggccggcagcgcggcgccgggcgcgcggccgccgagcacggagagctcggtgacctgcccgcccgcgcacgccacggtgagcgacggcgttggcggcagcgcgcacgcgtcgggtgcccccgccagcgcgtcgagcgccggggggaaacccagcaggcggcgcacccagagcagcgtcttcgcctgcgacgacaccagcggctgcgcggccaccagcgtggagacgtcgacgcagaggacgacgacgacgaggacgaacaccacaccgacgcgctcgccgcgcgacgaacgggaagccatttccgccgcgacgtcggcgattaactcagcaatcgaaagcttgcagctccgttcagcaatggcgaatcaagggagagcgtgcgcttagttggccattggtgggaggaggaagaaaggcgagaggcaagtggtggccatggccatggacgacgcgcgagcgagtgcttgccagccaaactagtactactactactactccactgccgactctgctagcgtagcacacactgtgcgtcactgtcccctcccgcgatctggaccagatattgccatgacacgtaggccccaccccaggtgggccggccatgtcagtgtccccgtactggtcaatggaggctggtttcgctgacgggtggggccggaggtccgacgtgtccgggttctgcacgccaggtgtgactgaaaactgggtgggtgtggggccagggcagggcgcgcaggccggagttaactgccctggagcgcagtagggggtggttggggtcggagaggtggtgcactctgcactggtgcatggcatgtgcgaggcgtgcgtgagcgtcgtggtgcgacggcgacgtatgcggttaagcggtgcgcgccagggcccaggtgcatcgcggaacccttttttttttctatttttaaatttttaattttaaaaataaacctacgccaatttggccaatgttagcaagaaaaattgatttctttcgcttcacaatactaaataattcgcttagcagtcagcacacaaatatttaattccatttgttcagtttgttttcctcttctttgtaagggttatttacaagatctgaatgttttcctcttctttgtaagagttatttacaagatctgaactttttaaccacgctagcccacactaatctaccgcatcggttcagctgacacgtcaccatgcttgacgtggcaggacaaggatatcacattaagagtgttgctatacgtccgactccctcgtccgacccccatctgacccaaccttaactgccaatcggtccgctccacgcagaccaacatatctctatgtgggctagtgcaattagcagttaagtgttggtcggacatgagttgtacgtaccggtcgtatgtatagcgattttcatcacattaaatacaggtgatgtttactgtgctaaatggattggcgtgctcagaagatttaaatttagaaaataagtttttagaatggtttgttttaaataaaaaataaaaaggttttaaaaaataaaagaaaattgttgcggaagatcacgtctactaatgccctctccaccttccttagattaatattttcttctctttcgcttttcttagccaacaaacaaaatcctacctccgtaacaaatacccaatatacacagatatcaagtcgagtcgcgaattgagcgtagcttagctggttaggtttcttctggtggagctagcccacacgtcgatagcgatatgtcggcctattcttgcaaagatgtttatagggatagagtgtgcgcgtgtacgtttataggggttagtaaaaaaaatatcaaagtcgagttagacaactatagggtgtgcgtgtgtgcgtccataggggtgagtaaaataagatatcaattcaagtacgtgtgattataggggtgagtaaaaaaaatatcaaatcgagtgtgtgcgtttatgaggatgagtcaaataaaacaaaatatcaagtcgagtcagacaaatacatgtcgttctaacgacgtccatcgcaagtattataatctctcatattttactacggtgatagtaatattttgtttgtcacttgtcccgtatctaatctggttcaatccgcgtgaattttttccacacgtcgaatgggatgttttttattttttctaacagtagtcaattggacgaaactgaaaaaatgggccaggttccccgatcgtggcatgatggagaaggacgctagtaataagtcatcggcttggagtgtacctaacttggatgctacgagtcaatcgagtggctttgggctttcaactttgaacaccatcatgtactacgtttcccacgaaaaaagttaggcgagtgcgcccgtcgttgcacgccgcatgcgcaatgctggggtcgtcaaaccagttgcgccgcttccgtcattttttcaggccttgggcttgttactgtccacgttcatttttactttctttctctcgaaataacttcaattttcacatacctcatacataaacagtcccatcttttcgcttatgcttatacttattagttaaaatttaaattttcaaccttaaatttaaagctgattttgagtttttttatcgaattttttttcaacatttgctttttaagtcgctaagaacatgcatataaaagttttattcacaaattacttctcgtttgcaaatatgccatttttcttattccacaaataagccaaacaatagggccgaaaatataccaatacaacacaaaacaaaaaaaaatatctactttataaaatctcaatgtaattatttttcactttatctacttccaatatatccatcccctattttcacaaattctaatgcaatgattactaaaagtaaatttattttgggataaataggaaaggcaaagataaactcattagagcacccgcaatagtaaagtaaggtgttctttataaaacatgtacatctcagcaataggctagattaatagtaaaccacctcaatagtatgtttacatgggtatctataactctctcatgcattgcctcgtttttctctatagactatccctaagttagtgatagctttgctctctctcttcatttaatatcttccatgtaggaaaatatactgacatggatctcttatagagagcctatagataaccattgtgggtgcccttatgagatggaggtctcattgtcttgaaagcgagtcatcctccttccattctcttccgtccgtactatccacatgagtaactaccggatcaaatgttttatctccgaaacgtatcctatgcataccagcattctcatgtacacaccgtgcacgctaacttaaaaatatcatatttttttaagaaaagattgtatatattttttgtaatattatatttatgcgtaaagtctcatctccaatcaccttgtagcacattcttaaatttgtggatctggttagttacagtatggacatgctacttaatctaagcacactcttttgaggtcagatgtagcacttgctaaaccggatcaatcaggttaattaagcagcaacatgacacattccgtttggctgtaaagagtgaaagacaagtgaattgaaagttgagtggatttggtgagatgccatcccaagcatgtgtcggttacgcatcgatcgggggatatatggaggaaaatcattagagaaacggacggattaggcttgatccgtttggctgtatctcttgtggaatgctagctagtggtatatactgccaagtgaccaatggtattaatttgtgtacataatttggtgtgaatattacggcctctggtttgaactattacgcaaccctctcgctacacgaaatagtccaaaaaaatcccgtaattttacaaaagtggagacacaagatatgagggtgtggcatcatttctcattcatccattgcattctctagtgtacaatcctcctccctactcctctatttatagacattccctcttccaccttccatgtttaatgttgggcccaattagtgggtaaccgggctgggccttcgtgggccggcggtttcctaacatgaactattcatatgcatcacccactgatttttttttccttggaaatgaagatgcacagttttattttaccaggacaaagttgtacaattccagccttgcttgttaaccaatttgtattgaatttgttctgcattaaattagcgggcaagcgtaaaaatgctctttctgaagtgtacttcacaatttcattgttggagcttcttttaagggaatggaatcaaattcattatggtactttgtgactacagttgaaattacatgtgaaagtagtcgttaccaaatgtactttgactaattactaaaagaactattgaaattaagattgagcggctgcaaacataccaatgaacatgcccctgcagtttcaggccgtactggttgcaattttaaaatgctcgatcgctgtgcgttgaagaatcaaagagtatcagaaacaaccaatccctatttaataccatcattatttattttttgaactaacactagtactcctgattgtttaatactgtacgcctgcacggtgtttggacccgtgaatctctgccttaaaaaacttctgaacccaagcataaagaacagctgactctgcctcaaccattactgctaatcagcttgataaatgcgctacaggaactttgtggtatggtgttttggactgttggtgtgtagtaatatgatcgagtctgtttggttgccattgccaatttgccatgaaggagctgattgactacacgaccatgaatgatgatgggttgtttcgttcgtgtacagcgctagcaacatatcagccgctaataacactattttcaggcaagttaagtatcaaaaggtgtggctaactggtcatgcatgtaaaacttttatccgttagggtttaaaaccgatgtctataactattacacaaatacaaataggctctcaaatttagtaaaactattgatttccccatagtcgtctctctagggatgtgtgacccgtgcgatcacaaatagccttagaattcttatggcctttaacataggctgtgtatgcaggggcggaggtagagtatgggacgggggtgtccaggaacccgatcaataaagttttttaagctaaacctcacatcttttcatcatgtgtgcacgcccatctcaatacaaaattaggcacctgcattagcttaaacttgatctaaagtagagtaaattaagcaaatggccaccctcctctatttcgtttagctccatccttgtatgtatgatcgaaattactatttagcatagttgtgttactagcgtgtactaaatttgttttagttttcataaacgtgcatatgtatgttccgttaataaaatcaagggttaattttctgttcaacaaacagtgtcatatctaataacaacaaaaaaaaaacacaaagtcaacgcattgtttttcagtattcatccgcaccatccatcattaaaatccattcatactaatggacccacgtgtcatactcctacacctctatcggtccatacccaattctccactcgagagtgcctgaggttcttatgggttgcttatgatttattataactcgtaacgtaacggtttactagcgattaaaaaaataatccatgggtaaaacttttacatatgtccttagcgacttaaaaaccaaaactgaaaaaaaaatcaattgacttagcgattttaaaagtcaaaactgaaaaaaaatactatgttgaacaaacatgaaaatcaattttaaaatttaaattttatctttgactccgagatcggggagatcgaccatcactcatggaatcgtggtccggctcaatcatcaaggcccaaaagctggagcatcttttggtgcgtgtgtcggtgctgacgtggaccgttcccttcttcggatactcgtgccgtggggcccgcatccacagtgacacggaaacatccctgactttgtgaagtttacagttatgccacttgacatgtgggccccactttggtatggcccacatatcagtggcacaactgcaaaatgcataaagtcaggggatcctcgttccagtgacacgcgcatgcatctgtagatcgatcgagatgagcatcatcaatcgtcgtggtcatggctttagctggtagggcgactggaaattcggggggatcatgtattcatgtggatgtgtacactttcttctcgtctcatgggttcaaggcttcaagtaatggtgatgttgatgtggcatgtgagtcatcctatcacatttgcttgctactatgataatgctggttttttttttttttgtctctatgatgcctatctgtacactgagctgtggtttacccatgggtaatttggactgatatctgtacattacgagtggtactaggctatgctagagaggtaacggagtactccctttatccgaatatataagtacacctaatacagaatgtgaattcatagtctaaaatatatcacatcatgtgctagatgtatttatattgagatggagggagcacgtggttcttaggtttacctgactcagattggtcggtcatctgcaactgagcaaaggccctgtttaattccaaaaaaaaaaaaatcacattgtcctatcgaatattcggacacatgcatggaatattaaatgtagaaaaaaatcaattacacagattgcatgtaaattacgagacgaatcttttaagcctaactataccatgatttgacaatgtggtgctacaataaatattttctaatgacagattaattaggcttaataaattcgtctcgcagtttccagacggttttgttattagactccgtttaatacattaacttcaaatgtatgtccgtatatttgatgtgacaactaaacctaaaaatattccccaactaaacaaggccaaattaccatggcaatgtgcatgctagtgattctcaggatccaggtgaagaatagttaaaggacagacttgaggataaccgggcaatgtggcatgtcattttccaggcttgaagcgatcggcaaaagctcccaggccagtgccatcaattggttcccccatcatgcagtgcagtactaatacgtctgccttcatgcactgcgcctgcaacatcagcatggtgggctccaagcactgacggatgcacaatctgcagctatgctgttctgcactagtgcagctgtgcagaagcagggacaaagacaaactatgaacaaaccaacggatgaatgaacaaatcacaaatgaacatactactaatctcgtttcagaaataaatgaacaaacactcttcaaggaaagataataatgaacaaataaatagagggggaaagaacaaaaagaagcagtgaagaacaccagaattccagagaaaagggtgcaggaacctaacccgttcctttcccttaatggctttttgccactgtctgaagtgatgttcttgctcctgcacctaacttgtttgttttcttgctcaacgttgcgttgttgcatctgttttttgcgcgaccaccaattatgagcaatgtcattttgtgcagcagcgaaggtacatactcccctgtctttgcctgtcttgcgcaattgtcagaatcttatacaacctgtattagtagcttctatagcggtacgcttaaaacacgtcactagtgccagctccacgctttatttagattattgagtgaattattaccgtaaattatctgcttgacagaattaacgaaagggcatgtagcctagtggttacagtgacctgagtagtacccaaggtcctgagttcaaatctcctatggagccaatttcagattgggttgtttgtggggctaagtttcctatttcaatggccgtatatatccggttggatatagaggccgggtaaaaaatatccttctctataaaaaaaataaactcaataaataacttaaaacaagcggtctaaacaatgcggtagaagaatttttttttgaagtgaattgcatcatggaccaagtattattgtctaatttctatcttggaccaggccatatgcaatattttcactttaggcaagggtttgttaccatctagttgcacattgggccaccattctgtcagtctatctgtttccatctgctagccgactgccaccactactgcactacgcaagcggcaagccgttgcttcttcgggcattcaccaactccggcaatgcatccgagagagagagagctaggaaggaggtacggtcgagtgcgaggctgcgagcacgtgcatcgggccagttcgcgtagagatagcttcagccttcagctgagctcgagttactcggccagagcaggcgaagaacggctggagctcatgtgccgaccaactctaatcttctgttgatcaattttgaggaagccacccatgctcgatggtagctcgattatacaaactgaaaggaaggggatgagtggacagaggccagcaacaatcgtgcggaagccctcacggcaccttggcatcctcacagtggtggcgcacacaccaacagtggcagcaggctgctggagttggagatggtggactggggtggtccaaagtgaaaaaaatggtaaagtcatatggtctaaagtgaaatctttgtattaggggtggtctaagctgaaactctggtaaatttatatggcctaatatgcaattcactcttttttttagagaatatatattccgatgcatagagcaaataatcaggtgaataatctaaaaggagcgggtattgagaaaggaaaaagatgacagcaaacaacgttttttcctatttagaaaccggcacgcccttttgcaaacgaagctcattctgtgtaaacacctttgaagtagtactaaattttcgtgtaggcacttcgttcccacgacagttcaagaagaaaaaaaaagagagagaagatagtatagttttagggcccttttaatcgtaggaatggaaaaacaaaggaataggaaaaaaatagaattttggtaagaattcataagtaaaacagaagattgcaaaatgcatggaaagcacaggaataactgtttgactaaaccgtggaaaaaacacaaaaatcataaatcatattagaaagatcgactcaaaaggaaattttttcaaagaggttaaagttattgttaagtttcctccaaaatctctacaagattatccattccataggatttttcaaaggataggatatgattcaatcatttttcaagtatcttcataggaatttttctacaatattaaaatcttctaaaattcgtatgttttcctgcaaatcaaaagggtccttggcacgttgttatgacaagaaacaaggataagctgtttcttgtactatttctagatatagccggtcctatttctgtgattggaatgatctcacaagtcgcaggtctattctgtagtaggtgcagtgatgttgcaactactactaattgcgatgtagatgggcgtctagccagcatcttttgttgttggaacgcattaatcacttcagaatggtaaatgaaaatgccaacaattacagataaaaactggatgcggcagataaaggaacaaatcgagtcaagcttgcaaagttgcaaaccaagatcccaggcaaaaataaatgttgcttataacctacagtttaaccaaaactgtgcatgtgctctggattctatgacagatccaataatacaagcagacccatgtgcgcatggaacgtgcgcacacatggatagaattcattccctgattgcaatttacatatatgcaatcaactcgataacacacgcaatggaagattataccatgctctgacacacggtcagtataatacgagaaaacttcagacaccagcagggaatttctgcccagaagtaggagtatatcacacaaataaagaattcaattatattcagatgcatgactggacaattcagaattgcaaacttaacaaagggataataaagcaaacatccaccctgcaaaccatactacacacttaaagacctctttatggttttgataataaggcaagctccagcgatatatgaacaaatgaggggaaaaaacaagcaccacacactctacttcatatccagcgataaaaagatttgaatctgaagtcggtttggttgttctagatttcttgggctatgccaagatccattggcatttcactgtccccctacaagtacaaatgaactgattagcaagacaagaaatataatgagattttccagaaaatgtattgtttatctcaattgctgttacatcattgccacccttaccatattctccttatcttcatttgtcacctccttcaccacatcaactgaaatataaattcaccacaccaacgattgacaacaattcagtaattgtggagttataacaggtgtgatatactgataattacaatatctgaaatacatgatggcacttaccaggttcttgctctgtaccaactggcaaagcctcgctgcctccattgcaatcttccttctgccccttgacctgcttcttggctttcttaccagtattcttggtgatggcttcttttgcaggattccggttgtaggagcctctaacctttgcatcaggcttcttctgaatgttgtcttttttagctgcttccttactttgagctgcatcagaattcagcgatcttggcttcagattaccctttggtgacacattggtggcactatgagcagccttgtcagactttttcggctgttctgaagagttcacagtgatctttagcttctcaagatcctccacgatattgtaaacctgaagaatatccttcactggttcctccaactctgttgcaaggccatgccggacaacataagcctttagctcatctctcatacgatccagaggctgtggaaaagcacacttattataatatgatgatcaatgaaagaaactgaactgctcataaatgatcacttgatgctcacctcgcattctgattcaagtgcaagcttaaagaagcccaacgatatagagtgcttggaagcagcctctgcaagcctgatttgtgtcatccaatatgaggttgaggacagagtgctgaacttgcgccttgctgtggacatggaaacttctgatatcggggtatcaaacttcccttgactatcggacctccttgaacgaaccaatgacacaggagtgatagttcctgtaggagttggcctggggctaacacctggcttggtctgtattgagtgcctccgtggaggtttggctgaattatccttcaccgatgaaagatcaagaccacaaacgctcttgctgacatccaaagatggttttggtctgcaaggaataaaactacaaatggtatcaaagacagagctagtatccagcaaattttatagttggcatctaagtaagaggcattaagttgctagtctattttgcttgacatagcaccaaaccatgagatgcttagtttctaagtaatacacatgtgtatgctggcctattgttttcccataagcttgcagaaatattgagataatgcagccttgtgatagctaaacctcttaacctctggaacaaactagttaggactaccaaatcttatctgagatgtaaacacaaagatgatatgacctaacgaccagtattatagaacttaagaaatgaagagcagaccctgcattcaagtcaagatggtttttgtttactttgttttgaattcaaaaatattatgcccatgtccttatgaatacgctgagttttgatgtacttaggagtatttcattatttggactaatcatactccatagatggttcaacaagaagtaatacagaaactctattggttaacctttctaaatcagcttgtttacatgcactttcaatatagagcatcggtctaccagcctcttaacaaacaaaacttgcattacactatggcaagtgggttgacaagtccttagaaagtttttgtgacatttgttcttgttttgcatgttttacttctttgacagtgagtgcaactcacaaatcagatttatgtagtatccaatattgatattagtagtaaagtccttgcttgatattactaaaagtaaagaaccggagtgagctggttggtgcacaacctctgtagatggcaccaacttctttttttttcacatggcaactgatttgcaggtctgcagcatgaacagtatgacataaagtcctataagattcatgtacacagtacactccattcgatactttgttgttcttgcaataaatatgtttcgtttaccaaactattttcagatcaatcagccacttgacaacgtaaatacccatctaattgctagctgtacacgtctgtgctacatattctggaaacaaataaatcatttgcacaacacgttgatgtaggaaacaaagatttcaacgctaatccggagcagcaaaattcagtttcgcagcagatgtggtttaaattagatgagaacttctcgtgataaacgccggcatctaacatgtccttgtaactaaataagcgaaggcaaatcactgaaaattccaaccgacaaaagtatattccacaaaccaacatgccagatttcactcgcatatagaaattgcagcttcgaataggagagacagacctcctcgccacggagccgctcgtcggaggagcatcggcggcgcccttcccccggctcgccgaccggagcgggtacctcagcttcgacgccctcgccgcggaacctgcacgaccaaaaccggcacatcacacccaccgaccaaaccacacgcatctcccgcctaaaccccaatcaatcaaacaaacagaaaaaaaaaaatccaatacccgccgactgatcgccggaagccgtcgccatgagcccgatcgaacccaacgaatcagccgccgccttctcaacctcccaactcctcctcaaccttctcaaaccccaaattcgaaaactgccggcgccgatcgatgcggacgagacgggaaacgagttctgcgttttggaatggctagtgctacacgttgtatataaataaaactcccacgcggggctgggaaaccctacacgcgaggaggagatgtgtctcgccgacgtgcgggcccgggggtggtgccgttggtccgtgggcccacgtgtcagtgagatggggtaggggagggtcgcgtggcgtggggtttgaggggagcgccggagcggggggaggggcccacgggaagggcgtttgaatcgcgtggcgggcgggaaggaggcgtgcgctcggcggaatcgggaaattttcgaacgagggggggaggcgtggggtgcgtgggggcgtaaatggcgttgttaaggggccgtgggcctgtttggttagctgttacccggggcccatgtgctctacctagtaatggaagttacagttgtgtatgtggtatacaacggaattctgctgggacagaacgaaaaccgttaggtatgagatcatgatatttttgagatatcaggcgatacttgcaaggtatcaaatgatttctatcacatatcaggtgatacctgttaggtattaggcgattcatatcacgtattagatgatacttgcgaggtattaggagccgggcaccaaagcatcatcaccggtggtcccaccgtccacgctacatcggagctcgtcgttggcggccgccacgtcggagctcgtcgatgccggctgcgtcctccgtcatccacgccccacgccagagagagccccttccccttctccggcgatgtgctccctgatggcgaggtgaggcgaaatagagaggcgatgtgctcctctctctctctctctccttcctccgccagcaagcccccttctttcttcgttgccacatgccgccgttgcgctgctctgctgccacgcttaagtgctatgggacgaggagcaagacgattccgtcgtgggcactgtgaacggtattccctcatttagcatttccttttaattttgttactgatttttaggatggagtcattggctccatatccatcattgcaaactatacaacttttgaactatacaagatcactcgtataattaaaaaatggagtttgggctcattctctataggaggaatcttgtataaatgaaaaattgtctggtttacaatgatggatatggcgatgacttatattaatactcaagcaacggagatggcgagctcggtgactagcggagcaaaattggcgcgcccatcgacggagcgcgtaccagacagagcaagtgaggcggcgattgcctgacgagtcagtggcggagccacgttcaactcaggtggtgcacaggaacaccacccccctcccctccaaaattcttatgcaagaacactaaaatgtgcagtgatgcattgattttttttttaggctttcaatggtagtgcaccacctctgtttggacgctagctccgcccctgtgacgagctcatacgctggcacacgccaagagcgagttgccgccatagatgatggcgaatcgggacggcggagcccgaacagccggcggcaggccgtcgcaagctcgagcggctggcaaccttggttgcttctgcttcttgcttgtttgaattggattgcttcttactcatgtcctccatagttcttgctctgcttgtgttcgtgaaaaggttctttctcgatagcatctgcttgattgcctcgatgttatcccaaggaaaacgtaaatgaggttggagtaaattgaatttttcctgtgtgttttcccatgaaatcagcagcaaaggaatcttttcttcaaatttcgtacgagtggtttgcgtgatccgaatgataggaaagaaaaaaaaaatctctgtgaacagtattttcctaaaattcctatgaaaaacatgtaatccgaagttgatatagctttagactagcatgtggttgaagcgcaaaccatatcttacctgctgcactgaaaatgttagtatttcctttgttttttaatatacgtcgttgactttttacattatatctgaacgttcattttattaaaaatatttacttattttttcttttgttgtggattgatttattactatagtaacattaagcattatttgaaatttttaagatttgcacaaaagttataacgaaagtcaacaatatcgtatattaaaaaacaaagggagtaataaacaagttcttcacagttgtgctgttgtttcagtagggaaaataaacctactgcatggtgacaagtgcaaggagttaatttaccaccaatttttttgacttcaacacgggaaacccactgcattccacgggtaaaagaaccctgtgcagatctcacctggaccagactcagacgggtcaaggagacgactgtctaccggtgaagtcaaaaggaactgattagttgtattgaagcctactgatgggctactcggttgcttcttgcttcatcacaaagcaaaatcatatccctgccctaatttaatggcagcatgatcgcagctaatctggagcacgtagtaataataataatacttagtgcgcagcgttttgacaatttggcatcttcgatcagatccaacactattaattattaattaatgtctgtaattggagaatggaagaacgatgatacttcctggaaacaatatgttaacactctgtgccacatggacgtcatactcatacctgtaggaacttgtgttaagatgtaaacgcagataattacagaactagggattgaaggtattataggccagcatttgttaggaattaccagctcatctagcggagaattctcgtacgaaggaatactcatgcattgcttgaagaaaccacactcggtcatgtcatattttgaacatccacggagccaaaaggatactcccctccctaaataagtctatttttatatatgaatatatccgtattcacgtataaaagtagacttaattatttaagtaacaaagaaaatatcaacacttattttaagtatttagcttggacaaaccatatcaaaatcctaaaacaagtaatctaaataagtagaccaattgtcgcaagagggaataatggacatttgattattaagattattttcgcggatcatctatttaattatagagataaattaaatatgttaagaaaaaaattaaagaagatagcttaaaataacacagccaaacaatatgcagtagataaacgtatattgagaaaacatatcttctgaaaattagagcatataattcgtttgaataagctaaaaagaacatggcaaaatcgaaagtgactgtgggcagcaaatatgcagctttacagcttcacagcaaagtgggtgtgtttagttcacgtcaaaattgaaagtttgattggaattagaacgatgtgacggaaaagttaaaagtttgtgtgtagaaaagttttgatgtgatagaaaagttaaaagtttgttgaaaaagttgggaactaaatcagacccaagcgtcgatcaatttccaagtaacaaatttttttgaaccttgaaaacagagacaccttataattatccaggaagtgtgtaaattaaataatatgcagtcaaatactcgaatgcagtttcatgtgggtcattgtcagtcagcacgagtatttgccaggtaagtatatatggttcggataccacacgaataagatattaattcccggtgcattcgtcctaccattttttttttaagaaaaaatcatgaactttgatttgatccatgtgtattcagagtaaacgttagagacatgatgtgcgatttttgaatgtttgacttcgcggcttgcatgaattgttttgtaccttttgtgttgaagttatttgccgaggattcatttggaaatttcctacacatctattaacgcggttaattgatttttcagacagcagagaatatacgtgcacaccgctgagcctttttcttttttcccgtttgcttattacagattgatctaccttcttcttgcaaaaacatcattgtgctgccagtagatacaaaaccacggtgacggtgcacagcaactaacaaatacttattatttttaagaaaataaaattctacatgtacctaaaatcttcctccaactatttacaaaatttcaaattcatgtacattataaaaaagcagggaaaaaaagaaagaactaatatatacttccatactctttaaactctatgtttttgtttattcttttaactgcttgaacataatgactttgaattagaattcttttttcaaatccttggaagatgtatgcatacaccgcactcgcatgctcgcgagtatgcccttttaactagggatgaaactggttcggatagtttccgtccgtccggaccatttttcggattcggatagtttcggtcggaactatccagaaattcttggattcggaaacgaattcggatttttttttctcggaaacgaaaacgaatacagtaagggtactatccgtcggaatcggaaaacggtcggaaactatccggattttttttcggatatccacagacattgataaaattttagaaaaaatacgtatatatacataactttttcatacggaatcagatgaagacaaactttatatcaacattgtagagcttgatgagatctacaacttttttattgactattttattatttgagatcatttaagggtctaaatatttattataatataccatattaatttttacaaaatctcagatctacaattcaaacgacatctgatggagatgtgttctatatcaaagttgtagagctcaacaggatctaccactttttagtttataacatttatatttgaaagcatttaaagcataaaacaaatattgcaagtttcgaaaatgtgaagtaaaataaataacatctccaatttatacaatggcaagtaagttatacatctaataaaaggtcttgagaatagaaaatgataatcatatttgcatatggatctcttagagaaacaaccatgaaaattgattttcacatacggttgtgagaccatctacaaaattgacgatataaatgttggagatgttgaactaaaataataagtgatatctcttccttgattaagaaactcaatttgaggggctttttatataccggtaaatattcgctaccgtattcgatccgtctcgtattcgctccgtatctgtattcgataatattcgatttcatttccgtatccgagttttcgattccgattccgattccgaaaaaaaatatgaaaaaaaaaatatgataaagctagtttccgtccgtttccgatccgttttcatccctacttttaacacacggtcaatacaccacatacaatataattgtgagtttacgcttttaaaatatgtgtatacacatagggaggacagataaatcactgcaccagaacgtaggtaccgagatttttactctaatgtttggagtttggaccaacacaacaaccctgtgcttctcaatatgaagtcgaatctaataaagcgctatgctacgcttcactttagcgaggataaaaaaaataggagagctgaaaaactaataaaaatactagaaaacaatataccgtttcaacagaataactgacgcttaaatactaagatatattttctataagatatcatatgatagtttctacgagatatcatgtatgatacccttggtaccaaatctaatacttacggtaccatgctgacaccatcatgatacatagataccagagtctgagacaatacctatctactaatacggtatcataggtactggatttggtacctaatatattgtgctgatataagcacaaataaactaatattttgttggaatggtatagtgctccgtaataaccctcgtatataatggtatatatgtaaaagaaaataaagaaaacatataatggcgggaaacatatctaatgtacccctcccgtttgctcctataaaatccccccacccccaggtcttaacggctaataaactctctctttcttcccttcctccaactcccaaccagtcaaccaccagaagcgagagaaagaaaaccgaaatcacgcgaaccgccgccgcgtgacgcgatggagccctcggcggccgtcgcgtcgaggccaccgagcttcaccgcgcagacgaatgccctcctccgcaagaatctcatcttccaggttcggatccccctttttccatccagccatttctttcctcttcgccttaactgctatgatctgtttggtactcggatgagtcttctttgttgttctgatgatatgccttagggaaaagaggaaactgcaagatggtcagtacaaaatttcacttgttgtttttttttcaaaaaaaaggaacagcaaaatttcggcataatttgctagttttcgttgttcttgaagtgtaggcgtcaacttgttctggtgaagtcgtgggcttgagttatgtttattcagaatattctcttgtcgtcgttgttgactttttggcatggccgtcgtcccttgatttatattgatgtcaaaatggaaagaatttgggaccaatacgcatccatcagcataggtgaatttccttgatcgtttgaattatagatgtttggaacgcgaagaggcgcactgaaatcccttttgtttttgtgcttcatatttcacttcgatggctgtttctgtagattattagtgtcaactgtcaagcgtcttttacatttcacacgattgcaattcgttttttattaattgcacaaactggtcgttgagtcaagctaattaagaagtggcatccatgtttgatcgtttcttgcagaaacgaaacaggaaaggaaccattcggctaatcatagttccgatatacctctgcctcttgctcaccattcttcagagagtcatcaacagcgttcttgacaagcccaagttcagatgtggttgcaagtgtgttgatgtcaccggcacaggctcttgccaaaatgtgtgtggaattcagtactctacactggatcaggctggcagttgccccataccgaaccccccggaatggcctgctctcttgcagttaccgcgccctgagtatcgcgccatgcaggaatcctccttgtatgcaggtttcccagatgtatcatgcagaaaatcacaatcttgcgcagctactatacccttcacaggagcaaatgagaccctatctaacagtaagtaatctgtagttctgtaccatctacttctttaaacctgcctcaaaatccacttaggacccctttagaaaaatgcttagggcttgttggatgaagaagtgaggcatgattctcttattatttttttgttttcagtaatgatgaaataatgattatatgacttatctgagagaaggaaaatctgttaagctgtagtgtgttcaccatattccataatccactaatttttgcccatttgtttggcagttgtcatgcaaaatttgttcacaagctcaccgctttcaaatctttctgataatgcgagcatatccagtcttctccttgtaagttgaaataaccatattattacttgtatggctacttttttttaagggtgaacatcaaagaacttactctattatcatgtaacttccaggggacagatgtaccgggtacttatacaggcttcattgaacccgcttttgtctcagatcgacccatatatgttcttagacctcaatgcaaagccagtgattcagttacagtccccattacgtttggtgatattaatattcggaaaggtaaaattcttattatgtatcgcttctactgtttctgagtagattaatctgaaataacaatgttggcaaactgatgaggttgtcagattattaacctgataccatgacagacttgtgattgtcattgtttgccataagaaccatcaacctctgtgcactccttcaatgacattctgcatattaccgtttatgtgcctcttgttttgttgaatgtttttggttgaaaatgacttaatatctgaacttcaaattctgttttagcagagatgttatgtattcaaggtttacccttgtggaggaatagttcagcaataataaatgaggaaaccttcaacggctacaggaaagggaaaagtcaggaagggataaatgagattccaatgggtatgcaggcatttcttacctatgccattagtttattattgcatcatatgctggcattaaaggtgcaaataactctaattacttctgttattacagcctatgatttccaagactcaaacgagaagcatttcagcgtgttagctttatataactcaacttatcagaatgtgtcttatgttccaatgccatttggacttctgcatatctcgcgctccttgaacgcggtgggtctcacttcataaaattgaccttttattagggacaaccatagactagtggtagatcatagttgagataatgggttcaagttaccactcttcttgaaatcaaatatatctgtttaatttgtaaagtggatctctcattcttatttttcttgtctgccaacccactaaaaagtttgaaacatttttatatttcattctgcaatcatttatggttcataacaaattgacaagaagatccaaggaaacatgacatctgatgtgaaccagaatattcataatactagaaaactgtaggctgtaataatccaggagggtttaaaacttatgagcacgcataatcatgtgttttcggcttgttctctagtaagtatagtagcacattatgaatttattagggacaatacctttcttgtcctttttacactatagttttgaaattttctactctgtttagaatattgaaggatcaaaactgatcccattatcattatagtcatatcatacttctgaaaaatatctctaacttggcaatactattatgcaaagcagtcaggaagctatacaactcagttctaccaataacatatgtttctgggcatctgtgtaggtctcaaatgcatatctccagtttcttcgaggatcaggtgtaaaaatgttgcttgcattcacaaaagaaatgcctaagcaagagactcgtttgagatttgatttttcttctgttatcggccctctcttttttgaatgggttgttgccttgcttttcccggtaagtggcaacaaattgatagtggtcttcccttttgatatagtagctatgaatttgacttgttaactagtccctctcagggtttcttaatagttaatagtaagtaaaatattgatcctcatattagatatattgaagtggagaaaagtagagaactgttagaacaaatcatgatcagttttataattcatgatgaaaatttgagatttaatgcaggttatgttgacataccttgtatatgagaagcaacataagctccgaacaatgatgaaaatgcatggacttggggatggcccttactggattatctactatgcatatttccttattttgtccatggtgtatttggttctatttgtcgtttttggatccgttataggtaggaagctattcccaacggttattttcaacaatcattacttgatttgacccattttatctaactcagttgtaatttgcaggtctaaactttttcaagataaatgactacagtatccaatttgttttcttttttagtttcatgaacctgcagattgtactagccttcctaactgcaaccttcttttctaaagtcaacactgctcaaggtacaacaaacctataccatttatctccatatccgtgacctattctgtactgcaaaatatatgatgtttcttgtttcttatgttctttccaccagcaattgcatacctgtacatatttggatcggggttgattgcaggatctcttattcgcaattttattgaaggtggcaagttcccaagtaagtttagcaaatattaccaaatggatgtttttaacaatcacattaccttcatttgaatattatatcacagttttcactatgccatagcaaggcagcaacagtttttaaacataagtaaactagccatatgggatgcctttcctgctgctagcaatttattttgataaatggggctgaaataattgcacaaaattttcctgttgtgttactgcagagcactggattacagttctcgagataatacctgcattttctttgtatcgaggactatatgagcttggccaatatgctattagggcttctgaagctggaagtcatggcatgagatggagtgatctaaatgaccatgcaaatggaatgagagatgcgctgattattattattctagaatggttggttttgcttcctgttgcgtactatttggaccattctgcttcagttggacacaaatctagtttcctttccctaataaaaaatctgctgaagaagaacccaacttggagaagggtatctattaacgaagtagttaacgacgctgttcatgtagaaatggtgaagcaagatattattaaagaagtaagtttcttatagttcttatattgcactcatcagtctttcagacagttcaatctcccacctcaatgcatttttttttgaggggaaacactactagacttacccagtagttataaattttataaataaaaaagtccatatttacatgaaacagaaaagaggaaaaggaaaagaaacacacagcaaagttcaataaggtctgtaaatgcattgcaattttttacattgcaatttcaggattacctataaggctgcaatatttttcaacaaactactctacataattatgtatatcatccagtactaatttactatattcatttcttgggaatcacataaatctgcatatcagatgttacctactacttgatatctagtggttgctaattttttatgattggattacagagggaaactgttgatcaagtactacaacaacagagtagcggctatgcagttgtctgtgatgatctcaagaaagtatatcatggaaaggatggtaatcctgataagtttgctgttcggggtctatcacttgctttgccttatggagagtgcctgggcattcttggtcctaatggagctggcaagagctctttcattagcatggtttgtaatttgatccctcacacgacatacttgatccaaacaattgcctagtcattttctctttcttctgcttaaacacataaattataattgtaggatttcttgtccatgacgattattttttctttatagtattctcttttatctgttaatgttttatatatttctgtagaattaattatgctttattgaccatatttctagaaccactgaatgtcctttttaaaatcccgaaatttatagcttttgcgctttagttttctaaatcctattcggtgttctgtaataatctctgtttccttccaactgttgccttacagatgattgggcttacaaggccaacatccggaaatgcattcgtacgggagttcagcatacagactgacatggaaaagatatataacagcatgggggtttgtccacagaatgagtaggatatgcaacctactattgcagatctgttgtgtgcattagcacttgttcatgtaaaaacaccttcgaattatcaccttttgtttttgctatgttgaatgcagtatgctctgggaaatgctgaccggcagagaacatctccagttttatgggcggctgaagagcctcaatggctctgatttggacactgtaagttatatcaagtataccaggtcccttatttcttcttctgatagcataatttttaaggtgaagctagcatatcttaatatcaatgtactgtctttcaatacttatgcccgtagatgtgctttattatatggatttttatactccaaagaaaccttataggatttgaattaagaacaaatgagtggatgctcgaaagcactgaaccatgtattaagaatggaagagtgtttgaagcataaagtgtcaagtgcatgggttttcatggagcaaaatacttctctgaactgaaaaaatggatataatctagatagtcttccctgattttctccatcatccttttttcattttcatttgtcttgaaatattttcagtatgtgttttttgacacagtacttctaaatttactagtataatatactgaataggacgctttcctactatttctatttagaagcctttcagagttatttactgaaatgaaaatgatttgcaggctgttaacgaatctttaagaagtgtaaatttacttcatggtggtgctcctgataagcaagtcaggaagtacagtggtggcatgaagaggcgtctcagtgtagccatctcgctgattggagatgctaaagtacacctttctagctacagcgcttaccaacatcttcttgcgttgtgactcatcgataattccctgcttatgcacattcataaaatggcctcaggttgtctacatggatgagcccagtacaggattagacccggcttcgaggaagagtctatgggacgctgtgaagcaagcgaagcgagacagagcgatcgttcttactagtaatgttcaaactacataccaattttgaatatgatacactacctaccttgtgtttggacataatttctcttccatgattgaattaacacgcttccttttgttcctgtgacacatcttttgcagcccattccatggaagaagctgaagttctctgtgacaggttgtgcatcatggtagatggcagcctccagtgcattgggacacccaaagaggtttaatcatctcacaaacctacttcataatccaataaaaataactattggaagcattgttcctcgagaaattttatagtatttaagaaagtatatctaggtatcaaaattttacactaaaaattttggtacctcaagatacaagtatctaaaagtaccaagttttacgatagaaaaagtggtactcccttctttttttaatgtatgacgccgttgactttttaattaacgtctgaccattcatcttatttaaaatttctgagcaaatataaaaatatttaaatcatcctgaaagaacatttgatgatagattaagtcataataaaataaataataattacataattcttttgaataagatgaatggtcaaacgtatctcaaaaaatcaacagcgttatacattaaaaagggaacttctcaaggatggtaaaactatctttgttccttgcttcatctaaagatttaacacaaaaattttcaatgacagctcatagcgcgatacggagggtactacgtgctgacaatgacaacatccccggagtttgagcaagaggtcgagaatctggcgcgaaagctctcaccgaacgcgaggaaagtataccatctgtctgggacacagaagtacgagctgccgaagcagcaggtgaggatcgcggatgtgttcatggccgtggagaatttcaagaggaggacggaggtccaggcgtgggggctcgcggacaccaccatggaagacgtgttcgtcaaggtcgccaaaggggcgcagtcgagcgaagaactctcatgatgatctggtgcaaaaatgatgttttgtttgtgctgttctgatgtactttgtacagaaagtaggataaatcttttgtcaggcattagtttgcttatttttctgtacataaggatcctatggcatgttgtttttgttcaatcttcttttggtcttttgtagataaggtttgtgttattgtgtatgttatagaaaaaaagatggtgtgtgtaggcgtatattggtgattgtattttatatatgtttgtcaacttgttgctgcacgtatatgtctctgcaaagaatcataaacctttgaccagaagcctttgaattgatcatattctttgtgtaatataatgggcaattatttttccgtcgtcttggtgacatcgctctcctggttgttgcaccgttgctttcatttgtacttcagtaggctgtagcgatgctttttcgttgggcctgcagcacctgaagttactggtgtatatttgttctaatcattttgagacctaaagcgttgtttcctatagatgtgttcaacattctttttctagcaaacgcacacgcgtagcacattaggattaaatttagattttctataatccccatctagtcaaatcaaacaattgataatttgttggtaagaattttataagtatgttgttaaagtgaaggtgcacataagacttgtttacgtgaatcgtaaaacactccctcgcgtcgctctcatgcgggcggcccgggggaaaaaccctagccacccaccccgacacctccctcccccctcccttctaaccgctggaagcaagcggtcggccgggaaggtggcggcggagcttctcctcagcgtgggaggtggagcggcgcgtttctgacaggaggcggcagccggagtgggcatcgggcagaaatgctccccctacggccaaattaggagagggcaagctcgcggtggcgtggtggcgcgattcgggaggcacggtccggtggaggcttgcggcagcgcgacagctgtggccaatggtcctcgctgcgaggacgtgcagctccgacacctggtggcgctggcgtatcgctgtgttccttgacgacattggcggcgaaggctagtaggcgcgcgcgtggaggcacgatcgacggcggtggaggccagctgcggcagtggccagtgtagagggaggtgaggccggtggaggcggaggcccgacgcgaccggtggggccggtggggggaaggtggggcgccgttggagcggtgcagctatggataggcaggtggtgggtgaaaacctagcctggccttggctgggccggcaataatggcgctcaagcgtcactccctctcctgagggcgttgtcgtgtcgtctcggcctctagtggggctgccgggtgaaaacctagtcgcgactatttttgagaccttgacggacggtggcggcggtctttcgtcacttctctccctagagacattgtctaggcaacccccttgccgaagcctcccaaacaactcgtgcaagctcattctagattcatgtcctcttgtgtcgacgcactagtttatgcaagttggccacgtcggagggcctatgggggagagcggttccatttttctctctcaccctctcttcctcaatcccaatgatgtagatagagcgggggttcctgtcggttgcaagggtttggtttttgggtgatcttggctatagttcctttgttggcttagcggcggccgatcacgcttagtgctagccgacgcagtgctagccttcttctgggtctgtgcgttggtgttgtcggtgtgtgggtggtggtattcttttttctttttcctggttacgaccttccggggttataatcttgtaattttttcatgctctatcaatatgaacttcgcactgtctaatgcgagtcattcaaaaatatatatataagtatgttgttgataagaattttataagtatgtgtagcattgctcgcaattttaagcgttcgctcttgaaacttcaaaaataccttatgttactccattaatgctatttcacgcatatgtgcctgcagcacatgctcttggcccataaggcttgggaagcgaagagactaccgattcctcttttctcgtccaccccctcctatttctctttccttccattctcattcgacactgtcaaagtggcttgttgtgacctgttgatctgctccaccagctcccaataatccccatctccggttgcttccatccttccccatcttactgacatccaacattccctatccgttgtctccgaccaccctctattcttccctatctgtttttctcgggccatcaagtgggcacccctaggtcctttgaccctagcaccgctaggggttgtgatgtcaaccatcaaccactgctccctgctacaaggactctatctcttcgttctctctgtcacagccagggctgcatcatgctcgtgtcggcctctccgaaataggaggcgacctttgtgatagcgcccaggaaggcaacgatggttgtggctgtaggagccgtgggattttttttatttagatggaagttttggattttttaggtgaatctttttatatggaagttttagttttaaatctttttgtatgttgtgtggaaagtttcacatcttcaattggaagttttgtgattttgatatggaagttcgggattggaagtttatgatttgagatgaaagtttcatattttagaatttctttttttgatttgaggtgaaagtttgcaacacaaatggaagcttcaaagatcagagtttgacttgatgtgcaaaggaggcgtagtgtgaagcaaaatcacttatgtatgtgatgcgaaaaggaggcgtgtgacttgttgctagcgtagttggtctagttaattctaggaaaactcctatattaccgtctcaactataacccgattttctccctaaaatcaaaaccagataatgggcctgtttgggggagtttctagcagccccaaacagtccagatttttatctaaattctgagaatccatagttgtataatggagaaaatgaactataggatataagctgagtttttttctagattttcacaagctgtttctcataatcttaatggcctgtttagtacagctccaactcctaaatataactccaggagttgagtctggagtggagttgtggagctgc

SEQ ID NO: 83351 - DNA, 20522 bp, Oryza sativa
attcctgcggcccgaaattggtatttcccacattttacttcacttgaaaattaaagaacctttaattttaaatcctattaataatttattaaataattaataaatcctgaaccaaaaatcaggatgtgacaagacatgaccactctttcatgacttgattgacaaccatctgagagtctccacagacgattagtcggcgaatacctagagatattgcaatcctttgtccatgaagtagcgccttgtattccgccacgttatgggacgcagaaaaatgtatccacaatacgtagctcaatctttctccagtcggggagattaaaacaaccccagctccagtgcctgtaagcctcttcgacccatcaaaatacatagtccaatattccatcttttcctctggcatgtcttcttggcactcggtccactcggcaaggaaatcagctaaagcttgtgacttgatcgaagttcgtggcttgaacgatatgtccaaagacatcaattctaaggcccatttcgcgatccgtccgtttgcttcgcggttatgaagtatatccccgagtggaaacgatgtgactaccgtgactgggtgactttgaaagtagtgagataatttcctaacggtaattaagacaccatatagtaacttttgaacctgaggatatcttgtcttggagtcggctaaaacctcgctaacgaaataaattggacgttagactttttgaacatggccttcctcttcacgctcgacaaccaggaccgcactcacaacctgggaggtcgccaacacatataacagtagcggctcttgcggatgtggcgaggccaaaactggtggagtggtgagaagtttcttgaagtcttcaaaggctttctgtgcttcgggtccccactggaaattgtcagtcttctttagcagcttaaagaaaggcatcccccgcttgccgagtcgtgagacgaaccggctgagcgccgccatgcaaccagtcaacttttggacgtctttttgggagcttggcggtttcatgttgagaatggcgttgattttctccgggttggcctgtatgcctctttgagataccataaatccgagcaatttccctgacggtactccgaagatgcacttttccgggtttagtttcatcttgaaagcacgaatgcttgtaaaagtttcttctaaatccacaatcaggtcatccttctgcttggtcttgacgactacatcatcaacataagcttcaacattgcgaccgatctgagttgaaaaacatctttgaatcatgcgttgataggtcgctcctgcattcttcaatccaaagggcatggtgatgtagcagtaggccccaaagggcgtaataaacgaggtcttcaagcagtcggattcttttagtcggatctgatgatatcccgagtaacagtccaagaaactgagtaacttgtagccagccgttgagtcaaccacctggtcaatgtgaggtaacccaaaagggtctttgggacaagatttgttgaggtcggtataatcgacacacatgcgccattaccccgtctttttccgaaccaggactgggttagccagccagtcgagatgaaggacttccttaatgaagcctgctactaacagcttggttaattcctccttgatcgcatccttcctgtcctgtgcaaaacggcggagtcattgcttgatgggtttggcgtcttcgttaacaagtaaagagtgctcaatcacctctctggggataccaggcatatcggatggtttccacgcaaaaatatctttattattctgaagaaaggtgatgagcacgctttcctatttacaatctaactcagcacctattacaacagtcttatcaagatcggagggatctaagggaatcttttttgtcttggcatcactttcttcggtcttcgtcagcttggttgaaggcacttctccctcgcttgccgtggtcgcagccagtcggatctcttcgcgggcgagagtagtctcgtgagtttgggccatctcgcaactttctttgtcacatgtgacggcttgcttgatgtcgctccgttgtgatatgacccctcgaggaccaggcatcttcatcattatgtaggtgtagtatgggacggccatgaatttggctagagccggtcgtccaagtatagcatgatatgctgtctcgaaatcagcaacttcgaaacaaacattttctgtgcgaaaattctcccgagtgccgaaggtaactggaagagtgatctggcgagtggtatagctgacaatcctgggataacaccgtggaagggtgcattactcggctttaattccgtgcgaggaatctgcatatcgtccagggtcttagcgaaaaggatgttgagtgcgctgccaccgtcgatgagagtccgtcggagcttgacattgcgaaccactgggtctagtaccagggggtaccgccccgggtggaccactcggtcgggatgatccgagcggttgaacttaattgttatctctgaccaccgaagatattggggcgtgctaggctgaaccgcattgatctcccgctctgttagcttttgttttctcttagattcataagccaggggtccgccgaagatgtgattaagttctttgcgatgatcttgaaaaccggtcggggcatcgtcttcatcatctttcttctttgatgtgccttgatctccgtctgagggtttacgtgcgttcttaacgtattgctccgcgaactgtttgtagacgaagcaatctttggccacgtggttggagttgggatgatgcgggcattgggagttcattatcttgtcgaaggtgttgacacgagaacgttgtcgggaagatggagaggtggtcgccacaagttcttcgagcttacgcttgcgatccttgtggtttttacttccactccctcctgcggtcggcgtatccttctttggcttccaagtggtgcccgactgcttggatgtcgtgatagcatcttcggctttggcatactcattggctttttcaaacatctgtttgaccgtcttgggaggtttgcgtccgaacttgtcgactaggtcctcgtggcgaatgcctttagtaaaggcggcaatgatgacgtcgtcggtgatgtcggagatcttgttgcgttgctcagagaagcgtcgaatgtaatctcgaagagattctccagacttctgaacgatgttgtagagatcgaagtgtgtgccgggccgttcaaaagtaccttggaagttggcgatgaagtggtcgcgtagctctgcccatgatccgatcgtgtcgcggggtagcccgtgaagccatgaccaggcagaatccgctagggccacaggtagatagttcgtcatggctttgctgtcccctcctgctgcgcggattgcgagaccatagacggtgagccaagactcagggttagtggtgccgtcatattttttgattccagtcggcttaaagccggctggccaatccactcgacgtagatcgcttgtgaaggcagcaactccgtccacgttgtcgtcgtagcgatccggtgaatgatggcctcttgctgtgcggcgctggttgatggtgtcgcgaagatcgatgggacgtcttcgatgtggggagtgtggtcgttcaattcggcgctccctatatcgctcgggaggcgagcgaacggaccgttcatcatgtcccctgctcctgcgactagattcggcgccggcaatgctgaggcttggctggtgatagtcttgagatcgaagatgagggactcggctaccagtcggggtgcgggtgcttgcagagttggctgggaccgaggcagcgatcatggtcttcgtctggttcaagatgttgactacatgatcagcttggttgagtgcgtcttccttgaggagggtgtcgaggagagtgattgctgcaaccgcgttctgttggggggtgcgaaagaccgctatcccatcgacgtcttgttgcccaatgagctctctcgcttgccacccagattccaaggcgcgttgtcgtcgatcttcagcctcctttgcaatccgttcgcgatcttgttgctcacgctgtagtcgttctcgctcttgtcgctgtcgctcttcctccaatcggcgacgttcagcttcttgccgtgcgcgatcttggtccgcttctcgggcttggcgctgttcctccgtttcgttgtcagccatgaatacgccgaagaagaggggcgtgtagttatccttatagctgtcgtcgaagttgtcgaggtcgccgtggtcgtagtggtagccgaaatcgtcgtagtcgaggatctcggttggtcgagaactgacgccgggggagctgaggtagccatccaactcttccgtcgagactgtcccgagaggttggagtataacgccaacctccctggatctagatcggatcggggccgaagccggagctcgcctagatcttcgagtgggagatgtcttgactgtgaagacagcggccaaatcatcaggaagtttcatcaggattgagggataggacccgtcgtcttgatctggtcgcggaagagtagattggatctcatccgagtggtttgaagccgactcgggagagatgatcttggagtaggcctcggccgagttcggaataccgaacggcacagggacctggtctctccccgactggtttgaatccgagtcaaggagagagatcttgccgaagtcgttggtgatgaagttgaggctgccgaaccggaacgcctgcccgggaggaaaggcgaagtcgtcgatgccagaaacgaaacccatcgcacttagtcggcgagaacttgacgctacccctacctggcgcgccaactgtcgaagcaagatttcggcaataataaaagggggtggctgtcaagctaggaaaatggatgggtttggagacaagaaattttatacaggttcaggccttcttattaaagaagtaataccctactcctgtccggggatgattccgccgagtgtgttattaattgtatagactgggaaaaagaatcacctcccaagaggcacgcggaccctccttatataggggaaggagtccgctttacaaaatacagtccatatcctaacggaatatgggattatagataaaatacaatcgtaaccgactaagatcccgggtatttccttgacatacaagtttagaacctaacccgagtcttcatagagatattccatctatatttgataccgtatatccgactaaattacaaccgtcatgtagatatggggtatccataatctccacaagctggcttgtctcgagctatcttattgggtcacatgacggtgttaaattttgaaatagatctaaggaaatcatgcataagagaaaatagccaaaagaaaataaaagacacaaatccaatttttaaagacttctcaattatctatctcttaaagataaatatagagaatatccataataaaaggaatgccgagaagcaaatagaaggcataacatccagattgtaaaggcttcccaaaatatctttcccctttgcaatctatcaatcccatgctggttggttttatgccagctgattgttgccctcaacattctttagttgagcgacacgtgacgacatacaagcgtcgaaaagagagccggttaataaaccctccctataaaactggcaagcgttcagttacaacggtgaatagaaaaacaagagaagagttgttccacgtgtcgtgaccacatatcctatatttggagaaactaaaagcaataaatagaaaaactaaatgacataaacaataaactctataatcctgataaccaatttctaaatatatgtattttctgcttatactataaataaataatatgtagatctttacgctacaattataataaaacaaatattaattctggtgttggatttatacctagagttttatgtcaaatctaaacaccataatgctcaaaatcataaaagaaaaattgaaatattagtatattaactatatggtttttaaaagccatacacccaagctaattagtggacgcgccaaacggcgtcttgattttctaatctacattattggtgattagtgaacctgaactaaaatttcatgaagtgcctttttttcaagttcacttagaaacttgtgtaaatattgatcacctaaaatttcatatataagcatgcatatagcattagatgatacatgcctactggataaatagtgaaataatgaaaataagagtaattctgggtttaccagctacacgagctagctgacaccaaaacagaaacatgattaatcggttatcagattagccaagagataaagcaatccaaataaattttaaaaaatgaaaaaaagcaacaaaaacaaaccaatatggccctagggagatccaattgtcagttatatctatctaataacagacacatttttgacaattatgtgatgttgtacagttgcaataccaaaaacagatagagaatttgctggtgaaaaacttgaaacataaattgcaaattgctaatatcagttatgtgattaaatgacaataactagtggaaattgaatagcattgctgacagataacaattgtgttactgatcaaatggcaagattatagatagagaaaaaaaacagagactaagtatgacatacttctgcatctaggatattatcatacatagagagctttcagaataatcttgcaggtgtaaaattattgaaccaacaagatggaacattcaatcttgcagatcttgtgattctgacaagtaatcctacttctgtgacgctagaaccttgaggacagcctcatccgccagagcactgtagttcggtttcactgtagttcagcttcaggttgtcgtaatcctgtgttgtcatggtggctgcaaattttcctgggcccttagagaaattcgaagcatgcagcgttcttcaagccggagcatccgtgttgctaggccaagattaggatgctcaccacgctggccacctcgatatgtttacaaagaagggcttctcatagcagcctccatcctgtatcgatcgggccgcgatgaggagatgctcggccatggcgcgtccctcctcgcgcctgctgcatctgcggcggcaatgagtctatgtaatagtgttattacagtgcgacacagctaggatgtaatggaagatggagcctcgaagtattgagcccgaggtccgccaattaattattttgaaatggtccattaattggagtcagactgccaatttatatatatgttgggctgagttacacctcagcaatagcccaatccgattttttttttcgtttcactccttggcaaagtaactcgcaacccattggcagtgatcaagagttcatgactttttgcatttaggttccagagttttcatgttttggttgcatttagattcctgtgcgtgcttagcctaaatatgtactctccttgccttttgtcactcctccgacggtcacaagctgccaccttgcctcaccatgaacctcctccctgcacgaactcctctccagtctccactccgccgaaagcacaacctctcaaatcgtgtttaatttcccgctgaatgtacgttgctgcaacaatagcaaaaaagttcccgctagatgcacgcctgctaaatgcaacggtttgttgggacacaggtcaagattctgataagcagttgatgaatagtcaatagataagaatataagcattatcgatttttagcttctactttactttctgcattagctagaggtgctagacaactagagaaatcggagcatgagacgccccaaataaatagcttcaatatgcgtttcacaagtagttaaagtggtttatgtgaggttgtcgtccaatccagtttcattattggaggtcaatttgaggtgttagacaagttcatgcatgtgaggaggaaagtgcaaggtgaattggatagaagcatacccaccaaccgagtatatgggggcatcagatccagcacctcgagaaatcttccagagcgatgcgcctgagatggttatgacacgaaaggagatctccgaaaaaatcataagtgggatcacaaacaccatgagaagatgctgacatgctcttgttcgctgcgaccaccagcggacgtgggtataatctgtttatgggatttggcatggttgtaaggatagaggcgaaagaatataacaccaaaggtccacgcaatttccagaaagaaaaacagaacacataaacaagaccacataaggcagcgtgtgacagcaagatcttgacatgcgaatgaatgaatgcatgatagctaacttgctagatcaacttgtaaacttatggaatgtagtacaagaggtgcagctcatccccgatgatatggacaaaaaaaacttggaaactcacaagtcatgaggaatacatgacggcaactgcctacaaaacataatttaccaaccccccccccaaaaaaaaaaggcgtttgcctagctagtaatacaaaactaaatctgaacatcagacaaagtatcaatctgagaatggacaaacaacacatactgccctctttgccccctacgttagaaacatccttccatctactcacgaatgtagatacacgaggaaaatctaagacatgctgacaacctagatctcgtgggaacaactcgaacaagtgaagcctattcattgaaaaacatgtacaaacatacatgaatggggggaggcgctcgcaacttgccttggggaacccaagcaaggagtttgctccctcaccctcctaacaaacttaggaactatggaaggaaaatatccataataacctccgttgaaaatcaaggaaaaagcaataacttagacttttgcaggggtgaagcgtcaagctagcatagattttactctaagcccttccttgtacaacccttgtttttcatacttgtacaatataaatttttacatgtgttatatatcagtaaaagttgtcactaaattttactattagagttatcgcacgaatcatgcaatttttttcttgcagcacaatggctgagttgaatgctgcaagcttgcaacacaacatgtaaaacttggaagtggatttttatccctcgagagaacatcacatatgttttgtgcatgtcgttcaaaaagttatcagaaaatttaaaaaaatttatcaagatagataatatatgatatatcttttcgcaaacatgcgagttaaaattcgacttatacaattcgaaacaaaaataacaaatttgaccgtaaattacgtgttatattcatagtcaaacttgtttttttttctacttgggccgagtttagttccaaaatttttcttcaaacttccaacttttccattacatcaaaactttcctacacacaaactttcaacttttccgtcacatcgttccaatttcaaccaaacttccaattttggcgtgaactaaacacacccttgtataagttgaatttgaatttgtatgtatgtgaagtgatatatcacatatttatctatcctgctaattttttttaatttttaaattttttgatgactttttgagtgcatgtaaaaatgagaggatatccttaagggatgaattaagttttccgtaaaactccaggtatgaacggcttggatgccggccaaaccaaaccgtcgttgttcgtgtgctgttttgcagccgctgtacgagatggccttttcactttccagcataaatagaagccgtcaaatgccggcgtgcgccagtgcgtcgtcggacggcaaccccccgaaagcaacgtcactgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtgttggttaaggtttctatcttgtaatcctgccccccatcctatataaggtgggcaggaggccctctagggggcaggagacaacctgatcgtcagatctatactacacccggcggattcaaatccccaaacaggagtagggtattacctctcattgagagggcctgaacctgtctaaatcctttgtctctgcatccatccactttaggtctcgtacgctacccccttttattattgccgaaatctagtttcgacagttggcgcgccaggtaggggtgcgtcgagtttcctatcgacaagtgcgatggaaccaatctccgatgtggttgaactcgccaagctcgtttttcccttctctgattcaatccagtcgcgaagatcaatctcggcgacttcaatggtttaatctcctatcaccagcaagtggattcgtggtgtcgctgtgcagccaactggccgtgtcgccgtgagcctactccgccgccgccgaatcttttctttagtcagcaagactctaagccatcagccctcaagcaaacagaggagccatgcccttgacctctatctgccaagacgtcgagtcaggcacagcaagccaacaacacatgtcccggacagcatacgtcatcatatatcgtacacggtttgtcgaaacatgaattcggcaataataaaagggggtagcgcacgagacctaaaagtggatggatgtggagacaaaggatttagacaggttcaggccctctcaatgagaggtaataccctactcctgtttggggaattgaatccaccgggtgtttattgatctgacgatcagattgtcccatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatatatataagttatcccctataactagtcggataaccatgccgtgtgggtatggggtacccataatctccaaagtagcccctaagaccttcacagtcgaaaagataatcttctctcgaaccagattactccaaagccgagtacttcaatcatctttgccatggtctcccgagtacttttaccaaatctgaagactgtggagggctgaaaaataaagtcaggtgcatcgactagatgcacctaataggtgtagccctcgactatgcggttaagtgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaataactataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttgataaacccaaacagcaccttgactatataaaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttctgggtaatatagaccaagtgtagctcatatgaatagcttctgatctgaatgattatcccttatgggatactccaaaataaatataataattgaatcccgactggcgcaagtattcggttgacagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtaataaaaacagtgacaccaatcaaaggtaatgaagttgcataaccatggaggcgaagaaaccagtcggcaacagtcaggtcagctagcagtgaagatgtaggcgcccaacaacaacgaaagaacagtcggtgatgacaaaagcaaaccgacgatgaagacgtagacgcgcatcaacagtgatggcgaaatccaccaatcatgaagatgaagaaaataatcggcggcgacaaacgcatccaacggtaatgatgattaacggcaacagagatagccgactatgatgacgaagtttcccatcaacggcagcagagttggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagccccctgtcacgaccggaaatcacccaacaggcgttcccgacgtgcgtgtattattccttgtcccaggaggcaaggtacaccaaaagttgatacaatacagagtttaacaagcggaagcgtatataaaattattacatgggcaacgaaggcccagcacacacagagacaaacgaagaacagcggaagactagggcgacgaccacaggcacttgacggcaggcacgagctagacaccgaagccttcatcttcaaggagctcctcttctgggcttgggaaaaattgagcaagactgtgtacaaccaccgtactcaacaagacacacccacaaatgcagaataaatgcaagggagtacaagggaattataatataaagggttagggttgcagtaaacagcatttaaagacatttagttgctcaaagctactttgtaaacgcgatcctagaatgctacaaagttattaatcaaggccgtgaacccacacgaacctgccttaacccaaggcctatgatgattcagaccgaactggcaacccgaccctgggtcccagctcgtcctaagccaacccaggccaaccattccacattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccacctacggccgggatacccgggacaggcaggcagaactgagcccctagcagcagggcaccaaccctctgccatatgacatctcgactaccgggccgcagctcgtgtagccttcatttgccctggagaatgtccatcgacacccgacttcatccatctccaatccgtgtacttttgtttatgactagactgagccacaaactaagccttacccactagacatgtggaagtacggtagtgctttgcaacagaggcccgaagaccggtccttaaacggccgaggtgctactatcaaaaccatgcaccccgagcccagcctaaaaccattttggggattttgaatagagggggcggtgtgaagccaattccacaataaacccacaattccagagtatccaggtgatatgaatatttcccaaagtctatagttgtaaaaccacctaaggttacctaattagattgcgaagcatctacctaaaattatactagggataccatgagtagagtgtccactagttgaggttttgtttgtctagggtgaacaaggtagtaataacaataacaataataatatggtcataacaaaggtaaataggcatggctaagtaaaacagtgataacgcgggaatttaaataaagcgacaatgcaataatttaaatcaacataattttataaaatgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaattttcaattaaaaaatactatttattgcgtcagccgagggagcggggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgccgaaggcggcctcgccggcacggccgacgggaggaggacgcgcacccgcgccccgatggtcgccgccggcgaccaacggcgcggcggagtggcacccgagagagaggagggaagggggaagcgaacggaacggtcttcggctcaccccggtcgacggcgacgacgggaacggcggccgaagcggaagaagacggcggcgcggctcgggatgacgagggcgacggtgctccggcggtcggcgggcgaagcggaggcgcggacggagtcggcgacgatgcggcgaagccgaaggaggggtcgccgagtcggaaggacgtccggagcgacgtcggcggcgaaccgaaggtcgacggcgacggcggagagagaggagcacggcgcgagcacgaatccgacggcgagagcgagcggcgagcggcggaaacggaagagcgaagcacggggatcgaatatatagcaacgggagggggagagcgcggccggggagagaggaatcgcgcgcggagatctcggccgccattgaagacgccggcgatgattgcgggattcaaatcggacgaatccgagggagagagagagggaaaagaggggggaaacgggggaaacgggaaagggaatcacggggagtgattcccctctctttaatgcgcgcggggacggcgggatgcggcgcaatccgcggcggcggcggcgctagggcacgggcgcggcggcgggcgcggcgggaggaaggcgatgacaggtgggccccacccgtcagcgagagtggcgggcgggcccgcctgtcagcggcgcgcgcgcgcgcggggagccgatgggccgcgggagaggagagagagagagggagggagaagtgggccgagccggcccaagagggaaggggggggagaaaaagaacttcttttaggattttcttttttttataaaccttttccactttgtttatttcttttcaattattatttgtgctctgaaaattccactaaaatttgtttaagcattttaggcttttaggaaatatacaaaaatcctccaagcctcgtttgacttttatctttgcacattttaattgttggaggctttcacattgaattttaattattctgtggagattatgggtaccccatacccacacggcatggttatccgactagttataggggataacttatatctatgtaatatgtaacagatcatgacttgggtgttacgtttccttgtatatgacggaacggcctaaagtcctgatttaggaaaccgataccgtattggttaaggtttctatcttgtaatcctgccccccatcctatataaggtgggcaggaggccctctagggggcatatatgatgaggacacgacctgatcgtcagatcaatacacactcggcggattcaaatccccaaacaggagtagggtattacctctcattgagagggcctgaacctgtctaaatcctttgtctccgcatccatccacttttaggtctcgtgcgctacccccttttattattgccgaattcatgtttcgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgagtggtgcctccgcctacacggctggcctattatgccgccgctgttgggcgtctacgacttcaccgccggcctgcctccgtcgccgccgagtggtgcctccacccacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctacctccgtcgccgccgagtggtgcctccgcctacacggctggcctattatgccgccgctgttgggcgtctacgacttcaccgccggcgtgcctccgtcgccgccgagtggtgcctccgcctacacggctggcctattatgccgccgctgttgggcgtctacgacctcaccgccggcctgcctccgccgccgtcgactggcgtcctcgcctatacggttggttggtcacaccatcgttgatgggcgtcttcgctttcaccgaccggcttgcttccgccgccgactggtgttttcgcctatacggttggcggacttcgccgccgttaatgggcttcatcatctacaccactggcttggttccactggcgccgactggtgtttttgtcaccattgatggattgtttcgttcccacatcggctacttctgctgtcaccgagggaatacgacaaagctaagtcatcgcttattttattctttatatgatattttgtcttttcctttgcctcactacatcaactggttcgccgttgactagtgagtcgggggctatagatgttatatcgtattttttaaacaattttcataatatttatcttgattgcttgcgacatgttctgagtacaaaagtgcctatcgagttatggagttccatcttcctatgctttccgtttggtttgccaatagatagttgcctttaggccgattcctagcacccgggggctcgttggatggaccgagtaacgcaaggtgctaagtattattcggaataaatcaaaagcatagagatgagataaatttattttctgctcttaataattgcaaaagtacccgagtagtaaattctgattcgtgaaactttgttccattaatggcgaactcatgtcactcatatgcatgtctgggaagtgcctaggccgactcccggtgcttgggggctatgactagtcggacagagcgtttaaacgtaatgaatcatctgctcggggaaatcaaaattgacaagaggagaaatacatatttataaatattttaaaatacttgcatttttcttgagtattgtatttacatcagatactactcatcctatatgtttgttctgcaggatccaaatccaaatatgcataaaagggattcatggctttaagcttatctcttacgctccaggaatggatcagtcagaacatcaccaccggctcgccgtcgtcgccgccgactggagtcttcgcctatacggttggagtcttcaccgaccggccgccttgtccgccgccgactggtgtttccgcctgcacggctggcctttatgccgccgttgttgggcgtctatgtcttcaccgaccggcttgccctcgtccgccgccgactggtgtttccgcctgcacggctggcctgttatgacaccaactgatgctatcttcttcacggccggctacgtcgccgtcaccactaataggcgtcatcatattcaaacgcaagctgtctacgtctgctgccgactagtttattcacttccatggctgcatgattctgccagtgttgattggccttatcttcttcaccgccggtcatctcgtctgctgttgactagtgccctcgcctctacgtctggtttataccactaccactactgatggacatcatcgtcttccgtcgccgactggttatgccgccgccgactggtgcttttatcttcacaactgcgcgtcttcactaccggtttgcttctgttgccgccgactcgtgttcacttcatcacggcaatgcaactttgtcatcatgcctcgacatctcggcatgcgatgccatgttgttttactacaacaagaggctctccaatattcaggatttctacttggacatcttcaacacatatcttcaatcaagcaatgactactcgacgataagaagctataattctcgactctatgttcagttgtttcccaactaaccaaagagtcgggggctacacaaatataaggctcaaaatttgccaaattttatgtcaagctgaagaaatcaattcatcaaccaacgagtcaactccaggagtcattatcttcatctttgattcggagcagacattctacttcaacaacttcaaatatttcggtttggacgagttagacaacaacatcaactctcctccaagtgaagcatctacaacagccataacattaatttgatggattattgtcactgacatcatcaccagcacttctgcttcatcgaccctgacatctctgctgttgctaatggatgattatgttttcgccgacttattatttcaccttcacggttgacctactatgcaaatgctgatgagcgtctttgtcattatcattggttgctacactgctattgaccggatcaccgacatcgtcatcttcatcatgtcggttgcgtttgtcttcgtcaagtattttcttcatcttcatgattggtggatttcgttattgcctttgatacgtgtctacatcttcaccgtcggcttgctttcgtcaccaccgactggtatcctcgccttcacggatggcttattatgtcgccactaatgggcatcttcatcttcttcaccggctgcctcatctgtcaccgactgattatttcgccaccatggctgctcaattttgtcgatgttgctggatgccttcatcttcactgttggctgacttgtctgctgccgactggtttcttcgctccacggctgtgcaacttcatcacttttgattgctaccatcaatggacaattgtgactacgacagaaggacaagctatatgctcaggggcttactagctcaaacacaagtatcataccttcaagttggacttgttccggatacatgcaacatgaattcatgatcatgggtctattttctatg

SEQ ID NO: 83352 - DNA, 5000 bp, Oryza sativa
ctgcagcccctcttgtttttttagttttataaatacaagtagattttgcatacaccatgatgatactaggattaaatggtacaaacatttctcttattctccaattaacgtggtactccctctgttttaaaaacggcgatagtaattttaggcccctcagagtaacagataggtaaattaaaggaagccactcatagttgcatacttgcactagtaatctccataagagcgaattttagattgaattatttgatgagctaagttcttaatttaaaagacagtatatatctacccttctctacaaataaattgcactagtaacaagtaacagcaatacatacttttccaatgattgagaagggcagatccaaattattaagacaatgactacaaaaaattgacattacattttcatgaaaaattttttgacaatgtcaaatctcacgtgccataactatttacttccatttataaaacaccaggcttcatatttttttcaaacaggtaggaaaaacagtattattgcattcatatttaaatataaatatataacagtaattttacttttcaccaccttttattactgacattttgctttggattaccgtttaacaaatattttgaactttggattaggtaatcttaccttcgttacactctgggccatattgactcacttctcaagcatataaacgatttcgaatacgtcggctcttactcgtcaatgaactcctatagccgtatgagagataatttctttactataatacaaactggatatatatatatatatatatatatatatatatataaagagttaagggtgatccaaagtgccacaaaaggtaaaattatccggtttaaagtgaaaacattggtaaatgatggttcaaagtaaaacattgataataaaagtggccccaaagcgaaattcattcaatatatgatgatgttaatgtcatttggtatgtggcaagcaacttatttgaccactccttttcaattagaataaaacgataatgtctaacaaaattataatattgaaaagtacttatagagataaatctaccatattatttatatgtttttaaactaaatattttgagagctgttgattatcaaagttttaaaaatttaaccaaattagtcaatagtgtcacatatttaaatacaggagtagtatttacccggttgatgcgtgtagatcgacatccctaaagagaaagttcattccaatttgtggtaccgtaattaaggcaaataacatcacagaaatgggagaggatgcatgttcaagatgatagctaccctgatatatcaatctagttttccttatcggttatcatttcgggtaagctaccaacaacatctcttttcttttggagtatgctactaggaacaacctatgatgtatagtttgatgcatatgtatatacacagtggactaagagcatccccagcagctcttctatctagtcatccatccgatatttggagtatggaggagaaaaacaatgctccagcagagtctccatcatcatatgctctatttttggaggtcctccaaacctagcccttcctaagctaaatatggagctctctctcctcacttcatcctcaactacccactccctaagatcttttttaagtggtgaaaggtgagaggaataggagtaaaaatgtgtggtagttaaaaaatattagtaaaatataggatgttggtatatgtgggatgtaatatgaatgatctgttggagtaaaaagttatatagagtgagaatctttttggatggccatctaaatgagagtatggaggataaaatttagatgagctgctgggatgctctaaccttctcattttctctccactcttgtgaagtccgacagaagtttcggtgcaaaatttgaagggacaattcggcaaactcaacgtatcctatacgcatttgcaccgattaaaaagagaagtaatttggggcatagacttcgctgtcctagtcttcggtctgatgttaccgctgtaaacatcgaaatttataagtgacaattgacatgccgatcacactgaatttcttcctacatttctactagctaggatggcagaaaaagttcagaaaatcctgaattcttcctacagttctactgggagcagggtttcgatttcgaaattggattttatgcctggggtgaccgaaatgtaatttcagaaatttctggccaaaattatttgaaatttgactgaatttaaataaaatttgatcaaattcacaaaaaatgtaaaaaaactaaaaatttcggacgagaattgagcatgccggtggggggcgaaatttcaaaccctgactgggagtataggcagtataggacaagttcagaaaatcgttgaattcatcctactgttctactgggagtgtagctgtttagcactagttcagaaaatcttggattcttcctacaattccactgagagtgtacgacaagttcagaacatgtttgctctcaaaatatatgcatctcaaaatcaaatataccaactcgatcacactcgatcgtatcaagaattaacaggaaagagaaaaacttgaagcatgcgcacaattttcgtctctatgtatgtactctgcaataatccatgcgttcatgaactattcacatggtgccgtactgatccgtactgactatctaacgaagtagtaggtgctccgctccttggcggcggcggcggcggcgcgctgctgctgctgcatgcgcagctgctcgtggaaccacatgatgaactcgtcggcgcggcggtccaccacgccgagcctcccctcttcgtcgtcgtcgccgtccgcctcccacgccgggaacggcgagtccgtgatccgcacctgccgcggcgccggcaccaccaccgcgggccacgcgaccacgtcgccgtcttcgtcgtcgatatccgtcgtcatcgcctcggcggcggcctcctccttcacgtccatcagctcgaacagcctcgacaccgtggcggccgagccgtacggatccgcggcggacgaacggtcgtgccactgcccgtgctgctgcaggcgcagctggctgcggcgctgcgcgcggcggcgcctgtgcagcggcgtgctgctgcagctgaactcgacctcacggggccggtactggtactgcgacacggcggcggagggatccatggaccggcacgacatcgaggagagcccggaaacgcctcccgacgcgctgctgatgccgccgccgctgcgacggcggccagcgccgtgcgcgccgcggccccgcgggtacgggtgcaccgccgcggccgggtccatggacctgcacgacatcgtcgacgacaggtacgtcagcaacgccgggtgctcccgcaaatcgtcgaggccgtggtcgtggccaccgccgccatgccgcctcgaggacatcatctggtgcaggtggacgccgagcgcggcgagcttgggctggtgcttgccgagccccttgacgaggacgaggtacacggcgcgcaccacgcgacacagcttcttggcgctctcgcccgcggtggccgcctgcctctcctgatgatgctggcaaccacccgactccattgccgcctgctcgctgctgctcatctcgatcgaaaaaatatttgtctcttctcttgtttttagaaaattccggtgatctcagctgcgatctcctggaccagctactcctctctctctttctctctgtgttcttcgcaaccaatgaggcttattatcagagaggagacgagagggagaggtatttaaagggggccagatcactagctgggcattcatggcaaagggaaattattggtgtacgtatcgtcttcgtattgttcctttcgtgtttcggacacatgcctgcttttttttttcgtgacgcgttcagttttgatcagtgtgatttagttggtggttttcttggtttattactggagctaactaaggcactatttagatcccgcccaaaaatttttaccctatcacatcgaacatttaaacacatgtatgaagtattaaatataggttaaaaaataactaattgtgtagattgcgactaatttacgagacaaatcttttaagcctaattacttcatgatttaataatgtggtgctacagaacatttgctaatgatagattaattaggcttaataaatttatctcgtggtttactgacggattatgtaattagtttttttattagtatcagaacacctcatgtgacattaatataatacctgatatgacatgctaaagctttacaccgttagatctaactaccccctaagctctaagcttgccgtgtccagaccggatctgataggtacgggcagtatatagatagctgcttttaaattacctttctggagacgctttcagaggtttaccaattgggttaatccgagtgtttaagtagtaaaacacgtgcatatatggcacttgcatatactgtacgcggcgataatcagttaagagagttgttgaatgacctgcgtagctgctccattttagtattactcttttccggttgataatatttgtcccggagaaaatattaagttattgcagaaacattgtcctaaggattttggttaggaagttgacaaatacaatgccaaccgctcgattatcatggctattggacttattgatccagtatatatcaattgagaaaccgttcgataaactcgtcaatttaaaaataatcaaactaaagttcaaatttgtggtaaaatctgtttgagtttaaccggttgctgtgaccgaacgattttctaatccatgttgtccagttgcatgtttatcaatgtcatacacctcaaataaccgcttaccatttttttcggccagatgtatatgactgtactaccatttttatttgttactactactagtttgcatagtgctcatttaggtaagtacttatttttttaaaaaaaatgaagtcaatagagaaacaaataaagtggggctgcaggaat

SEQ ID NO: 83353 - DNA, 6151 bp, Oryza sativa
  unsure (1)..(6151): unsure at all n locations
gccgccgccgtcgatctgctgctggcagctggatcgccgccggccgctgctctggcgccggtggcggcctcgccatcgagctcgaggcgaaganggagccgccgccgccgccgtcgcttccttgatccgccctcaggcaccagttgcacgtgccgtacgactctgccttggggtatcgctccgagcagtatctggcagtatcatacatgcgtatatacagatcagtttagctgtaaatacgtggaaaatgattgcgtgatctacgttattgcatgcatgtacgtttcagatagacactgacatgcaacacaagtatatatatgtacatccatgcacggagataaacgaaccaacacaacaaaactggcgaatcctgaattatacttatgtctcgatcaatattcatgcgtctttttcagaaaaagaaaagaactcttcatcaatttgtcaagataagatcgatgcatgcgttcattatatttatagttatccatatactatacagttagagctagcgatcaagcaagtacaataatgctttaaatcaacatttatgcccataatttttctttaatcacgcagatgtttcaacaatattcatatggcctagctgacatgcgcagccactgtcaagcgctaggggaaagagaaagaaagcagaattaattaacaaagatcgaactatttgcagacagtgaccgtgttatgtactatatatttcagccacgaacgccctactttgaatcaatttgtttgacaatttcgcgcggatcgcgcgaaaagtcagacaaaattagctggaaggcgcgctaaaagttactactcggagacacgcgcgcacgtcaaaagcgcacgaactgtggcttgtcatcgatcagctacatgccagtcaataatcttataatcacagctaattcgatcactagctacggtctggggccaatccatgtagatggattagtcattagttgagaggaatgtgttacatgtgtagcagtgttgagcagttgtggttcagagatcgatgcatgatcaattgaaactattgaagtggttgcatgctcgaactgtgtggtgcacatgcatatgtacgtcagtggattattccgatggcgaaaaaattaaacaatctgcatcgtgtgccagtttgctattgatctgaatagttagtttctcagataaacaatccacgatggctattaacctatgaactcatccaattaagagtatcagttcatgtaaatcttacagttaatttatatagaagaatatattgattccaaattaaactgattctatcctgatctgagtatgtgcccagaaatccaaatgaatcaatctagcatgtctctcatattgggttgggggaggtgtcaaaaattattttcgttaaggaaaaaaaacacccaaatctgcagttgcggacgaacacgaacaaattaacaaatgaattttgacgagagagcaaaacatacgtacgtgtgctgggagcggacggcgcaggcggcgcagcggaacagctccggcaggaggccacggtcgccgcacatgcagcacacggccgccgtggcggcggcaaccggccgcggcggcgacgacgacgatccggcggctgacttgtcaatccccatatatatctcggcagatcgatcgatgaatcgggcggctatctcaagcgcatcgattggtaaagctgccgcatgagatcgatcgatcgatgggatgggatgggattgggaatggatcggatcgaaacttcaaaagggagcagattggttgctgatggcgaagtcgaagtcgaatgtggtttgggaagaggaggaattggaggtggtaatgcggcgcctgccgacttcacgcatctcaagatcttgtagaaggaaggaaggaagctgccctcctttaattttgtcctcctcctgctgctgctgctgccatggctgtaaagatttgctgcagtttttttttatatttttagtttctgagatggcttttgcgttttggaccctgaagtttgtggctttatgttacaagttcttttgttggcctcccaagaaaaagatcttctcttgtactatgaagcaattgaggcatgtagtttatttgtacgatgaatatcgaatggctaagaataggtgatgaatctaagggactggctgttcagattgatgttattttcaaccataccattttatagtaaaattgtcaaaaaaatgtctacgtttagtttattgccaaatttgataaataaataagaaattctgccaaaaatttagcaatattgttaacttgccagattttagctacaatctaaacagaccctaagacttaataatcctagtactagtaggctcgccggtgagccacaacattatgaatatttgcggtgcctggcatgccacacacatgcttatgtctaggcattagaaaaattccttagttcatcaatgtcttaagtttaaatctaatttaagtatttttctttggtcctatgtgtacaaattgtatttaaataatataaggtgggtatatagctctaacttataaacttttcagtcttaatcattatgcacacgtgtttatttgaaaaggtgttatagttttagtcttttttattagatgcacaaattttaattgtcgaaacacaacaatgaaacaaaataaccacccacgctcatgtgcaatttcaatacgattttcatgatgcgcacgtatttaatatgtagcctttgagaccgatgagaagtgattgttgttgctacaattgccgctaccgcccaataccacaattgctaattgaaagtatgtatcgctgcaatagctacagctgcaaccacaacaatcagatccgattaagctctttatttgttgagtatatactcgaatatatattaaaatatatattcatgacatgtgtaagtggcagccgtgtacccaatgctttatctctgtcttagtgaatcttgattcgacgtcttctaggtaaaaaaaaaataaacaaagcgtgcaagacaatagacatgtcggctagaggctacataccaaaataccacatatgacagggttcagaacgcaaaaataactggagtgaaaaaataattcgagaggcaccaacaggtccctttcatggcaaaactgtagatagtgagacatcaaggggcaaaccctttcccccgaggaataatagcgcagctgggcggatggacttcgttggacggccgtgcggacgcaggggcccacttcgacgctccctccacctaccacccacccactgacacgtggggcccacataaaaccccaggcccacctatcagtcacgggcctcgcggggaagcgaccaccaaatccgccggtggcatcgggccgtaaattcacgggaagcgcgggggttgattgggccggaagcgggccttggtcggcggtttgaccctgcatgccgcgctggccaatgggagaccggcagcgatggcgtggggcccacgtgccgtggcgggtaggtactttggcgcatgtggacgggggaggccgatggatggatcgggccctgcgagcgagccgacaaggcaacggaaatctcgtgtggttttcgcggctaaattgaagtacactctcgtgtggttgattatgttttttgattagagcgattttttggattaggatgccgtcatgctgcgtggctgcgtgcgagcgtgtgcgtgcatggggtttagcgtttcgagaggttaggatttgatcggctctgtggaacgttgtagagatcgggtgcgtgacgtggtgatggtggtggtggtggccggtcttatcctaggtaggtagctggccgagaacgcggcttgtagtctctgaattagcgccttaagatatgctcgtatgctaccgatagctacataattttattagtgtgaagtacatatgtcccaacattagaaaaattgataataaagttatatctacaggtggacgggattctccggataaaagttcttacctaagacttgatgggcgacggcggcctgtgatatctatgaagacgtcgtataggagatcatgttgatttccttgctcgcctccattcagggtggtgtgtggcgacgttcttagatgttctcgtcgggttacatgagaagcgagtagatcttctctctcgcccttctctctacaacgtccaaaagtttgaaagcaatattatgctgtttgaaagcaatattatgctggagaagagcgaggcgataggtatgttcctcttcgaagggctgacgacgatcgggtacgcttagcgatgatcggttagcattagtcctatcctcaattccgttattggagtcgccaacgtgtaatggtgtgtttttctttctttctttcctgatcgtagcctcccagataataatcttcgtatttctccttgctatatcagcatgaaactttgcactatcttaggtgatggttgtttcaatatatatatatatatatatatatatatatatatatatatatatatatatatatatatatatatatatagtagtttcgttgagcctcttggcttctgggatgaacctgttgcattattaaggaccaagtggcggctcgatgaacaacgttgccattcatccgcgagtaccacatctccagctgcatcttttttattacggaatacatagacgcaagcatacacccacattattacaatcaaagaaaggcaatatgaagattcacgtagggccaagtccagtttttacaagtcaattgctgaaccatttgggagcggacgcatgcaagggcaactgaacacaaccggtcacggccacacaaaaagttgtgctagtgtagggaaatatatcctatacgcaataccggataatacgggaaccgaagcttcccgacctgaaatggcgttgccctccgggccaaagagaggaacattatggcttaagcctctgctatggctcttcgattgtttgcctccctacaatctgtacaagggaatggatatacattgcgtaccagagatcaatcattatacccaaccagcaggcaacagcatttagctgtttattctcatctcaagcaacaacacgcctgcttagacaccgcataaggaggtgtgccaacattaatcaataatgcaagcctaaaactgcagcaaggccttgcagtttcactcctatcaaaacatgaacagcttatctcttggatgaagtcaccttccatgcatttccttctttttcccgtaagctgggatggaaaagtaaaccaaatcccaaaatcaggtaactaccaatagaagcatatgtactatgcagcaagacaaaaggcaaaggtttgacataactgcctaactgtatccaaacatatatagaacttgtgtttgagcacctatgctgtaaagtatttaggatgccctaaaatatccagtgaacacaggtacctcagcaaaacttaagcaataggaaatcagctctgtgcacactccaaaggatgtaaacttccttcaccaaactcatgcattcgaaatcgttccaaaaattcgaaaggtctgcacagagaatataacagtttatgaatgataagggaaagaaaataataagggcaaatatcatgcatgttaaggcaaccggactggtttctctctaattggattacctcttagtataataaaaataaagtggaactgtttcaagattcactaagcttgagtaaactggaagcaactaataaagcaatttattaactgcatgtgacagattgacaacacactatggtaacacaaatagactcattcgaagaataatctgacagccatattttttttaatagcatgacgccaaacacctttagtgataacttgatcctaaacagcaaagtatggtttgatgccaagcaattggtcatgttagttatggcttacagcaaaatttcacggttccgggagagcttcctctgattgttttctatgacacttgatacatcaatttcgggtccagcaatcatagatgtagcgttcgcatccggtgtccataactaataaagaaacagataaaatcaaattgcattcaagtacttcaagtaaaatcattaaaatatttctaaaaatatcagattacttacctttattgtgttatctataccacttgttgcaacagcacagtca

SEQ ID NO: 83354 - DNA, 2020 bp, Oryza sativa
  unsure (1)..(2020): unsure at all n locations
cagtttactgataaaattgataaacacatctttatggccatgttctggtgcatatcatagattttataatgcttgagactaaccctgaaatctagggcatgaatgtaaatggtgatgtccttgtaaaaaccatgaatttcctggacatgataagcatgttttatctgtatttatggtataagtttttttttttttgctgttatcaggaagtgaaccatgggttcatctgtctcaaagcaagacgacgacaccgcattactgatctgcaaggatcggttgagacacattgaacaagcaattgatgcaaggtatgccctttcagctgctcaacttgcatacgagcaatctctccgcagtcttggcattgctctaaggcagtttgtggaggcacacaaggatgatgatgatatagagaggtctcctagttcttcttatgctatagtatcatcatcgccacctcaccgttccgatgttaaccatatgaagtcagaggcaagcacttctgtgacagtgacaatcaacacaagtcaggctagctctgttcagaaggagcagtcggttactgctttccttccaccaccgctgcagctagagttttgctcctcatgggatttctttgatccaactgttgttagtgaaaatgttgcatcagatgcctcagtgaacagccaaacatttgaattgagaacgttggaagatctgagcaatccaaatgaaatgggtttggcttcttcaattggaaacacaagtgaaattgttgaggtgcaagaagtgtttggtgcacctggatggaaacaggttcacaaaaatgataaccttcctgacttgcaccactctaattctaatgaaattcagatgtctggtactcatttacccaatgactcaagcttggaggaagagctcgagcaagtacagacgcaggctataggagggcagaattctaatgatgttagtgataatattaaaagtgaggccaaccatataaatgttaatgctcccaaaaatgaagaagccaaggccattttcatcactgactctgactcatccaaagattttctttcctgtgtgaaagatcttgaacgtcagttttctagggcagctgtatcctgccatgaggtctcgaggatgcttgagacgaagaagatccgccttagcatttcttcccagacaaaaggttaggacaacattttcatgatggtagtgtcctcgtgttttttttttctacttaacattggtgctaatttctcgaataaactttgaatagcaggaaaatcatcagatgtgctttttcgaccaacatttctcatcggttgcaaagccggaactgcagcatctgatggtatatttatcttctgcagacaaatactganatttgtgaacttcggtgtagtttatactccaacaatgtcagcctcattttgatgtttattgcaaaaatatcattcattcttttactgcaggatcagagaagcgtgtcacaaaagcaatcacttggaatcgctcactttcatcgcgatcatcagcatctaagaacccacttactccagctcaaatggacgatgaattttcagagatctgtagtgactttgttgaagagttttgtatgatttcaggaagccatgcatcctctttagatagactctacgcttgggaaatgaagctatataatgagttaaaggtgagctcatatgtgctcttcaatcgatgcttataagagaattgcactggcaatggatcttttacagcatctgtgtagaaccatgggattctgcttgtcttgtgttttattagaaatgtatcaaaacagattgtattatagttgttaccactattgtcaacaattcctaatgcaaatatacattaacgcaaagtcgcaaactcatacagaaaaggtaaatgtatgaaaaaaaatctttgacgcattagtatctgccttattatgtaacgcacagtccagatttggcaaaatagcatgcataactacttttaaggattaaataattataatcattctatgtat

SEQ ID NO: 83355 - DNA, 11006 bp, Oryza sativa
actcaactgcatgtgcagttaagtgagaggatctgcctccaaccacaaggatccaaaattatcaccaccttctacatgcgcaaacaggttcctcgatccatctgatctgagtcgcatccaattttggcgccaacacatgcaacttcctccctttttccccatggattaatgttacctcggtgaagcagcgatccgattaaactaaactaatttgcagccatgtacattaacgaacactccatttcaccggtccaccatgcatgcaccacccgccaccaccgcggcgcgacgccgacggcgacataaacaatcacacagaaccgcgtgacgccgccggccggctatatataccgtcctcatctgacctgctgccatcggctgcgaagatttcttggtcagttcagttgagttcaaccatgaacaccgccgtcgaggttaggtgcgccgccgccggcggcggcggggtgaatgctgcagcgtttggccggaggatgatgaggccggcgccggcgggacactgcagggtgatcagggcggcggcgacgtcgacggtggcgagcgggaggggggaggacgactactacaaggtgctgtcgctggacagggcgggggaggtgggcgcggaggagatccggcgggcgtaccggcggctggcgctgcggtaccacccggacgcttgcccgccgtcgcgccgcgccgagtccacgcgcctcttcctccagctccgccgcgcctacgagacgctgtccgacccggcgctccgggtcaggtacgacgccgagctgatgatgcgcgtgcggcggccggcgaggccggcggcggaggaggacgcgtcgtcgtcgtcgtcgtcgttggcgagggacgtctgggaggcgcagctgcgcacgctgcgcgcgcgctccgacgagcggcggcggcatggcgcggacgggacggctagacgcggccgttggttcgaggtgtgagctgtgacgagatcgatttctggtgttcttgacttggctcgatcgagcgtctgctggtggttgccgtttttgatattttcaattctttggctgtcattgtgagattattatttgttccggtggcatctctttttttactgtggcgtttgagagcgtgttgtgtgtaagatcaacgtgtgttttgattattattctgtgatgaacaattggcatttgtgattattggttttgatatttggagattatcgtcgaagtggttttggagataatcaattttcaggagatgaacagggtttactggtttgtcgggaccggtcagaccgggcggtggttgccggtcagaccggcttgtgttgagcggtcagaccggccggcccacggtctgaccggccgacgctgtgtcggtttcggtttcggattgtttctttggatatccgtgattgtttcatggttatggcttctagatggatactatacgtatgtgatactgttgttttgctactaatgagtcaagttggtgatagcttggtctcggaatatggtttttttgtttgtttcatgtgtaggtgactcgatgcctcgagagagtatttgcactgatggaccgggagtcggcttggtggtaagacaatgtccgtggtggtcagatatcatgcgggatactaaggctagagttgatgcacgtggttgatggagattccatatggcatacgatggaggtattgtgtgcgtatgggatacggagtcgaatttggaaggagtccaaatttggtatgattggttatgtagagtttgtttcttgtactaagaggtttcctatggggattaggactcttagtatgagtttggttcgtggctttaggttgcttacctcatgtataaatagagggggagcgtgaggcttcccggtatctttttggtatcgcttttcatagcgttgtgttttagggtttcgagtttagtcgagatttttgtaaggagtgctgttgttgcacgttgtaaacatagagagaagtaataaagttgtcatctacttttgagagttcttcgatttgtgtttcatcgggtacggcagtctaaccggcaactcaacggcggtccgaccggcgacaagcagcggttagaccggcggcatacgggcggtcagaccggcggcggcgacagcaagcggcagctgatcccggcggtcagactggagattgaatctcggtcagaccgacggcaaccaggcggtcagaccggtgcatctacttcggttagaccgcgatccatcgatttcgagggtaacttttatttccgctaaaagttttcggtttttgcgtataccaaccattcacacccctccccctctggttggcttagttcttgtgattcgatcctacattgtgcactgtaaactgtaaaacttttccaattctgcaaaagttacgtgtaaaccatatgaaattaggtggtgtttgaaactcatatagatgaatataaagataaaggttaagtgttttacgcaaatcaatatggtattaacgtataattagttgagttttaattattacaaacttgaaaaatatttatctaatatttagagaaacttccatatagaaagttttcgcacgaaacacatcgtttagcagtttgaaaaatatgtcgtgaatactccctccatttaatattataagttgttttaaactttgttaagtttgatcaagtttataaaaaaattaacaacatctaaaatatcaaatttgtttcattaaatttaacattgaattcgtgttgaaaatactactatatttttttataaacttgattaaatttaaagaaatttgattaagaaaaatatcaaaatgatttataatatgaaacggagggagtacaacacagcgtccggcaaaaaggaatggattggacagtaatattttgagatattatggatgtatcccagagattttagggagtgctgtctgtgataacattgaggttggctcaagtgcaccatacagtaaagaaaacgggcaaagcagagacaagcctaattctatcaaaaacttgtgaaaaatttgaatatacagatggacaagcaagttcaaccctggtccttgaagtttcttggtcatgtgtgaaaaattgatgcaatgaacacaacacagattttaagatatggatacccaaagcgatgaaatttgtgaatagacgaaacaagatggagagctagctcccatcctcacttcactagactagctcacggactacaccctccgtctaaaaaattagattttagctataaatctgaatatgtgtttattcaaattcatatttaggagttaggttttttttgaaggagaaaaaaagaaaggttgaaacttgtgcaaacatgtcgcctaccgagctaaccgattaatcatcatcatggataatcatatgtacaggcccaaagtgtggaagcacgggcttggtgcttcttgcacatccactcatcttcaaaaaagctggatctatcagaccagtgatttatctagtaaaaccaaaccagtctagttaattgtatcgaaagatcggatctgcattcaaactgtttagaaccagctgaaccgggcagttttgaggtgatcgaacaaccaccgataatactaggtagtttgtttgtggtgggttatccaaaggccagttcttccattatggcccatatcatcttgtatttttgaaataaaaaatacttgacaaatattggttgtgtatatagaaaacttataatatacacatttagtggaccacgatgcaaccacccgatcaccagctagaccgttggactggtgaaccaacaggttagctaatgttgatattttcttttacattgcatggaagaaacactcacaactatgcacgctcgccacactcgtcactcgttaaggtgccctataacacatgtttgaagagaaagaagtcagcggcaaaattaatccctaatcttattaaaatcttattgaaaatacgtcgagcgtacatgatttttggtgtgcaccaagacttaaactcttgtgtgtacatgatctttaatttcttccgtaaatccgtctatgttcttttggaattggggatgtttgatttgaacagatcacaatgagaatgcaaagaggtgtttcaccctactttcaatcaccgatcgatttcacacactagctaaatactgactgatcaggaagaatgggatgatcctaatctgctagctttgcgtggcgcctgatctttagactcagtttgcactcatcttatcagcttcttattaatatccacacaaaatgcttattattacctcatctgaaccgtgggtttggaaatccctgttctaaactttgtgggggcatgttcaattatagactctagtataaacctacagtacgaggttatttaaaaaccatgtctatacaacagtcaaaaggaaaaaagactctaaccattaactaaaaaaaaaatttgttgttatctttttttcactcatataaccttgtttccattttatggaggctaagtagatgttgagttcgctgttaacccaacaatgatgttttgtctctcatgtttctctcttctaaatctaaataaatattcttaataattagtaaaactaaaagtcatctattaatgatgattgtacataccctgataaataagtagcgaccaactttccatcagataagtctagcgaaagacgaccttttcactctcagtactccagctaattaaattcatacatacatggtataaacacagctttccttctgcaaaagccaagttggcacagatcgaaaagatgaacctgtttccttctctagttcacactcgttttcacgaatatggtgacgctgccatccagacaaacggccatcgtcggcttgacaagctgatgaacacccaacatcgccatctcctgcacaattgccacacagctatagcctgtttgagagggagtaagaataggagatgaagagtttgagaggataagtcatacggattatatacggtacatcaaattttaatcctggtttgtgataccaaccggtcccggttgttaacacaaaacgggactaaagatttgaactttagttccggttggagttaccaactgggactaaagatcccggaggggcctgacagcccctgacagcatgtgaaccgggggtaaagatcaaccaggactaaaggttatatagccccgtccttcttataaaccgggactaaaaaccatctttagtcctggtttaccgggattattgtggtttttggccgaccagacaaagatggtttctcaagtagtgctagctctaatgctcgatttctttctgcatcttctcctatacctcgctagccgctacgaataatcgggcagtcagcctcgtcgtgagatggaatcgagttttgaaacagatggttgcagaaaagttgagatgaaagttcatttgtttaagagagggatcgtcccaaattaaggaaaacgaagtcgcgggaactcgcggtggctgagcttgcaagggaggatatattctccctcgatcccttttgcttttgctcatcgcttttagaaggcgaaattccaaagcgtgtctagccctgaaatgtataaatcctactcgcgtctcgcttgcgattaattcaccatcgatcgcttttgagttcagtggtagtagctgataagttgtgttcttctaattccctgatcaaaatggcctcgattagagattttgccaagagatatgaagctgactgcagacacctcaaccaattcttttctggtacatatcaactgatgatatcagcaccgccatcttgtctcatgctagcatcaagaacagttcatcagtttcttttttcagagatttgaacagtttatcagaacaatctgtttacattttattctgtatcaatttctgtttcactgcactgttcaatgttcatacatgtttctgccatacgttttctttctaacacgactcaaacatggtgtcatgtcactgacatctccaaatccgtaatttaaccctttgttaacctttttttgacaaatctctgttagcttcattccttgccagagattaaccacgattgattatcacaaaatctgcaggaaatgtttccccgaacaatgcgagaccggtcctggagatcttcaccgcaaggagcagccaggagatgaagcaaatctgcagggcttacagcagcatgtatcgccaagatctcatccagctactgtcgcagcagaagaccacctttgcagtaatcccagcttctgatcctcttgtgtcaaaacatatttcaatcttgtctggttcgatcgccatcgtgcgccatgctagctgatgcacgcaaaaaattaatggtgcagagggtggcgtgcctcagagctagcgagccgtgcgtccgcgacgcagacatcgccagggacgcgctgttcgggcggcggatcgacggcgacgtgctcgtcgaggtcgtgtgcacgcggccctccggcgaggtcgcgctgatcaggcaggcgtaccaggcccggtacagcgccagcctcgaacgcgacgtctcgtcgaggacaagcggcagcctcaacgaggtgagagctgcgccgatcgcttgatcagattccgtttatctcgtgttcgatcgattggtgtgtgtatgtttgataggttcttctcgcgttcttgggatcgagcgggagcggctaccatggcggccgggtggacgcgacgatggcgatgtgcgacgccaagacgctgtacgaggcggtggagatcagcgcggcgcgggtggaccagaggagcgtcctgcagctgctgcgccaccggagcggcgaccagctcagggcggtgctcgcgtcgtacaggcggctgtacgggcaggagctcgcgcgggcgctgaagaggaaggacggcgacaccagcggcggcggcggtggccggcgaggcgagtcgtcgtcgttcccgggcatcctccgcgcggcgctgcggtgcgcgcagctccccgagaggcacttcgcgagggcggtgcgcgcggcgctggagcgcggcgagggaggcgctggtgcggaccgtcgtgacgcgcgcgggcgtcgacgtgcgccgcgtcaaccaggcgttcgcggccaagaccgggtggacgctggagagcgtcgtccggaacgagttcggcagcggcggcaccgggaagtcggacgacggcttgaccggcgacttgctcgtggagttgctcaagttggcctgaggacaagagattgagattttctgcagttactgtaccgtgcctttgtcactaacatacgggtccgatgatcttcgagcccacatatcagtgataaaggcacggtgcagtcgactgcacatgatcataatccgaggagagattgagatcctctacagttattgcaccgtgtttttgtcactgacatgaagtccaccctcactagcgggcaccaagcctcttgtctctcgagccgtcagatgatcgatcagctgcgaggatccatcacaatcttccattcttcctgcatgtagtggagattgcaactgatacatctcacgtttgtcaagagttagatttgttactgtattttggtgataaatataatgaaataatgaggcgaagaattatactgttatgtacacacagctatacatgcaaaccacatcaatgttcacaccagctacagttgacaaccatttacaactgctgcaaccacagcagctgtggctggaggcctgaacacactctatgagtgtgcctctaaaacaagcataaatagattgtttttccctattaagtttatgttcaaaaaaaatagagatatctctccaaaatgacaatggtttgttatgcttaaggctatcactggatttagtggagctacatgcacaggtgtaaatattttatgtttaaggtaaaggtttggtgcaacttgtaaaacttttaaaccatcaattttgtattagaataaattaattatatcatgatagttctttcaagacaaatatacccataccattccttttattctttttaaagctaattaaacatttgataacattgagtagttaaagttttagaagtttgaccaaatatatcctaatcatcaaatgtttataattggagagagaggaagggggaggagaaagaaacatggatgttaagcttaatatcaaccatgattgctatctcacgcgtacgcgccagcttgccagctgtgcccgcctcctagcgctctttctttttttctgattttctttcctatttttctgttacacgtttatcccatatcacggaaaaaagtttctttttttatttttcttttcttttctggaaactatcatgtgtgtttctttttcctttttttctgactaaaacaaacttttaagtaagatttgaaatcttctcaacttatattcgaaaattttcaattcaagatttaaaagcttaaacatatatttaaaatcattcaatatagatttgaaaattttcaagtttgaaaacttttaagtaaagattgaaatctttcaacttagatttgaaaattttcaagtcaagattgaaaactttcaactaagatttaaaaactttcaactcagatttgaaaacttccaagtttaaatttgaaactttaaacttagactcgaaaactttcagctcggatttgaaaatttttaaatcaagatttaaaactttcaattcggatttgaaaactttcaactgaagatttgaaacttttaactcaaatttaaaaactttcaagtcaaaattcaaaatattcaacttaaatttttaaaactttcaactcaaattcaaaaccttgaactgaaattggaggtgaaatattcaatttataaaatatagcatgaaaaaaatcgcacaagcacgtgaagaaaatatggggagcgattaaaaaaagcgtaaaccggaaaaaaaagcgaaaaaaaggaaaaactctcaggctatcgcgtctgcgcgtgcgtgggccttggcggcgtcgtaccggggctagcccgtgcgtgggctttggcagcgtctgcgccggcaacgcggttgcgctaattagttgcgccctatcaactcgtagccttgataaaataaaattttgctacatgaggatgaagaaaagaaaagaaagataatataggttatattgttagattaataattagagtcttctttgtagaagctaggtattttgttgaagagagtgactggaaggaaattcatatggtgaaccatgtaaacaatcattcaacgtgctaatttccaattgcatttatttatttatacgaaggcattgtttgattgttacaaaagatctgtttataacttcaggtttagaaaaaaaatgttaccaccctaatcccttgtaaattgtgttcagctactatttttggagttcttttagtgttgggtttggtttacactttggtgttcgccatagatacaaatttgcgctagatccaccattgcatatagtcaccacagtttaaatatgtaattgtaatcttcacagtaaaatgaaatgtttaaatttgaaggatactaaattgatactaagctagtatcaacttagatcctatttggcacaactccaaatcccatatccattgaatgtaaaaaaaaaatcccatatccacactagatctggagtttgaaagttaagctacaatggtttaaagtttctctaaaataggaacaaaataattcatccaaatgttatcaatgcagtcatgactctatatccatagatttctatgactaaatactcaactccaaatggatttggtcctatgtcaaaaaggaccttaatgaaatagatgcccaaattgaatccaagagaacttaaacttgaggtggtggagaacagaaatgaacctctcaccaagttttataatggaaacatgagggaatatacaaactatcggtggtagcaattagcaaataaatgatgcatatgcagggtaggaaacttcattaactccatacgaaacttgtgtttataaagaaaacatttagttgtacgcaactatggaattttcataatgttttcatagttatgaggaaacatgaggaaaattgcaaaatatttgtggtagcagataaacacatgcatactagggaaattcattaactccatgagcagtgcatcccctataaagaaaacatttaatttcatataacgggttttataaatgttaattagtagcttgaattttttgttgcgaaactgagctcgatggtaacacaatttaaaaaagaactacaattatcagtactgaatatatgtaaaaagatgtttactcctaaagaggggcatttaactatttgccacatttaagatgtggtaattaaagatttgccactcgtagtttatgacgtatgggtgttttctacaagtggcaattaaggatcttacaagtgacttgtaagagtgataaatagttaaatatctcctaaagaaaagcgcgagaagatggaaacaacggaaatgctaatatgcatgcaagggcaagctgagcaagttgcgagaatggggcaccctatttccggccatggccatcttcttatctattatatcctctcatacccccaaccaaccacatgcccacatcggggaagaagcgacaagaaattgagacgacggcgttgcacactgtaccaccactacttggcgccaacaacctcctaaaaaacgctagtgagcttgacctttacattgccaatgatccttgtcatcaacaccatgcctttcctccacattcctcatcctatccccactcccacagccaacgacgtcacctttatcatctggttgcacaaccgcctaccctaactagttggcggttgtgcttgtgttccccggttgctaaccctaccctccgccctctctcgatccccgcggcttcaatagcgtcgcctaagcctcactgcccacccatgactactaccttcctagctattcttagcctagaaacttaaaacccctcttcctctttccaacgctccttccctcgcttatctcactccata

SEQ ID NO: 83356 - DNA, 4374 bp, Oryza sativa
agaaatactaaaatacagatagagatagttgattgtacttcatcttggtctattgtaaaaattgtccgatgtactggacgcattcatcaccaagtccaatttaaagatgagagtctaaggattcgatcgcatatagtactgcatttcagtattttcactataagaattgcgtaacgcgtgactgatggcgatgtgtaaacctaatcgatagactagctatactagctaacaacgcgtgatttttggagatttttgccggcctttcacaattaatcaatctcaacacagacatatatagagagagtgttatatacgaacgtacgatttatcgtcctttttataaaaaaaagattttttatgctgtttgtacgagctggattaattctaatactactagtacctcaaacatatctgcatgcggatcgatcagccatgtactaggaaaaaataaataaataattgcatataaattaggatttggttgtactacctttgtcttacatgttggccccgtgcattcctccatgttgtccaagaattattttttccagttacagagctaactagactataccaatgaagattgccggccttgatatataaatgagctcttaattttttaaagtatactatacacagttatttaaaatcaaccaaagcctatcatatatatatggagctcacaaaaaagagaaatattttcacaaaaaaagagaatataatatatatctggtgagaaaaaaggatgggaaactgacctttgttcaaaacaaaattgtataaactgaaaaatggtccttaattagttcgatcgttccactgcggtccatatatacatatatacatgaaagggcatgtagcctagtggttgcagtgacctgagtagtaccccaaggtactgagttcaaatcttcataggagcgaatttcagatttggttgtttgcggggctaagttcctaatttaaatggccgtatatatccggttagatgtagagctgggtaaaaaactatccttctctaaaaaaaataaaaaaatatatacatgaggtcgcatgattagcaatttgtactacaaacgttaacatgtaagcgaatattttgtaaagtaattaattcttttgaagaattatcccatcgtatcataaatcaataacttattaatattttctgcaaggagagacaatgactttttaatattagattgatcaaattaatgagatctaattgcgacggggaaatttgaccacgtttttataagagaatgcataccattaaagtcatttgaaatccacaaggtaggatacgaacatgagagtcccaacaaaacgaagtggggatgttggacattatgtttaaaaaaatagtttaaactattgagttggtccctgtagagaagataccatatcaaaagggatatatagaattaattaaaataagatggaatcttgattagctcgttcaagtcttctacgaatggaccgcatacgacagaaatcatcttttttgagaggctctgataaaagagtcatatttttttacgctaaatgtatggccatcccacttgattaattatgttctgaatacaaatcaaattcaattgtaaagcatattattattatcatctatataaacactctcccatatggagaggcaacacatactacagtggtggacccagaaaaattatactggccatacctattctagcgatcacttcaccatatattttttaaaagaaaacacccaattatgatggaagaattttagcagattttagtcggatttttcaaaatactattcaaatgtggtccataatttatgaaaaatctataaaattcagaataatcaattccatgacctaatctatttagctgttcttctttttcccccaatgtttctcttcttctagtcctttcatcttcccctgatttgatttcttaatgattacaagatcaagacaaaccgtgatcattgttatattctattttctgagaggattctatttttatgttctttgattgcatactatatcctagtgttttttcaaaaaaaaaatgggtatgccggtgctaacccggtacaccccttaggtccgcccctgcgtgctaaacacaactattatgatggttctgtatagattcccatcaacttttgctttatctagctgtttatatatgttggttgaaatggaatatattttttatgtattttttctgattatagtgctttcttttcatatatgtagggttcaccaattaagctatgacattttttttattttaagctagagtaattttctcatgggtgaagactattttacccccccccccccccccattcctatcaactacaccgttcaaactagtctggaattcagaccttagctgtatgaaattagacatcacgtacccccacccacaaactatcaagtgggagtgtgtgggactacatacacttaggtcaagctatgaacaatagaaccaaactttttatcatctgcttttacttatgtactccctcagttcctaaatatagttaagtaggagggtttttgaaaggattcttaaggactggtgtgcaaggtctaaaatacctcccattatagtcttgggcaatgtgaagtgcatggccactctggtttgaaggatccggctcctctgcctttaggtgctaaaggcatgagcatagtaatatgtgccttgcgcaacagtgtggaacatatatttgcagttatttactgtttatgtgctactgtactggactgtagtgattgatctcgttcgttcactgtaaatcggacgactgaaaatattctaaaggcacaacactgtgcttccctggttgaggtgatgtgaacaactaggggtagtatgggaaatttagtgtacaatgtcacattttcatatcctagttagccatacttgtaaaagtttcgaatctgaaaggtagctatatttcgagatggagggaggcactcaattagtaagatacataaaatatatttttgatggcaattcaaaaaaattaaattaattgtagtggatctcagggtggagagatggggacggtggccgtgcgactggaagaggatggctcgatgtatcctagacagcaggtcagcgactccccaagttccaatcggcttggtttgttgttttgagtctttcaacacatcggctcagcactaaagaagggtttggctgcagcgggagagcaaacacgcgtcagcccttggggtggatagcgagccagctcggctcagctcggtcaagctcgttaggataacgagctagctcggctcggctcgttatcgtaacgagctagaaacccagctcggctcagctcgtttggaagctcgagctagctcgttaggctcgcgagccaacccatccaaaccatccagttggcagatgagaaggttggagttggggtcgatgtggaggtcctttcagatgacactgtggagaaggccgagcggcaggagaccccgaacgccatcgcgtcgtcttcccctcccgccaccgcggcgagcaactggagcttgtggcggaggaggagcttgaagaagatgttgtagatcttcacgccgacgcccggcatcgcctcacctcacctcacctcgcctcttgcctatatcccacggcgacgacgatggcgcggctcgggcggagccctaggctgtgcgggtgcggcggcggggtggggaggaagatgcggacggagagggaggagttggggtgcggcggcggggtggggaggtccttggaggcgacgccatccgccgcggagaaggccgggttcgacggcgccgtggcaggagaccccgaacgccaccgcgtagtcttccccgcgcgacggctggcggtggcagcgtgaagcactgtggtgccgtgcaacggctggtggcggcaacgtgaaagaggatcgagtgagagagtcagagagatgccgtgtgggtgctagggttttcctctcctcaaccgagttgggcttttgctgttcgagttgtgttgtctgttgggcttctccgcggctcgttaagactcacgagctagctcgttatttctaacgagctttaaagccagctcggctcattacgaaatttaaatgagtcgagccaagcttgtcacgagccgcacgagttaacgagtcacgagcttttgtccaccctagtcagccctctacgcagtgtcgcacatgaggcgtggtgcggtgcaaagaattttcttctggcaaaaactcaaacttaaacactacatacttcacagttcacgcagtcaaccagccatagcttgcaaaaagctgcctccagcagcaatactccccaaccacaagggaaagggatcctctgacttgcagttgagtgagaggat

SEQ ID NO: 83357 - DNA, 3757 bp, Oryza sativa
acacataacaacctttaacaggacatataatttcatttcttttgtgatttcttgaaaaaaccaaccaccaaacatttgtgtggagttccatatgccatttggataaataaacgcttaccagatttatttgtaatgatcaattgattttctgtgactagttgaatgatggtactcctagagtgagaagcaaacgagcatatgttatgctcacataagagttgtgaaaaaaaaaaacccactccagcaaacgcacacgaattatttagtacaagtagtaggtttgcaatgtaagaaacaaaaaagctcgaagcagatcattataaggccaaacgaaacttggttattatttcccatgccagtgcagatttacataaaaactagtacggctgggcgctagactacagacgcagaaggcaggttgacgtactcacaggtgcctgaaaacttgtctgaaaactgcacccatgtgaatacaaccgactacgaaactgattaacatcaactcacctaattgactaagatagtactaataacacgtacttatagtaataaacagcatcagaagctaacattcagatgaacctgcaggaattgttggactctgctgatctgatttgcactgcagagctaacagtaactgcataaaaccagtgaaacaggttcctgataagttggtcccatgagatgagatgaagatgatccgttctatcatcaacactacctacctgtctcaagcggtcaagcctactcgcgctcaatctgaatggtcacatggctgatgttgtactcagacttgatgtacccaatcaccttgtccagcatttgatcagcgtctgcgtcctgagtgattgtcacatggcacgccaggagaaccttccccaccgttatggcccagatgtgcagctcatgtactgcaaccacaccgtccatgtcgcggaggccattctcaaggctggtggcatcgatctcgcggggcgtgctctccatcaggacctcaaggatgttgcgcagcatcttgattgtggtgaagagtacgatcacggagaagatgagggtgcagatgagatcaataatcttccactcgggcttgtaccagatgatagcccctccaatcatcacaccgatgctctggattgaatccccaagcacatgcagataagcactgtgtacattgatattacgacgagccttcttggcatccttggcaccagattgggtgctgtcacaaccagcatcactcttgagcaatggttcctcagcatcatggtggtggtgtccagtgcctggatggtgatggagattgacggtaattgaattaccatggccatcttcgtggtgatgtacatggccatgctcttgatcttcatggtggtgatggtcatggtcagaaccaccatgatcatggtcatgggaatgtccatgcccatgaccatgtccgtgtccatgtccatggtcatgaccaagcaagacagccattatgatgttaacaaataagccaaatgctgagacagcaaacatgagggagccctggacctcaccactttcattaatgagccttacaatagcttcatagacaagaataccagcaaggagccatatgagctgaatagaaaccagggcaccaagaatttctatacggaaaaacccatatgactgctgtggtgtagcttcccatccagctgcccaaagagagaacaaagatatggcaaaggccgcaacatccgaaaggagatgggctgcatcagtcaagattgccaaactgtttgctttgatacctccaaccacttcgaccgccatgaatatgatgcaaaggatcacagcaataatgagcttcctcattgacgccattctctcccttgcatcttttgagctattactggaatcagaaaagtcacaagcagcacctctgcaaactttgttcccagctgctacagaagtagatgatgagatgtccattctcacttcagcaatctggggaggtgctgagttatggctgtccatctagggggaaaagaatcatgtcaatacacaagtacaaagatgatgctatatttacttctcatgctctgagaaaacatgttaacataaggttcctggtagaaatagtgcgaaaagctagtgataagaatcctttcttgtgtcactgggggaggaaaaaaactgaacagcacttcataaagtaaaaggtggcatgaacattcttaacatgaatgaataacgaagttaaaacatcaaacatatataacataggcaacactgtttacaagtaaaaaatctccgtgccatggcagagcgtacttttatggtacttatgccaggtaacaatgagtagccttttgttaagcggcacattaaaaaaatgtgcatcagtaccaccttcctaaccaggagacaacagtagcaggtacaaaaaggttggccaaaggatataatgaatagaagtaaatatgttcgttttagaaggtgccaatgtctctttgctcaacaaatatagcaggcatagttcttgctagtgcaaatataatataagcattgcaaataatgaaaccattttcttagtcaggctaaagctttcaagatgtattaaaaaagcacaacaaaacaggaaataaaaaaaccataaaactgaatgcagaaggagagcactagaattgtcgtgctggcagtacaagaacagttagctggcacctggcagtcttttccaactaaaagtgacagtatcacgaaagggaagattaattaagtcgcactaatccaacaacaagaaggtccccctaaacataactagacattcagcacatgattgcaaacaaacgtcacaagattgaagtaggtacttcgtaaatcaaaataccctcaaacagatcaagttctctctacctaaccgaaggcaaccggcaatcgctggttacagcgaaagcacaagaggggaacaccaccaagggagcaagctaatcggcattcattcatgtttacgataacctacattagagtgtatgtccacaaatccaaaaggacaatataatgaaactaatgaagcactccagagctatcgtaatgagattttccaaccaatccatccatccatcggaagcttttcattggacacgaggacggactggtcagggaccaacgctgattgattgattgatcgatttatttcgccaattcaatgacgccgtgctcgcggacaaacagtttgtggctgacgaaagttgaaacctactccagaccaatcgaatctgtagtgttaggaagaacccaaggaggaaacgaccaaaaatcgatccctatcatcaccccgtaacaccgcaattggagacagggactcgtgattcgaccgattttgaaaaatttttctctcccccgatcaaatggacggagaagcgaatcgaagcgagaccccacacctccactcgaacaacccaatcccgcagtagcaacccgtaacctcgagtcgaacaacccaatcccgtgacccgtaaccgccgctcccctgatttctcctcctcctccatgaaacaatattccatcctaaacaaaaaaaaaaaaactagcgctccaaaatccgaaacaataacagcaacagggaatgaccccagggaaacccgcggcgagcgaagagcagattcgtggaacgaacgagagaggagcagaggttgatctggtctctcggtggggacgacgaatccatcgtaggaagaggtggtgggaaaggggatggggatgcggcgatgaggcgctaaccttggggatg

SEQ ID NO: 83358 - DNA, 1129 bp, Oryza sativa
ctatgaaagtgtggtatgtcataaatatagcaatgaaccaaagacttgcttgatttagtcaaagggcttagccacaagttgtggcaagtgtttctctcctgctcttcttttcttttcttttctttttttgttcgagataaaaatctcagttagtatgtccctctacaccatgcaatacaaattaagttgaaacacattcaaatggatatacggataaaattctttattggatcttatttgagaaacgataatactccctccatttctaaaaggagggattctaggtttttaagagattaaggatgaagataaaagatcactatcatgcatgcctcatgttgcgtggtgagtgaaaaagtggttgtggataaggtgagaataaaattaaatatcaatgattgatcgggcactatatagtacatataaaatcccttattgttggataaaattctaaaatgtttcgatcgttgggcgttcgagagaataattttttttaagggaaaaaggggggggagatatttcattgcacacaaagaaaggctacagctattaattccaatatgatagtattatctctgtccattcctagtgtaaatgcggcacacacgttgaagaggcatatgtttacacgcaggtcaccctaaacgtgtccaaaaagtcaggtcttaaaaatcattatatgtagtaagatatggtggatttatactcggtaaacacgtcttgattaatctaatgaccactagttcttcttttagcaaggagacatggcaaggctagtgaaagatgagagccctgaactgaaaggcagaagcactatacgtacgtgtcatataattcctagtgtagtagtttttttatcattgctcaattttgtttgcttcccctgaataatggatcgagcttttgctcatcctgactttatacctcacgaggacaacagagagtattactttttgcaggatgattatatttttgtttttatcataccgacgattaggtgcccaattatatacctagtactccctccgtccctaaatataaaaaaatttgatagaatgtgacacatcatgtccatatatattgtactagaatgtgtcacatcccactaaaatcctttatatttagggat

SEQ ID NO: 83359 - DNA, 652 bp, Oryza sativa
tccccatgcgggcagctcggcgctcgtcccggcgtcgctcgatattgattcgagcgtcctgctccccgtagagaccgtcgggacgcctccggcttcccgaggcccccgacgatgttggagccgtggaccgcctcaaggccgtggccgatcgatgggccctcctcctcgctgacgaggagagggcaatgggggtatgcgacgtaccggtgacggcggctcggccgcccgcggctaactgccgctgggcagtggtgaccaagttggccacgtcgttcaaccagcgctggacaggggtctccggctccgagttcacggggggatgccgcagaaggacacccgccgcctgaagcgcgcctcggggcgagccgccgtcaccgtaagtgaggcggcgtcgtgccccgacgcgtcgtggcctccctccgcccgggggcgggtgtcacaccctgaagttctccttccaagcctaaatttaatttataaatgatcctaagaaaataccggtgcaaagtaagagtaaaccccttttaaatcaatgcaaataataatcggaattggcatgtggaatttttcttgagttctacaggtcgaaattcactaacaggattttaagtggaattttcagagccctaaaaataattttaaccaattaaaa

SEQ ID NO: 83360 - DNA, 27433 bp, Oryza sativa
  unsure (1)..(27433): unsure at all n locations
gaaagtatatttaacaataaatcacatgatatgaaaggaataaatattacttaaatttttgaataaaacgaatggtcaaacacgtactaaaaagtcaacggtgttaaacattttgaaacggagagagtatatatgtatctatgttcattaacatcaatatgaatatggaaaatgctagaatgacttatattgtgaaacgggggaagtatttatatataaaatagcttactaaatattatagataaataagcttatgcatgaggccatgacatgtatggttcctgggttcttgtttattgttgcatatggtacttaaattattgcatttagcttcatattcactctgtttaaatagataatagttgacttttcaacacacgtttaattatgcgtcttattagagtaattcatgtaaatgtaaaagatataaatcatacttaaaatacttttattgataaaacaactcacgacatgataaatgataaatacatattttttaaaacaaaataagatgaatagttgtgtgttcaaaagtcaaatggtatcatctacttaaaaaaacagaggtagtataatttttcacatggtttatacaactttctgttgctggctgtcatctagtttaatctatttatcagccacttagccgtgagagtaggcggacgcagctttaaaatatagatgggacaaagaatgaagatgcttaatcgataagagaaatcgaacacaacatatatcatatttatagttaaattgcataattgcctcgaccattgtttgtggcgtgcatacgtcgtgaagatacagactaatctattggacgtttacaccttgttatacctaatttttatggctaatgactaatataaggggtagggagggtcatgggtgtgaagcgacacgagtcgtaaatgagacagtcaacccaccctgcctaatgggtagatccgcccctaaagagtagtacgagtgaattatttagacatattctatcatcagttaggcccctttcgtttggaccggttgcttcgataacttctgtagcacgttttttaaatcgtttatataagaaattttttaaaaaataaatctattttataaatttaattgtaacaacgccttgggctgtgtttaattagaggcgttaggaacccctcccttcacacgtaaaatagagcgacgaattaacatacgattaattaagtattagcttaaaaagttttaaaatagactaatatgatttttatagaaacttttggaaaaacatatcatttagcaatttgaaaaacgtgtgttcagaaaatgagagagatgaggttggaaacattgagggaggaacacaacccaaatagtttcaacgccacaaaaaagttctaatcctacataagggtttgcattatcctataacttcactttaaacctgctcatggtgttctttaggagttatagaaaccttccaaccccacctttggattgttgcacaactctactttaaactcctctcttaatatattgcctctgagatacgatataggattgggtgacaaagtgaaggagaaaagtgagagatgatgaaccattcgaaattaagagatactccctccgtccaaaaaaacgaatctatgactgaatatgacgcatcctacaaaaacgaatctgtataaaaatatatccagatttattctactaggatatatcacatcaagtggtaggttggtttttatgtgacggaggaagtaacctccacataaactcggaagaacaatgtgtaactggatatgacagattttatggtaggaaacttttattttaacgcgattttaactattagaacacgataatatcatctttagggacaaaatacccctaaatattcgtgattttaaatctagaacacggtaaaaaataaaaatcaatctttagagacaaaatgattttaactatatatagaacacgataaaaatcataaaaatcaatctttagggacaaaatatggttatttgctggttaactttagtgtcctatatttaaaatcatgaaattgcagtgctcacttgctcttataagttgctactcgattaattcttagctgctaccaaacgtacctaatactaactaattattaattaataatgcgctaatcttttctgaagagttaggcaccaaacataccctaatactcgatcaatattgattgattatatccgtaatactcaatttattattgattaattatacgctaatgacccgttctttttttcagccgtcaatagctagagttgtgtgattcaaacgcaagcggccttaatttaatccgcttttaatttaggatatcagtcacaactcacaaatgtaaaaccagtaactaattaaacaccgattcatgaatattattagaagcagaacaagaaacactatgaccaagcattagtacctgatcatgcatctaacagtacagatcaacttgttaaactctatatcattaacctaatcctccgcttaattacctattaataatctctctctctctctcggttcacttttgggaacattaacacaaagcctcagatcaggagttccacacgcgcccaccgtgttgcccagcttcttcggccggccgccgcaccaccgcctcgcggcgccgccgccgccgccgcccatgatgccgccgcctctcaggccggcggcgtcgctcgccccgtcgcgcgtcctcttctccggcgccggcagcttccgccccctgaccgcctggacgaccctgagcagcagcattacgccctccacgttgaggctccaccacccgggcccgccggcgccgccgcccgccctccgcgccgcctcccgccgcggcgacgtacggctcgtctcgatggcctccagaaggtcggacacgaccgacttgctcggcagcgccgccgccgagccaccggcgccggcgctggtcccggcggcattattggcggcagcgccgccggcggcggcggcgagggtgatcatcaggtggcgcgcgggctggagcgcgccggcgaggagggagcggctgagcagcttgacgaccgccgacgtgcgtacggcgcgctccagctggctcgcgagtccgacaacggcgccggcgccggcgcgttcggccgccgcgtcggcggtggcctggccggcgccggcgggcggcgaggtgggcttcttcagacgctgtatcctgccgtgggcgcgcacccacgggttggagtgttggttcatatcgccgccggcttcgtcttcacctgaacgaaacatcgagaacaaaacgaagaaattaatcaggactcgacacgtctcactgcaacagtgttaaaactaatcagcaagttttaatagcatgggggcaattgcatctgtgcactcactttcgaagccaattgttgttttacccccactttttagggcttgcagttttacccccacattttaaatctaaatcagccatgtacccctatttctaacggccgattttaacggtgctagttgttaaaaaaaaggacatttatatcctggatggttattgtatttttgccctatttttttcagttttgcgtgattttgctcctaatttgtgatttcagcttgtgtgatgagcattttgaccaaatataagcatctcttgtgatgttttttactttaacaaaaaagaatcacaaatataggcaattacaaaatttaaacaaaaatcccaaatactagccttcatggtcaatgctctagaccttgtgaggtgctgagagatgatagccttcatggtcaatgctctagaccttgtgaggtgctgagagatgatagccttcatggtcaatgctctagaccttgtgaggtgctgagagatgagagtcatgttaggcatcttggagtaagggtgtgtttggttgcaagctacactttgccacagtttgcaacgcctaaggttagacagatttgacaggtgtttggttgtagccacagttgtggcaagattcccctccaacaaattgggtcccacgtgtcaatggctcaaaaaagtgtggcaagattcccttagacttagtaagttgtggctaacaatttgatcacctcaccttaggtaaggtgtgacaacttttgttggcaagtaatggtaaagtgtggctgggaaccaaacagcccctaagtatcaaacagattcgtagcacccgagcttggcagcgcaaggcttgccggatccagcggacgaagagccgctcccttccaggcactaacctcaggaaatacatgtagaaatggcagtgattcagaggcgcgttgtagctgcggagcgtgaaaacgcgatccacgaagctgatgaacctgtccaactcctgataaccccaccaatcgatggagaggcccggtgcttcctcccagtggtggagccaacgacgggcgagcacgcacgtcgccaccgcctcgtgcgccgggagcagcaacagcacgaggcggagcacctcgtccggcagggcgctgatgcggtctggcggcacctcgtgcgtgtgggtggaagcgcggcgccgccgccgcctccgcctccgcctccgcgcacacacgcggccgccgccgccgccgcgcaaggaccaatccggtgggagaggagagctggttggatgtttatcgattccctcgaggatagaacggtaaattgatatttcataaatcattttttttatttctatttgtttttctaaaaaaatgtgggaccaacctaacggtgttaaaactgaggacgttttaaaaaaatgggggtaaaattgcaaaccctaaaaagtgagggtaaaacagtagttggaattaaaagtaggggcatggatgcaattgtccctaatagtatagccaaatgttagatctaaatcatctatcgctattctaacagtcaattaatacaataattaagtataaaaatatactacaccattaatacctggtctcaggtattatacccatatactccctctccctccgtattttaatgtatgacgccgttaactttttaaccaatatttaaccattcgtcttatttaatttttttatgcaaataaaaaatacttatgtcatgcttaaaagaacatgattcaatttttttatgcaaataaaaaaaatacttatgtcatgcttattatgtcatgcttaaagaacatttgatgataaatcaaatcacaataaaataaatgataattacataaatttttttagtaagacaaaagattaaaaatttttagtaagacaaaagatcaaacgtttgttaaaaagtcaacggcgtcatacattaaaatacggagggagtaatatgttggacataacaaatagcttgctttcttctctcttctcttttcatcgcatatcatagtctatgttacagctagatacaaatagcttgctttcttctctcttctcttttcatcgcgtatcatattcggcttatagcttgctatgtacctgctctaactaatgtttttgatctagtacatgttgttgtgtacagtaatcaacctagtatatatgcacgcatgcatgaagataatttgatacgcatcgcacaatatgtaattaactagtaggattaattggtaatcacacgcgttctaatttgcatgttaattggaataccttgctgcgtggtggagagatcgtggtaggagcagaaccgggagaagatctcggcgagggtggcgcacttcctctcggcgccaccgccgccgacgacggcgtagaagaatccgggcatctcgaagacgaagacgcgggcgtcgaggcgcgcgacgagggcgtcccgggacagcatccagtggtggttgccgacggcgcaggaggccatggagaccgggtggccctcgacgcgggccatgcgcaccgacaggccgccggagcggaacagccgcgccgcctcgaagcggtcgccgcacagcacgaagaggctgaccggcggcgagccctcagcggcgagcagctgcgtctccctccccatccggtactcctgcgtccgcccgactcgcagcggcggccgccctcctcctcgtcctcctccctcccgagtcgccatctccgatcgatcaacacttaatgctgcttgatcacacaaattaagctactagattcaatttcactctgtactgcaaaagaagaagaggaagaagaagaagctgcaggcacgcaaagagcatgtccatacggcaaatatactggtcctttttattagacagtgatagatcgttggctcgtggctagatagatattttttgcccggatatttttccatgcagctaatattattcgctaggttaaacaacggcacgtgttaaggttaatgaccatgtatgtatgcaccactcactctatgctagctaccagttaaactatggtacgtagtgcttaccacaacgagagccggatcggagagaaaagagaagggaattacgttagctagagagggatcatgttggagtatatgcgaggttgtacgagctgggagaagacatgggggtggccactcttaaataagagggaggtagtggtagtagtagatagccatggtcgccgaccgaggaagaagaagcagtggggggtcgcgaaacggaggccgcgcccgcgcgggagaagagagcgtattgcattgcattgcatgcatgcagggcacgcgccacgcacgcgggacacctgcgcgccacatcgagcggggggtaggggcccaggcgtggggcccgcaggcgctacacgcggcccccaccgcagcgcgacgtggcccgacgacggccacgcgtcccgcagcgctggaccccttgcatgccgccgcctcgcctgcgccgcgaatccgcgaccgcttcgcgcgcgcgcgcgcgccgagccgagccgttcgagttcgcgcgctgcgcgccggtcgaatcaaataccggcggcattggcctgcctaatcaggggcttagagcaagcataatagacgtctctgtaagaaagtagacgagagaggagagaaaagtgaggagaaacggtctatgaatttgtgacagctggtttagaaaaaaaaccaaaaaataaatctatgaagggcagatggaccatatatttattacagtgaaaagctaacaactatatgagtgggttgaaagatagactataaaaatctatataatcagtagctggttgtattattagctatgctcatagggcctgtctagggatcttcgtagtatcttttagaattaaaaactccctacacagtttagcttttagtttagattctaagaatttatagttataaaatctaaaaaataaagtagaagtcataagctagaaaacctagcttttttaagattatcagtatcaattagttgtttcttaaaattttaaactcttctaaacaggctgttagctacacttggtaagcctacctaccgaagacaattatatatatatataatcttacttaattatttttcatgagcgagctgtacatgtagggcagtgtcttatttgtatattctatatacctgagtatgattaatcaacttatcacatcatacttatatttagagcatgtttggttgagaaataatgttccacgtattattttttattaaggtggctaagttttttcttgttataattttgcgataaacaaaatgataagttaaacttagataaatttgataataaaatagagtgtatgacatgtggaccatgtaaaaagttaagatgtgacaaatttagttgccaatcaaacatgcagccattagactcactcttttcatctacgtggtctcgccgaggtggtaatgtggtggttaaattgatgacatgtatctattaattacttactactaccttcattttttaatagatgacgctgttgactttttctcacatatttgaccattcgtcttatatttattttgttatgagttattttatcactcatagtattttaagagtgatttatatcttatacatttgcataaaatttttgaataagacgaatggtcaaacatttgagaaaaagtcaacggcgtcatctattaaaaacggagggagtataagattgctcaaaaaggacccacaaatattcgctatgtaggctaacacatttccacatatgttattaaagggagagagaaaagatatatattgatgcgcgttgatcgatttaattaaatacgaaacgctattgttaggacctgttcattttagaggaatttcaatgcacgggaatagaaaaggtgggcaaagggtgaatagccaaagtggtccttcaagttttatctaaagcttaagtttagttcttaatgtttcaatttatccatattagtcctttaagttctaattttagttcaaacttatccttgaacccatttagaagccacatggctaaatataacaacaactttcttgataaatgatacttataccccccctcattcatatatataagaaaaacaattgcattcaatgattgttttatagataatgcacagtaatttatgtaaaatgaaaataaattatgtacttacaagtgtatacgatagccattgcttaagtttaatgtgcacatattgaaataatgagaaatatatctgcaatgttgtttattcatcttggttttatcttttctaatgtatagtttgtatacaaactaaagggcaaaagagacattctctaacagaaatattgaatagaaatagccacatggcatattaagtgggtccaaagatgattttaaacaaaaacaaatatttagacgacatatgtggacaaaatgaaatctaaagtatcaaattgagcatttgatgaaacttgagggactaaattagctattcacccgtggggaaaataggaatacatgcacactccaatatataggaatttttcaagagatttgagtggattgaaaattttctatgtttttttctatacaacgtgtggaaaagaaaaaaatcttttatttttactatatctacatttatattaaccgaatagtatccatagaaattaatcctgagaaatctaaatactttaaaatttctataaaacaaaaaagcccttaaattgtcgaactatatattcacgaaaaaaaaaagacaatataactagcatcaggatgttaaactcacaggacacagcaattatgataattcgaatgaatttgggttcgttcaggtgtgtcaaaggtctgaagaaacggctggaaccaagtcaggaaacaacgtatatttgtttccacccagaataatgcaagatctcccaaggccactttgccattcgtctgcccaagccccaacggtggggaacataactggaaagagtgcaccccctccgttgtttgtactgttatctctcctcttattaaaaagtttgtgcaaatataaaaaatgaaaagttatgtttaaagtagtttggataataaagcaggtcacaaataaaataataataattctaaaaaattttattaagacgaatggtcaaacagagcatgtaaaaagttaaaatatcttatattatgagaccaaatgagtagctgtgtagtacattagttctggccggtcggcggtggcgacatgaaccgaattggttttggaagtactccgtatttgacgttactgtaaaattatattagctgtataagtaatttctggtttgtagatatgatgaaactggccactcatgttttagtttgtgttaattcaatctcagtctccactgattattttatttggtgaagacgagattaattgttgtacatgttttttagactaattaattaataatttgttaatgtttttcaaaataaatcggctagccgtcaatttaaatgaatagagtaggaaaaaactgtatgcaaataaaaactgtaagaacatgtacaagttaggtcccgagatgtgggctagtgattaagataacaagtacatctgtttcacaatgtaagttattatagcatttttcacattcatattgatgttaatcaatctagatagatatatatgtctagattcaatatgaatttaagaaaagttagaatgacttatattataaaatagagggagtagtagcgagttccctagccattgcaaggacccgtgttttgccctcttcttttatcttggttagggatgttgagatctcttaataatgttaaaattgaaatttcttttgtatttttttcccatatctcttagaggactagcaaagctaatatacggactacttgctttgaggctgcacaattttttcatgtaagaccgacttgagttcttaatttttattcagactttcaacttttccatcacatcaaaacttttctatatacataaacttttaatttttttcttcaaactttcaattttagtcaaactttcaattttaacgtggaactaagcacaacctaaaactacgagcttctatcatgatcattcaaatttcatcgatcccatggtgaagcagtcaaagcagatcgttgctcggcgagcaagatgtactccccatacaaagaaaagtcttctcttacgcacgtagtagtacgtgtctatgtctcgcctgtatccagcccagcccagtacgtgcggagagaggagtcgattgttcttggaatctcggtgcgcgcgtagtttggctccttccaacaccgtatattcccccatgtctctcagaaccccccaatacagtagcacatctcgaccagaacatccctatgcgtttcgctgactggtggggtcccagaaggccaactcgaccaaaatattgggacaaaaagctacacacttctctcaggtagcggtagcagccgtactttaattgcaacttgcatgaccttgggcccatgccctgcgtctgcatgcacgagtagtggaaagcgagagcccactacactactacgcggtgatgtcacgtacgcatgcgccgcgcccatcggcgcaccggaaggccaggggccatcagccatgccatcttttgcgtggatcgatccaccccgcgaagccgccccgccctcccgcggtggtcggaggcggcgtacgtacgttacgcgagtagaggagatgcgtgggaggagcgggagcgcgacacgcgggcctcggcgcagcgacgcgtgcccgccgcgcgcggcagcgcgacacacgtacgtgtagtagagctgggacgccgcgcgcacgactcgactcgggtgggctctcgatgggcggctttccgtttcgctgctcggtggaacatggaacgggcttggtccagcgtatggtagtgcagctgtattgggtgggtcaaaccaccaggggcaagttgttgtttccctgcgcgcgctagctttacggacgcgtggctcgttgggtgtctgcaactcacggagtagtggcgtgctgcctgagggtgcggtgtgccgcgtgcttcggtgcgtgcgatgcgactgtgattctgctctaggacagcttactccttcgtccaaaaaaaaatctaacctatttaaaataaatataatttagtattataaatcaaaacagtattaaaatatgtcacatctctaaaaaaacaagtaatataatacttaatgtgttattcataaaagatactaaatgagattggatgatgaagtggaggagagaaatgagaaaaggagaagatatatcacttttcatagagtgacaactttcacacaaactttaaataaaataaaataaaaagtgaattggacaaacaaataaaattacatcatagggttagtatgctagagatagtgtaaatatctattttatcttacatacatggataaaattatacgtggcaaactatccattctataaaacctgctctagttggtgttaggttcttttctacggacaaattactctatccatccaaaaacaaaccaccacgttttgtagtacgaatttaaacagttatattatttttgctttatatggaatgaaactagtactcactctctcccataaaaaaatgaatctaggattaatatgacatattctagtacaatgaatctaaatatatttgtatatttagatttataatattaaaatgtgttacatatgttggtcttttagtgacggaggaagtaggtgcgtaggaaggccatggccgcacggccgccgccgggtcagtggctggaccagtggaagcgtacgggaaatactagtctccagaaaacggctctcacaacttctttattggctggcactctaccagcagtactatacacaaaaacggtgtctcactagttctttactagtacactagtacacacgtttcgagctgaaaaagtctccagagcacacttctctcagaacttctttggcagcactccacagtctccgctacagcacgctgtccagcttactagtcctttacactcagctcgtttcgagctgaaacttgttgtttcgaggcaatgttctttttttagagctagggatgtaaacagagcgggtaattgggtttttttctcgcttatctcacttttattttatttatttttctaaattttatactaccatgtggaaagtgaactagtaagtgggtttttatgcgggtagcggaactacccacttgcatccctacttaggacaacagcagtacaacacaacaatataccgaatattacttcacacctagaccaagaatatttttagccacatactccacaaagcatgtcactatatggtgggtcccatgtctctctcctctcacttttcatctcttctttttctctctcctctctttttttcacatcagcggaggaaatggagcatcggcgccatgatggtcgctgccccggccgcagccgacgacccacggaaggcctctccctcgagctcctctccctctcaaccacctacttcctcttcccccctccttgctcgtcccctcccctccttccactatagcagggcgtccaagcgaagagacagtggccaacgagcggagaggcggctgaagcagcggtggcgtggattggaggacgacaacgggcaacaacaaggtaggcacgaatcggaggacgacgacgggcaacaataagttagctgtcagcacatgattaattaagttttaattattacaaacttgacaaatatatatatttgatagagtaaaatgtgttggcggtctttaatctggtagggttgtgtcatatagatccctaaactcttaaaatgcatattcatgtctcagaacttgtcaaagtatatcatttaggtcccaaatcgacacgtcccgtctagaatcctacatggcgctgatgtggcatgccacatggacgtgacatgtccttttctttttttttcttcttttattttcctttttcttttccgttttcttctcattcttccttttctcctttcttctgctcgggtcacagagaaaggagaatacaggggaaaaagacaagaaaaaagaaaaaggaaaaattttaaatgggtcctatttgtcagccaaaataataccacgtcatatccgtgtggcatgccacatcaatgccacgtaggatcctgaagggttttggtgatttgggatctagatgacacactatgacaagttttgggacttggatatgcattttgagagtttagggaactagatgagatacccctacaagtttaaggaccgcccgtacactttactctattggatattttcggctgctggacatgcatcgcacatctattatattattaaaggaatagaaaaaggagtctccacgttcgctctcatggcctagaaattctcacattaatcggagaaaaagaaaaagcagagtccatatataaatacaatttagaaatagctaaaattcggaattaaaaaataaggaatattagaagaggagactagaatccatatagaaatacaatttagaaatagttgaaattcggaattaaaaaataaggaatattagaagaggagactagagtccatatagaaatacaattaggaaataactgaaattcggaattaaacataaggaatattagaagtagagtatagagtccatatagaaatacaattgagaaacaatagaaattcggaattaaaaataaggaatattagaagtagagtatagagtccatataagaatttaaaattaactaaaattcaaaataaacataataaaattaaaattagagtttagagttcgtataaaaatacaattttcaaataactaaatttcgaaatttaaaaaacatggaaagaagagtctaaagtcaatataagaatacaatttagaattaacttaaattcaaaatttaaaatttaaagaatatcgaaagatgagtttagagtccacatagaaatacaattagaaataataaaaattcagaattaaaaataaataatattagaagaagagcctagagtccatatagtaatataatgtacaaataaataaattttgatattaaaaataattaataactaacacgtatataaaatacaatatgaatattatatattagtagtttcgtaaaggtaatacaaaatgtaaaattatgttgtcattttaatatatttgaaaaatacattgagaaaatatatgttattatatgatagaaaatataatgatgctagctgcgcaatctgcgcggaccaccatgctagtttataataaatcacttcacaaacttgcaagttataatttaacttttataggttgaaaaaaacaaattaaactatggctagttaacatatatttgtgatcaaatttatttttcccttgcaacgtacaggttaaatttgacattacatgtttgtggagtaatttatcacatatttaatctatgttgttgaatttttttcgtaaccatttagatgagatgtgaacaacgagggatgtcccctcgagagtttaaaatagttttccagctccttacggctttggttttttggcaacatgcacacactcgttcttatggacacaaactattcctgtgagtattttcgaaggactaaccaagatatatcttaaaattgttgaagtcgtcataagcgtctcgctgtcgaccgatatattgacgggtacgttgtctaccactgaaaaaataattagtcgtaaatacgattactcgtgtcaaatttaaaacttgaatcaagtaaactgattctttcacaacaaacttgaccatatttgaagctacgttcgcttggcagctttagcttcgttgagcaaaggagaactcacgttgggccacacccagcccacaaaattaccaagtcctgaagcctctttacgctaggatttagcccaatccactattacacaccgactttgctgagctaggtcttcggtttcttgaggacgacgacgccccaaagcgcatgaacttgcataattcgaggctacttgcggacttcatttaattttggcctggatcaaccatgtacgctcatccccgttccaaatactacatcatctcttattgttttttctgtttgtttaggatgtgagcatatcattgacatgaaatctgtaattcacatccacgaattggtattgctgggactgggaaactgttatgtttgatcttggttttcttcttactcttagcttcagaattgtatcttctgaaaccagtgcagttgacaagaacatcaaaagataactggttccctactgccctgactgtggcctgatatttgctacataaatctgccatccagttaattaatcatgctggattgctggtctggttcctttctttcaagatttctcgccccaaaatctttgttgacgttcgaggtcagttgagatgaaattgcatgcactcagcttctttatttggatgtgtagttagttcagagttacatgaacaatattttgttgtgtataataattgtggaggacttttacggtacattctactgctagtatatactaccagtatatacaagggtagttttggtattaggtaaaagtctgaaaagggctttttggtcatttaaattagagaattaatttcacccggattaattttccttagttttttctgtggatgtcgtcatccgcttcttctcgatacatctcgcgtctccggcgtcgctgctcctggcgcacatcgctcccgcgccgacgcctccatcccgattcctccggcgccgggagaagccgaacctccacgtgcccggcgtctcccacgtccccggcgccttgcctccatccctagcctattctcccccacatccgacctcccacagcttgtgccttgcccaaaccacaacggcgagagtgccctcgtcgagccggcagcctccccacgcctcccatctccgtcctggttgccctgcctgccctgcagccactggagtgctcctggatagaagccagcggcggcggacacccatgcgagccgagcggattcggtttagagtcgatgtggtgaaacggatctgactaagtgagttcgcgttaatttacaaaaatacccccatgcaaaaagataaaaaaacaaatataccctatccaaattatactgcagtataattgggagggaaatcagataaatttacaccgtcagatcaaacatactggtagtatatactagcagtagaatgtaccataaaaaaactctaattggtaccactatcagcaatgtgcaattatatttttcagataacttctctctttccaattataaactgaatgctctattgaaacccttatcggagtattcgaaccaacaactgtacgttagtgttccatgtcttaccattcaatgatgaaacaatttgatgttcaacagcttggatacaaataggagtccaattaacagggagtaacatttaacagcaagcagtgtcttaatttcctcaggaaagcgatgcatcacgaatcgtaattagcatgtgttgtagcttagagaggctcctgagagtttcttgtgtcttcttgaagtcttgaaccagccaatcacagttatttgtgctactccgtaattccttccatctccaagaagctggcagcatgtatagcatcttaataaagtattatagtgcacacaatcattagcaactgtcacaacaaaacttctagggtgtcacaaaaaaatgtacttaaacatttttctgaaagagacaatcgtacttaactcttatgatagcatgataaaaaacaggatccgtggagacaaaatggacataaaaatgggaacggtcttttaaatggaccccaatcattgtgccattgttaaatgcaaatatataactaaagaaatcattgttattagatataatataaatttactaatactaatgttacaatttctgataattgaagatgtcatttgtccacaaggttcgtcctggaggagggtgagttaggacttaggaggacccaagatcaggtcgaaaagcatagtcgatggacaacagatcactgcaaattaaccaatcaagccgtaaatatgccctatgaatccaagggttcaaacggagtttcagtgtaatttatttgatatagtacaatcacatacttgaaattatcttcctgtgcaatgaaacataatggcatgcatgaacttgtgctatactgctctgccattgacagcaaactttggtttctgatcaatgaataattaccggggctttgtcgctgtcgttaaaggaaaaaaaacataataacggtttgggtcaacaactcaaggtttatcaatcaggttactgaattctcggtctgtgtcgggtactcctataatgcagtagttggattgaacttaattacagtagtattatcagggtacgtacaaaggtggcgagttaattcattcatataattctaggtcaccaactagctagtgccaacattagtgcacatatatactttatgttgccattatgcagccactgtaccacacggtttaacaattgtgaagtagcaaacaaaaaggttttgcctaactgcctaaccactgacggctcatcagttgcatcagcaaacctcactgccgttgcacgtttgccatagtttatcagttcggctaccaatcaacataaacaacaccactaagatccgtaatggtgatcgctgccagtacaatgctgcaaactttaagcgccaatctatgatgatttcgttgatgatccttgcttttgtgagaaaaggtgtgattagtttaattagtgcatacagccaccataaatattcaacaactgagttgttacgaacaaatgtctgaatattgtcaaatgcactcaccgaaaattaaattttcaataaattaataaccagaatatgtaagtagaattttcagataagaaaattactgcctgccttcccgcctatgtgtcggtaattaaaggttgattggtaaagttgcacagatatcaattaagcataaaaagttaacccaaaagctgggtgtagcttgcttctttagagtcctcatctaacaatgcttagctgcaatccaccatcaggacagtacttaaaggcatatgatagcttatataaaacaaggaatagcaagtttcctattcatcaagttcttcattctactttaaaaaacggagaagaggaaaatgattcagtgtgcacaattggttgtgatgttgtatcattacagagatcgaaggtgcatcaagtaaagcaagatactaggcacgagctgatcgaacgaacatgggtagaaaggggaaacaatcaacacacccaaggattaggtattaaggccccttttgaattcataactaattttctttaataatggataaaaatctggcatcaatatccatacatatccagaggttgtatgaatacttagattttgaatcttataaccgagataacacaacaacaaaataaaaaaagaaaaggactagaagactaatcttcggttttcttctacttaacgagccctgccgtaccaagaaccacaccaagtcgatcttgatatggaatccaaactcctatactcctcatccacgttacatccatatttgattcgctcctttccccaccatatccctatcgacagctggatccaatcgattcaaatttagtaactcccagcatctacttccttcgcttgccaatgtcattcagaggagaaaaagaagaagtccctccagttcacctttgctactacacaaatagataatgtcacgcacggatacctcggatacaatacaacaacatttaggccccagatccaatgtcgcaccccatccatcactagcattgccaaccagcttgccttcatcctgccaatgccgctccttgttgtagttgtcttgcaaaacaagaagtagaaacagatctggccattagggtgaatccggttgccgccggcactactaaggatcccactgttttcacttctcgtgcaggcaccttattatcacatggagagcaggatgccattggcactgcccacgacttcgccatcacctcaagttgtcgtcatcgagctaaagttgtccaaccggccacaacagccacctccatctcaccgcctcgacgaaccatccagtcaccatcaccaagacacttataggacgttgagcacgagacagggcagaagagcagaacaaatgacgaggcgatggccacaccaacccccttttggatggttgcaagcggcacgccgctgaccactgccaccatcaacacctgttgtgatgccatgctctaaggatgttgagcccgaaatggcggcgagctccattacccccacaataaagccactggagcttgcaaaaccgaccagccccaccgccctcattgctcccgctacctacactgccaccaccaccgccgccgcttgcactacaccaagcgtcgcaatccagcctcaccatggggcctcgtcggcctgtccttgcacaaagcagagcaccaccagccaagtggccaacctcactagtgagctagacactataattggatctgtggagagaaaaaaaagaggaagaaggaggatgaagatgtgtgtgtggggggtggggacggggagaggtggcggtgttgtggcgcgcatgcgtcaggggagtgaatgattatccttttttcacctagtttctattggaatcaaactgattcatgtaaaagtccagcaaattttttgcctaatacgacgtagtaaaaacacaattagatatgttctttttatcttcatataatgggattaggtgtttaattgtgtagtgcaagccgtacgtgaattaaaaattgctcctagaaaaggagctgccatggtttaggggatgaacaacttagctacgtaaaaaagatgggccaattccctacatgcccatgtaatttcacccaatcccttctacgcccctgaaatttgtttgatctcttatatacctctgagtttttatttggatcccttacatacccattccgttagttgaccattagtttgaccgttagttattgtagaaattactttcttgtccttggtatattgttaaaagctagaaatttttttatgtgtaaattatttgagttgtgaaaaccaataaggaataaattactaaatatttgttatgaatttttaaaaataaaacattatttcattaaaataaaaattatttatcgtcaaaacagttctgcacaaaatttgaaaattacttttcaacaaatatttagtgaaaaaagattcgttgtgaaaaaacaaaggggatgtaattagtttatcacaaattagaaaataaatttcagatcaaatttgatgaatttcgtatatcttcccaaaaatttaaacctaaataacatttagtttttgctcttaattttctggtgaaactaatgtatggatttaatcataattttttaaaaataaaaaataataagttttattttttaagttgggcattaaatgattatattgcttgtattttgtataagttatttttttcatatgaaaatttattgggtagttaccacatatgtataggatgggtaatatagtcattttaaaatatttaacggtcaactaatggtcaactaacggagatgggtatagaggagatcaaaataaaaactcaggggtatataagagatgatgtcaaattcaagggtattgaagggattgagtaaattttcaggggcatatagggaattttctcttagtttatcacaaattagaaaataaatttcagatcaaatttgatgaatttcgtatatcttcccaaaaatttaaacctaaataacatttagtttttgctcttaattttctggtgaaactaatgtatggatttaatcataattttttaaaaataaaaaataataagttttattttttaagttgggcattaaatgattatattgcttgtattttgtataagttatttttttcatatgaaaatttattgggtaggtaccacatatgtataggatgggtaatatagtcattttaaaatatttaacggtcaactaatggtcaactaacggagatgggtatagaggagatcaaaataaaaactcaggggtatataagagatgatgtcaaattcaagggtattgaagggattgagtaaattttcaggggcatatagggaattttctcaaaaaagatagactacatgcacagccgagtaattataaaagtatttcatctaatcaagtgaattaggtgacgcacgaactaaccaaattgcagtggtacaggtacatacattcttatatggtcggctaaagaaattcttaaagatagcaaagcaccggccacggcgagactattaattaggtcaacttattgaacaatatgtgagaatttcaactaactgatcagatcaaatacataagctacctaaatgacttaacttattttctatgtttttgaactaatagagatgatatatcagaatgcatgttgtagtttgtgagatagctagtcttagcccaaccagctggttcatttttcaactgagctccaagagtttcaaactcggctcatatatttcctatagtagagtaaccatagagttgactttctgtgaaaaaaaaacccccacatttttgcattgtttatgcaaattatcataaattgaatcaattgctcataaacctctagtgcaatcatggattgatcaattgtaattttgctgttttggtttctctcttttctcctctcccctctttcggcccttgggcctttgtatatactcttttttcctctcttaataaaatttaccgtgagggcctctctcactgtgttttgataaaaaaaaacactttaaccttttttttgttttgaaattttatcggtttgatgagctttaagatttttttctctctttctgcatccaagtccaatttcttgactagaaagttttgattcttttagctgaaatctccaattctacttttgggggttgatgggtagctagcatttgagttgaaaaagtagagtaggctatagctttgtaaaatggtccattgaaatttcaaagcactaataatgccaatagaaaggtaaacacaatgagaagccctacataaagacatcaaacctctcactttgtaaaatcaagcattcatccttccgaatctgttttatcccattgaaatccccttaaataccattgtcgcatgctcacatcccatcttttccaaagggaaaagatcttctcaatgaggagggaacattgtgtgccaaaattgactcacgaatatacaagcatctaccaacatggacactcctgtccatatgcatagctagaaattaagtttctttagaacaaagaaagcacgtgacataaacttatgctatacaaaatattatgcatatgctagaagttacttccattaccttaaaataaacatatactacatagaaacttaacattgaataattgttgatctacaagaaattcctgccttccaagatgatgatgagctgatcccatgaaagaaactctgcaggagagacaaagctgcatgcttcagtatattctctgcttcacctgtctctcgcctgccaaccatcgatccaagtcccaattcccaaaccaaggtactacgaaaaatggacacatcaaggcaagaaaaaaaaagaaaaggagcaaaacgaaaacgagatatcactgcgaattcgcaaaaaagttagcggcaggtggtacgagcagagcaggaagccaacaaaagcgcgcgaaataaagctgcctctcgcgcgctttttttttcttttaaagcggagcagcctcctactcctgcacccctcctctctccactttccctgtaaagcaaacgcgcgccatgaggaagaaggcggcggccggcggcggaggtggcggcggagggaagggcgtggtggcgacgacgacggcgccgaccgacctgctcgtctgcttcccgccgaggcagcacctggcgctgatgcccaagccgatctgcagcccgtcgaggaccaccgtggacaaggcggtggccgcgcggcggcggcggcagcagcagcagcagctcccggcggcgaggtctggaggaggaggaggagggcgtgggcgtggtagcactagcagcccgctgttccgcgggtccaaggcgaagcaggccgccgtcgaggtcgacgacgagccgcagtcgcccaaggtgacgtgcgtcgggcagatcaaggtggcgcgccccaagaagcagaggaaggtggccgggaagccaggtaatggcggcggcggcggagaaggaggagaaggtgggaggagctggatcaccgtggtggaggagatcgagcggctgcacgagcagaggaagaaggtgagctggctggaggccgtcgggatcaggagggacgcgctcccgttcctcggcggcgcgctccggagcctccggctcaaggtgcgctgcttcgggtcgctccacggcgcggtggagtcctccaccgacgacgaagacgacgacgacgacgacggccgcggcgcggaggagcacgaagccgtgtccgccggatgcggcggcagcgccgcctcgagcgtgttctcgaagtggctcatggtgctggaaggcagcgaagagacaccggagcaggactccggcgacgacgaggaggagcccgagcgagaagacgacgacgagtgctccaatgcgccgccgtccgccccaccggcgaacgcgctgctgctcatgcggtgccggtcggcgccggcgaaaggactagcaaggagacgaacagaggagccaccgccaccggtcggcgaggcggtgcacgacgagggaagcgcggccgccgccgccgcgggggacgacggcgcagaggaggagagagacgagctggtgttcatgcggacggcgccggatttcctgaagctgtccatagacatcgccaaggagacgtggatcgtcggcggcgttgaccccctcgcgcggagccggagctggaagaggtgaccgaccgaccggccggccggcgaggagtccccggcatcgggattatttgtacagtttgtatttacccttgcgttttcggtataatcttgtgactcaagttgttgttacgtttcctctaacttggtaaatggtgattatataaatccaagctatagaaatgaggtgaatttatcatgcaacaatcctctacgatccaattgtgcacatggttgggatttgaaaatagaatcccattaaaaaaaaacttaggaaatgcctaacatccaaaattcttcaagttacttgctcagtgtcggtatgatccaggtcaatatggtgccgccttcgtcaaaaatgcaactccactaattgtgacctttttatccaaaaatgcttttcaacattgccattgtctcgtctgtgcaatcgtcggccatccggagacgagttcgggagcaaagtgtttttactagaatgaaaggagcataaggcnatcatgatatacgtagatagatgtgagttaagcactgattagacaggaaccacagcttcgttgttgattgagacagttcatggtcatggcactctcctaaacggttggtttctttgacttcacccgttggtactacagccaaaccgcctatgaatatgcaacgcgctatgtgcgctctgctcataaacctcctcatgttattgcaaagttggccgttgctcgtccgacaaactatgcaccaattggactctgtcacaacagaatctgcagagaaggtcgtcgtatgctgcagtgcagactgcagagggcagagccgcaacagaatcttcagaaagaacgtcgtatggtacagtgcagtgaggggatgtgacctctcatagaaaaatgtatctagacatagggtacagacaaattttttttacggagagagtactccatttcaatataaataaaactaatataaaatatgacatattctagttttattaagctaacaacctcatctagaatgtatcatattctgtattaaattagtattttgggatgggaggaattccacggagatagaccagacgtactctctcatcccaaaataagccaatctaatacataatatgatactacctccgttacaaattacaagtcgttttgactttttcctataatatttgaccattcgttttatttaaaaaaagtagtgcaaatataaaaaggataagtcatacttaaaatattttagataataaaacaagtcacaaacaaaataaataataatttcataatattttaaataaaacgaatggtcaaaagttacaaccaaaactcaaaataacaagtattttgagatgggggagtactaatctggtgtcacatgccaaaggttggtttattttaatacatatggagtaactgccctaatcagaatcactaccatttttccaacaaaaattctgcacggcttccgaggcaacctgcaccagcatctggcaatcgcaagctcaccaaataattaacaaaacattactgcgagaagagattctaaacaactcagtaggcaccaaacgcacgagcacggaggactaaaagcaccagtgttaacttactttttggtactgaatactgatagctatacactacaggctaattctattaaggttgtgtttagatccaagggtgaaaattctattaaggttgtgtttagttaaagggtgaaaagttttgacgtgttacatcggatatacggacacacatttgaagtattaaatgtggactaataacaaaacaaattacagattccgtctgtaaactgcgagacgaatttattaagtctaattaatctgttattagcaaatatttactgtagcaccacattatcaaatcatggagtaattaggcttagaagatttgtctagcaatttacacgcaatctgtgtaattagttattttttttcgtttatatttaatactctatacatgtgtccaaacattcgatgtgatagggtggaaaattttgctaggggatctaaacaagccctcagttgagtaagttaaagtgaaaaaaaggttgttgcaatattgtcaacacctagcatagcgaatatagagaaatgagtgtgccaagtaacacctcggcaagcataatggcggcaggtggcttctgtccacctagggaacgacagtctgcataatataagatcattctcttcgagtgcctgcagctgcaaaaagagcaaagggaaagagagaggaaagacaagttccattgcaccactactcgtaggaagctgcaccattgaaaagctaaccgtttttttcacaaaccaaaggcatgtgttaacagtcggtcactgaagagatctacacgtgacagaacatgtggcattgttgtaaagtttttcccattttacctgttcatctcgaaaggaggaaaccggtttctgaatctaagctggtatccactatccagtgctagagcctacaggtagggatgaaaacggatcggatacgatcggaaactagctctatcatattcgttttcacattttttttcaaaatcggaatcggaatcggaaacccggatatgaaaacgaaattgaatattgtcggatatagatatggtgcgaatacgaagcgaaacgaatacggtgacgaatattaaccggaacataaaaacccctcaaactaagcatcacaactcaaaaaagaaatataactctttattttttttctaatataacatatcaacttttccaaattttagtgttaataattttgttatatccgattttgtggttgagggagaacgattcaatagtttatcgcactcatatggccgtcctaaggagccgtatgtgaaaataaaatttaaaactagtttatcgcactcatatgaacttcaaattggatgattctttttcataaatatttctaaaatcatgctctaatgtgttattgtgttcttactgctattattttggccatagtttcttgtgacttttgttttatcaatttaaaatttgaatttcaaaaaatagcaacttcagataatattttgaagcattaaataatttcagctgaaaaagtcatgaacataagagttgtagaattcatcaaaagctacaacttttattttg

SEQ ID NO: 83361 - DNA, 1117 bp, Oryza sativa
cgccgccgtagtgcagcttgcggcgggggcagccaccgctctgtttcttggctccgacgtgtccgctcttgccgtcgggttcgccattgtcgtggcgagaagcggcatccgggctgaagctgaggacgatgaactcgtcgccctcctccttcaagtacggcgccggcggcggcggccacccctccgccgagctcaccgacctgctcctcctcctccgccgctgccgccgcagcggctggcactccgtctccggcggcggcggcggcattgcgtcgagccccatcagcctggccacgacgcaggggctcatcccctcctcctgctgtacctgcacctgcaccaccaccgcaccgtcgtcgtcgccgccgcccgcattgccggcggcggcgtgcgcgcagagtaggcggcggaggaagtcgagagccaaggtggaggacgccatggcaatggcaactatggcagcatcagcttcgcaatgctgctgctattatatcttcttcttgcctccgttcttgattcgatttgaactgcagttggagggaaaaagaaagaaagaaagagagaaagaaaagcaaaaggaggaagaagaaaggtatggctatggaggtagcagcagcttgattagatgaagaaatggatggaattttgcaaagattttactgctagtggtagaaaggtgatcaactgttgcagtggttatcttcttcttctacttctacttctactgctgctgatgctgttgcacttttgtgttttgtctgtccccttggatctttggagtgagggtgtgtttagttcacgtcaaaattggaagtttggttgaaattggaacgatgtgacggaaaagttgaaagtttgtgtgtgtagaaaagttttgatgtgatagaaaaattgaaagtttgaagaaaaagtttggatctaaactcggcctgagtgaaatttttaccgtttgacatttgaaatactcctagagtatttgctcatactgttttattacagttagtagtaggactatcatatttgtgtgtattgtgataaggttgggactgacactgtttacctgcctgtgccatatatgaacactgtagttcatagcttcactattgcaatgatataa

SEQ ID NO: 83362 - DNA, 8400 bp, Oryza sativa
cgtgggggagtggggaggagagagaggcggtattcggttttcgaatcccggccatctcgggcgcgggcgcgaacggaagggagaggggaaagggcgcgggagacgcggcgcacgcgcgggcgtggccaacgtggcccgggagagacggaggcgtgggcgcggcggcggtttcggcgcggcggcgcgccgggatcggcgggaggtgggggaaggacccgacaggtgggccccacctgtcggcgaccccgagagaggaggcgggcggcggctgccaggctgggccctcggcctacggccggcccagcaaggaggagggggaggaaggaggggaatgggccggcggcccatccgaaaagaaaaaaggagggaaaaagggagggaaaagaaaaagaaaaaggaaaaggattttccctggaattaaaaattgcactttggtgatttttaattggttaaaattatttccaaggctctgaaaattccactaaaaatcctgttaatatattgtgacatgtagaatccaagaaaaattccacatgccgattccgattattatttgcatttattaattagggaattagctctaggttaattaagataatttcttcggacgatttatttagccaaatttttaaagcaagcaaaaaggggaaaacttcagggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctggatttcgatttgatccggacttgcctgttcctcaggaactctcaaacatttcttcaactgggagacgtggaacacattatggatgccaagcatgttggagggaagctcgagctggtaagcaacttcacctctacgttccaaaacccgatatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagactgcgcgattctcaatctttccctaacagctctgactttctcttctgcctcatttaaaacttctgtaccaaacaactggcgttcccctgtctgataccagaagagcggagtacgacacctccgtccatacagtgcttcaaatggtgccatctgcagactagcttggtaactgttgttgtacgagaactcagcatacggcaagcttttgtcccatgccccaccaaaatcaagcgcacaggctctcaacatatcctctagtatttgattgactcgctcggtctggccatctgtttgtggatggtaagcggtgctgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgggccactttggtgagtcggtcaatgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaattcagctatttcccttctcatgctgacccaccaaaacttctctttgaggtcttggtacatcttagtactaccgggatgaatggaatattgagtttgatgagcctcggttagtatcaggtcttttaattccttgttttcgggtacacacaatctttctcccatccagattgttccttgttcatcctcaacaaaacctcgggcttttccgaccctcatgttctttttgagctctgctatttcaggatcacttgcttgagctatgcgaacctgctccaccagtgtgggctgtgcctctagggcagccacgaatccgtgctcaactataccaaggttcaaatgttccaaatcatgttgaacctcacagcatagttcctctacccatgcgacgttgcagtaactcttcctgctcaaggcatctgctaccacattggccttgccgggatgatagtgtattcccatatcataatctttgattagctccaaccatcttcgttgtcggagattcagatcaggttgggtgaagatgtactttagacttttgtgatctgtatatacctcacaacggttaccgatgagatagtgccgccaaatctttaaagcatgaacaactgcggctaattccagatcatgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaattccataaacaccttgttcatcaaattcatgaagaaggcaggtgcgttagtgagtccgaaagacataactgtgcattcgaacaacccgtaccgagtgatgaatgctgtctttggaatatcctcttcgcggatcctcaactggtgatagcctgatcgcaggtctatcttagagaacacagtagctcctttcaactgatcaaacaggtcatcaatccttggcaaaggatacttgttcttgatggtgacctcattgagtgcgcggtagtcaacgcacatcctcttggttttgtctttcttctccacaaagataaccggagcaccccaaggcgacgtgctcgggcggatgtatcccttctgtaactgttcatcaacttgcttcttgacttccgccaactcgttggctcccattctgtaaggcctcttgtggatcggtgcagttccaggtaccaagtcaatccggaactcgatatccctttttggtggcattgttgtcagatcatccggaaaaacctctggatactctctgactatgggaatatcctccagcttcttagtggttttctccactgctacctcttgttcttcaccagcagcctggtttaaactaatccctggcttctgcggcactggagactggaagattaccacctctccttttgcattggtcaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaataaataaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccggcacgtcttggcttcgggcactttccaaccgtgtgtccgggtttgttacaattgaagcagagttcgggtttttctcccaacctcttgggctgttctgtcagagctggctgaactgattgagctggaatctttagtgaactcggagtagggttgaggctgtgctgctcactattgttgtgactgtcactatggtggttcttgttgaagttacccgggtggtagggacggtgctgccggataatcatggtggaaggtccaccgtgatgtcccatcgtgaaacgaggcttctgactcttcccctggggagtcctgaactgagctgccttcctcttacggtttattttgttacagtgctcctcctgacggatagccttatccaccagcttctcaaagtcctcataatctctagagatcaactggttagtcaattcatcatcaagaccagacaaaaacttctcctgcctctcggcatcggtacgcacgtcctcaggggcatagcgcgcgaggcggttgaactcatgcaaatactctataactgttctggttccttgttgcagggaacggaactctctcttcttttgtgccacgattccctcgggaacctgggctttattgaaactatgacaaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaacggcatgaagccagtcgtgggcctcgattgggttggtggtgcttgagaaagtgggcggcttgacacgaagaaattctaacaatttggactgaggaggtggaggaccaaactgcaggttctgctgctgcagctgtgcttgctgctgcacctgctgcaacacctgatggtactgttgctgcatctgttgcatcatcattgtcatcatctgagtctgattgtccaacacctgagcgatcgttgggttctcgggcggtggggacggactgttgtcagatgcaccgttggcacgtgctccattgatcggctcttcgctgccactggcgttgttggagtcgcgtgaaccattccttgtctccatctgaggggataggtagaaatatgagaaaaggaagaaaacaggggctcagaaactaatcttgcttatgaatttaagtgcaattatcttaatcttgattaaaacactgaaaaagaggcacgaaactcctaattgaggcagtcataccactgacacatgatatcgaccgccgactaacccacaagcaacaaacctaaacacgaaaactagcaagcaaacagactaagaaggcgataaagctaagggcggcgactctgaagctcgaggcggcgcttgcaaacgagggataggactgacatctaaagtagacaagggataggaaccaactcatgctcaaatccaaattaaacaaagcaaaagaagactcaaataaataaccgagcatgatgatttttatgcatagaatatttttcatgaactcaaataaagacactaatgcaactaaacaataaattaatgcatagactagttgcatggaaaatgatgcgcataacattgcccccaccgaatatagacacgacctaatgcataacccccaataaattcccgactgactgtcgaataaactccaactaaaatttttctaaagccctaggctgagctcattttttttttaaaaaaaaatccgatccgaatgaacgaccaagatttttcccgcaaaccaaagaggcaaaactccaaattttcccaaaacaaattccaagtgcaaaagggcatatgcatatgaaaaggggttcagagggctcttagggtttccagttggcttgtcctacggtcaaggtcggctctgataccaacttgtcacgcccagaaattctcgaaccagaatttctaagctgaatgtgcattgaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacagacaatccttgacggcagcgacgaaaccaaatttgacaaaacagctccaactaggaaaatcttcagctctggtgtgggggaaaagagagcaagactgagtactacccactgtactcagcaagtcataccggtagaggaggtatgatgcaggatataaccaaaggaggctagaggttcttttgcataaagctagcatttaaaagcagtagttgaaagcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacaacccaccattcaatgtattttaattaactaataccattgcggtggcaccaatccaaagctatgctcatagtcaaagtctatgtaataaggtgatccccatttgtgtgctagttgaactaagcatggctaagcatttcctaaaccaacatctagtcattttgatacccaggttatcaatggcatatggtaaacaataaatggctgagtaataggacccattccacatgatattgtaaacgaatgcaacatttaatagaaatgcgggatatttgtaaattgggtacaatatgatcaaacgtattgcatgacttgccttgctctcgcactgacgagacctcagcaacgtcttcgagaaaccgtggatcgacgaaacggccgaaacctacgcgacaaacaaagcacacaagcaaaacaggctataagactactgaaacagagaacaaaaccatttttaatggattctacacatttttcttgatttactgagacttgaatgggattaaacggagctcggatgaattagatatgaattttagaagattcactgtgtttattactataaaagaaatccttaaataatttattgcgcaatattaaccagggctgacgtcagcacggaggggtgcggcgccgacaggcggggcccaccggtcagcgaccgggagagagagaaagggggtggcggcgcgcgggcccactggtcagcggcacgggggaaaggaggggcggcggcgccacgtggcggccgaaccgacggccccgatctacccaagggtagatcgccccgatctacccaagggtagatcggacggcggcgggacctcgcggccggggcgcgcgggcgcggcgcgagacggcggcgaccatggcgccggcggcgcggcgcccacacggcggcggcgcgcatgcggcagcggcgcaaggcggcgaccgaaggcgaccgaccggcggcggggagcggcggctagaggaggagcggcggctacgcggctaagcggcgcgcacgcggctacacggtacggggaaaaggagaaaggggagggggaagcctcaccgacaacggtcgacgacggcggccgacggaggacgacgacgacggcgggacgagctccggaacctcctaacgaacaaaaggagagggattagagagagaggaaagagcgtgggagggcgagagcgccggccgaaggcggcggccatggcgccgcttgccggcacacgacggggatgggtctccggcggcgaacctcgacggggaaggggcggccgaggtagatctcgaccccgcgaagctaacggcggcgacggcgcgagacggcgacgagcc

SEQ ID NO: 83363 - DNA, 2394 bp, Oryza sativa
tctgttaagcagtgtgcgcatggcgtatgcccaatactttagaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatacgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtgttggttaaggtttctatcttgtaatcctgccccccatcctatataaggtgggcaggaggccctctagggggcaggagacaacctgatcgtcagatctatactacacccggcggattcaaatccccaaacaggagtagggtattacctctcattgagagggcctgaacctgtctaaatcctttgtctctgcatccatccactttaggtctcgtacgctacccccttttattattgccgaaatctagtttcgacagtcaccgactgacagacagcgccgtgttgcagtgcagctgctgtgcgatcgatcgaggtggtgagaccctcccatccccgccacctcgcagccaccgggccgcccgcccggccgcgccccccgatccctttctccctcatcatttcgcgtctcgcgcgcagccgcgctcctgcaagcaacgtaacgcaacgcgcgccgcgaccgaaccacctaactggccacgcgcgcgcgcgcccgcccgcgccgcgtcggcctctccgaaccgcgcacacaaaactgctcgattattgtgagaccgcgagagcaagcgagcgatcgatcgatcagccagccaaccagcccgtcacgttcggaaaaacgggttaggtgccgcgcggccgcgcgcccccggcggattcgtggaaggaatcgcaccggagattaaaagaaaaaaaaaacgagcttcagaggaaaagacgtcctttcaaacattcttaagaaaagaatgtgagcatattgagaattagtaacattgaatattgggttaaaattacacatatcttactacactatctggtacatctccgtaccggggattcatcatgcacgattcctcacttctctcctgccagccatcgcggcgccacagaatcgctgctccgtctcggtgttctgcctcctgtccatagagctagccagcccacgattttctgcctgcaccgattcgcgtgtttttggatactgatcatgtgtgcgatcgacaatcacccggctaaacctgtcatcataactgtgcctcgcacactcgggagactttcttccagcgtacgtagaattgtcctgcgtctcctgcccgcccatggaacgaagtacaacttgcgagagctcttgagaccataattaaccatgattagtcaaaggcaataattcgtgacactaatttcgcttcgtcgatgcgtggcaccgagtggccggcgattggctcggagtaaatgcgaggcaattgatgggttccttcttccctgcagtggtcctggctgaagaaaagggttcttgctgtttgctcttgtggctgctgtgacactgtaggtccgagagaacaatcataggtaaattgtctgcttcatgcatgataactcatgaattatggagttttgatcgacgtaaagggaaaaagatatgattattgccaacctggaattcgttcttatcggcacggattgagaagcctgaaggaacaggaatggaatactgtcaggttttgatgcgcattctaatgaaatattcaggtgaggtttgtaggtcggaattacttatgccgaagtaataatcgacaagtactgaaaaatgtacgcagaatatagatcacagttgaaacgagaatgatataccgtctgggctctgcattttcagacggaattttctgtgctgtatctgaaagcaaaagcaacagcctcatttaaactgtgaaagttaagcagacgacattcagagaagctgtcaattccatcatt

SEQ ID NO: 83364 - DNA, 10533 bp, Oryza sativa
aatcttttctttagtcagcaagactctaagccatcagccctcaagcaaacagaggagccatgcccttgacctctatctgccaagacgtcgagtcaggcacagcaaaccaacaacacatgtcccggacagcatacgtcatcatatatcgtacacggtttgtcgaaacatgaattcggcaataataaaagggggtagcgcacgagacctaaaagtggatggatgtggagacaaaggatttagacaggttcaggccctctcaatgagaggtaataccctactcctgtttggggaattgaatccaccgggtgtttattgatctgacgatcagattgtcccatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatatatataagttatcccctataactagtcggataaccatgccgtgtgggtatggggtacccataatctccaaagtagcccctaagaccttcacagtcgaaaagataatcttctctcgaaccagattactccaaagccgagtacttcaatcatctttgccatggtctcccgagtacttttaccaaatctgaagactgtggagggctgaaaaataaagtcaggtgcatcgactagatgcacctaataggtgtagccctcgactatgcggttaagtgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaataactataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttgataaacccaaacagcaccttgactatataaaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttctgggtaatatagaccaagtgtagctcatatgaatagcttctgatctgaatgattatcccttatgggatactccaaaataaatataataattgaatcccgactggcgcaagtattcggttgacagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtaataaaaacagtgacaccaatcaaaggtaatgaagttgcataaccatggaggcgaagaaaccagtcggcaacagtcaggtcagctagcagtgaagatgtaggcgcccaacaacaacgaaagaacagtcggtgatgacaaaagcaaaccgacgatgaagacgtagacgcgcatcaacagtgatggcgaaatccaccaatcatgaagatgaagaaaataatcggcggcgacaaacgcatccaacggtaatgatgattaacggcaacagagatagccgactatgatgacgaagtttcccatcaacggcagcagagttggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagccccctgtcacgaccggaaatcacccaacaggcgttcccgacgtgcgtgtattattccttgtcccaggaggcaaggtacaccaaaagttgatacaatacagagtttaacaagcggaagcgtatataaaattattacatgggcaacgaaggcccagcacacacagagacaaacgaagaacagcggaagactagggcgacgaccacaggcacttgacggcaggcacgagctagacaccgaagccttcatcttcaaggagctcctcttctgggcttgggaaaaattgagcaagactgtgtacaaccaccgtactcaacaagacacacccacaaatgcagaataaatgcaagggagtacaagggaattataatataaagggttagggttgcagtaaacagcatttaaagacatttagttgctcaaagctactttgtaaacgcgatcctagaatgctacaaagttattaatcaaggccgtgaacccacacgaacctgccttaacccaaggcctatgatgattcagaccgaactggcaacccgaccctgggtcccagctcgtcctaagccaacccaggccaaccattccacattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccacctacggccgggatacccgggacaggcaggcagaactgagcccctagcagcagggcaccaaccctctgccatatgacatctcgactaccgggccgcagctcgtgtagccttcatttgccctggagaatgtccatcgacacccgacttcatccatctccaatccgtgtacttttgtttatgactagactgagccacaaactaagccttacccactagacatgtggaagtacggtagtgctttgcaacagaggcccgaagaccggtccttaaacggccgaggtgctactatcaaaaccatgcaccccgagcccagcctaaaaccattttggggattttgaatagagggggcggtgtgaagccaattccacaataaacccacaattccagagtatccaggtgatatgaatatttcccaaagtctatagttgtaaaaccacctaaggttacctaattagattgcgaagcatctacctaaaattatactagggataccatgagtagagtgtccactagttgaggttttgtttgtctagggtgaacaaggtagtaataacaataacaataataatatggtcataacaaaggtaaataggcatggctaagtaaaacagtgataacgcgggaatttaaataaagcgacaatgcaataatttaaatcaacataattttataaaatgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaattttcaattaaaaaatactatttattgcgtcagccgagggagcggggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgccgaaggcggcctcgccggcacggccgacgggaggaggacgcgcacccgcgccccgatggtcgccgccggcgaccaacggcgcggcggagtggcacccgagagagaggagggaagggggaagcgaacggaacggtcttcggctcaccccggtcgacggcgacgacgggaacggcggccgaagcggaagaagacggcggcgcggctcgggatgacgagggcgacggtgctccggcggtcggcgggcgaagcggaggcgcggacggagtcggcgacgatgcggcgaagccgaaggaggggtcgccgagtcggaaggacgtccggagcgacgtcggcggcgaaccgaaggtcgacggcgacggcggagagagaggagcacggcgcgagcacgaatccgacggcgagagcgagcggcgagcggcggaaacggaagagcgaagcacggggatcgaatatatagcaacgggagggggagagcgcgcccggggagagaggaatcgcgcgcggagatctcggccgccattgaagacgccgccgatgattgcgggattcgaatcggacgaatccgagggagagagagagggaaaagaggggggaaacgggggacacgggagagggaatcacgggggtgattcccctctctttaatgcgcgcggggacggcgggatgcggcgcaatccgcggcggcggcggcgctagggcacgggcgcggcggcgggcgcggcgggaggaaggcgatgacaggtgggccccacccgtcagcgagagtggcgggcgggcccgcctgtcagcggcgcgcgcgcgcgcggggagccgatgggccgcgggagaggagagagagagagggagggagaagtgggccgagccggcccaagagggaaggggggggagaaaaagaacttcttttaggattttcttttttttataaaccttttccactttgtttatttcttttcaattattatttgtgctctgaaaattccactaaaatttgtttaagcattttaggcttttaggaaatatacaaaaatcctccaagcctcgtttgacttttatctttgcacattttaattgttggaggctttcacattgaattttaattattctgtggagattatgggtaccccatacccacacggcatggttatccgactagttataggggataacttatatctatgtaatatgtaacagatcatgacttgggtgttacgtttccttgtatatgacggaacggcctaaagtcctgatttaggaaaccgataccgtattggttaaggtttctatcttgtaatcctgccccccatcctatataaggtgggcaggaggccctctagggggcatatatgatgaggacacgacctgatcgtcagatcaatacacactcggcggattcaaatccccaaacaggagtagggtattacctctcattgagagggcctgaacctgtctaaatcctttgtctccgcatccatccacttttaggtctcgtgcgctacccccttttattattgccgaattcatgtttcgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgagtggtgcctccgcctacacggctggcctattatgccgccgctgttgggcgtctacgacttcaccgccggcctgcctccgtcgccgccgagtggtgcctccacccacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcgtgcctccgtcgccgccgagtggtgcctccgcctacacggctggcgtattatgccgccgctgttgggcgtctacgacctcaccgccggcctgcctccgccgccgtcgactggcgtcctcgcctatacggttggttggtcacaccatcgttgatgggcgtcttcgctttcaccgaccggcttgcttccgccgccgactggtgttttcgcctatacggttggcggacttcgccgccgttaatgggcttcatcatctacaccactggcttggttccactggcgccgactggtgtttttgtcaccattgatggattgtttcgttcccacatcggctacttctgctgtcaccgagggaatacgacaaagctaagtcatcgcttattttattctttatatgatattttgtcttttcctttgcctcactacatcaactggttcgccgttgactagtgagtcgggggctatagatgttatatcgtattttttaaacaattttcataatatttatcttgattgcttgcgacatgttctgagtacaaaagtgcctatcgagttatggagttccatcttcctatgctttccgtttggtttgccaatagatagttgcctttaggccgattcctagcacccgggggctcgttggatggaccgagtaacgcaaggtgctaagtattattcggaataaatcaaaagcatagagatgagataaatttattttctgctcttaataattgcaaaagtacccgagtagtaaattctgattcgtgaaactttgttccattaatggcgaactcatgtcactcatatgcatgtctgggaagtgcctaggccgactcccggtgcttgggggctatgactagtcggacagagcgtttaaacgtaatgaatcatctgctcggggaaatcaaaattgacaagaggagaaatacatatttataaatattttaaaatacttgcatttttcttgagtattgtatttacatcagatactactcatcctatatgtttgttctgcaggatccaaatccaaatatgcataaaagggattcatggctttaagcttatctcttacgctccaggaatggatcagtcagaacatcaccaccggctcgccgtcgtcgccgccgactggagtcttcgcctatacagttggagtcttcaccgaccggccgccttgtccgccgccgactggtgtttccgcctgcacggctggcctttatgccgccgttgttgggcgtctatgtcttcaccgaccggcttgccctcgtccgccgccgactggtgtttccgcctgcacggctggcctgttatgacaccaactgatgctatcttcttcacggccggctacgtcgccgtcaccactaataggcgtcatcatattcaaacgcaagctgtctacgtctgctgccgactagtttattcacttccatggctgcatgattctgccagtgttgattggccttatcttcttcaccgccggtcatctcgtctgctgttgactagtgccctcgcctctacgtctggtttataccactaccactactgatggacatcatcgtcttccgtcgccgactggttatgccgccgccgactggtgcttttatcttcacaactgcgcgtcttcactaccggtttgcttctgttgccgccgactcgtgttcacttcatcacggcaatgcaactttgtcatcatgcctcgacatctcggcatgcgatgccatgttgttttactacaacaagaggctctccaatattcaggatttctacttggacatcttcaacacatatcttcaatcaagcaatgactactcgacgataagaagctataattctcgactctatgttcagttgtttcccaactaaccaaagagtcgggggctacacaaatataaggctcaaaatttgccaaattttatgtcaagctgaagaaatcaattcatcaaccaacgagtcaactccaggagtcattatcttcatctttgattcggagcagacattctacttcaacaacttcaaatatttcggtttggacgagttagacaacaacatcaactctcctccaagtgaagcatctacaacagccataacattaatttgatggattattgtcactgacatcatcaccagcacttctgcttcatcgaccctgacatctctgctgttgctaatggatgattatgttttcgccgacttattatttcaccttcacggttgacctactatgcaaatgctgatgagcgtcttgtcattatcattggttgctacactgctattgaccggatcaccgacatcgtcatcttcatcatgtcggttgcgtttgtcttcgtcaagtattttcttcatcttcatgattggtggatttcgttattgcctttgatacgtgtctacatcttcaccgtcggcttgctttcgtcaccaccgactggtatcctcgccttcacggatggcttattatgtcgccactaatgggcatcttcatcttcttcaccggctgcctcatctgtcaccgactgattatttcgccaccatggctgctcaattttgtcgatgttgctggatgccttcatcttcactgttggctgacttgtctgctgccgactggtttcttcgctccacggctgtgcaacttcatcacttttgattgctaccatcaatggacaattgtgactacgacagaaggacaagctatatgctcaggggcttactagctcaaacacaagtatcataccttcaatttggacttgttccggatacatgcaacatgaattcatgatcatgggtctattttctatgctcaaagactggactatttattattccccgtaagggttatcaactgaatacttgcgccagtcgggattcaattgttacatctattttggagtatcccataagggataaccactcagatcagaagctattcatatgagctacgcttggtctatattacccggaagatttattactcaggagcatgttacatgcgtcatcctttaaagggtgtcgaaggcatatgttttggcctaggcctaatatgtttgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtactgtttgggattttaagcaattgattggatacaatatcattgcttttcgccacgtaagtgtgcatttttattgacc

SEQ ID NO: 83365 - DNA, 971 bp, Oryza sativa
cgcccgaaaccctagcgcgccgccgtcgccgtttccttccaaatccggccgctcctttccttctccggccgaattgattgaggggaaacaatctccgggatctcctctaccttttctcctttggaaacatcggctaaatcgttttggaagttcgtggaatagagttcgattcggatcggcctctttccttcaagccgcgagctttccttctcgtcgccggccgccgtgggcctttgccgccgcctccttgcacctatataaggacccccgagctcccctctacccgtcgcctcctttgccttagcctgccgtcgcgtctagcgccgcctccgcgtagccctagtcgccgccgtcgttgccgtcggttcagccgcgccgcgccgccgttgcagtcgccgtcgtcggtcgccgtcgccaccatcgggttcgccaagtcatcgccgtccccgtccaccgcttcgccgccgccgaagaccgtcggagcgccgtcgccgtcgtcgacccgaagagcttcgccgcttcctcctcgtcgccgccgccgtccgttggtcttccgccgccgttttggtcaccggtgagttcgccgcgtcgtcctctacgtgctggtgccctccgtttgtgccgaagtgccgccgttcgccggcgagcgtgcgccgcccgagctgtccgctccgccgagccgccgccgctgtcggtgacgtcatcgctggcgtcatcgtcccttttcccgtgagccggtcgtggaccgatcgatctcagccgtccgttttggatagggttgatctcggccgtccgttcccgtgaaccgtcgcccgtgcgcccggtccaccgaaaccctagccgctgacgcaataatccttcttttccttttcaaaaataattcattattgcgtcataattcaattaaaatccatataaaggttttaatccgatttaatctttaaaaattcataactaattcatcttaactc

SEQ ID NO: 83366 - DNA, 41953 bp, Oryza sativa
tgtgcatacaaagaaaataaaacaaacatgtttggaacacaatgtaaatgagagtttttaagtgtgtgctgtgctgatactatgaatattatatctaggaagttactgatttttgttgttatatatgttgaagagtattatgaatacctagcaacatgatatatatgccatgtttatggttcatcaattagagaatcttatcataccatggtgacccactataataaacatggtgtatgttgcaggtgtaaatcaacgtctgagaggaattgtgttcaggataatagcttcagagataagcattcattaaaattccaaccaaaacctgggcagtgattattgtttcaatgaacagtaagtaaattgataattctgtgtgctaaggtgctgtcgtgacattatatgtaaactattcatagcagaattcctgactcaatactccactgttgctttttgtttagaattgcaatacgtgaataatgtatttgtagtttttgtactatcttcaacatctttacaggaaatacaattattgctctctgcttgtgtggctggtcctgggagatgttttactgcttgctgcatatcgaggttgaaatgttttcgtttggggggtgggggggaaaggtcactggtgggaggttgaaatgttctgtagaaagatgtcgtcatgagaatgtcccgtagctaaagggagagcgatgccactgtaaggatgaatagtgagccatgccattgtccctttatttaaacacattacccgttatccaggggaggtagcaactgctagctttcatgtactctatttctgttccccattcatttatcattcgctgccatggcagtttgatctgcatagattagaatttgcttttgtgatatgtttgaaactttccttgtgtttgaacccacgtcagattctcttatcaagatgtgattgaatgtactctttcgaccaatcattgaatgaacttattttacaccttttggtaaatgatactctttgttttttctgcaagggcaaaggctactagtttgccacgtggcccactgatttgagagaattttgtttgtaacttcaaaggagctattgaaatcgctttctttctccaactttttttttgatgtgtacaaagtaagaatcttttcggcctattataatcctcccatcggtgtcaatgattttatcaccgcattatgcttgaactttgaggtgaaaaaaatgatagtatcatttccctatttgattgttcctgcaatgtgtcaccctagaaaatttcttattttaggagttattatgattcatatatttggactcaacatatgttatttgaatataagaggtacttactaactaaaacattatatcagatgaagtaattcatagttttcattttttttattttcccaaaaatgattattcttgttctaagccctgcatgtgtgaattcttatggccttgaaaataaattgtcaactggacggttatttgtttgtgcctgtgagatattaagtttgatgcatcaagtcttgaaagagttcttacgacatatcagaagttgtcgcttgcatgcttctacataattatgtgataccgagaggcactaattttgtcttttcattgaatgagaaactgagtgaactaaaagcaactacaaaggttagatactttcatcttggatctttattaaataaccgagattattaaggttggggttgatgtgggaaagatactttagtaatttgcaatataatttgttaaaaatctagttgaccattagaaaatggtgtgaatgtatttttcatcacaaatccttttgttagttttataatttttagtagaatttagctataaaatttaatgggcggattttataatactgggtcctatgtcaactgaaatactgacaatatttttgtactgtagcctctataaatgatcacttagttatagatgagcaattttgatttctgaacaccaaatatacaaaatagtatcctataaagtatctccagaatctgcagctattcaagtcactgtctaaaatgtggatagatattgcacaccctgggataactcacttgtatacgaactttaaaatatcttcacttatgttggtgaaggaatagtaacaggctcctgggctatataaatgaacctcatgttctactttctgtaacttaggtgatcggcaacctgtgtattcatttttgggattgactcctactttaaaggcttcacttcgcctcatttttttcctgactgttcaatacttgtgaatggagtacggtaatttgcgacgtcaagcagcttccttgaaaaagagcctcttcgatcaggcttgtgctctgttcatctcaaaatttcaagcattatagttgaggcatatctgagactctgcaaatatatccatcagtccttttgctatatcttcttctgctatttatcattcagcaagacatagaatacagtgttttgatggacatcaccttacagtcatgccattttaattgccataccatggattgacactattgcacacagataatgaaaacaaagctaaggagaatcagattgaagcacattatattaatataagtgggttatcgatatttctgtagagttcattccatttcgtacttatccccaccccagttagcaaagaaatgctttaaaatcaacgcctttcaccatttcggaactctcttttctggtctttatcttagtttaacatgtgttaagtgtgctggtttaacaaatcgttttgtattgacagggttacttggatgagcaattttgtcaggttgaggatttgcaggatgaagcaaatccaaattttgcagaggaggttgtttccttgttttttaaggattcaaccagggtaatgttgaattttgagcaagctatgtaagtggtgacaatttcataaactagacctgtcttgattatcttttcacattcagcagcattattgttggttactaatatctaacatcacacagtgagaagcatccgaaagacttcgccagatgggacacacacatgcagcaattgaaaggcagctgttctaggtaagcctcagctcagtttcttgtgagatctccatgttgtcatttgacggaactggcactgatggacttttacagggtgtttgaattttattgcctttttaggaaagtgtatgcctagtgcaattacccatttgtctaggaaaaaataatcctgcctttttccaacaaaccacctaactttgtttagaaaaacattgcttggagaaggagagccacacatcgcaaggtcggtttgttgggtgaaaatgaacatgattagattttctatattttgagcatatgctgtaggtaaacttaatttgaaatcttaagtttttaactgcacacaattgtatctttcaaaaagactatgtatgtgataataattttatcactaaatctaatttagagtgtcaagaatctataaaaagctaactaacattaccctataaaaactatatggccttagtttttctcccttcagtcttcaagaaagtagcttaactttcctaactggcatagttctcaggtttttatattaagtttatccttttctcaatggaagcaaatatgacagtttcgaacacaagctgaaggagaacttccagaagcctgatgtacctgaactcccaccacacgcacacacaacaaagaaaagaccttcaaataatggcctgcttaatatcttgtgaaattctagtgaacggtcagggaatatgttaaacagagatatttacagagacccatattgctttgattggtgcagccttgcaggtgcacagctggtagatcatgagtacatgctcactccttatttcattatttgacatgataaaagaagctggcaatttgcttagttatacatatgtgataatcttttgtgtactttatcaatgcttgacatgatatggtttgtcacagcattggtgcctccagggtgaagaatgaatgcacttcattcaggaatttctgtggagaagaaaacgccgaagggtatctctctctctctctctccacttttatgacatgtggtatggcatggtaaaagttcatggcttgagcattgtgattttcccatgcccatggctgttactgggtgtgctcgtctgtgcttgcaggcttgcagccacagcggctgtggcagttgtaaatggctgccggctgcagctggtttcaactgccgcagctgcagtggctgtggcaaccagagcatccaatcggcctgatcattacggaaaaaccaacaaagtaaatggctaagtgccagtctgccaccttgtcaaacttggcatggctcagtcgaggcatgtagaagtgtcacctgtcagccctcactgttatgagtgttagtacctagttacacatgcatattctgatgggtgaaagttcctcctgctagtgaactggaattagcccttgccgtctatctttttttgttcaattcattggcttatttcgtatgatgatagatctctactactattgttatgcagttgcacgagatccttccagaaagtgaagagggagcatgccgtcctcaggcagaagtgggagtcctacttccaggtaatcttcaccagccacttcgtacccagctttcattaatggcaatatatgtttgttactaaggttgtgttcacctcgttaccattttcaagcttgccaaattctagcaagacaacatagcattaccaacataaccttaccaaaataaaattttgtaaggccttaaaccaaataccacctaatgttactatatactccctccatttctaaatatttgacgccgttgactatttcaaacatatttgaccattcgtcttattaaaaaaattaagtaattattaaatcttttcctatcatttgattcatcgttaaatatactttcatgtatacatatagttttacatatttcataaaaaaatttgaataaaacgaatggtcaaacatgtgctaaaaagtcaacggtgtcaaacatttagaaacggagggagtatttcaccaaaaaaaaaaagggtaatgccaaagtttggtaagttttctttctgcaacaaactgaacacacctatggctaataaaccattcatttctccacctatctcataataaacacaacgtggctttgtgcagctgttgcgacaagctggtcctgctgggaccgcgactaggcctgcgggcaagtaagctataagcagccggctattgaattggtctcgggctgctgctgccgtggatgcgactaggctggtacacaagagcagcctgccgttgttctagtatgccactacggtgaaaacccgtatatagacgtgctacgacttatgagttgtgacatgcatgtctgcttgtttatgacaaaaataaaaccgatcaagattactacatcatcatgagattgctctctttgcccttattttgtccatgctgttgtccagattgcgatgggtttatatacagctataaccacagatgaaactgtccggctgtgtcggtgaccattgctatgctggagatagtgtgatcggccgacaaaagtttatgaaggtaatcaggactgatagccctgatagtgtgataggtattactgaactaactggaatgacaggggtgtatctgatatctatgtgatggacatgactgagctaactactactaagataagtactcctatatgcaaaagcatgagctatgttctaatcttggcggttaagttgcaaccactcaagatgtacattttgtgtttggctccttttacagctctgttacagtgttactgacaccggagcaaactctgacgacggaaaatttgaaaaccacaacctaagggtgtgtttagttccacgttaaaattgaaagtttgactaaggctgtgtttagatccaaagtttggatccaaacttcagtcatttttcatcacatcaatctgtcatacacacacaactttccagtcacatcatctccaatttcaactaaaatccaaactttgcgctgaactaaacatagcctaaatttgaaagttcaaagaaaaaagttgaaagtttatgtatgtaggaaagttttgatgtgatagaaaagttagaattttgaagaaaaagttgggacctaaaaccggccgaaatatgcaagtagtagttcctactttcacacaaccaatatggttcattccatgatgggaattcagaaatatttcctgtcaagctctcgctgagcagtgagcaccagcacgatgggaaaaagtggagtagcatttcgccgccggctttcatagatctttttttatctttttgaactttttaattttttaattttaaaactaaatatttccaagacttattttcaagatttgaacggtgtgacagtgttatttggtcacactgttctaatatagacaaaatgtctagattttgtaaataagtttcagaagtgtttattttttaaaataaaaaaattaaaaagtacaaaaagtaatttaaaaaaaatcctttcacgataccggcttgcggcttcacggaccgaatcaatcggaggtagccagtttggccactttggcgggagtgcgattaaaacctgtttgacgacgtcaactctccggcgtgccggcttaaggtagggctcatgtgtaaaagaaaaagaaaaaaaaactcaggtcgcctgcacgatgggaaagggtatccttgtaattgatacaggattcggcgtttgagtttggactctgcactctgccgcgcacgtcgtatgaatattggagcttaatcaggtcccagggattcaaacgcgtaccactattggttccgataaagatgttctacccaattggctccttgaggattccaaaacaaagaaattgtttactggagtacttcttgcgttgttcaaattatgctagactatagtaggaacaaagaacaaagaacaaaaatatgtctatgaatagttccacgcttttcaatgcttcaaagtcaagcctcaatgaggttaaaattttctattatcaaaatccaaactaactggaaagcaccaccggtgatatggggagcatcgaaagcaaatcgaagtaatttggttggggtttttacccaccaaaatttaaatcttggtgcgcatacaagttagcaatattagaaatttggtcttgtttagtttcaaactttttcttcaaacttacaacttttttatcacataaaactttcctacacacaaactttcaacttttctatcacaccattccaatttcaataaacttttaattttagtgtgaactaaacatacctttatcgttggcttctctttttaaacgtgtgttacttttttttaagatcttgttgttcatattattagatctttaaacgtgtgttactgtgttaggggatttattcatgagtgtattagtgtgatattacatgtgtagtagtttgtgtacgttaattggaaaaaaaacgaaactattcttaaaacaaattcgaattgccggtaacggcgaccagagcaaaactcacgcaagcgaagtttcaaatttgaaaacgaaattaaaaaaaaaaactcacgcgaacaacaacaaacccgcgacctgcgcgagaggacaaaccaaaccaaaccaaaaccaaaagcgaaacacagaggacaacacaaagcacggccggggggcggcgcaccgcgcacgacggcgacgagacgcgtggcggagcaacaaaaccagcccccgcattgccccgaggcggcgccgcccgagctcgaatccgcccaatctcgccggcggcggcctcgatctgagccgaggccgccgtgcgccggcccgggcggcgaggaatggggagcgtggacggagatttcgaggggctccaggcaggtgaggcgccccgctgatccggatgctctcgggagtttgaattctagccctagctgctcgaggtttgggttgctgcgagtttttgtgattttgggggtaaatttgtggcgaggaggagtggtggtcggcgatgggcgaacccgctttttctgcgctctgatttagtggttttcgagttggaattcagctcagcgacctcagtgattcgtgcatattcttcctctggttctaggcttctagctatcgccagcccagctattgttcagttactatgttttagtgtttgaagttagctggcgaccgctggattttgaattttttgctgtttcgatagtaaaatgtttgccgaagaagaaccgtgtgttaacccgtttttgtgccggagggttcaaaagttttattattatcatttttgatctgagatatcagttccgagctgccgatctgagttgtgatttttaatttctcatacttgctttacatgatggtgcaaaaaacattgtagcggatcggcgtgcggaagtgattgaatggctcaatgcgttactcccggagtactgtttgccactggactcatcggatgacgagttgcgggagctgctcagtgatggcacggtcttgtgccatatcgtgaacgcactcattcctggtgttctcgaggtgtgtccttttgggcttgaagaattttggcttttttgttgaactgtggatgttgatattggtgctctctggatgtgagtttttgtttgtttaggagtcgtggggtgcttatgcatcgtcagatcaacatgcaggccatgtgaagaagttcctcgcagtggttgctgatatggggttgccaggcttcagtgttaaagatcttgaggaggtgaggttggtcttatcatactatgtagttggtttgcagaaatgagttctgaaatgcaaatggttgagattagttttcttaaatgtttgcgtgctagccttattgtgctagtcaatataatggtgcttggccttgttgctcatggtattgcgttgctgacaagttttagtcatgcatacacatataagtagaactatatttctagagttttttttcccattataatctgtgaggaataaatgaataacctcttaatatcgcctaaccataattgcactatagtaataactcaaattctgtgatagattgttgactgctagaaaaggaggttagattattagttctagatttattctatgccggatgctgtcatctaggaagcaaatctgcaaaaaggattgacaccgcatagttaaaatgacatgcttttaaatactcgcaattgacggaaacatgcaagcattggagcaaatccccccaatttcactatttgtggatgtaagatgttacagtttttcattaaaaaaaatgtttaccatttccaaagttcctgattgcttatgttaactcataacttgaccatggcagggttcaatgtctggggtagtggactgcctcttggttctgagggaaagtgtgagttctggattacgtgatggtacttccaaggctcctttgaggaaaaaatggcgagttccagaaactggtgaacctcttgtccctggtgtggcacaagggaagacatcccctggagaggacaagaggaatggccttccagaccctaagtctcagcagaaaactcccatctttaatggtatgcacattgttgactattttggtgcatagtttaaaaatattagttgaaaagaagtccctacatgtttacgctttggctctagaattctgtactatatagtcaaattctcaaagggaaaatgacatgggctatttgtgattgggcacttggccatgttgtggggggtcaacgatttattggttgaagctgtagattggacaactatgttcaacatagaatcttagtggacatacaaactttctgatgaagctagatttgatcatggtggggtggttactttaacgtttcttaaattcaacatggcttccaagctccaaactacaaacttgttaacgtgtatgcttgctgcaagttgtaactcaagctattgtgtataatctatatctgggtcactactgttccctaccttttagtttataatagctcgtcatatatgctgcaggacgaaagcttcgtgagattttccaattaaaacgtggatcctatgctgatcttccggctgccaagatttcagaaatgatgcattctaacagtttagatgtaactttccattgcttatgcttgttgaattgttctatcttgttgtttgctattcctttcctaacagtaattaccttctcacagaatgcaccaacccaatcccttcttagcgtcgttaatggcattttggacgaaagcattgaaaggaaaaagggagaaataccacatgtatgtctgtgtttctgaattgcatgctctctttttcattggtatcttttaaatctaataaatttatctacctcacctcagcgtgtagtgtacctactgaggaaagtagttcaagaaattgagcgtcgtctttgtattcaagcagagcacataagaagtgtaagagagtcttttttccctgaagcctatatatcctttagctaataaatgcaactcatgaatcagatgtctcttgttgcagcaaaatgtgatcattaagacaagggaagataaataccattcaaaaatcaaagcacttgaaatattagtaaatgggacaaatgaagaaaaccaggtaaatattcagtattttcattgttataataaattacataatttagaagttctcccccctaactgatgacattgtggacttcctttcttcagatggctataaaccggcttcagataattaaggttagacctacactgaaaagatttgatttcctacatttgctatctttatagtacatttgctatctttatattattgtaataatataaacaaatgaaatattaactatataatgtttgatcatatattattgctataaggatgatatttgatgttaattttgttaccgcctagaccggtagaaattatggcaactgttatatcaactatataacatattatatatttttttctgcattcaggaagagaagtcaaaaatagaagagaaaaggaaacttggtgagcaagatgttgctcggctaatgaaagaaaaagaaatttctgaaaacacaatagctagtcttaagaaagagatggaagtcatgactagcatgcatgagcaacaacttcagaaaatcgaactgaccgcaaagcaaatggaagaacatttaactaccaaaattaaggaggttgagtctcttttagtgcaatcaaacaagaaaattgaagaagttgaggctgcttccctgttaaaatcacagttgtggaataagaaggagggcatttttcagaaatacatgaatagtcaacaactatatgtcaaggtttgtttatctttaacttgctcttacttccttttgtttttcatcttatttatgggttattgcttgaaaatgacagggtttaaggatatcatcatggtctataaaaaatgagatgcatgcccttgaaatggagttgagagatgagatgtccaattttggtatgtgttgtataatctataaagtaaacatttacttgtatattttaacattgtgttgcttaaacttttgcaggctctggtttaaagtgtttggttgatgctgctgaaaactaccacaaagttcttgctgaaaatcaaaagttgttcaatgaagtgcaagaactaaaaggttttttactgctcaaattttttatagcttcagaatgcacctattgatgtccatttcaatatctgcctcttttaggtaatataagggtgtattgtcgtgtaagaccatttcttcctggtcaagataaaaaatcaaccactgttgattacattggtgaaaatggtgagcttttgatctcaaatccatttaaacaaggaaaggatggacatcggatgttcaagtttaacaaggtttttagtccattttcttctcaaggtatatttttttacaatggaaatctggtataagcttatctgtgtgcaaataaattctaatacttatctttcaatttacagctgaggttttctcggacattcaaccgctgattcgatcagttcttgatggattcaatgtttgtatttttgcttatggtcaaactggttcaggaaaaacttacacaatggtactaacttttaccgatattttactggctcagcattgttgttaacttatattgatcttttttattggtattgtactggttcagcatgatgcactgctactaacttttgatcacttatgttctattccaataattttgttcttagagtggacccagcacatcaaaacaagattggggtgtcaattacagggctttaaatgatttatttgatatctcactaagtaggagaaatgctttctcttatgaggtgggagttcagatggttgagatatacaatgaacaagtgcgggatcttctgtcaaatgatattgcacagaaacgatatcctttttcatacttaaattgtcatttctaattatatttctggtacctatgtttttagtttgtaagagaatggttgtgttctctttaacataaaaaaacacttggcatatggagcacctctcaacctaatggacttgtcgtcccagatgcgagcttacacccagttaaatcaacatcagatgttttagacttgatggaaattggacaggcaaatagagctgttggttcaacagctcttaatgaaaggagcagtcggtctcataggttgagtgactgataactgaagttaaactatatcttttttgctctcaatatgattttattttgaaacacattattctatgcagtattctgactgtacatgttcgagggttggatgtgaagaatggatccacttctagaggatgcctacatcttattgatcttgcagggagtgaaagggttgagcggtctgaagcaactggagatagattgaaagaggctcaacacattaataaatcactgtctgctttgggtgatgtgatttttgctttggcgcaaaagaatgctcatgtgccatacaggaacagcaagctaacacaagttcttcaaagctctttaggtaatcaattatttagttgaaaaatcatgcatgtggagttagatttatggtttttgtaactataatcttataaaataatctcttgcaggtggacaagcaaagacactaatgtttgttcaaataaatcctgatgttgagtcatattcagagactataagcactctaaagtttgctgaaagggtttctggagttgagttaggtgctgcaagaagtaataaagagggaaaggatataaaagagctgctggaacaggttcttgctttttatgttctgtctgactcatcattaactgaaatttctttgcttttgttttacataattgctgaactatttagttctaggaagaaggggaatccttatgtgtaaatttgatgttcatgcaacaaattttcttgcaaatactgaagtaatttctaattgaacttagagctctattttagaatgttgctgatgttttactcaaaagcatggccattgttctcaacttcatattttccacaaatttattcaaacattctaaagaatcagcagtaaaacaacagcaatttccaagctattcctgaacgaatgttctcccaatagtaatacaagttatcatcaatattaggcttgatcctgaacaaatgttctcccaatagtaatacaagttatcatcaatattaggcttgagatacagaaaacctgctgcaaacaacctttttttttgtctagtatgaaaaaaatataaacaaatcaaaatggtgacttgttgtgatgttctatgtaattattcaagtctatatgctgctagtggtgtaaatttctagttgaactcatgttatggtttgtgcttgccaatgagacatgtttctgttataatgacaattccttctttttactataaatattttgtcctcccaacttgaaaagtcacttcacatattttgtccaggttgcatctttgaaagacactattgtacgaaaagatacggaaattgagcagctccaactcatgaaagacaaagtcaaatcgccaagttttgcagtcgatataaatggtgctagcatgccaaaaaattctaactctgacctaagatcagtattgtcaatcacaacaaaccaacagagccaactatcagatcctcagagttatgctgaggtgaacagagatggtggacctacttcatacactgacattacaccaacatgcttggatgaagcagattttgaggacaatgcatcagaagatggtttctctggaggaaccgactattctgttggctgtgctgccggtgccagcgttttcccaaattcctgctcagatagaaccgcagatacctccatgtactctcatctccctatatcacttacaccaaactaacttgcagctattaattgttctctcattacatttactcaatttgttgtaatataatcttattattctttatgcaacattatcttttcatgttgtgatgaagaagcattaatttggtacctcctaatgattgcagtaggagaatttcatcacgaatagctcgattcagtctcacaaagaatggacaaccagcaacatccagaccaaaaccaaaggatactgctccgaagactccaagtatgtactataagccactaatttacttcaacagattggtaactattactgtactggctacacagttttagtatatgtgctcaacgagttcaaattatcatgccaatatcagaagacacttgccaactttgtcttggttttcaaaaacaaatggtaattttttgggaatagaaaggtcatgttgctccgtgcaaataatttcatacacatgtggttgctattattgtaaaacttttagttttttttaaagatatttttcaaatttttagtgcactgtccaaatagtttcatacctgcacatgatgtaattaattatccttggttattaatgagaaatatattgattatcagatcaaacgagagttcaatcgagccaattgataggaggctcttcactgagggcatctaaaaggtggcagaagtagagcacgctccggttgctcagttgtattttgtatgtccagaatgtgaaaataggcgaagtagctgtaggagacaatgtacttgtaagttgtaactctacagatgtgagagcattctgctgacgaaggacgagcagctgatgactcatcctttgctcatacagatcaaatatccaggaaaggattcccttttctgttctccatgtttcccctgtacttcaatttttgtcatggttactgcatctctggaatcaaacgtttccaattttggaagaaacactggtattttttatttttattttgctctgagcttctgacgtacttcgagcatgctcgattctttgggcaagccaaatgttactgggcatggaagtctgcgtggtgtaatggaagagagacagtttggttctctctctctcgatcaatggatgcttgcatcaccctcggaatcaatggtgtaaagcttcgctttggtcgccctttggacctaagttttggagtttgtcgattctgatagcaaatcaggtctgaaaaaattataatcgcaactgttttaacaaaatcactgccgctgtttcttttttttcgaacacactgccgctgtttctgtaattactgtaacttgttcagatgagaacggtggcgatatcgaacttataaagagtagcacggaaataacgagttgtcgccgggcaaagtccaaatgtatatcgctggagcactgaagatcccttgaagaccagtgactactgaacacttgtgcaaaagagctaagcagaaaaactgaagaactgaagccttggtaaaaaaaaaaacttatgcaaaagagctaagcagaaatactgaagaactgaaccattggtaaaaaaaagaaaacacacaaaaacacttatgcaaaagagctaagcagaaaaactgaagaactgaagccttggtaaaaaaaaaaagaaaaagaaaaagaaaaagtgaagccttggtaaaaaaaaaagaaaaatgcaaaagagctaagcagaaaaactgaagaactaagccttggtaaaaaaaaaaaagaaaagaaaaagtgaagccttggtaaaacaaaaaaaaaaggaaaatgcggtgagcgtggatcgaacacgcgaccttcagatcttcagtctgacgctctcccaactgagctatccccgcccttggttaattaatgatctactacaaatatatctgtatccttaagctatctcatataaacacattttacatatatcttcaagtagattatgtttatgttgcaatgtaattttgtgtttaaaattttattttgagagattgaacaaatcctgccattctgcatgcataatgaccccgtaacttataaacaagaaaagggcaaatcatgtttgatctttttaaaggggaacttacaaaaaccacctcaaatatcacactgagttcgagggaagaggattatctgacttatttccctctgactttgagtcgcttacgtgtggacccactaagtagagggtccatatgtcagtgacacaagttagagggaagtaagttagaggatctcaatccgagttcgagatccctgtaaaaccatttgtagcaatatcctttcccaattgtcactgcttgcacatatgcgatatccatcaatacgatccgatgtctacgctcaagccgaacctgatatgcaaacaaacagggttagcggaatcaggaaatgtagtaattcgagtaagtccaaccttcaaggaagaaggaaggcaatccgtcgcttgtttgttgcaagttctttccttttctctttccttatgtgttatatgacttagcacatcttttgatatacatggactcatcttccggcgacccccatctctaagagctgagactcgtgattaccatcgcccaacaacatgctggatgccagatgccgcaatcgtgccatcgagcctacccaatattactggtgaccacggctccttggctagtactccctccatcccaaaatataataacttttagctctcaagatttgtcccaaaatataacaacttctccaccaacattctcttcccaaccaatcacaactctctaccattcacttttcccatctacttccactactcaactaatcacaaccctccatcattcatttctacccactttattaataactgtgtcctactataaaaatgcttatattttagaatggagggagtagtattcaggtgagcccatgtggggtttgcggctatgagaacgggtgggcataggtgaattaggaggagggagatttgtgataaatcatcttatcgggagtatcgaattgagggtgacatttgggatggttttttaaattttcctttttaaacaagaaatactacgttttaccgttgataagtgattgactctacgaactgctatcaacgaacattaactctacgaaataccattaccaaagtgttttttcttctgtttctgccatcttcattaagtctcccattagatacattccgttaacacgtcatacaaaaaatacattttacctatagaaccatatctcagagtctcagagtaggaagtgcttgatatatttgaaggggtaaaatggaaattttgcataaagttaactaggtgcatttgatactaatgctagtggagttggcatggagaaaaaggaaaaaaaattaaaacactcttatgtgatgttataccataaaactcccgttctcgagtatcaaacattttctcctcataaataggtctataataataatcttatcatctgcaatgcgtcatatgacatagtacaatgtatgccttttgtgcatttctcgaacaccaagcccgtctagctcagtcggtagagcgcaaggctcttaaccttgtggtcgtgggttcgagccccacggtgggcgtccattcctttttttttctctcgtctccactccactggttcggagaaaccccatgcttgagctcgcggacagctcagacggagaagatcctcctcactttcttcagtttcctccggcacaacgggcagctcccgtcctcctctgccaccctgcaaccacagcgtttgcaattttatggtgataaggtttacaaaccctgaggttatcgtaattatcacggacgataaccacggttcatggtaaccacgataaccgttaataacgataatctcacttaggccgagtttagtttcaaacttctaattttttccatacacatgaacttttaactttttcatcgtttcaattttaatcaaacttttaattttagcgtgaactaaacacacccttaaaacagtttagtacctcgtgccgcacgcgtggcaggtggcggagtgcccgcaggggaggaagaagcagtccctccgcgcgtcgcagcacaccacgcataggtgccgcccctcgccgccgccgccgccgccgcctctttcctctacgtcgtcgtcgtcgtcttccccgtcgccgtcgtgcgagacggagtcgtacgacgaccccaggctcgcgtcgtcttcctctttgctcgccgccgccgccgacgacgacgacagcagcgaggctctcgcgtctcctcctccaggcccgggaccgaacagcatgttcagtatatcgtacatgatcagcagtgcaacagccaacagaactgcaattcagagggattaataatttagtgtgcagtcaatcctaccattaatttgagaggttcttcttgtaggtgattattgagttggtacctaatccgatgatgtacactatccagcgaggtccatatgacagcttcacataatgaccatcagaattcagtccctgaatgaaattgtgcactagactagtcagtactgcatccggctaaagtgagcattgtacagtatacgagaggaatctgaagatgacagagaagacgctttttgtcacctctttggggccggatgacagaaccacaacgttttgtcctaaaaacggcagtttgtaagtgcaaagagagctggccggtgagcatgtataatctgctgcgctggtgttgtagaacaaggtcctgattctgaattccagtagcacctgccagatgaaacctctgtaacaaggctgaagatgccacaaaaacattttggaagctctgtcgctcttgacacggggtaatttaccgttacatcctgattgttaaagtttcccaaggcaatgaagtactctgaagagagattgatagtctgcttgattgttccatttcctgtgattacacatcctgatagcattagtatacggattctcccggggtactgcaagtctgcaactgattcttagtcaatgagatcatgcttaccgtgcaccaagtgccaagataatgtggtctcatttgctgatggattctcagcccattgcaagaagctttctttgcctatgaagcagtgaagcaccaacacgcaagaattttaatggtgtcagtgaaactctgttactgatatgaaaaaatcacacttaaacacacttgttcatatatctgaacctttcttacctcgcgcaatgatcatgcagattggacgagacgattcagtttcactcctgacgctgtaagctacttctatctccgatcctctgttaaggaaatacacccattcctgcagcacacaacatggagtatagtaagtagcaactaatcttcaattctgaaaataactgacatgatcatgagttcagagtttcaaacagaatcacacagatgataacgcagcattaccatgtgagaattggctggtacgacggcgcggcgagcctccgaccaagcggctgggacgccgagaggcggagcgaccggcatcccgtagagcaccaacccattctccggcgaccctccctccgtccttgcctgcaagagcgagtgcacacattaaaacactcgtcctgactgagctcgtgcagagctacgggaggatggtcaccttgatgtcctgcgcaaagaacgagttcgtctccacaagcctcgagcaacctgagccgatgacgactagctccggcgagccgtggtaataccccaacatcaacgccgccggcgctgttccatcaatgtaaaggatcaaagcgagttatagcactgagacataggccgtgttcaggtttcccagcacgcaaagtgaagctcgtattattgcatgattaattaagtattaaataatatttttttaaaaaatagattaatatgattttttaaaacaacttttatatagaaagttttttataaatcacaccatttatcaatttgaaaatcgtatgtgcggaaaacgagagaggtgggttagaaaaatgggaggaataacacagccatattatgtgttgtcgatcagagagattcggagtaactgacccaagaaacagaaggcgaggagggtgacaaagcagagcactgccgccgccatgactgtaaagtctgtacccgtcgccggcgctggacagcaagacgacgcgtgagagaagctgtgaatacctgaacggatcacggccgcgggggattttgtggaatcggtgtcttagctgatgtgtcctggttcggtagctggctcgtgctccaactaccattccacctagccgaaagaacagagcagtagttagttgagacttgagacagaactcacagaaggcaattcgacacgagttagcgattgacattaggcttattcattttattaccactttatttgggctttggaagtagagaatagaagtaacctttgacgattagaagtaactatacagtaacggaaaaataactttaaaaaataattacagtattacaagtacattactagaggaaaataactctaaaaaaatagaaataactttacatggtattaaaagtaactttaaaaaatagaagtaactcatgtaagaagtggctacactggtagaggaagtaactctcaagaaaaatataagtaacttttcatgtattaaaagtagctctttgaaaaaaaaatagaattaaacatcctgggaatacctatattgctagatgatttaaaaataagaataaaatttagaagtagttatgatttgtataagtcacttttaggtcttattgaatttactatcataaatatctgagaagtaaattaatcaaatctagaaataatttacaacaaaagtaatttgcgtatataaaaaagtaatttacaacatatatatttatttttatcaaaatataattatgtaagatcttgttataaagatttaattaaagaatacaatgatactatcagagtgtggatccagtatataatttgaaacaaaagtttatttgaggcttagctattatgactattttttctttgttgttgcatacttgcatactcggaaatacatgaatgctaattagacataactaatttcggaaagtgcactcggttaaacatcgtattaattatgaaagcacaagctttgtagtctcgtccatattttttactttgaaatttactttgtgatcacgatcacttgtcgagttgaccccctcatatttaaaatctggcttcaccactgtacatgaacagtgtattttcatgcttaggcatgatttagtttccaactttttctttaaacttttaacttttctatcacatcaaaacttttctacacacaaacttccaatttttccgtcacatcgtttcaatttcaatcaaactttcaattttgatgtgaagttaacacacccttatttcctttaagaagatcatctaacggcttcgatccttgatcctattcagcattgcttcaaatcatttgtgcagaactgctcagctaccactttttgatgaggccttcaaacaactcttgtctaaaagaaaaggagcagctgatggagccgccgtcgccggtgcccaacagtacatccttctaaaatccaggacgacgcatgaagaaatcgaggcaagtttccttagaacacggcaatcatgctgctccgcgagcgcgatgaccttccccactgtgaacgcatcaatgtcgtacctgtcgtcgccgtcgccggctgcttgttcctccatcttcttcttcgtcgtcgtcatcatctccggcaacgagtcggtgtacgcgaagaagagcaacgccttgaacacccgcgcctccatgccgtcgacgcggacgatgccggtgctttggccgacgacgacctccttcgcagtcgttgcgccgaagagctctaggtcgaagacggacgaccgggcgtcgagcacgcaccggtgcgcggcgaacctctcgccgccgacctcgaacaccacgtcggcgccagtttctccgcggaggaggtcgccgaggtgacggtgcaggtcggacggcggcccgtcgacatcgacgctgccgggcgccacttccgccgggcggaactcggtgacgacgacgtcgcatcggacgatgaaggaatcgttcttcagatgcctcctcctcgacctctccaagattctcctcttgacgaaccggctcggcccctcgccgcgctcccgctcgtgaagctcgtcaaagacgacgacggcggcggcggcggcgctggcgcttgctccgcctccttctccgcgtcgccggcgaaccggaaccggtgctgcgcgtacaccggcgcggcgacattctcgtcgaggatgaggtcgaaggagatgtagtcggcgcagccggagttcttgccgttggggtagtaactgatgcgccattgatggcctccgatggcgaacgcgctcgacgtcatgtacactccggtgggtatcggcgtggtggccatgtagccgtcgatcgtgaggaggttgtacccgctcgtgacgttggcttggacgatggaggcggatcgcgacgccatggccggcaaaccttggtgtgttggaaatgcaggtgccttcagtttactactccgtcatcgtatgctgatcggatcagatagttaattaggccctctgatcttgtccgaatctgggtctgtttgtgcatatcgttggatcacgcgtacacaaggacgaagggaagtttggctctgaacgaccaaatgggccgtggaggctaatgagccggatcaagaaacccacaccagcaaattctccctctgttttcgatggttttccctgcatctgtacaactacacatagcagtcaaagaatgactctaaaaaggtgataaaatacaggcggtttcatgcgcctatgaatataacaaaatataatactagctacgattttatccctctaattcatctctgaatatgttaaaaaatatgtaagcaacatccatatctcaaacatagagaaattgttggtagaaactaattaatcaagcacgcaatatgcacaatgataggtccaattcggagcccacatatataacacggctataacactgtacaacgagctgctatctctgtctcaggttataagatattttgactttggtcagaatcaaactacttaatgtattcaactattgattggatgaaactaatttagtactgtaaatattactatatttatctataaacttaatcaaacttaaaatagtttgactttgatcaaagttaaaatgttttataacctgaaacggagggagaagtaactttcagagcatgccaatcaactcctccgtgatgaacgggcagctcctactcaggtggtagaaaccatcagtggctaacaccgccattagattgtctggaaagctgacaaaatctaagcaagcctttatgaggccatgggccatggcaatggtactggtcaaccaacgccatgatggacgccactgtgcccacgtcaatgtacttgcacaacttgctctcgcatatcagcttgagcctctccatgccgtacacttcggctgcgacaagcagacgctggcatatggcttcttcctcctcctttctcatctccggcaacgagtcggtgtacacgaagaagagcagcgtcctgaacacctgcggctccatgtcgtcgatgcggacgacgcatgcggcgtcgccctctttcatcgcgccgaagagctccgccttgaaaaccttggaccgcgccgcgagcacgcaccggtgcgcggcgaatctcaccccgccgccgccgccgacctcgaacgccacatccgcgtccttccctgcacgaattaggatttaggagttcgccgaggtgatggtgcaggtcgggcaatcggggaggcttattagcgacgacaaggctttggggcgccgccgtgtcatcgttgacgacgacgacgacgacgtcgcagcggaggtgaaggaatcgttcttcatatacctcgacttctccaagacttccctctcgatgaacttgcagcaactccgccactccggtcagcgtagttcttgagacacgtcgacggacaaggcggcggcactgggtcagaaatgcccgacatattactacgaatatttggatcacataagtaaacaaagttcctttgtttctgtttcactattctgcttaggaaggtacatgtcatttgctagcacatgtttgcaatttatctcgtatggagcaaatagaaattaacccgaactcttgggttccagagcaccataaacttcattgcatatgtaccgcaatcaatcctccaaatgaaaaatcatatatgggaaattaattattcaaatgggcaaccagtttcatgcacaacataggctaggtccttccatctagtatttgtaaatctattttctaaagctgtgtcgaagcaagatttcagcaataataaaagggggtggctgtcaagctaggaaagtggatgggtttggagacaagaaattttatacaggttcaggccttcttattcaagaagtaataccctactcctgtccggggatgattccgccgagtgtgttattaattgtatagactgggaaaaagaatcgccttccaagaggcacacggaccctccttatataagggaaggagtccgctttacaaaatacagtccatatcctaacggaatatgggattatagataaaatacaatcgtaaccgactaagatcccgggtatttccttgacatacaagtttagaacctaacccgagtattcatagagatattccatctatatttggtaccgtatatccgactaaattacaaccgtcatgtcgatatgggatatccataatctccacagtagcccccgagaccttcgtagttgacaaaatagccttctcgaaacaaaaaacagtagtccgagtgcttcaattcaacttgctccagcttgccgagtactaaaaatcaaaaactgtgaagggcgaaaataaaacatggtgcatcgagtagatgcacctaattaggtgtagcccctgactatgtgattagttgaaaaactaaacatatagtcaagaaccgagtggttttatagcgaagcacgcatggtacttagtaagatacccagccgactgcttctcaacttgaatgtatcaaggacaaaaaatacaagaagggccgagtgataaacactcaaaggtccaaaaatagacatgtttgataggaatccgagtaaaaatctcataaaatgacccaccaaacaggatagaaaatcatggtaattaatgagtccaatagcctaggctgtgacccttaccataaccaaaataagcatataacatgctaaaagaatgactattaataaaccagtcatctcaaatcaacccaaacagcttttgcagcctaataaagcttacaaaaaaatggtataacacctttctgtcaggcacctttttatgcgcatcataataattccaaagaattattgaatcgcgttaaaaaggattttaacagcattaggccacaccatcgtaaacacaaattgccaaagcaaaaagtgcctaagtccctagagatcacaacagaccacgctgattatagcattgggctgaagtactgtacaggcccaggcccattagtgctcccgataccctaataataccgaagtaaaaaacgtctcttcgtcttccccgccgagactctcgccattttccccatttcctgctacagtgcaaaactacgccgggcaaactagggttcatcaatccgctccaatccacactcaaaaacttcacgaaatttctccctgcatccaccgctccaattccccatccctttccagccgtatctcgaactaaatcagaccatccatttcacattcatggcggaagaaagagaaagcttcgagagtcagtgggcgccctccgatgtgacggaagacaatctgaaggagatggtggcgcacggcgttcttccagcaaaagagatcatcgggtggcgaccggcatttggtgaggcattcccgacctccgatacacacgaaatcgtggtatttgctcatttcttctacggtggattttctcttccaacctcaagatttttccggggaattctgaacttctacgggattagcttgcatcatctgaatccaaactccatagtgcatattgccaattttattcatgcctgcgaagcttttctgggcattaggcctcatttcgccttgttccgctgcatcttcttcctcaagccccaaccaaacaagagtaaaccatgcatcgttgggggtgctggtttccaactcaggggaacactaagccaaaaatacttctccatgcccttcaagacctcaaataaaggctggcacgcaaattggttttatgttcaaaaccccgagcctgttcttctcgagtactcctgtcttcctccagtttatcgggatacttggaactcactgccaatgggagacgaagctgcacaagcagtagaactgatggagaggatgataaagctgaaagaacagggccttcaaggagaacagatcacccggcactttatcaagtgtcggttagctccaatcaaagaaagatctcgcacagccttcgaatttgacggcaagcatgacccaaaccgtgaagatccagattctcttgacttcaaggtcatgaaggaaaggatgtataagatcttctcaaacgccatcgttgtcagctacttacacttgttgccagtcgtaccgttcaatgcattcaatcctcctccaccggtacgtattcatacacttcaacctttctcaaaacatgatcttgctttcttgttgaatcagttaacaatgaaggatattacacccaggaatttgctttgatgaagtcggatcccccaatcgctcaacgccgatcgccccgccaccaaactgggcaagggagcggaggaccaagaattcggtctgaaactcaaccaagtgcttctgatccaatcggccagtcagattctcgaaagaggaagctggttctaagtgacgacgaagccgatgataccgccaggaggcctggagaccgagagacaaccaagaaactaccaaagcaggctactccaaggtagaaaacatccagtcgccctgtgccaaagatcaggaagtcttctaggtgcaactcatataacgatctcttttgcattgatgcgcacccattgcggcaataatactgataatcaaatttgcaggaaaccatctgatatagatccgtctgggaaagactctgacccgactaacgtggacacaagttcttccaaagaaaccgagccaactgctgaggatcatctgagtgacaatcaaccggcaaccgataatgtagaatccggtgatcaacccccgactggaatccagtcggccgaagccgaagccggagttaatcaggagcccccgactggaaaccagtcggacgcagggccaagccaagagattccagaagtcgaaacccaagcagacaaccctcgtggacaagacgccagcaatgaccggagatctggatcccctttaaaagtatccgaatccactcgtcctcgtccagaaatcattacaggtaaacactttgtccgaaaccatgttgacccaaataactctgatcgatcgtgtaacctttgtcaatggatgcattaggaccaatgatcggtgatgaagaagaaattccccgtatacaaacagccgaagattcgtgccctcctattctggtcaagtggtgggatgacaacttgcaacctcaaggaattgtaataaaccggcaaaaagaagacgaagaggtatgcctactgaaaaaggcactcaaccaagcgactcgcattgtaaatgtaagttccttgacgcctaacctcagccatcttgtttaccgtctggctcgagcgctgattaaactgctccgcagaggattcatcttaggaacgaggcgaaaaccgcaaccctagagagactagttcctcatcttggaaccctcgaagccaccaggagtcaactgcacgaggccagagaacttaccaagaagaatgaacacgatctgagggatcggattgctgagctccaggagtccaatttcgaactgagtggctcatcaaaaggttcgcgcaaactctgcccaactgatttgtgctgttatctctgtaatcttgattaaccgaagttaatgtagtgcaagctgccaagatatctcaactagagaagcagatccaaactctggaaaatgacaaggcagagctggcaagacagagggattcggctttaaaggaggttgaaggtaccaataatcaatacctcaaaagccattatcttctacatgctgattcattaatgtgaatctgttgacgcagaccgcaagatcaagtctcaagcacaatttgatgtcttagttgacaagatcaacaagcttgaaggagccaaggataaagtcgctaatgccgctactccacttatccaggccatgttcttcaataacgccggttcgagtacacttgatgctgccgaaatcttcgacaagctgagagtcgctacagatacttacttcaagaacatcaaagaagctggaagtatgggagcaagtctggcattggcgatgaccaaatccctttatccaagagttgacattgatgccattgatggctttgtagacgggacgagcgaagaagctgctcttgacctcatcagtgatgcgtagaaagcggctgacaagattgctgctgatgtagttgagagattccaagatgtcgaccttcggccaactgggtctgataagtctaatgatgaaaaaactgatactgattgatataacaatgattttgatgatcaatgatggtggaagctcaatttgtacaatactgatgaatttatgctatgcttggtgttccatacttagcttctgatttcttaaaagcctttgtcaagccttattgagcctaaaacccgcaaaagctattaaaaaccttcagtcctcattggctaagtcgaaagaccaaacagggcaatgataaatcaagtaagcaaattgaattgataaaaatcacactccattattatcataatggccccctgactgaaaacttcaaggaaaaacttgaagttagcagtcaaataggaaagatacaagcgaaatgcctaagcataaaatcgacgaaggtgttcaatattccaagaattgttgatgagagtactgtcttcgcgcttgagtcgataagaacctggccgagtgacttcagcaattatgaacggttcttcccataagagagataatttatgccgatcccgtgttgtttgaattttcctcagaaccaggtcgccgactaaaaaggctcgcgatcgaacattccgattatgataacggcgcaatccttgcaaatatcgagtcgactgaattaaaactgcttctcgggcttcttctagtcggttgatgtcgtctactcggccctcttcatagccctcctcgttgaagttccgaaatcgtagtgattcaaattccacttcactcggcaacattgcttctgcgccataaaccaaaaagaacggcgactggtcggtagcccactaggagtagtgcgtaaagaccaaagtacggacggcagctgatctacccacttgctagcatagggacgtagtcggtcaaaaactcgtgctttgatcccttgcagtatcatgccgttagcgcgctcgacttgtccgttactcatagggtgtgccacggaggcgtaacaaattttaatgccgaagtcttcacaaaagtctttaaatgctccgccagtgaattgagtgccattgtcagtgatgatcctattaggtaccccaaaccgatgcacaatgttgatgaagaaatctctagctttatctgctgtgatcgtgatgaccggtttagcctcaatccacttggagaatttgtcgatagccacaaagagatgcgtgtaaccgccgactgcccttttaaacgggccgaccatgtcaatcccccagaccgcaaatggccaggacaacgggatggtttgcaactcttgggctggcaaatgaatttgtctggcaaaaaattgacaaccttcgcatgtccgcacaatcttgtcagcgtcggacaccgctgtaggccagaaaaaaccttgccggtaagctttgccgacaatggtccgtgcagcggcatggttaccacaaataccaaaatgtatatccttcaacaactatatcccttcttccaaagacacacagcgctgcagtattcctgacagacttttcttgtacagctcagtctcatgaataatataaagtctgctgcgcctggaaatccgctcagcttcatttttgtcttgaggtagttcttgtttgctcaaaaattttataaacggttctctccagtcggcttcgatcatgcttatgccttgaatatccatggcttcgactgtctcttttctgggcacggtcggttcgtaaaggtgttcgacaaacacatctgaaggagctgcttcccgttttgaaccaaaattagccagtctgtcggctgcctcattgttatgtcgaaggacatgggtgagctcgagtccatcgaatttattttccaacttgcgtacctcttgtcgataagcggtcatattatcatctagacatgtcacgcccgaaaattcacaagtaatttccgaacttatttgtgcataaaatcctcgtccaggaatcagccgaggtacacaaactgacaatttaatatacagattcatcaaattaactaaaacgataaatacttacttaagaggcacttagtcctcaccaagaagaaaattgcagcggaaaataaaatctagcgaagctccggctccactcccacaggcagctcaactggggtataagccaaacgtcttctccttcgcaacttgtcttcaactgaggttgattgattattgcaaggtgagcatatgacatactcagcaagccacacagcaaatatgcaagtgcacaaggataccaaaggaatggcataatattggctcatttgcaaaagcagcatttagcaaaatatttaagagaagtaaaacagtggagtaattaatcagaaattttaatcaacactgaacagcacacccatgctgcacaggcccaaccatcctgaacaaccatacccggctgaacagatctaactccaaaccaggagctaagcaaattattatcaggtataacatccataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatttccgccacttctcagtctggtgctccgcaatgaaccatgctatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgagctaccattaaaccatcattaaataataatgaatcataagttatcccaatagtgtgctaatgtttctaagcatggctaagcaatcatatctaatatctagttgaaccaatatatataaagctcaactagtccaattataatcacccaaggtatcaaggaataaagtaatcgagaacaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaacactcccgacgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcaaatgaatttattaagaattttacaagattaaatctaattaaagcccatttaaaaagaattaaataaatttaattcaatttatggacaattttaatatgtagatctttattttaaacaacttttgcaacttgaaccacattaaactgagttaagatgaattagttatgaatttttaaagattaaatcggattaaaacctttatatggattttaattgaattatgacgcaataatgaattatttttgaaaaggaaaagaaggattattgcgtcagcggctagggtttcggtggaccgggcgcacgggcgacggttcacgggaacggacggccgagatcaaccctatccaaaacggacggctgagatcgatcggtccacgaccggctcacgggaaaagggacgatgacgccagcgatgacgtcaccgacagcggcggcggctcggcggagcggacagctcgggcggcgcacgctcgccggcgaacggcggcacttcggcacaaacggagggcaccagcacgtagaggacgacgcggcgaactcaccggtgaccaaaacggcggcggaagaccaacggacggcggcggcgacgaggaggaagcggcgaagctcttcgggtcgacgacggcgacggcgctccgacggtcttcggcggcggcgaagcggtggacggggacagcgatgacttggcgaacccgatggtggcgacgtgtcacgcccagaaattctcgaaccagaatttctaagctgaatgtgcattgaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacagacaatccttgacggcagcgacgaaaccaaatttgacaaaacagctccaactaggaaaatcttcagctctggtgtgggggaaaagagagcaagactgagtactacccactgtactcagcaagtcataccggtagaggaggtatgatgcaggatataaccaaaggaggctagaggttcttttgcataaagctagcatttaaaagcagtagttgaaagcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgctcaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacaacccaccattcaatgtattttaattaactaataccattgcggtggcaccaatccaaagctatgctcatagtcaaagtctatgtaataaggtgatccccatttgtgtgctagttgaactaagcatggctaagcatttcctaaaccaacatctagtcattttgatacccaggttatcaatggcatatggtaaacaataaatggctgagtaataggacccattccacatgatattgtaaacgaatgcaacatttaatagaaatgcgggatatttgtaaattgggtacaatatgatcaaacgtattgcatgacttgccttgctctcgcactgacgagacctcagcaacgtcttcgagaaaccgtggatcgacgaaacggccgaaacctacgcgacaaacaaagcacacaagcaaaacaggctataagactactgaaacagagaacaaaaccatttttaatggattctacacatttttcttgatttactgagacttgaatgggattaaacggagctcggatgaattagatatgaattttagaagattcactgtgtttattactataaaagaaatccttaaataatttattgcgcaatattaaccagggctgacgtcagcacggaggggtgcggcgccgacaggcggggcccaccggtcagcgaccgggagagagagaaagggggtggcggcgcgcgggcccactggtcagcggcacgggggaaaggaggggcggcggcgccacgtggcggccgaaccgacggccccgatctacccaagggtagatcgccccgatctacccaagggtagatcggacggcggcgggacctcgcggccggggcgcgcgggcgcggcgcgagacggcggcgaccatggcgccggcggcgcggcgcccacacggcggcggcgcgcatgcggcagcggcgcaaggcggcgaccgaaggcgaccgaccggcggcggggagcggcggctagaggaggagcggcggctacgcggctaagcggcgcgcacgcggctacacggtacggggaaaaggagaaaggggagggggaagcctcaccgacaacggtcgacgacggcggccgacggaggacgacgacgacggcgggacgagctccggaacctcctaacgaacaaaaggagagggattagagagagaggaaagagcgtgggagggcgagagcgccggccgaaggcggcggccatggcgccgcttgccggcacacgacggggatgggtctccggcggcgaacctcgacggggaaggggcggccgaggtagatctcgaccccgcgaagctaacggcggcgacggcgcgagacggcgacgagcctagcggcggctagcggcggtcggagtagcaaaagcggcggcggcgggtggttgcacggcgcggaggcgatggggagctcgggagagatcggcgaaatggggaaaaagcgagagaggaggacggcgatgcttaaaaagggggagagggagccggacgtggccgggagcggcgggattcgacggccgacgtgggggagtggggaggagagagaggcgggattcggttttcgaatcccggccatctcgggcgcgggcgcgaacgggagggagaggggaaagggcgcgggagacgcggcgcacgcgcgggcgtggccgacgtggcccgggagagacggaggcgtgggcgcggcggcggtttcggcgcggcggcgcgccgggatcggcgggaggtgggggaaggacccgacaggtgggccccacctgtcggcgaccccgagagaggaggcgggcggcggctgccaggctgggccctcggcctgcggccggcccagcaaggaggagggggaggaaggaggggaatgggccggcggcccatccgaaaagaaaaaaggagggaaaaagggagggaaaagaaaaagaaaaaggaaaaggattttccctggaattaaaaattgcactttggtgatttttaattggttaaaattatttccaaggctctgaaaaatccactaaaaatcctgttaatatattgtgacatgtagaatccaagaaaaattccacatgccgattccgattattatttgcatttattaattagggaattagctctaggttaattaagataatttcttcggacgatttatttagccaaatttttaaagcaagcaaaaaggggaaaacttcagggcgtgacacgacggcgaccgacgacggcgactgcaacggcggcgcggcgcggctgaaccgacggcaacgacggcggcgactagggctacgcggaggcggcgctagacgcgacggcaggctaaggcaaaggaggcgacgggtagaggggagctcgggggtccttatataggtgcaaggaggcggcggcaaaggcccacggcggccggcgacgagaaggaaagctcgcggcttgaaggaaagaggccgatccgaatcgaactctattccacgaacttccaaaacgatttagccgatgtttccaaaggagaaaaggtagaggagatcccggagattgtttcccctcaatcaattcggccggagaaggaaaggagcggccggatttggaaggaaacggcgacggcggcgcgctagggtttcgggcggcagcggcggctcgaggaagacgaacctgacaggtggggcccacctgtcagcggctgagagagaggagagcggcggctcggcggactgggccggctgggccgagggaaagagagagaagggttttgggccggctttcggcccaaagccaaaagaagactttttaaaacctttttcaattaaattatttcttaaatgcaattccatttattaaaaatacttccttagctcaaataaatcccagaaaaatctaggaattatagaattaagcaaagtatttaatgaaattttatctggcccctttttatattgagatttagcaaattaaaattagatcttctcttttaggcttttaaaatcatttctaattattccttttaaacaacaatttataagttaaggatttttaaacaagaaaagctcttaacaattatacttagatcattaatgatcaaataattactgaactgttctttgtattatttaagaattgagctctgaaaaaaaaccgagaaaatttcagagagttgacttaaccatggagaatttaacaaaaattaaatccatccatgctttagatttaagaaatttttatttcccacattttacttcacttgaaaattaaagatcatttaatataaattctattaataatttattaaataatttataaatcctgaaacgaaaatcaggatgtgacaaactaccccccttacaaagaatctcgtcccgagattcggaacggctagaaagaaaagggcataggtaaactgcagtctatcttattccataactccgataattattctaaggctttaaagaaaactactgctgctttgaaactggtggctgagctgcaacacttgaagacacaactcttgaagacgcaactggcactgcattggctcctgtgacgacaatgttgttgacctgaccttgcggctgctgatgcttcggcttcggacactctcttgcaaagtggcctggcttgtaacagttgaaacatacctgctgcttccttccactactgttattctcctgagactgatcctgctgaactggcaccggctgattagcttgcttgatgttaacttcattgctttcattagtctctgatttgatctcaccaccgatattcaactgttgcgattgtccttggccagcggaaaaaggttcaccaatttggagtggcttgatacgctgcctctggctactaccttgtgcctcctggaaaacagtcattttccttttacggttatccatcctgttcttcttgtcttcaagtcgaattgctttgtcaaccaactcctgaaaatcctcatagtcatgagagatcaacataactgatagctcatcctttaagccttccaaaaacttctcctgcctttcctcgtcagtacgcacatcttctggagcatagcgagctagacgattgaactcatgaagatattccgtcacggtacgatccttttgcttaagtgcccggaactcacgcttcttcaaagcaacaacacctgcaggtatgtgtgtcttcttgaatgcttccgtgaactccgcccaagtgattggttgtccttctgctctgttcatccggaaatgatcccaccattctgatgcaggtccttgcaactgatgtgaagcgaaaacaactttctcctgatccgtacactggagcaattccaacttcttctcaatagcgtgtagccaatcacctgcttccactgggttggtagtgctagaaaaggtaggtggcctcacacgaagaaaatcagctagcttgttctgcggcggtggagcattgttgttcccttggttgagctggttctgcatctgctgtatcatcatgttcattaactgagtctgttgagccagaacttgagcaagagttgggttcccttcattgttattgtttccacttcgactggcgcgagtgttcaccatctattgcagattagagaagataggaggagaggggttacactaaagacaagaccttaaccatgttaccactgatctggtgtgtgtagaccattatattgttcaagttgattaagcaagcaacctagtatagttacacactcatcaatgaactactccaatgatggaaatgcaaccatacctacacacaagcaaacaacaaacgttctaccctactaactattcttcaaagacactttggcggcataggttctaaggtaggatccaaacttcattccatcttgaccacttggcacttcagatcgaccatcaccttcttattcatcgatccacttgactgacctccataagtagacctcactggcgtcttcaagtttcaacaactagtttcagaaccacttaagttgaaagcaggaggggagaggatgataaaatgatttatacagaattctagagaaggaagaaaggaaaattttcacaaatcatgttttcagaaaatttgtccttaaggtttgaccatttggcttatcctacagtcgagatggctctgataccaacttgtcacgcccgaaaattcacaagtaatttccgaacttatttgtgcataaaatcctcgtccaggaatcagccgaggtacacaaactgacaatttaatatacagattcatcaaattaactaaaacgataaatacttacttaagaggcacttagtcctcaccaagaagaaaattgcagcggaaaataaaatctagcgaagctccggctccactcccacaggcagctcaactggggtataagccaaacgtcttctccttcgcaacttgtcttcaactgaggttgattgattattgcaaggtgagcatatgacatactcagcaagccacacagcaaatatgcaagtgcacaaggataccaaaggaatggcataatattggctcatttgcaaaagcagcatttagcaaaatatttaagagaagtaaaacagtggagtaattaatcagaaattttaatcaacactgaacagcacacccatgctgcacaggcccaaccatcctgaacaaccatacccggctgaacagatctaactccaaaccaggagctaagcaaattattatcaggtataacatccataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatttccgccacttctcagtctggtgctccgcaatgaaccatgctatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgagctaccattaaaccatcattaaataataatgaatcataagttatcccaatagtgtgctaatgtttctaagcatggctaagcaatcatatctaatatctagttgaaccaatatatataaagctcaactagtccaattataatcacccaaggtatcaaggaataaagtaatcgagaacaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaacactcccgacgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcaaatgaatttattaagaattttacaagattaaatctaattaaagcccatttaaaaagaattaaataaatttaattcaatttatggacaattttaatatgtagatctttattttaaacaacttttgcaacttgaaccacattaaactgagttaagatgaattagttatgaatttttaaagattaaatcggattaaaacctttatatggattttaattgaattatgacgcaataatgaattatttttgaaaaggaaaagaaggattattgcgtcagcggctagggtttcggtggaccgggcgcacgggcgacggttcacgggaacggacggccgagatcaaccctatccaaaacggacggctgagatcgatcggtccacgaccggctcacgggaaaagggacgatgacgccagcgatgacgtcaccgacagcggcggcggctcggcggagcggacagctcgggcggcgcacgctcgccggcgaacggcggcacttcggcacaaacggagggcaccagcacgtagaggacgacgcggcgaactcaccggtgaccaaaacggcggcggaagaccaacggacggcggcggcgacgaggaggaagcggcgaagctcttcgggtcgacgacggcgacggcgctccgacggtcttcggcggcggcgaagcggtggacggggacagcgatgacttggcgaacccgatggtggcgacgtgtcacgcccagaaattctcgaaccagaatttctaagctgaatgtgcattgaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacagacaatccttgacggcagcgacgaaaccaaatttgacaaaacagctccaactaggaaaatcttcagctctggtgtgggggaaaa

SEQ ID NO: 83367 - DNA, 1132 bp, Oryza sativa
tttttgaaaaaatttctagaaaagttgcttaaaaaatgatattaatctatttttaaatttaaaatagttaatactcaattaatcatgcgctaatacctcaccttgttttgcgtatctttccaatcttctctatctcctcctcaaacacagcctaagtgtcggtttattaggaaaaccgtcatttatattattagtgttggttttttaataaaccggcacctatataatattataggtgtcatttttttacttttagacccattgaagggtcgggaggaccgaaaaagtctcatactatgtgccaagtttagggcgtttcttatcaggagtttcgtagtagtgtgtgaatttgagcccaacatggaaaaaaagaataaaatgcactagtggcccttaaacttgtcataaggtttcacttagatccacgaacttgtaaagcgtacatcgaggtctctaaacttggtttaatatatcaaccccgtccaaagcattgtttgaccgtggtcttgtctacgtggcacgccacatggacgatgacatggcgttttttttcatttccccttttctttttcctcctattcttttatcttcttcctccactagagccacctcgagctcccccgcgtcaaagaggtcgaagaagagagaaatgaaagaggaagaagagagaaacaaagaaataataataataataataataataataataataataataataataataataataatgatgatgccatgccgtcatctacatgtgatgatgatgatgtgccatgccgtcatctacatgtcatgccacgtaagtaagaccacggtcaaatgagactttcattgggatgatacaataaaccaagtttagggtcttcgatacacactttgcaagttcatggatctagataaaatttgcttacaagtctaaggaccgctagtgcaatttacttaaaaaaaatagtaaggaccttttataccaagctaagttagactcctcgatggtgtcacttggtttcaggaggagcgactcagaacacagcatctacacgtgtgccgagcttcgcggttgatcgtcggcgtgtacgttgacaatctcatcagcaccggctgcagcagcaaaaaaaaaaaaaatcga

SEQ ID NO: 83368 - DNA, 26816 bp, Oryza sativa
gtatgaacactatccgtccgaatccgctccgttttcacccctattagttcccgttcttttcaaggtaaacattggagtagtatttcacaagcccctaaacaacacgattttttttaacaagaacttataagcatttatcaaaaaacatttttaaatcaagtttttaactttttaatatttaatttgtttgtttctatacttgagtaattaccataaacttactttagtaacacttcacaatggatttttcttaactggcactcacctcactaggtcaccggtttaggtttagcactatgaaccatagtggaaaaaatcggaccaatagatgacccggtcatcttgctggttcaccgatctgacagtccaaccgtgaaccggccggtcgtaaccaatcaaccagggatcgactccccactagcgcacattttcattcgatttttgcgaaaaaaaaatcaagcctgcgcacaagtatggcccaaacacactaactgggccatcgtgtggcacattcattcactaacttgccttagtctggtccgaccaaaggcggtttattgcccggttcatcacaaaacaggccggttcaagcgatctgaagcggttcaattgtacgtccggtctttctattcgaccgaaccattgcaacctctggttccggttttttcgggttaaaccgctgacctagtctgattttttccactatgaaccctaccagcactagaccgatctttggttttggcgacgagccttgagagtcctcttggccgtgcatctctccctcttatacaagtgctagtgggcttgggggctaaaccgataaggatttaagttggttgttaactgatcaaactacctctagttcttatctactctattttatgttaggaagataacggtggaattatctatcctttaaaagtcatatgaatttatttttaaatttaaaatacttaatggctcaccttgttttatatatgctcttaattttttcatttccccctactctcaaattaagtggttacttggctagaagtccgtactccatagtgatggtgtgtggcaaagttacgatcattcgctccattgaaccgcaatcattctacgagcaatccgttaacaaatctaacaagagacacaaagcacgctgaacagtgaatcggacgaggagaaaatgcatgataattaagcactagccataggcgtggaaccagtgagggtgacaacaaagtcaactaataaccggtgatctggattattaatttgatattcttagttccagctaagtaagttccatctgcccagctgttttctgggatcaagctgttggtttaatttgatcttccagaggtcaggtcaacttccttgcattgcattatgggagagccaacagttacacatgaccaacatctttttgtccataacttatggaccattagtacattatgctagtagcatttatatattgattgatactttcttttttcctgcacttctaacatggacgcaattgaatacgagtactaattaattcactcgtttgttgtaatgtagtagtactaagatatttgttgtaatgtaagatccgggaccttttgctttgaccattaatagcttagattgtcaaatacgaatgctgtcatcattcatcagtagatttgtcatcaggcatacacttgtgtatcgtgtgtcacattaatttctgtagttaagtctattacagagacggaaaggtatattattggcaccactaattcttccctgggacaaatggcacaatgctgaccggttgctaatcatactataatcctattgttagcacttagttttcaaaatcagcaagtctctgaaatagcatcaaacgatgcgtgggtacatcactgaacacgacacgtcggtacccactgcgtgatggtgatgcaaatgtacaggagcagtagcagcgtcggaattaacgaggtggttatggcgtcgtacgtgcaacgatcgagacgtgtagagcaacgccaacaaatcgcaggcaatgccgtggccacgacgatcccatgcgtgctagcgatgaagatcgatcgatgcctgcatctgtaacatcagaggaacaatcgatgaagagagctacatagcgcaaacagaattcagaatgcaaaacaggagaagaggatcctgcgtgcattacatggctcatgcctcatgataggtcacatgctgatcttggtaacttgtggttttaccagctaaaatgttggataatagaggatagatgaaggacaaacagaggatttaattagcattcctttgggattggcaattgtagatacctttggtttaaataatttgctaccttgattttcagagaaatgctatatattacctcttttaagggtggattcagtaaaaaatattgcagatgtcactaactagataaacaatataatgttaatgttttatttttctttgttctaaagaatattctgtaacgggattagcatagggtcattgatatcatctaacacgacctaatacaattggatgcatatccatccctgccccccccccccccccatacaatttcacatgaaaaaaaaaatctagcctagtctcttgataaggatcttgtgcacagagaagcttctagctctctctctctcatcgccactgccgctttggttcagctattgcaatgggcatatgtagacaacagagtaagaatgggctaacactggctatgtgtcgagcgcaaagactagggttgtgtttagttggatccaaagtttagattttggttgaaattaaagatgatgtgattgaaaagttgtgtgtataacaggttaatgtgatggaaaagtactaaagtttggatccaaattttagatttaaagacagcctagctatagttgctagtggagagctagcagatggatgtagtgattgaaccgagcgatgacataataggatgatagttggatgcatcgaacatggagaacacaatcgtcacttcgatcatcatcctcgaggtcacaacttctgtcacccccaacaaactatgcccatcgcgtcgtctttgagcgctttgatctcaagtccccacgctagttgacattgcttttctatatttgttatcgtctcgccgcattcctactgctattgttactcccacagtttatgcattgtcttacatgtactccataactctatggatgagtatacacttgtctagtgttgcttgccttggagtgcgcatgtagctagtgacaatttaattagttgctggtcaatgctctctattctctccttttatctcaacttatcttttctgtcagcatgaatgaatcataaccatctaaattatctgactgtatttgttcttatgtgacaatggccttcctgcaagcatatgggattgcaataaattattgtcaagttttacaataaaaaataagattaacatttccatatttcaaacactgtatcctaaaaaaaatctatgttttccaataatctgtttcacacgtataatctgattctaatttttcaaaattttctatccagcatttgaatggtgtttccggatgtcaaaactcaaaacacagcaacatgagagcaaaacacactgtaccaaaaagtcaccggttgcgttaaaacaagaaaaatacagggcaacctgctgaccaaaaggaagttcatcatcaaacacacaagacacaacttgcccctctatcccttctcaaaaaaaaaaaaacttgcccctctacaaaaaagagaaaaaatgcacaacttgccacggccggatacccgtggaatattcgcgccagctccaacgccgctgcggcgcatcgaacaccaaacacaggtatagtccccacctcgcaccctgccacgtcacccgctaaccggaagcaccggtggacgccgccgacacgtgtcgacctcctcaacacgtggcgcgcgcggggtggaaccgcacggctccacccgtcctgccgccacgccgcaccggatccagtggaagcagcgcccagtgtcacggcctccacgctgcgttgccgcaattatgcgtcaccgcgtggggcccactcggcagtgagaccatgcaggctccgctgctgctgtcatcgcgagaaagcgattagcgggaggaggagtaacatcgaaggaaaccactaatcacggattattttgagcaattaccgctctaatccggggcgataagacgagggaaattactaattaagggaggggattaaccggtaatggtctttggagctggagagctttgctataaaagagctccaatggcgtccctcacacctccccgcccaccattcccactttcgcccacacacacacccagatccacagccatcctcccaccgccgccgccaccatctccaagcccacgaacacccacagccaccgtgagctcgagcgaggtaagaaaagctttagatctgagcgacttcgagcgtcttcaaggtaaagttttctcgaaaccctcttcttcttcttcctcctctggctcccccacctgttcttctacggtttcttggttaggttgcttgcagagagcgagagacccagggccttttagatccagggctcccagatctgctgtttttctttcatcttctttgtgttctagtgttaggttggtagccaagaggggttctttttccacacctcacttgctagatctaccaccaaaaagccatctgtttttttactgtggctgtcgatttctccctccttcctgcctgttcttgattttggattcggaaccaggcaaatctttgttactactgttttagtatcagaaaaaaaaatcccaaaaaaaagagtgagtagatggctgcagctatagatctgtcaggggaggagctgatgagagcactcgagccttttatccgagatgcctccggctcgcctccggtttgttcccagtttagtcccacctcgccattctccttcccgcacgcgttcgcgtacggtggcgggctggcccagcagccagagctcagcccggcccagatgcactacatccaggcccgcctccacctccagcggcaggcggcgcaggccggcccgctcggcccgcgcgcgcagccgatgaaggcgtcgtcgtcgtcggcttcggcggcgggggcggcggcgacgccgccgcggccgcagaagctgtaccgcggcgtgcggcagcggcactgggggaagtgggtggcggagatccgcctcccgcggaaccgcacgcggctctggctcggcaccttcgacacagccgaggaggcggcgcttgcctacgaccaggcggcgtaccgcctccgcggcgacgcggcgcggctcaacttccccgacaacgccgcctcccgcggcccgctccacgcctccgtcgacgccaagctccagacgctctgccagaacatcgccgccgccaagaacgccaagaagtcctctgtctccgcctccgccgccgcaacatcctccgcgcccaccagcaactgctcgtcgccgtcctccgacgacgcgtcgtcctgcctggagtccgccgactcgtcgccctccctgtcgccgtcctccgccgccaccacggccgagacgccggcgaccgtgccggagatgcagcagctcgacttcagcgaggcgccgtgggacgaggccgccgccttcgccctcaccaagtacccgtcctacgagatcgactgggactccctcctcgccgccaattaacaccaccaccacttcttggctagtactcacgccgtcgttagcctaatcgtcgccgccgccgccgccgtgcagatgggattttagacattctgcaccgcacggacgggcatggattagcagttttatagtccctaatccttttggtttggttcgtttgtgtacgtagatcgatctctctccggacttgtttcctctgtagatgctagggttggttggtgttcttcctcaaccggagacgccgatgctaccggcagccggcgtttttgtgtccggcgtgcgtctccggtggccggtcactggtcggttactccggccgtggcgtccattgctcttctaaagtctgttattaccttctactgctgatcttacaggttgtaaacagtagtagtagcattattattattattatgtcttgtaatattattagcgtgttataagaacttgtaatgtgaattacctctactactactattattattatttagcgtcgttgttaaaattgttgtgtgtaatctttttctgatttcaccttccaacttgcgaagatctgcctgttgagttgcttgtgtgtgggggcagagaaacacttcgctttccagaaaggagaagacgaacaaactcgtctgtctgactgtctctgcatcaacgtcactggatttcggctagcggatgcagatctcatctcaacggcgcgaagcttcgggcgaagatgttcttcaatattttccgcttaattttctaccatgttaatccgaaagcgacgctacccgtggaccggtcagagtgaggctctcagcgggggcagcggcaacgacggagcacgtcgccgacgagatgctacgccgtaatgctttttttttcttttttcatcgcctgatttggatttcgcatcgctcccgtcaggatgtactacacggaatcgcgttctttagcctcggtttcaatgacaggacaccgttgatctcacgcgaacgtgccgttgcgttttactgtgtgtactacaaggaatcgaatcttgcaaggtatagtatgatatccgtgacgggcaacgacgataccgtgacaggcaggctcggtgcatcgatttcttcttttttttttttgatttgaatgttccgggcggagttggaaacagaggcgcgagagtggaggaattccccgccaaaaaatatcgagagattcgtagcagtaggtacagcacccgcaatgtaaagtaaagtgctatctataaaatatgtacatctcagcaatagactagattaatagtaaaccacctcaataatatgtctacatgggtatctataactctctcatgtattgccttaatatctttcaattagaaaaatatgctgacatggatatgttgtagagagtttatatataactgttgtgggtgtcataatgcacatgggtggcgggaaaccgcgtagcctcagcgtccgcgccagcgacgactctcgtactctctctctctctctctcctctcgtctacaaaaaggatgggcctcattggccccacccacgtcgccctctggatgagggtggcattgaatgcgtgtgttggtgggacccaccaccacgcaggaggtgggcccacctgccagtgtcacaggggctcagtacgcagaaagagagagagatcaggtaaaaatggaatggaaaggagagccgccaaggcggccacaggtgaaagccgacgacgaccacgaccaggcgtttctctgactagtgagtgatacactgatactcctacaattaactgtggtgctttggttggttgctttggcatgtggtaactggcaatgtggcacgcgcgctgtccgtcactagcgattcttgtagagtgtagtacaactatctcatcatattttcacctgatctaagggcccgatcgagagcaggccattagcacatgattaattaagtattagctatttttttttaaaatggatcaatatgaattttttaagtaacttttatatataattttttttataaaaaacacaccgtttaacagcttgggaagcgtgcacgtgaaagacgaggtggtggggacgtttgcccgtgggaacgagcgcacacttaaagccgtgaggcatcatcatcaatccggtggcaagttgggcttgtggcactgtctggctgcacactccagtagcagtagacgttactccttaggccatttgccgtgcatcaccgtggcgttctacaccgactcgctaaacttgggcatgtgttcttcgtcagttttagcaggcatgtgtcaaagcgaggcgaggaactggcgaggaacggtgcgcataacacgttgggagagggcgtgggcctgtgcttcgtcgctcccaacgcaacggtggccggatctgatgacgtcgatggcgtgggcatcggcggcctggggagaaaggaagatggcggcagcggtggaagaggaggcggtgaaggaagaggcggcatcatttataggtcctaacctcgttctcgttcccgttccgtaccgtcaacctcgtcgtcatcctccgctccaagccaccttggccagtccgcaacagcagcttgatgatggcctcctcgagtcctccgcctcccatgcttaccactagatccgtgccgtcccattctgtgccaccccgctccatgccgctgagcggccgtcccgctcgtagtctctgtctctccgagctccacgccggcgcgccggccaaggtaggatggacgccggtcgtaggtcaggggaggagtcctcggtcgccggtagggggaggagtcaggacatcagccggtgaaggaggggagggagccaaagtcgctggctcgttgtcgggagtgagtggaggagaggtcgagaggagataaggggggagagagacgggggagggaggaatttataattttgttttggagtctagggtctttggtataaattttgaacctctacccaaaatgaaaaaagtatgaaaactaaatcaaataagtggtagggactgaaatataaatttaaagccacacctaaaaccacaaattttggacctgtgaccctagcctatgtggcagtctgaggctcctcatttgactgggacacaatgtgaatggctttagtagtttacatcttttgattcttttagttaaaaacttattttatatatagagctctaagaaaacttacaccctctgtgctatgagaaactaacttatgagaattaatctggacaaatgtttatctaaatttatcttaaaaatagttttttttaactattctaggaatcaacgttttttctcggtgcaaaggtaatgataccgagatgtcttggtgtcaatatcgccaataacgttagcgttgacaccctagccccatgtgatagctaaatcattgacgtttagatgttggacttcgataacaggatcactagcgtcgggaaaaaaggtctaattttaaatatgtgcttttaagaatctatttacaaaataatttttaaaaggctcgaaacataatagaatccgacagtagtagggtaagtctggttgcttggctgggcttggcgttccatgacttctatccttgctgctacacgggaaaaatatacagtgcaaaccacatgacacatatgtagtggaaacctgaaagctatagttacataaaaaaatagacgtattcgtccacgtcattatgagtaaaattttgacccctaatgatggtagttctcgatgcaaaggtattcatacgtctattttttaatttgatggtagtttttgggtgtctactatatacgtaatttccggtgtatatttatactactctatgctgaatgctgaagtaaatgtgaaatggcaggcacaccagccactggacaaggaggtagggtcggcctcatctgcaactgatcaccggtcaccaccaccgttgggtaagtagcagcagcgtgtagtgggcaagtctcaaatacagtgatccttggtggccggtacaacattcttgatggcaaagtggttgctcacatacagtgatccataactagtgctttatttttgttgggaagtccaaatgatactcttttttgttgaattgaaaatagggccaattggtttggagccggtttttttgtcataccaaaatttagtgccaaaatgttggtatgttttagtaccactagattgatagtatagaatttgtatagtatgtgtaaaaattgatagcaaacaaaacatccatataacattattgaagttgccaaatttttttggtaggacaaagcactataaaaaaattattttcccatacaatcaaaaccaattttcgcatgtggttgggtcgccgcctgctagggcagcgcacctgtccgcgaaaatccgccttctgcgggcggtaaattatgtcgcccaccctcggaaagaaaaatcgctaaaaccctatctagctcccatccacaggtgacattaacactatagtctgctatcgctcgtcaccgtcgttgccacagaggccccgcagctcatactcatcgtcgtcgccctgcccccatgccttcaccacctccaccgttgccccttctcaccccggtagcagcggcagcgtggatccgcctgtcacggggatgctcgacagcggaacccattgcggcgccacccgacggcggatcccgcctagaggggagttagctgccgaatcctcgtgggagaggagttgagagagaagggatcgactacagtcaccgtcgccgagcttgagcacgctgtcagctgctcgggagggggaggcgagggagagaggaggtgagaaatgagagagagaagagggggggggggggttgagagagataaggatgaggaagagaggaggtgagaagataaggatgagaacttataaaattttgaagatgtggaaaggaagagagaaggacggtcaaacttttcgtaggcggacctcttaatcggcctcttgagataatgtattttcgcatgcagtctttgaaccgaccctggggaagcaactttgcatgttggcgcagtttcggcccgtcttcagcctagagggggtcttgtacagaaaaatcgattctgtagtagtgaagatttattttaatccaaacaagcccacaatcttaataaactttccaaccatatattatgtagagagaaacatgactagccaagtcggacatctcctaaatgttaaagtatatctacgaacaaccaatttgctcaccagcgtaatgtatgtcagcttgagcttcgaatgtttgtaatccatcccatccataatgtaaccattcgtggttgcaatggtgaccatatcctttactccttccctccgaaaaaaattaaactctaggatcatgtttttttataggacggagggtgtagatgtaaaccttagtaaagcaaatgtagagcgtttagataagtaaaaatattataatcaatactaaatcaaatttagtaagaaactagttaatcttttatcgtacacggtgtctttgtcactgacatgtggacccagggatcatcagacctacatttcagtgataaagtcatgatcatcaagcccacatttcagtgataaagtcatgtgacttcgactatagaggatcctgatccgattagttggcctctggcgtagcgttggtattggttgaataatcagtttaagtcttatctctctctttcatcgcatcagtatgtcttaacccgaaatcatacaaaataagtactgtatcaactttgccatatgaaaataacataatttcaaatattgttttcacctggaaagatgtgtaataaaaagttgcttttgtcaatggccttgggtaggttgtatcacccagagttacattctgcaatgtgacagtttgttttcttttaagacccaacgttttcgatgaccagagagagatagagtgagagagtcgttaaattgtggcccgtatattatccgtgaatcgttaaattgctgcagagcagaacaacgcaagaaaagacggaaacggtgccgccccactacgctacgctagtgctgttcctcctggtttttgtggacttgcagcaacgggcgtgcatttgtttatctgaattttctgattacatttcggcgtgcgctatggatggaggaggatcttcagatcaatccagcatccatcctttttctaaggccacgaattttcaggtttattcttctggatcatgttaagaggataattcagcgtcctaactttcagcttttctttctctgtgatcggctacgaagccaacggtttggtaaagaaagaaaaaggcaaagtctgctgctgctcatcactgtccactaatagtgaagttatggatcaaacatgatcagggttttgctgggggatttagcccggctaggcttcaatatgttgggcttgccgggcttcaatatggtagcaacaagaatgcagcctgtctggacaaagttgggagcctactcgtactgaacggcgattgttttttttaattgctcccactgatctatttatgttactatgtataactgatattggtactattcaatttcaaattttgacaacttcttttttccctaaaatatattataatacttgatatatattatgttatattaccaaagtgtgtatacgtagtgtttcatccatcatactctaatcattaaaaagcaatttattgttaaagtgagatgcatggtagcagttgacagtgtcattacaaaattataaagatggtcattatgctttaggctttatgcaaacaattaatatgctatattcggataactatatgggcggtcaaaatttggtacgctaatatttttaatgtattatttgggtaggtaaatgcaccccctttgattataaatatttttcatatttgattaaactttaaaatttataaccaccaataatttcataaatatttagtttaataaaaaaaagacactaacacagacacgtctacctgtgttacatctataacgggttcaaccagcaattacaaccaattggttaaaacgtggccaatcatcactaacggttggaggccctttacatatgaggtggctgatgtctataattgcttctcaactggagccgttacagataagtgctaatccctaatggtttcaatattgcccgttacagatgagtgatttgtaacggctcgcttaggcccatcgcatataaccgttacagacgtgagaatctaagctattgaaaataatataacagagttgccttgaaaagatatatattatactttataaacatgctttaatacaaaactactccctcagtctcaaaataagactcttttacttcatattttaaactagatgggtgcttattttaggacggagggaataataattaaaattttaaaggtttaatcaaattttattttaaatgttaaatatttatgatagaagaaagcataacattcttacctaggacacatctgattttggaaataaataaatatttatgccccaaaattggctcatggttttcacaaaaccagtgtaaacaaccggctgtctagatcgtagccatgcagctagctggctgccagggatcagtagaagtactctgtgcagtgaacagggtgagccatgagcatcatcactgatggttctttttgagtggctaagcatgtcactgggatagcccatgatcattctggatgcaatgcatggctagcttcaaagtgaataaaactgatctagaaacatctggttcttcatagccagagaccaggctacaccatataagagaccactatgtactttcttggtcacaaaaatgatttgcatgctcaactaacatggtcctagatacgctctgctgggtccagagacaagtgtctagatcgtggagaggggaatttcagtttatgggtccgattccattgtaaggattgcccccaacaccgttccatcacaatctagtgaatcttgggatttgatctaaggaggatgtctctactcggatgtagcacaacagtttgtttctgataagagatttgatttatagagtggactctgctcgggcatactgcaaacgttttattctgattagatagcttattcttttaggagaacacggaataaagggacatatatatattctacgcacatcaccctcacacagatcaagcttagaaattgctagcaaaacccaattgcccattgtatagctcacatatatactatcatggaatagcttacacattgaacatgtgtagcactaaaattggtttgtgccaaacttaatggcgcgacttaaaattggagtaatattctatttagttcggactacatcgtcgaatgataagtacggtatcaagtttatcgaaggtgatgttttagaaaccatatgtattgggtgccacaagttattcagatttgtttcagttttttttcctttcttatttttcctgcattcctagttagtgcagatcgaggacatataagtattttttttgtgaggatatatgtatttttttaacttaataaaatctgcattatctcgttctattattcatcgtctgatcacatgcatgctagtttctgataagaatagtctttcttcaatatttgagggaggagaggggattgcatatatgcaagtgcagaatttctacaacaggatgagttgtaaagcgcataataattcaccgaaatataagaatgcacacatgcaagatagatcgagaattggatagatccaagaatgctcaggttggtatgtattaagtccattgttgtggtcgtcccagagcttagctattgtccttttaacaaattctaatccccttagctttatcatcaacttgcatgctctgcgtgtgcaagaggattccagaaaagaagaaaaaatgtgctagagtggttgtattaaggtagcagatttggtagtcctagctttgcttgatccattgctttaggccatgaaggcatataacggcagggataagcccagattagcaccacatgacatggaagtgaaaggcgtgtgctcaccaaccatgtaaccactcaaaatctcacccttttcttttgtccacaaagctttttctatatgcaactatagtcttaattaattaattcaacaggaggcatcttattaccatttgaaagctagatatatgaccaggaggcatgcatgtacacatatatagctagctagctatttgatttgaacaatataaaggccttgataagtgctactaatccataacaacactagtagtatccgggttctcaatcacattgtggaccattttggcatatcattttgtgcgctcaatcttgataagtactcccttaagtttttgtttgcaacgtttgaccactcgtcttattcatttttttttgaaattattatttattttatttgtgatttactttattatctacagtattttaagcacaacttttcgttttttatatttaaaaaaaaattgaataagacgagtggtctaacattacaatcaaaaactcaaaattctgggacggagggagtagttatttgtgcctttaatctgacatgctagaagggggtagggggagtgtattaattatattgtgtaactcattatctgattgcactaagaacgatctagctttgcttggcttgatagctgaactgctgaagtgcatttgccatggcagccatgcaaatccatactgttatactagtttttattatctcatactttccaaaagaaaaaaaaaaaggcctttactctccagcttttgttttttttagaaaaaaaatgcaggcatttgtcgttctttggccccacttgtcccaggttaatgtttgggatttaaagttttaacctcatttccactaggacattacgtgttgctttgtatccatcgttagcagagtagagagtgtgaatcaagcgcacatgggttaatccagaatttcagatccatcatccttgtgcaaaggaaaggatatatgatttcaacatacacaagagctagtgtgaccagtatagcagagtgtgcaaattacccccttccccgaactatcgcggtcgatcgaattaccccactgaactcgaaaaccagatatcgctcaccataaactttcaatactggacaaaagcaccccctaactcaacatcgcagtggttttggtcctaagtggcagtccagtcaacaatttttattttaaaaatggtggggcccacctgtcatagtctctcctctctatcccctctcacctctctatctctctcgtctatcgctcgctcaccgctgagaatgagtggagcacgcgccggcggtggttggcccgacgcgatgggacggctacagaagccggcgaccgtggaggcgaaggcagcgcggtcgaggactagcggttgcgagtctcctcgaggcggaggccgaggatgaggcgtgccggcggtggctggcccatcaggctcaccaggcctcgtcctcctgtggttaggggagtagcggccgacaccggacttacgcaagaaggcagccatggcggggaagaggggaaacgcggtggggcggctgcggaggccggtgaccacggaggcaagggaggcgcggtcggcggcaaggccgaggcagctcggggtcgcgggtgagcgccgtcggcgggtgaggcagctcgaggtcacgggtgagcagcaaagagaagaggagacgagtggttcaccgtcgccattgaggtcactgttcggcgctgaggcggaagcggtggcgctgctaattctcccttccctggagacggcggtgaggcctccccccctctctctctctctccctcctccttctccactcaggcaggcggtgagcgacaaatcctcctcggggaacgcatggcgcgcgtggtgggcagggcgaggcgggcggcaccgaggacattggaggcggcaggctatcgtgacgagtttgccgcccatccccgtcgtccccgtgcccgattgttcctccgccgcctccgctccaatctcctctccttcccgatgccctcgccggcggctctaccccactggtcccgtcacgacgtgccctccgcaatctcgccgtgcaccagagggaagaaagagagaagagagattttagcagtactccgactgccgccgcatcctctgcgtgctcgctacgccgcccttgtctccgcctccatgccgctgccggcacgtgccgccctcgcttccacctccttgccgctgccggtagtgccgctctactgtgtcgctccgtctccccctgccgccgtgcgctttagaaggagggagaagagcgccgcgtcgttccctctccccagccaccacccgctttagaaggggatggagaatagagaggtggtggggattctaacgagtgggatctagcgattttttttaaaaaaactgatgattggactgtcacgtgtgctatttgaatcctaaaccgcttgcaacagtgagcgatatctggttttcgagtttagggggtaattcggtcgatcgcgatagattaagggggtaattcgtactttcctttatattatggattgagaacaagaggatagcttattcttcaacgcatccttgtgacaatctcctgcactcccagataaacagatcatgcatgagcatatatatcgatcttgttagaagatatagctagctttgattgtcagtcaaagatatggctccctttttatcaccatcacagtcaggggcaacatggctagaggtcacttcactatcaaaggtcatggatcgagtatactgatccacttttaaatgccgtatccttacatactccctccgctccaaaagtctgtctaaatttgtattgtagtactaaatgtgttatatccatccaaaaatctttatatatttggatggatatactacatacattttgtcctttaaaacataataactaataataactagaaaggtggcccgcgcaacgcgcgggcatccatattatttaaatataagattatattttgttcgtaagatatatcttataaattaagggcaactcaaggtcacacgtatctaaaaaatcattcatcgaaattttaatagagaatagattaaggtcacatgacatttgaatcaactgaataataaaatgctgctaggtaattatcatctctatcatttatacacatagtgtgacagtgtgaaatatgtctaagctaaacttgtgagagtaaggaaatcaaagttctttggattgaatcgtctcattaaggcacatgatatattgacaaccaaattaaggatagatcaaatgtttgattttttttcctatgtagaagttcaacaaattcattttttttcacagttttgaagaaatttaatggtatgttcagacacatatcactcacacaattcattggcttggtaatgcaaaatattagcaattgtttcaagataatttctttctttttttcatgcttgattgttttctttgaaacaacatttgtttgaaataagatcaaaattgtataaatttgattagtatgtgtagtgtacttatacatttgaagtgttctatagtaaagtttgcttttgtcatataatccaattgtatcaaataatattgttttatcatgtaaattataatcaataagttcaatatgattcatatcatcataattaatgaaacttagttaaaaaatatgactacctaaaaattattgttcgcttattttgttttttttctccttacttaatggtgcctttgtcattactctgaatcaaagaaaaagtggcacatcataccatggctcatatatagctataagctattactctatgtccactcattgctcagtagtgtccttcactcaccgattatcttgtgatagtcatatagacaatatttatcaatttgtttagtttacataaagggcaacaccacattgctcctttctcatgcatggtcatagagtccaaaatgatttttccaaataatgctctgcattaacacatgtatctagaacattaactacataacatatacgtgtggaacacatggtagttttcgttctagattcacccttatttacatacatgtaaagagtgtaatgacaatcaatactgacacctattaacaattgttatatacctaattagaatatgtcttaattatattcatctcatgactctgactatctttgatcaccttgagtagtagaaaaaaataattgtactgtgggtttaggatgggtgaaactaatggattatttgatttttatgatatctatttgagggtataaatgaatgaattaacttatacaaatttgaaatgttgttctggaaaaagcgctttaagaaaaaaaaaatagaattgttttcccgaaacacatcttttaggaacatgggaaacatgcaaatgaaaatacaaaatctagatcgaaaaggaaaaacagggagtaagactcccttatattatataagtacaattaggtaatcaacccttcgttttagcttacatagagttgcatgttgcaaaaacttaacccaatggacttcattattttccttctgcaatagtcgttcaatttgttttcactttattaacaaaacaatcattatccattgatgatttgttgtgtcctcaccttggcaaactggtacggtgtggtgatcgtgatcaccttacttgcctcaatctggtgcaccgcattgtcgtggcgcacgcatgcatgtgttgtgtagaggaacggactgatgtttttggaggatttttttagaaaaatagatctgatggtttattatctatcaatttaaatgaaaatcgatagtcaaatattttagcaacaatatagtctcaaatattgggcccacttgttggtttaaatataaattagtcgatatagattataaattgttaatttaataggtataaaatataatggtgtaaaattcaaacaattttatatttgaaaaaaaaattaatccaccagttcaagtaaaaaaattatcttatattattaatttaataggttaaaaatacaattttttaaactttacttttaaacattatagagctaatttttagttatatttatttgtaaagagttaatttatgatgatatatatagtctatgtttgtaaaattataattattttaaatttattatcactaatataactgttttatcacatgtacatggagaaagttggaaaggagagagaagcagatgtatttttttaattgatgtatataatttgtgtttttatgtttttttggctttaatcttcttttattgatagtgcgttacttacgtactttgtattttgggggtttttttttacgatcagtactttcgtgaacgggagattataagatggaagttttttaaatagatctaatctaacagtaaataacagatcaggtgttttgcttgtgttttgcttttcttttagaatttataggaatttctttaatttattaagtgccacataacagcttgagagcatttgtataaaatttaataaactttttatatataatagataatagattgataaatacataattgaaatatagaatgataaagagtgttgattggatatcttatatacgatctagtttaaccgcatatatttatagagcgatatattttatttttaaatagtagaaaatcctactttaaaggccatcaatttttttaatgacactacgtacgtatgttttttctttactttatcgcttttatccggtgaagagtagataattaagcttcatcgtttttatttcagatgtatgtacgtactgaatactttcctttttcttttccgtcccacaggaggaaactattactttttaaaataatacatctaatcgaatggtccataatatcgggtccaccaattttaatgaaaatcgatgctaagattaaatacgtgacgacctaggagtgtttctaggagcgccacatgatggcttaacagtgtttgtaggaagtttaatggacttttagtatataatagatagatagatagatttctgactataaatttagacatgggttattgaggttcatagctagatttttttttaagatggcttgagtatatgcaacgagaaacaaaggcatgcatacatgtcatcatttggttaattagactattgcaacttgcaatagctacctacctgatgtacgtcgaagcaagtacaagttgcatgcaagctttattgtctgtgtctgtctttaagaaaattaaagcagggagactctaggatcagaaagaagaataagctgttcaaaatagaccaactgttcatgatgcttttcaccttcctttcgttaattagaagcatataatcccagagatttcagcgtcaaggggaaaccatttgtagcttggtagcacaggttatataattaaagccaccaaccaatcatttgggctaagatcgagcgatactgttacggtgctgttgcatttacttttgactaattaatctgcgagctaccaggccaaatggatcagccccaatgattaacaacgctcatggattggaactaattacacagattcatcccgatctgcaggtaacaaaaatatgcgaacctttctgcagccaatctatgcaatggtacagaagtgtaaacagataattggtggcttgcagagaagatgaatctgaattatataagcaggttgggtgcttcttgttggtggccatgtgagtatcagtatgtgacccaggatgactcggatgacacagctctgctcgccgaccgatatgaaaatgacggtgatcgactgcgactgccaccagttggcggcggccgaacgagaccccccgcgtcgttcctcgtcgtcctccaccttcggctccctgcttaaactgcttcgccgacctgttaactatttggcaatgtacctgtgattggctccctttcctaaaccttccgatcctgtttctataaatcggttgagcgttctatagaagcttgatgcctatttgtacagctaccatgtatcaacatgcatgattatcgcattgagctgtatcatccaacattccctgctccggcggacggccctgctcgccaagccctggctctgttggtctctgcctctgtctcaaacagatgttgttcgagccattgactggatggctaaaggagaacagagagaaggaaggatgataggacgacaggtgggccctgtaaattcattattattatttttctgattgggatgtcatgttggcaccacgtgtaccagtttaagtcaagacaatccataagggataatttatccggtacaaaaagcttagggtgtaaaatatttggttttgtattttccgggggtaaatcggattggcacaatagttcagcagtgtaattcaaacttttttttttaaaaaaaagttgttctactattttttactctctatcccaatataactgcaacatagtaaacataggctctatttagttcacaccaaacttcctccaaactcccaacttttcatcacatcacatctaaaacttttctacacacataaactcccaactttttttttccaaactaccaactttccccaaacttctccccaatttcaggaactaaacacagtcatagtatagatgtgatatttgtactaggttgtatttatattgagacggaatgagttttaaagatagtcaattcgaatatgctaccactcggtgacaatgatgcatataaaaccatctatgtaccctctatttaggggggtttgagattctgagaattaaccaatgataatcacttagtaatcaatttagcgaagctgaaaaatgcctttagtttatttttattccacagttgctgattcttcaaatctagattgtttggagtagctgtagagatttactaatacacattgtgctgcttgaatctttttcaaacatgaccatagactagatgataaataatcatgatctctctttgccggagcaatggagggactgggagaacacataggtgagagtgagtcgatcaaacgaaggacatggggtctgtttacttcttgccctgaaaatcttgcctgactcagacgcaattctccgacatctaattttgtgtctgcagctggatcgacctgcctgagcgagagccctcaggtcaaccaaacaaggccatgatcccccgccgctcgtgggcgcacgcacaggccatgtgacccatgttagtaggccgccgcgcatcgatctggacgcgcgactgcacctacgacgttcgcctgaatgcaagcatgatgcatgcacccgtagacgttgctattggagatatatcctatatgcagtgtagtacaagtactatggtggtagtacgtactatattttgctgcttttgataacagaggattatgagaaaaaaaataccagtaagaaaaggaaaagaacatacgtgttcccagtagattttggttgccaacagtgcgatgacatagtaattaccggcgaattaaccatgacaagctgacgcccaatggatgaagtggccgagctagcactgcagattaaacaacaaattaacctgcaatggccaactaatttagctagatagccaagtttccgtgtcagccatgtgcgcccgaggagggctaccttgtgcagctgccggaggatcgatcaatgcagacatgcgcacattcatgcatgcagctgcaggagcatgcaacggcggctggtcttaattaatttgctgaattgagctgatctgcatgcatgaacgcgtgaaggcacaggcagagggccggccgttggtcgcaatgcagaggcagctaggcgcgcgtacagtgatctgcctcgataccgcgtcgatccatccatcggctggtccgtcgtccgtccgtccctgtcgcccacgccggagcctagagatctgtcggcctttgggcagccacccaacagtcaagcgtcgtgcgtggtggctggaccattttctcgtagtaccaaactgcgtaccaaaccgatcgatcattaactaccttcaagagtactctctttactgtactattcataatcggaggccgtatgtcgactaaatgctgaggtggagaaaataagaaaggagagagaggtgaagcgggctgtaaacttacagtcggcttggatgcaagaaccaaaaaattctgtgagagagacaagtgcgccatatattaattgtaagagtaaattgcgttgacggtacaagaacttggcgggtgggtgcgattaagtacaagaacttgaaaattagacatatcgatgcaacaacttggctaggtgggtgcgtttgtggttcaaaagactgccacataagattttttgccacgtcagctttccaccttggacaaagtctacgtgagggccctttacacatcatattaattttgcacaaatcccctgttgtttttcccatttgaggacattttctagtacggatcaattaatcaccatgagggataggacctcaaatatgtagcttccggctgcagcggtcggtgggactcaaagccggcgtgcggcagcagtcgtcgggactcaaagctggtggcggcggtcctcgggactcgaaaccggcgtgggtcagcggtcgatgggacacgaagcccggccacggcagccgtcaggactcaaagccagtgcagggggttgttagacctcgaagccaccatcgctgcccatggccgtagtaggttcccttcaactgatgagaatctgaaccttccatttttttgtgctgtaattttatgggattcttcgtccatagtggaatcagcatcatgataactgcatctggtgtaccacagtgagaggactctttgactctttgttgctgtcaaagcagtatgtgagtgaataatggcaatgtaggtgcttttgtaaatactctggaagtgcttttgttatataagggatacatgaattttttagctacttaaatgaatggtgaacacgatgtagcaaatactgcttgtattctctcttttggaattgtatgtccaagtgataacctgaattttgctaacattgctttgaccagtagcaatttctgtacagacatatgtggtatgttttcttgtccatagacaaatcctggcagaaatgtgctcctaatattctgaaatgttttaccataaatagctgttgtataaacaggaaaaacaagagatgttcctgaattggaacttagagcaatgtaacagagcacagtccaaaatgaaacatgtctgattggttggcaaaaaataaacagaacttctggctaaattataagctaatcctttttatcaagttgaatatattgttcactttttctttgtctcctcccttttcttcaactctgatttcttattgggttgcgtatttctcttccttggctcagcttttctcttccgaattgttgccctgccctctttggttgctgtcgttattggcggctgcactgcagcttttcggtttgtggcaataaaatttgattccggcagtggaccaaggtcaaatctagaagagttgtttataatgttctgcagaaagtacattgaaattgtgaaaactgttttataaagctataaaatggaaaattggcaaagcattgtctaacctctctcgtcaaggaagacaatatggtattttgtaactgatcatagctaggttgtgtcacgcccagaaattcacgaaccagaatttctaagctgaatgtgtattaaacccctgtccaggaccagccagggtacacaaacgacaattgttgacatacggatccacgtcttacaaaaatacaaaatattacaaatgcagcgaaaaaggtaaaagcgagctaagcctgaagacttgactcctgcagcgggcaattccattccacaggcaacccttgacggcagcgacgaaaccaacctcttcaagacatctccaactgagaagaacttcaactctggtgtgggggaaaagagcaagactgagtactacccactgtactcagcaagtcataccggaagaggaggtatgatgcaggatataaccaaaggaggctacggggttcatttgcataaagcaggcatttaaaaccagtagttgaaaacagtaaaaacagttgtagtaattaagcaatattaaccagtcactgtccaacgctacgccacgttgcaacaggcccaaccaaccacctgaactacaccagttcattaagctaaactaggggtgagactaatcacggtgaatctggtcgaccacccataaccgcgggcacggctattcgaatagttttactctgatcagaggtgtacaactgtacccacaagacacagccccacgacacgttcccatgcgccgacatgccaccacgacataccggaaagaggccgtgacaggacctttcgcataaccctttttaaccgatagcaccacaccttagggttcgcccccgtccccagcaggcaacgggcagcccccctttcgtgccgcggtgaatccggaagccgatcaaccggacaccccggccgacccaactccatcacgcccaccctcacctgggtacgtcggctagagaaaagctacactacaagcccagccgttgcccacgctggcttgtggtaagtacgataagttcttccagggcatcccgcgaaccggtccttaatcgccatgggcacgactagcaaaaccatgcacccacagcccaccatgtagtgtattttaattaaccaacaccattgtggtggcactaatccaaagctattgccaataatcaaagtctatgctttaatgtgatccccttttgtgcactagttgaactaagcatggctaagcatctcctaaaccaatatctagtcattttaatacccaagttatcaatggcgtaagggaaacaacatatagctgagtaataggacccatcccacatgatattgtaaaacaatgcaatatttaatagaaatgcgggacatttgtaaattgggtacaatatgatcaattgcaatgtatgacttgccttgctctcgcactgatggaaccacagcaacgtcttcgagaaaccacgaatcgacgaaacgggcgaaatctacgcgacaaacaaagcacacaagcaaaacatgctataagactactgaaacaggaaacaaaaccatttttaatgga

SEQ ID NO: 83369 - DNA, 666 bp, Oryza sativa
tggacatcgaatgccactctttaaaatggaaaaaaaggagtaatcagctgtgacacgaaaaaaaacgaatccttttgtagctcatcatttattggaaaatatatatacatatatatatatatatatatatgtatgtatatatatatatatatatatatgtatgtatgtatgtgtgtatgtatgtatgtatgtatgtatggcgcaagagttcctcgtattatccttgtcttaaactatatggcagtttatttttcacataatatttgatcatttactttattaaaagtttagtacaaacaagtagcgcagctaattaagggggttgccaaaggccctatccaaataccaccaccactacacccctcatatttttactttatattaaggttagctaagataagtatatttatctagtttgtttttgtatagcttgaaagtattatcagtttagttagttagcaagtctaaaaatattagcaagaaacatgatctacaaaattagtttgtgaattctcatctttttcaaagtaaaatagatggtacttatttgtgagattattcaatagtttacattaaaagaatttagcaataaagactagtttcaaactttcaatgatatcattaaagagctaaaattcatgtttttttaaaggactactttacgca

SEQ ID NO: 83370 - DNA, 922 bp, Oryza sativa
agtagaagatagtgcaattaatgatgattttgccctttcttttgggattaatcgtgcacacgtcagtccacggtggatgagtttccggttcaacaggacgataccgggtgctgcatgtgcacgcctgacccttataattaaatccttataacaccgtgtacaggacacattcatccatctttaattagtttttttaattctaattgcatgcgtgtctggcgatctggaatacaacatgtagctcaaccggtttagctagatccaatcattcgacaataatattcattcagtgtcattcaatctctcactcatccataaataaaacacataaaaaacctagtggccatctaccgtttgatcggggtagctctagtttcatccgagtctatgctatgtggaaaaaaaacttgtatcacgacgagaaaaaatatatcatagcaaattatggcataacagaaaatttgatctaaattgtaaaataaaacaaaattttaagtaggagatagtggaattaatgcttatttttcccttttttctaggattaatcgtgcacgcgttagttcgcgttggatgggtttttgttcagcagcacgaatgcaccatacatacccttataaatccttgtaacaccgagtacagtacacggtgtgccctcacatgtttgtgtgtttccgtggaagcgtaggtaacttgatttgtttcagagaactcataactttgggggtgtttacattaagaagttttgacgtgtcacatcaaatattatatagggtgttgcatgggatattccgatactaataaaaaaaaactaattatagaatccgtcagtaaaccgtgacaagtttattaagcctaattaattcatcattagcaactgtttactgtagcaccacattgtcaaatcatggagcaattagcctta

SEQ ID NO: 83371 - DNA, 1136 bp, Oryza sativa
  unsure (1)..(1136): unsure at all n locations
tacacattattcagagactcctacgatagtcaagacaaaaaagacatcttaaccattaatacacaaaaatagttttttattagctttctttcattttctccctctgcgagcagaggaatttcttttaataaacactaagagtcggctctaagccgatatcataagtagcaacaatgttttctcttcctcccctctatcttccacgtcaccaaatttacttatatgataacagagagagtccgctaataaacaccgttgtagatacctcataagttttccccctcacgctcgcgaaatgttttctactggagaaacacatgtgtgcctacacctgtggcaacattcatggtacccgctccaaccccccccccnncccnnngncaaaaaaaaacacaaaccaaaatctctctcatcttttttttttcctttacaagaaaaacaaaaaaacgatgtanaaaggaaggtcgaaaaggaaaggaaaagaaaggaggatgcagcgacgaagagaggaagaaagaggctctctgatttgtttgcgtttgtgcagcgcgtcttcccttccttttgaccacgcgacacatccagcagccaaaaaaataaaaaacccaaaaaataaaacgattattttatttttgtgtaaagagaagggaaaaaaaaaacgcgcgaaggagaaggagacgagctgcttcttcgtctccaacttcccttatctctatcaacccccattcctccattactctccctctctacatatacccttccccacccacctcccaccctcccctctccaaccacaccactctccaaatccatccatcgatcgagaattcctcttctccctcttcttgttcttcttctcctctctgaatttaacaagaaatcaagaactaggtgtttgttttgactaacaagaactcggtcgaacactctgcgtgcgtgtttgtttgtgtgtgtcatgtgctctgggccgcgcaagccgtccacaccgccgctgccgcagcagcagaaggaggcgacggtgatggcggcgtccttgcttcttgagctggcggcagcggacgacgtggcggcggtgaggagggtcgtggaggaggagaaggtgtctcttggcgtggctgggttgtggtatgggcctt

SEQ ID NO: 83372 - DNA, 2253 bp, Oryza sativa
tttttcccgtacccaaccaaccactcttgcccccacttcattttttctttttttcttcgaatctgaatcgatccaccatcctagcctacagatcggtaacacaccatggacgaggatgacgacaccgtggcggttgacggcggtgaccggcggcggttgaggcgaaggcacagcttaatcggcaaggaggtgttcacctgggtcaagagcaacaaccggcggctgctccacatcggcgacgttgatagaacaagcaagtatggaaatgacactccgatttgcatctgcatactctccttcaacttcacgtatgaagccccaatttctttttgcaaatcaaattaacgtgtaatctgcaatattacctgatctgaattgatggtctgcacagatcctacatttgcacatcgtgctccatgtggctggccgcaggacaaggtggagtccgccagtgatggaggttgtttgctatttttcatttgctcgtcgtctctatgacatgaacaataatgtttttgctttttttttgcgcttgctagatgatggatggctgctactgcgcaacgtcgagcccatctctataccatgctgctacatcctcccttgattccatcgtcgcgtaccgttcgccactcggttgctctctccactaccagtcacaagacacagaccagcctctccatccttatagcaagatccagcaaagccaccaggatgtagtttcacgatggatttttggatgaatctttttttttcttttctagtttgattcacctgtgagtaatcttatcacttgtgtgtgattgagcctgtaatttttttcattcgtacggccattttgtgatacagactaacaatactcttagtatcagtttttactttttatactgtatattgaacacaccagtaaacatattactacatagtggatacgagatcatgggctatatagagagagggtggtaattgttttactcgcagaccacgaagcctcagtttttacccttatactgtgtattaaacacattagtaaacatattactacatggtggctacgagatcatgggctatattgagaggacggtggtaattattttagtcgcagaccacgaaatctaaataatatttataacactggtattcttttacgatcatctaggaatgatgcacgtacaatgtgagggcattcgtgcaagtaaatttgttaggtattcttttacgaccatctaggaatgatgcacatacaatgtgagggcatttgtgcaagtaaatttgttacttttgaaaggggcattcatgcgagtaaattcgttacttttgaaaaactccacaaagtaaattcgttacttttaaaacgttgtgaaacattagaaaaatgaacttggaaagaaaaactaaacggatggttatatatttaccgggtcctttgatgaagcacagataagatgtaaaagaagaaaaaagaaacacagcagggggggtggtaaaaaaacgaaaaaacgaacgagggagcattgtgcggcgctcgaactaggattagcgataccggacatttagtataataactatttgatgatgagaatgtttgggtaataaagtgaagcaggaaggaaaggaatatgaaattgggaatgctatggaaggtgggatatagtatactaggcataccctgcggcgggtactcggggaggtacatggggcgctcggggatcaccgtgtcctgcagcatctgcggtgcgtgcagtgcatcaaacaccaaaaattcatcaccatcaattcattattagcatagtagcaaatttaattaggcaaagctaatacccaacgtacccttgtgatgttgttctgcgacttgaggacggaggtgaggaggcggccgaataggggcgactccatgagccagacgaaggccctgagagagaagccggtgaggtgcggcgcctgcagcgacggcgactggtacctcaccgccgacaggtccacctcctccaccggcgtcatggcgcgcggcggcttccccatcgatcttgattcttagctactacacccacagctctagtagtctagtggctagtgtgggtggaggtggaggaatggagtggaggtggaagaagaagaagagtaggcgaagaaggcggcggcggagttggcgagggaaggagggaggaccatgaaattattgtccgcccacccggccgttgattttcttgtcaccccaactacactatttactccctcttcttcctccggtct

SEQ ID NO: 83373 - DNA, 4127 bp, Oryza sativa
taaaaaaataaactaggagcacgtaaaataaaaaaatcactagcatattatcaattaagttttaattattacaatctttaaaatagatttattttatattttaagcaaattctatataaaaaaatttacacaaaatacaccgtttaacaatttttaaaacgcatgctaacgaaaatccatatacaatctacatcttaattagtaatgctaccgcttaggattttcctcataccacttatttatttttctaaaaataaatacaccctctcttaaaaaaagtcaaatcctgactatgaacaggacaagcatttgtaggatttgattttttttttacaaaaaagagtactactattcaagattaaaatctaagcaaggattttaacaacttgtagtttaattgacattggtcaaatatacagatttgacttttatagttcaaattggcctcacaaaactcacggataggttggaagttagcatgcaggaggacgacaagacaacatgaggaaggagacatcgatggagtataccagactcaacaccaacaatttattatatcctccccttgtttcgtgctaacattaatcttacgcaaaaataggtgtggcatcatcaaccgtttacatgaaatatgtcattttcagccttgagcaataaactgattaatatccttgatactccatccgttacaaaaataagttaacctagtaccagatatgatatatcctagtattatgaatctgactagatatctgtcatatcccacactaggttaatttatgtgatatattctagtattacgaatctaaatagtgttgatgcgaaaaacacacatcggcctgagagatctgcttaactccagtgcatgtcctaaatcttgctttcgggcttaaagtcgtgccagttgatttaattctgcaatcaacaagaaaggaaaacaagaaaacaaggttaaatccataaacgatagccgatcggctaaaggccgatgacatatcgttaatcattaagccgatgttattggcattagatcggcaatgaagaataaagcaagataaagctaaatctactcaatcggctgtagatatcaatgatatataatctacctctagaaacatatttaaaccaagtgattgggatagattgatagtgagtcgagacagtataaatcacttatgcataaaagtactttaagacaaagattatatatattcatatcatagccgatgaagtagatctaacatatatcggcttgtactccgataccactctatgttaagatattaaaacaagaaaaatataccaaacagtaagcctaatatatcttagtgcaataagatcttagtataaaggtcagatttagtacgtcaagtaaacgtgtacagaacaagacaactgaatcaggtaagatcggctgaaaccccgatactatctctattgatgatcataagacaagctagatattataattctagatattgcttaatagatcgaactcgaccgatgcagcattaagcataaagaaaaacacaagatctaaacaagttgatgaaaacctctatgagatggtggatatactatataatctagatcaatatcgatatctaactctattgtctgccttccaatgatagatgttggctgatttagggttagatggtaatactgatagagattatacagcacatatgataactcgacgatttacataatcaagattagagtgtcataaagatgtatgcactaatcccgagaatacaagccgccatgacaagttttacctcttgttgaagatcgaaaccgatgtagctcaacccaaaagcaagaactcgtcgaaataatgaaaataaaaaatgtggcgatacgccgaaagtgttattgaattgtcgttatcaatatacatggtcttgggccatatttatacccaaaatacataatgtgtccttcccgggcacgactctaaatctgctacaaccgttaagatacgaacaagtctttcaggcaaactcttgccgataaatatctctaaggaaactattcaaaatatcataattaatagatacaattgcctatccgtgaccttatctcaatcatggcaatacttgtgcagcacgttgatcaatcccaaagatgattgtagaaccaccttagcgagatcggctatatcagttgtcctctatccgatccatcgtcagccgatgcagtctttagccgatgcctcccgtagccgatgcatactttgtttccgagaaccaatcctccaccaaatccgcttcaattttaacttctaatttggtacatgatctaccaattttggtcgtcaacagatagatacatgtcatatcccatactagattaacttattttgggacggaggaggtccattatattcttttcgtgaatagaaatcagtccaccatatatacataaagatatgtatcgatctctctctcaacaaaaaaaaatattgtaccgatatccacttattactagggcgcaacataaattaagttggtgaataaataaataaagaatgggcgattgctcttttgaccttttttgaaacctaactatcaatttgaccctacttttaagtttgcttattcgacaccgtttttcaaaatcgaagttatcacttgatcctgttttctgcagtgttagggtttcatttagaaaaagaaaaaaaattcttcatgagccacaatcgaccaaaaatacccctaagtacatgtcggtacttttccagaattctaactactccttccttatcctctccctctcctctctcaccggagcctaaaggggagattcctcccacggtggcaacgggggagggctggcgactgctcggcgactaggagaataggtggcggcggctcgggggcgaggaggagcgacggtgaggtggatccgatgaaggcttggtgcctgcgacaaggaaaatgagcagtagtggtggctctgtgacgaggacgagcaacagtgaggcggatccagcggaggcttgttgcacgggagatgagaaggaggagtggcagggtggatgtcacgccctgaagttttcccctttttcttgttttaaaaatttgttaaataaatcgtccagagaaattgttctaattaacctagagttgaatccctaattaataaatgcaattaataatcagaaatagcgtggtggaacttttcttgagttccccatgccctaatgcattaacaagatttttagtggaatttttagagccctataaataattttaaccaattaaaaatgagcaagtgcaatatttttaatcccgggaaaatccttttcctctttttcttttcttttccttcctttttctcttgagtcttgatgggccgtcagcctatctctctctctctcgcgccacctccctcttgctgggccggcccaagccgcctccctcctcttcccgggtcactgacaggtggggcccacctgttggccccgtcttcctcctccagccggcggcaaccgccgctgccgccccacctcttccgctcctcccgcgcccacgccgcgccgctcccatgtcctccccacgtcgccgccctctccccgcgtctcccgccccgcgcgcgcgcacgaaatgggcgggatttgatttcgaatcccaccccactctctctatctctccaccccacgtcgccggcggcttcggccaccctcccggccacgtcctcccctccctcgcccataaaaaccctccctcgagctccctctcttgtttccccattcgccgttgtcagggttatggataccacatacctaatagtagttgactaaatctcggcaggatccaccacataccatatcttatacggaaactgacctcgagggagttccggttaaggaaagacaaaccatagttctacatggaaacgacaatgactactcagattgtatccatattggtttccctagttctacttagacaaggggacacctatgggtataaatacaagaccccctaggaggagacgggagatgaccacctcaatcaacatacacggaacaacagaagccacaacatacaagccaacatacgccaagacaagacgccggatatcaacttcagggataggcacggttagtcccctacggt

SEQ ID NO: 83374 - DNA, 46272 bp, Oryza sativa
  unsure (1)..(46272): unsure at all n locations
ttaatatattgtgacatgtagaatccaagaaaaattccacatgccgattccgattattatttgcatttattaattagggaattagctctaggttaattaagataatttcttcggacgatttatttagccaaatttttaaagcaagcaaaaaggggaaaacttcagggcgtgacacgacggcgaccgacgacggcgactgcaacggcggcgcggcgcggctgaaccgacggcaacgacggcggcgactagggctacgcggaggcggcgctagacgcgacggcaggctaaggcaaaggaggcgacgggtagaggggagctcgggggtccttatataggtgcaaggaggcggcggcaaaggcccacggcggccggcgacgagaaggaaagctcgcggcttgaaggaaagaggccgatccgaatcgaactctattccacgaacttccaaaacgatttagccgatgtttccaaaggagaaaaggtagaggagatcccggagattgtttcccctcaatcaattcggccggagaaggaaaggagcggccggatttggaaggaaacggcgacggcggcgcgctagggtttcgggcggcagcggcggctcgaggaagacgaacctgacaggtggggcccacctgtcagcggctgagagagaggagagcggcggctcggcggactgggccggctgggccgagggaaagagagagaagggttttgggccggctttcggcccaaagccaaaagaagactttttaaaacctttttcaattaaattatttcttaaatgcaattccatttattaaaaatacttccttagctcaaataaatcccagaaaaatctaggaattatagaattaagcaaagtatttaatgaaattttatctggcccctttttatattgagatttagcaaattaaaattagatcttctcttttaggcttttaaaatcatttctaattattccttttaaacaacaatttataagttaaggatttttaaacaagaaaagctcttaacaattatacttagatcattaatgatcaaataattactgaactgttctttgtattatttaagaattgagctctgaaaaaaaaccgagaaaatttcagagagttgacttaaccatggagaatttaacaaaaattaaatccatccatgctttagatttaagaaatttttatttcccacattttacttcacttgaaaattaaagatcatttaatataaattctattaataatttattaaataatttataaatcctgaaacgaaaatcaggatgtgacaagacatgaccactctttcatgacttgattgacaaccatctgagagtctccacagacgattagtcggcgaatacctagagatattgcaatcctttgtccatgaagtagcgccttgtattccgccacgttatgggacgcagaaaaatgtatccacaatacgtagctcaatctttctccagtcggggagattaaaacaaccccagctccagtgcctgtaagcctcttcgacccatcaaaatacatagtccaatattccatcttttcctctggcatgtcttcttggcactcggtccactcggcaaggaaatcagctaaagcttgtgacttgatcgaagttcgtggcttgaacgatatgtccaaagacatcaattctaaggcccatttcgcgatccgtccgtttgcttcgcggttatgaagtatatccccgagtggaaacgatgtgactaccgtgactgggtgactttgaaagtagtgagataatttcctaacggtaattaagacaccatatagtaacttttgaacctgaggatatcttgtcttggagtcggctaaaacctcgctaacgaaataaattggacgttagactttttgaacatggccttcctcttcacgctcgacaaccaggaccgcactcacaacctgggaggtcgccaacacatataacagtagcggctcttgcggatgtggcgaggccaaaactggtggagtggtgagaagtttcttgaagtcttcaaaggctttctgtgcttcgggtccccactggaaattgtcagtcttctttagcagcttaaagaaaggcatcccccgcttgccgagtcgtgagacgaaccggctgagcgccgccatgcaaccagtcaacttttggacgtctttttgggagcttggcggtttcatgttgagaatggcgttgattttctccgggttggcctgtatgcctctttgagataccataaatccgagcaatttccctgacggtactccgaagatgcacttttccgggtttagtttcatcttgaaagcacgaatgcttgtaaaagtttcttctaaatccacaatcaggtcatccttctgcttggtcttgacgactacatcatcaacataagcttcaacattgcgaccgatctgagttgaaaaacatctttgaatcatgcgttgataggtcgctcctgcattcttcaatccaaagggcatggtgatgtagcagtaggccccaaagggcgtaataaacgaggtcttcaagcagtcggattcttttagtcggatctgatgatatcccgagtaacagtccaagaaactgagtaacttgtagccagccgttgagtcaaccacctggtcaatgtgaggtaacccaaaagggtctttgggacaagatttgttgaggtcggtataatcgacacacatgcgccattaccccgtctttttccgaaccaggactgggttagccagccagtcgagatgaaggacttccttaatgaagcctgctactaacagcttggttaattcctccttgatcgcatccttcctgtcctgtgcaaaacggcggagtcattgcttgatgggtttggcgtcttcgttaacaagtaaagagtgctcaatcacctctctggggataccaggcatatcggatggtttccacgcaaaaatatctttattattctgaagaaaggtgatgagcacgctttcctatttacaatctaactcagcacctattacaacagtcttatcaagatcggagggatctaagggaatcttttttgtcttggcatcactttcttcggtcttcgtcagcttggttgaaggcacttctccctcgcttgccgtggtcgcagccagtcggatctcttcgcgggcgagagtagtctcgtgagtttgggccatctcgcaactttctttgtcacatgtgacggcttgcttgatgtcgctccgttgtgatatgacccctcgaggaccaggcatcttcatcattatgtaggtgtagtatgggacggccatgaatttggctagagccggtcgtccaagtatagcatgatatgctgtctcgaaatcagcaacttcgaaacaaacattttctgtgcgaaaattctcccgagtgccgaaggtaactggaagagtgatctggcgagtggtatagctgacaatcctgggataacaccgtggaagggtgcattactcggctttaattccgtgcgaggaatctgcatatcgtccagggtcttagcgaaaaggatgttgagtgcgctgccaccgtcgatgagagtccgtcggagcttgacattgcgaaccactgggtctagtaccagggggtaccgccccgggtggaccactcggtcgggatgatccgagcggttgaacttaattgttatctctgaccaccgaagatattggggcgtgctaggctgaaccgcattgatctcccgctctgttagcttttgttttctcttagattcataagccaggggtccgccgaagatgtgattaagttctttgcgatgatcttgaaaaccggtcggggcatcgtcttcatcatctttcttctttgatgtgccttgatctccgtctgagggtttacgtgcgttcttaacgtattgctccgcgaactgtttgtagacgaagcaatctttggccacgtggttggagttgggatgatgcgggcattgggagttcattatcttgtcgaaggtgttgacacgagaacgttgtcgggaagatggagaggtggtcgccacaagttcttcgagcttacgcttgcgatccttgtggtttttacttccactccctcctgcggtcggcgtatccttctttggcttccaagtggtgcccgactgcttggatgtcgtgatagcatcttcggctttggcatactcattggctttttcaaacatctgtttgaccgtcttgggaggtttgcgtccgaacttgtcgactaggtcctcgtggcgaatgcctttagtaaaggcggcaatgatgacgtcgtcggtgatgtcggagatcttgttgcgttgctcagagaagcgtcgaatgtaatctcgaagagattctccagacttctgaacgatgttgtagagatcgaagtgtgtgccgggccgttcaaaagtaccttggaagttggcgatgaagtggtcgcgtagctctgcccatgatccgatcgtgtcgcggggtagcccgtgaagccatgaccaggcagaatccgctagggccacaggtagatagttcgtcatggctttgctgtcccctcctgctgcgcggattgcgagaccatagacggtgagccaagactcagggttagtggtgccgtcatattttttgattccagtcggcttaaagccggctggccaatccactcgacgtagatcgcttgtgaaggcagcaactccgtccacgttgtcgtcgtagcgatccggtgaatgatggcctcttgctgtgcggcgctggttgatggtgtcgcgaagatcgatgggacgtcttcgatgtggggagtgtggtcgttcaattcggcgctccctatatcgctcgggaggcgagcgaacggaccgttcatcatgtcccctgctcctgcgactagattcggcgccggcaatgctgaggcttggctggtgatagtcttgagatcgaagatgagggactcggctaccagtcggggtgcgggtgcttgcagagttggctgggaccgaggcagcgatcatggtcttcgtctggttcaagatgttgactacatgatcagcttggttgagtgcgtcttccttgaggagggtgtcgaggagagtgattgctgcaaccgcgttctgttggggggtgcgaaagaccgctatcccatcgacgtcttgttgcccaatgagctctctcgcttgccacccagattccaaggcgcgttgtcgtcgatcttcagcctcctttgcaatccgttcgcgatcttgttgctcacgctgtagtcgttctcgctcttgtcgctgtcgctcttcctccaatcggcgacgttcagcttcttgccgtgcgcgatcttggtccgcttctcgggcttggcgctgttcctccgtttcgttgtcagccatgaatacgccgaagaagaggggcgtgtagttatccttatagctgtcgtcgaagttgtcgaggtcgccgtggtcgtagtggtagccgaaatcgtcgtagtcgaggatctcggttggtcgagaactgacgccgggggagctgaggtagccatccaactcttccgtcgagactgtcccgagaggttggagtataacgccaacctccctggatctagatcggatcggggccgaagccggagctcgcctagatcttcgagtgggagatgtcttgactgtgaagacagcggccaaatcatcaggaagtttcatcaggattgagggataggacccgtcgtcttgatctggtcgcggaagagtagattggatctcatccgagtggtttgaagccgactcgggagagatgatcttggagtaggcctcggccgagttcggaataccgaacggcacagggacctggtctctccccgactggtttgaatccgagtcaaggagagagatcttgccgaagtcgttggtgatgaagttgaggctgccgaaccggaacgcctgcccgggaggaaaggcgaagtcgtcgatgccagaaacgaaacccatcgcacttagtcggcgagaacttgacgctacccctacctggcgcgccaactgtcgaagcaagatttcggcaataataaaagggggtggctgtcaagctaggaaaatggatgggtttggagacaagaaattttatacaggttcaggccttcttattaaagaagtaataccctactcctgtccggggatgattccgccgagtgtgttattaattgtatagactgggaaaaagaatcacctcccaagaggcacgcggaccctccttatataggggaaggagtccgctttacaaaatacagtccatatcctaacggaatatgggattatagataaaatacaatcgtaaccgactaagatcccgggtatttccttgacatacaagtttagaacctaacccgagtcttcatagagatattccatctatatttgataccgtatatccgactaaattacaaccgtcatgtagatatggggtatccataatctccacaagctggcttgtctcgagctatcttattgggtcacatgacggtgttaaattttgaaatagatctaaggaaatcatgcataagagaaaatagccaaaagaaaataaaagacacaaatccaatttttaaagacttctcaattatctatctcttaaagataaatatagagaatatccataataaaaggaatgccgagaagcaaatagaaggcataacatccagattgtaaaggcttcccaaaatatctttcccctttgcaatctatcaatcccatgctggttggttttatgccagctgattgttgccctcaacattctttagttgagcgacacgtgacgacatacaagcgtcgaaaagagagccggttaataaaccctccctataaaactggcaagcgttcagttacaacggtgaatagaaaaacaagagaagagttgttccacgtgtcgtgaccacatatcctatatttggagaaactaaaagcaataaatagaaaaactaaatgacataaacaataaactctataatcctgataaccaatttctaaatatatgtattttctgcttatactataaataaataatatgtagatctttacgctacaattataataaaacaaatattaattctggtgttggatttatacctagagttttatgtcaaatctaaacaccataatgctcaaaatcataaaagaaaaattgaaatattagtatattaactatatggtttttaaaagccatacacccaagctaattagtggacgcgccaaacggcgtcttgattttctaatctacattattggtgattagtgaacctgaactaaaatttcatgaagtgcctttttttcaagttcacttagaaacttgtgtaaatattgatcacctaaaatttcatatataagcatgcatatagcattagatgatacatgcctactggataaatagtgaaataatgaaaataagagtaattctgggtttaccagctacacgagctagctgacaccaaaacagaaacatgattaatcggttatcagattagccaagagataaagcaatccaaataaattttaaaaaatgaaaaaaagcaacaaaaacaaaccaatatggccctagggagatccaattgtcagttatatctatctaataacagacacatttttgacaattatgtgatgttgtacagttgcaataccaaaaacagatagagaatttgctggtgaaaaacttgaaacataaattgcaaattgctaatatcagttatgtgattaaatgacaataactagtggaaattgaatagcattgctgacagataacaattgtgttactgatcaaatggcaagattatagatagagaaaaaaaacagagactaagtatgacatacttctgcatctaggatattatcatacatagagagctttcagaataatcttgcaggtgtaaaattattgaaccaacaagatggaacattcaatcttgcagatcttgtgattctgacaagtaatcctacttctgtgacgctagaaccttgaggacagcctcatccgccagagcactgtagttcggtttcactgtagttcagcttcaggttgtcgtaatcctgtgttgtcatggtggctgcaaattttcctgggcccttagagaaattcgaagcatgcagcgttcttcaagccggagcatccgtgttgctaggccaagattaggatgctcaccacgctggccacctcgatatgtttacaaagaagggcttctcatagcagcctccatcctgtatcgatcgggccgcgatgaggagatgctcggccatggcgcgtccctcctcgcgcctgctgcatctgcggcggcaatgagtctatgtaatagtgttattacagtgcgacacagctaggatgtaatggaagatggagcctcgaagtattgagcccgaggtccgccaattaattattttgaaatggtccattaattggagtcagactgccaatttatatatatgttgggctgagttacacctcagcaatagcccaatccgattttttttttcgtttcactccttggcaaagtaactcgcaacccattggcagtgatcaagagttcatgactttttgcatttaggttccagagttttcatgttttggttgcatttagattcctgtgcgtgcttagcctaaatatgtactctccttgccttttgtcactcctccgacggtcacaagctgccaccttgcctcaccatgaacctcctccctgcacgaactcctctccagtctccactccgccgaaagcacaacctctcaaatcgtgtttaatttcccgctgaatgtacgttgctgcaacaatagcaaaaaagttcccgctagatgcacgcctgctaaatgcaacggtttgttgggacacaggtcaagattctgataagcagttgatgaatagtcaatagataagaatataagcattatcgatttttagcttctactttactttctgcattagctagaggtgctagacaactagagaaatcggagcatgagacgccccaaataaatagcttcaatatgcgtttcacaagtagttaaagtggtttatgtgaggttgtcgtccaatccagtttcattattggaggtcaatttgaggtgttagacaagttcatgcatgtgaggaggaaagtgcaaggtgaattggatagaagcatacccaccaaccgagtatatgggggcatcagatccagcacctcgagaaatcttccagagcgatgcgcctgagatggttatgacacgaaaggagatctccgaaaaaatcataagtgggatcacaaacaccatgagaagatgctgacatgctcttgttcgctgcgaccaccagcggacgtgggtataatctgtttatgggatttggcatggttgtaaggatagaggcgaaagaatataacaccaaaggtccacgcaatttccagaaagaaaaacagaacacataaacaagaccacataaggcagcgtgtgacagcaagatcttgacatgcgaatgaatgaatgcatgatagctaacttgctagatcaacttgtaaacttatggaatgtagtacaagaggtgcagctcatccccgatgatatggacaaaaaaaacttggaaactcacaagtcatgaggaatacatgacggcaactgcctacaaaacataatttaccaaccccccccccaaaaaaaaaaggcgtttgcctagctagtaatacaaaactaaatctgaacatcagacaaagtatcaatctgagaatggacaaacaacacatactgccctctttgccccctacgttagaaacatccttccatctactcacgaatgtagatacacgaggaaaatctaagacatgctgacaacctagatctcgtgggaacaactcgaacaagtgaagcctattcattgaaaaacatgtacaaacatacatgagtggtgggaggcgctcgcaacttgccttggggaacccaagcaaggagtttgctccctcaccctcctaacaaacttaggaactatggaaggaaaatatccataataacctccgttgaaaatcaaggaaaaagcaataacttagacttttgcaggggtgaagcgtcaagctagcatagattttactctaagcccttccttgtacaacccttgtttttcatacttgtacaatataaatttttacatgtgttatatatcagtaaaagttgtcactaaattttactattagagttatcgcacgaatcatgcaatttttttcttgcagcacaatggctgagttgaatgctgcaagcttgcaacacaacatgtaaaacttggaagtggatttttatccctcgagagaacatcacatatgttttgtgcatgtcgttcaaaaagttatcagaaaatttaaaaaaatttatcaagatagataatatatgatatatcttttcgcaaacatgcgagttaaaattcgacttatacaattcgaaacaaaaataacaaatttgaccgtaaattacgtgttatattcatagtcaaacttgtttttttttctacttgggccgagtttagttccaaaatttttcttcaaacttccaacttttccattacatcaaaactttcctacacacaaactttcaacttttccgtcacatcgttccaatttcaaccaaacttccaattttggcgtgaactaaacacacccttgtataagttgaatttgaatttgtatgtatgtgaagtgatatatcacatatttatctatcctgctaattttttttaatttttaaattttttgatgactttttgagtgcatgtaaaaatgagaggatatccttaagggatgaattaagttttccgtaaaactccaggtatgaacggcttggatgccggccaaaccaaaccgtcgttgttcgtgtgctgttttgcagccgctgtacgagatggccttttcactttccagcataaatagaagccgtcaaatgccggcgtgcgccagtgcgtcgtcggacggcaaccccccgaaagcaacgtcactgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtgttggttaaggtttctatcttgtaatcctgccccccatcctatataaggtgggcaggaggccctctagggggcaggagacaacctgatcgtcagatctatactacacccggcggattcaaatccccaaacaggagtagggtattacctctcattgagagggcctgaacctgtctaaatcctttgtctctgcatccatccactttaggtctcgtacgctacccccttttattattgccgaaatctagtttcgacagtcaccgactgacagacagcgccgtgttgcagtgcagctgctgtgcgatcgatcgaggtggtgagaccctcccatccccgccacctcgcagccaccgggccgcccgcccggccgcgccccccgatccctttctccctcatcatttcgcgtctcgcgcgcagccgcgctcctgcaagcaacgtaacgcaacgcgcgccgcgaccgaaccacctaactggccacgcgcgcgcgcgcccgcccgcgccgcgtcggcctctccgaaccgcgcacacaaaactgctcgattattgtgagaccgcgagagcaagcgagcgatcgatcgatcagccagccaaccagcccgtcacgttcggaaaaacgggttaggtgccgcgcggccgcgcgcccccggcggattcgtggaaggaatcgcaccggagattaaaagaaaaaaaaaacgagcttcagaggaaaagacgtcctttcaaacattcttaagaaaagaatgtgagcatattgagaattagtaacattgaatattgggttacaattacacatatcttactacactatctggtacatctccgtaccggggattcatcatgcacgattcctcacttctctcctgccagccatcgcggcgccacagaatcgctgctccgtctcggtgttctgcctcctgtccatagagctagccagcccacgattttctgcctgcaccgattcgcgtgtttttggatactgatcatgtgtgcgatcgacaatcacccggctaaacctgtcatcataactgtgcctcgcacactcgggagactttcttccagcgtacgtagaattgtcctgcgtctcctgcccgcccatggaacgaagtacaacttgcgagagctcttgagaccataattaaccatgattagtcaaaggcaataattcgtgacactaatttcgcttcgtcgatgcgtggcaccgagtggccggcgattggctcggagtaaatgcgaggcaattgatgggttccttcttccctgcagtggtcctggctgaagaaaagggttcttgctgtttgctcttgtggctgctgtgacactgtaggtccgagagaacaatcataggtaaattgtctgcttcatgcatgataactcatgaattatggagttttgatcgacgtaaagggaaaaagatatgattattgccaacctggaattcgttcttatcggcacggattgagaagcctgaaggaacaggaatggaatactgtcaggttttgatgcgcattctaatgaaatattcaggtgaggtttgtaggtcggaattacttatgccgaagtaataatcgacaagtactgaaaaatgtacgcagaatatagatcacagttgaaacgagaatgatataccgtctgggctctgcattttcagacggaattttctgtgctgtatctgaaagcaaaagcaacagcctcatttaaactgtgaaagttaagcagacgacattcagagaagctgtcaattccatcatttcttcaagaggggggcaaactaatagtgccgtgaactttcagcttgtcataatgggaactaagctgaaattccctggtaattgcacagcttgattaaattttatataaaagtagaattgtatttgatatacaactcttgtttttttagttttataaatacaagtagattttgcatacaccatgatgatactaggattaaatggtacaaacatttctcttattctccaattaacgtggtactccctctgttttaaaaacggcgatagtaattttaggcccctcagagtaacagataggtaaattaaaggaagccactcatagttgcatacttgcactagtaatctccataagagcgaattttagattgaattatttgatgagctaagttcttaatttaaaagacagtatatatctacccttctctacaaataaattgcactagtaacaagtaacagcaatacatacttttccaatgattgagaagggcagatccaaattattaagacaatgactacaaaaaattgacattacattttcatgaaaaattttttgacaatgtcaaatctcacgtgccataactatttacttccatttataaaacaccaggcttcatatttttttcaaacaggtaggaaaaacagtattattgcattcatatttaaatataaatatataacagtaattttacttttcaccaccttttattactgacattttgctttggattaccgtttaacaaatattttgaactttggattaggtaatcttaccttcgttacactctgggccatattgactcacttctcaagcatataaacgatttcgaatacgtcggctcttactcgtcaatgaactcctatagccgtatgagagataatttctttactataatacaaactggatatatatatatatatatatatatatatatatatatatatatatatatatatatatatatatatatataaagagttaagggtgatccaaagtgccacaaaaggtaaaattatccggtttaaagtgaaaacattggtaaatgatggttcaaagtaaaacattgataataaaagtggccccaaagcgaaattcattcaatatatgatgatgttaatgtcatttggtatgtggcaagcaacttatttgaccactccttttcaattagaataaaacgataatgtctaacaaaattataatattgaaaagtacttatagagataaatctaccatattatttatatgtttttaaactaaatattttgagagctgttgattatcaaagttttaaaaatttaaccaaattagtcaatagtgtcacatatttaaatacaggagtagtatttacccggttgatgcgtgtagatcgacatccctaaagagaaagttcattccaatttgtggtaccgtaattaaggcaaataacatcacagaaatgggagaggatgcatgttcaagatgatagctaccctgatatatcaatctagttttccttatcggttatcatttcgggtaagctaccaacaacatctcttttcttttggagtatgctactaggaacaacctatgatgtatagtttgatgcatatgtatatacacagtggactaagagcatccccagcagctcttctatctagtcatccatccgatatttggagtatggaggagaaaaacaatgctccagcagagtctccatcatcatatgctctatttttggaggtcctccaaacctagcccttcctaagctaaatatggagctctctctcctcacttcatcctcaactacccactccctaagatcttttttaagtggtgaaaggtgagaggaataggagtaaaaatgtgtggtagttaaaaaatattagtaaaatataggatgttggtatatgtgggatgtaatatgaatgatctgttggagtaaaaagttatatagagtgagaatctttttggatggccatctaaatgagagtatggaggataaaatttagatgagctgctgggatgctctaaccttctcattttctctccactcttgtgaagtccgacagaagtttcggtgcaaaatttgaagggacaattcggcaaactcaacgtatcctatacgcatttgcaccgattaaaaagagaagtaatttggggcatagacttcgctgtcctagtcttcggtctgatgttaccgctgtaaacatcgaaatttataagtgacaattgacatgccgatcacactgaatttcttcctacatttctactagctaggatggcagaaaaagttcagaaaatcctgaattcttcctacagttctactgggagcagggtttcgatttcgaaattggattttatgcctggggtgaccgaaatgtaatttcagaaatttctggccaaaattatttgaaatttgactgaatttaaataaaatttgatcaaattcacaaaaaatgtaaaaaaactaaaaatttcggacgagaattgagcatgccggtggggggcgaaatttcaaaccctgactgggagtataggcagtataggacaagttcagaaaatcgttgaattcatcctactgttctactgggagtgtagctgtttagcactagttcagaaaatcttggattcttcctacaattccactgagagtgtaggacaagttcagaacatgtttgctctcaaaatatatgcatctcaaaatcaaatataccaactcgatcacactcgatcgtatcaagaattaacaggaaagagaaaaacttgaagcatgcgcacaattttcgtctctatgtatgtactctgcaataatccatgcgttcatgaactattcacatggtgccgtactgatccgtactgactatctaacgaagtagtaggtgctccgctccttggcggcggcggcggcggcgcgctgctgctgctgcatgcgcagctgctcgtggaaccacatgatgaactcgtcggcgcggcggtccaccacgccgagcctcccctcttcgtcgtcgtcgccgtccgcctcccacgccgggaacggcgagtccgtgatccgcacctgccgcggcgccggcaccaccaccgcgggccacgcgaccacgtcgccgtcttcgtcgtcgatatccgtcgtcatcgcctcggcggcggcctcctccttcacgtccatcagctcgaacagcctcgacaccgtggcggccgagccgtacggatccgcggcggacgaacggtcgtgccactgcccgtgctgctgcaggcgcagctggctgcggcgctgcgcgcggcggcgcctgtgcagcggcgtgctgctgcagctgaactcgacctcacggggccggtactggtactgcgacacggcggcggagggatccatggaccggcacgacatcgaggagagcccggaaacgcctcccgacgcgctgctgatgccgccgccgctgcgacggcggccagcgccgtgcgcgccgcggccccgcgggtacgggtgcaccgccgcggccgggtccatggacctgcacgacatcgtcgacgacaggtacgtcagcaacgccgggtgctcccgcaaatcgtcgaggccgtggtcgtggccaccgccgccatgccgcctcgaggacatcatctggtgcaggtggacgccgagcgcggcgagcttgggctggtgcttgccgagccccttgacgaggacgaggtacacggcgcgcaccacgcgacacagcttcttggcgctctcgcccgcggtggccgcctgcctctcctgatgatgctggaaccaccggactccatggcggcgtgctcgntggtgctcatctcgatcgaaaaaatatgtgtctcttctcttgtttttagaaaattccggtgatctcagctgcgatctcctggaccagctactcctctctctctttctctctgtgttcttcgcaaccaatgaggcttattatcagagaggagacgagagggagaggtatttaaagggggccagatcactagctgggcattcatgccaaagggaaattattggtgtacgtatcgtcttcgtattgtccctttcgtgtttcggacacatgcctgcttttttttttcgtgacgcgttcagttttgatcagtgtgatttagttggtggttttcttggtttattactggagctaactaaggcactatttagatcccgcccaaaaatttttaccctatcacatcgaacatttaaacacatgtatgaagtattaaatataggttaaaaaataactaattgtgtagattgcgactaatttacgagacaaatcttttaagcctaattacttcatgatttaataatgtggtgctacagaacatttgctaatgatagattaattaggcttaataaatttatctcgtggtttactgacggattatgtaattagtttttttattagtatcagaacacctcatgtgacattaatataatacctgatatgacatgctaaagctttacaccgttagatctaactaccccctaagctctaagcttgccgtgtccagaccggatctgataggtacgggcagtatatagatagctgcttttaaattacctttctggagacgctttcagaggtttaccaattgggttaatccgagtgtttaagtagtaaaacacgtgcatatatggcacttgcatatactgtacgcggcgataatcagttaagagagttgttgaatgacctgcgtagctgctccattttagtattactcttttccggttgataatatttgtcccggagaaaatattaagttattgcagaaacattgtcctaaggattttggttaggaagttgacaaatacaatgccaaccgctcgattatcatggctattggacttattgatccagtatatatcaattgagaaaccgttcgataaactcgtcaatttaaaaataatcaaactaaagttcaaatttgtggtaaaatctgtttgagtttaaccggttgctgtgaccgaacgattttctaatccatgttgtccagttgcatgtttatcaatgtcatacacctcaaataaccgcttaccatttttttcggccagatgtatatgactgtactaccatttttatttgttactactactagtttgcatagtgctcatttaggtaagtacttattttttttaaaaaaatgaagtcaatagagaaacaaataaagtggtccctttcatggttccatcatcaagctctaattaggtttagacatttggaaagctttttagtgttaagacaattagttaggatcttcttttagtgtcggacatgctggttgaagggaagaaattgtctagaaaatactcaatcattgcttgttttgggcccatagaagaaagggcaaatgaacttttcattaaaactggtgtcattagtccatacggacgggatcataatgaagaattgatgccgtattcaaccctgaaagaacagctccatgaacactcggcaaaccagtgataagatgggatcttaatattaaagacatttttgtcaaaatataatgaggaagcgttactaaaaaagaatatcaaggatgtctttttctgtctttcatgaattacaagtggaattttgatgtcaccagctggacaaatcaagtcactgttcattattgaaaaggttatatatatatatggactgcaatttcataacaggaaggagtccataggctgctgctaagggcctgttcactttgataccattttcaatattaccaaattttagtaaagttattaaaaaatggctatatttagtttgctgtcaaattttggtaactatataagaaatcctgccaaaattttggtaagtcattgccaaaatttgataaggtttttttttggcaccaaagtgaacatgccctaagtttgatatcactgtccaaatttaatgaggccccaccaattatcactgtccagctcgagcaaacagctactagtactcagctagcaaatgaacggcatttccatggtttagtattcggtatgaattaacttgtcattaatctggtctatccatggactgtttaacacttgcaagaaatagcaccatttactgcttttactgtgtattttccgggcctaattaaatactccagtacacgccacattgagatatttctaatccctgggatgtcccctgtacgttcccacttctcacatatagcacacaagggacaaaaagacctgttggctgtttgagtgtgttgataaagtttatgttttaaatttcataagatgtagtatatataatgtgccaatacgttgccccctttttttggtaaaatttagctatttttctggtgcaaggagtaggctgaatatctttgtaaatgattagaattttttttctttgacatggcttttgttttgattatgctcttctccatgagagagagagagagagagagagaagttacgtttgctcctaaattttgccgattctacaacaacatatagagagtatatagaaatcagaaaaatcacaattaagaagcaaaatttaaaacggccttccagtattttcaggggaaaaaacgaactctaatgaaattctccatcgacaacactcttacttgaaatatttatctgctttattaacaagttaagttgttatgcgactcaagagtgtactagagcaggttttcagttaatcacttggactaattccttcagtcacgatcagttttcatgcattatgcgtgtagtcttgggcaaaaagcgctatgtatttaagtccaaatttcaaataattagtactagtaagcattatacgtcttcatcagtgttgatcaaccggacgcgttgaatacttaaccaagatatttcctaattgacatttaaggctcggccatggacctagaaatgtgaccggtggttgatccactgcctgttgcagtaatcagcaggagatttagatagtgtttctccatgtgcctaacccgactacctacataagcctaacttagatacagtgtattaattaattactgtatatgtgtatttgttcggcaacgaattcagctaccagcttatcccacgtatctatcttgctgctgtgttttcagacacctaataattaaattgttagtccctagtaactattggatcataccaagttaaaaggttcgatgtgttttcgcctggttaaaagtatacccgtctggtttacttctttggagagactggttttggcgtggctcgttgagtcgttgacctgcagccaggtctactaaaccgttttaaagggtacagttatcatcacctcacgatttaacagtcaccctaaaataccgtgatgtagttttaaaatctgaaaagaatatatatagtaaatgatgcctgcatgagctcacgtcgatcttaacacggaacccaggggctcttgcctcttggtcgacgatcaagttttgcgatcgctggacgcatggcaggttgggcagcggagtcgccgaagtgaagcaatcgccgtgtgttggagacgcaggcgagtcgtcgtcgtcgtcgtcgccgcgccggatgagtcgactagctggcggctagcggctgcatagaaccaacgttgttcgggacttcgggccggtgactgaaggacgtgatcacgcgggtggtggataaacgggccgaggagattggtacatgggccgtagatgaattctgggctggaggccgcagctgaatatataagcccataaaatgccttcgtttcagcgggacgaccaatcaagggctttgacggttgttaattaaggaactatactagtactactctatgctgtgttgagtgtgattctttttattacacgaaacacgcatacgatacgcacgtacgatacatcatactccctccgtttcgaaatgtttgacaccgttaactttttagcacatgtttaaccgttgtgaaatatgtaaaattatatgcctatataaaaatatatttaacaatgaaacaaatgatagaaaaagaattaataattacttaaattttttgaataagacgaaagaacaaatatgtttaaaaaagtcaatggtatcaaatattttaaaacggaggtagtattttcgcgagtgcagcccctaacagatacttagaaaacatatgaagaccctgtaaaacacgtttagttaaacagaaactaacgacatacccctagtccattaaatttctaatcaaagctcacgtgtgcgtgtagtattatttatgggcatcagagtttagctttcgatcggtgaagtcatgtctccacgactcagtcgactctaccactacacctccgacgcttcctcgtgttaagtgtgattttaaatagcaaccgggttagcttggcttagcttattgtgtattaatgtattatgcgattaattggtcaattttttcaatacaataatttgagaaactatcgacgtaccttttgcatgaaaccactctcgtttcagtcacttttaaaaggctcggatcgtgttaacatttgtgtaaacataataaccttgccattttattcccctcccccttctcttgctcgcctcctccaccgccgctcccacctccccaccctcaccaataccagaagacgccaacagtagtaaagccccactagccattcttctccctctccccctcactatctctcctaagccacgaggcgatggggtaccccagtcccactgtcttccacatctctaatggctctcttgcccatcagagacctcgtcgcctcccctgcctccaaactactcaggatgtagcacacccaccgtcaaccacatccaccaccgtcctccaaccccatggctcccccgccacctcccgtcaccttgtccccacctccccagtcgtggtcaccgctgccaccgctccctaccatggaactagtgggtgaagaagatatggaagccctcccggccgtgaccggccccagcgccaatggcgaggtgaccgtggaggagtggcagtggtgaggcacctcctcgcacgctccaagccacaatgaccaccataatccgtgaacttcttgagaggaggaggaggtgcacgcgaatggagaggagggtgaggagaacggactgacgggggtggggggaaggagagggggagcccgagggatcaaggacgggaggggagaaccgaagaagggggaggaaggtgcgagcggacggagttttttatgaggtgggggctcggcttggctctgtcagttttaattggtgctggtgttcttttaaaaaagagcaccaataatgttagttctttagaaaattggtatctataatctactataggtgtcggttcttttaagaaaatgtagctacagtattggtgtcggtttttcctttagaaccaatacctatagtgttcaaaggtatcggttctatatttctttatcactcgaagatgggaaaaggtccaatgaactggcacctatactcaagccgatacctaacctatactcaaatcgatacctataagggattctgtagtagtggattcacgggttgactcacttacccactgagatatcgataaagtataggcatcataatacataatcgacgaatcgaactaccaattgagttcctcccgtacatctgatgatctgaactgaacattttattattaggtatatagtattatgagattgtttagcttttggatgactactgtaactcgtcacctgaatcgaaaaagtttttcatccctcaaggggatatcttctcgtttcatgcatgccacctaaatagtaataaaagtatgaaaaagttgataggatggataaatatgatatatatcactacataaacatgcaagttaaaattctactttaacaatttgtaaaaaaataataaatataaatgcgaatgcatgataattactttaaattttcctttgttgcaacttgcagaaatcgaatttgacattgtatatttgtagagtgatatatttcatatcaatctatgttgtcttttttttgttatttttttaataactatttagatgctctaaaacttcttatattttagaacggaaggagtagtttgtaagtaacgaggggacgtcgccactacggatgaaaatccacatatatccaccttaatcaaatataattggctcctggcagagttgtttcaggctttgtaaaggaggggtcctctgatactcccctctcgccgtcgcagttatatcagtgatgaaaacgtaagtctctttatgcaaaaaccatgagcctaagcgtacggtggacactgcttacatcgtacacggagccgcatgcaagcacaagctagccacgcaacttggctcatcacaagaacttgtaactatacatcgacatagatgtgcccaccaccttaatccaattattccaatacaccatgtacaccactgatgatcacgtatgaccgtatatataaatatcacgtcaaatgcctgcaggctgcagcagcatctttcagtcactatatatgtatactactactctataataacttgttatatatacatatatacatgcataaatgcgtacatatgtacagatatatgcgtaaaagtatactactacgtaggacctgtataaggatgtgcatgcatgatcgctcgcgtgggcacgcgtacacgtatacgtatacgtaggcaatccgatcgttagacgtaggggagggcgcagctggtggagcgggccatggtggcggcgccggcgccggagcaggcggaggggatgacgtcggcgccggtggccgtggcgcggtgctggcagctcttgcgggcgatgtcgcgcatggagcttgcgagggagagcttggggttgaggcggacggtggagttgaagcgctcgcagagcgcggcgtgcgcgtcgacggcgccgtccacggtgagcgccggctcccgcttctgccgctccttgacggcctccgagcacagcccgcacacccacttcccgtggaagcgctcccgcacccgcccgatgtacctcggcgtgcactcctccgccatcccgcagcactcgcaccgcacgctccgagcctcctgatccgcccccgccgccatcccgccgccgccgtccgagttcgacctctgcagcgccgccgcgccctgcatgcaaaccacgcaaaaagacgtaaatattagagaagaactaatatcaaataattaaaaggaggcttcgaatccaaatcatttagcccaccgccctaaaaagctagccgaaagatttcttgatatttctccatatataaaccacgtagagcacccatccgtcaccatgacataaattccatcgtatttatagacacaactgcgtgtacacgtctataggtgggtcggccgtcgccggcctagctccctccttgtcacgtacgtatagcagtcaccattcatcaccaacctcactaattacaagtacacagagcgagcccatcacaggtgattgtttacttgccattctgattgatggacctatcagcactaattctttgatgatagaaaggcagttttcacatactagctttaattaacaccaagtaacacagtataatgatggattatacgtgcagatcaatgatagctcgaatttgaagagggtcattagagcaggcacaatagcaggctataagccatctagaaacatattttatgagataatagaggagagagaagagcagcgggctagaaatctgtagccagctgcagcacggacttcaaaacatggtgtgtgtatgacaggtgggactatgtattaatagtatagtaaacaactattatatgaattgactattagattggctatagataaattagagttactagtgagctatactgttgaacttctcttaccgtggggggctcagcctgctgcctagccatagccaaacgccaaggcatctcgccctctctctctctctctctctctctctctcgaactttcctttcctaaataaagctactttaatcacctgctaatcaatgagctaagctgtctaatgtgtgtgcacaccaatcgcaagctgctaggcctaccacctggccctatttataggcacgagccgcccgaagcaatcgaggtctcgggttggtccggctcaggtccagtgtgcgcgcacagtgtctctcactggataaaatctccccacgaaaaccaatccatcttcgccaaaggggacgaaccacacccgcgccgtcgagctcgagagcaacttgggggatggatggccaatgtcaggttaaaagttcgcggaaaaaagcgatcaaaatatctccatgctgcatgatttcgcctgatctgtgttgcggtttttttcccagaaaagtgcaccggatcgatccagcacaggagcggatcttttcaagcggccaaatgggcagccaagcaggttaactttctcgtcgattaattttactgctactgttgcatggagtacgattcaggataccagcaactgtcacatacagcagcgtgcacgcacataatcgtctctaccctaaatggtcgatctgttcatccatgcatccaattaagtaagtggcaaaaaggatttattaatgtctgaacacatttatcttgattcttttcggattacggtttcatctgcagagatcgactgcacgcacacgcttgcacatggtgcggcggattggatggggatcgattgatcaagcgggttgtcgaaatcaaattaatcgcgcgcgcgcgcctgtgagcagctcacgggatgcgcatcgcggccgccatcgacagagctccatcgcctaacctcatctccggcaacatgacgactacttttcctctttttcgcctccctttcgggtgcgggtcatcgctcgccggcgtacatcattcgatcgtccgcatgtcgccggtgatttcacctccggcgccgtacgcctagctgaggcgattcaggtgagtgtgtcccaagtggatattgaaccccagcaattggtgatactaactaataattagatatctaaataaagcgtaggttgctgcgcaagatctgcgtgctctttcttgcatgtggagagatcgatcgatatatacctgcgtatgtgcctcactttactagctagctatacgtctcagtactttcgtacgtagtatgtaggtagcacgacatattagcaatgtgtgttgacgatggtccgatatatatatatatatatatatatatatatatatatatatatatttttccattgttagatgtggcaaataactatttaccacatggattcacatgtcatagacacatgacatgaggatccacatgtcattaacacatgtgtggcaaaatagttaaacgccaaatctaagagtgataaatagttaaatgtcccgtaacttctattaattataaaatcaatctatctattgaaagatagtaatatagtgaaagttaaaatttgatggtcaacggtgacaactgacaagcaaatgaaggcggttggagtaattttgtgtaaatactcacatatatgccgtagattctttttttgcaaaagaagataactgtgttgcttaaggagtagcctcatatgatttttttttttgttaaggagttgaatccctgtactcatagcttactgcttcaaaccattatctttttcttgtagcactttagttagttttgttttgttgcagatatatggttcactcttgtagcgatggtgtgtggtcgttagtatcggatctcaatatggttattagctgttgtcgatttctgtagtcgacagagaggtttgtgagcagtatttggtagtgggtttaaggttattgtgggcacttgactaactagacaaagaacacaaagattttttacacaggattagacctcctgaatgataatacggctactcctatcgaaatgtattgagagggaaaaaggattacactttgctcatgcaaggatgttatgcctctctctctctctcatgtgcaaaagcacctattattgcgccacaccaatgctagcgtcgttttatttacattatcctaccttcttcaccttctatcatatcgacaggcgtactgcttccaggcgtctctaactagtcattgtctcgagttgtgttgtacgggacatttgctttcccatctaactggacaggggcaggtaatgatgtatgttatgggtacacgggatatgcttgatcacctgtattttatgtgagaagacttgtgatagacatacgtatttattgtggaatgacaggatgcttaagtgtacattacattctatactcatgtcttgaccaagggacctatagagagacggtgaacaccactactagtagtcgcgaagaccactggagatcagcaaagactattagagatcactgccagcaacgcagagaccatcggagattagagggaccaccgccatagtcactgagatcactgctagtggccacatagaccactttcatgtccacgaagaccattagtttattagcaaatcctgcctattccgagaagagtaggaggcgcatagggcatcttctcacccatgaccctagtagttgtttcgaagattatcaatctcactctatgtagaaaagatataggagcaaaaaatgtggcatgcatgctttaaattaaaatacaatatacacttatgcaccagggatggtaactaatggctgtcaaagttttcttcattgtttaaagaaaatagaaaagacaaataaaaggttgtttcaaatgaaaagtcaaactaattaaggtggtggatatgaattggagcatgaaacttttgttcttgtcacaaaagtacggcccattctcaagtgctcaaatttaggcacttctgtatgcaactttacagtatttttttataagatacggtttaatttacataggaataggaaaaactccggtgtttcaaagcagaccttcaattaggaacatgtttgtttttgccattgcatccatgttccatctgttacctccttgcaacttaaaaaacgacaaaataatccattggcaaaaaagtaactgttcctaggtagcaagaagaaaaatcatcggaatatgaaagttacacgcaatgtacaacttacagcagcatgtataataaaaccaacatgatctagtaattctatactaaaataggaaagtacaatatacagcatgtacaagacttataacgtgaacctgttcaccacttacattaccatcacacacactgactcacacagttatacagctcatgaacaattaaaacttgatgcatgcagcagtgtactaacttgacaaataatgcaagtgcctctctgccgttgtgtcacctactcgcctgcattctagtacaagtctacaagatttctactgtacatgtactccctggagcagctgtgccagtgttggttcattatgttgttgctagcaggaacaaaaatgtgttgtgttgatcaatgttcccggcaccacttttatcgcgatgacacctgcaggtataggctgcagtatgcatgcgacggtagtaattaaggccctgtatagatgggactaaaacttttaagtccctatcacatcggatgtttgaaaattaattataaatattaaacgtagactattaataaaactcatccataatcttggactaatttgcgagacgaatctaatgagcctaattaatccatgattagcctatgtgatgctacaataaacattctctaattatagattaattaggcttaaaaaatttgtctcgtgaattaacttttatttatgtaattagttttgtaagtagtctatatttaatactctaaattagtgtctaaagacagggactaaagttaagtccctggatctaaacaccacctaaaggctgcacacaattcatgtcttgctgttgcaagctcattcttcagttctgagttctctggctcgcacatggtaagcatgcgcatgggatactaagcttggcatcatgccatctaaataagtacgcggagaaatgatatgtagatggaaagaacatacctcttccagaatggtgctaaataaaaagaggaaagtagcacacacacaaaacacctgagatagataggacatacacatcggaaagataggttcgcccataggaaagacaataccgctctaaacaagttaggtttgtgatgtattccgtccatggtattttgatcatctaaaaggtatcatgttaaggtctaaaagtcgagctatagtcttgtcaatgttgagttgaaatcaacggtcaataaaaaagtagacaacttgtcccacacaagttgagataagacacatcttcgatatcatccttatgaatgataggtgtttttagcggctatgatattgatagtgttggccgacctaataattatatatatgatcgacctacttatcaagcaaagaatatgtaggtccgtgacatgtatgaatctgacaggtacttttgtcataaatagacttggatacgatacgtgtctttatttaacaagcggctgatatttcaacgtacaaaacataaagtgtagagtagaatcacgagaagtatgaagtggaaaatataacaccctccttacaattactttttttttctttctgcaggttgtcacatgatataatagatgtttcaagcatctacaaaggctacaaccctcggggtaaagaacccattgtcagtaaacggagtacaaccccgttacagagccataggagtcataaaaccgccgagataatacagaaatgggctttctgcacctgggcctgaatcagaagccagaagaaaggctgtgcgcagatggagaaactaaaaactttgtagtgtactgtgtgggctatgacagcctctcacagcaaattcgcagtatctcaataccaaagacattgccgtggcccaggttttagacattgccgtgacattgatcgttatcgctaaaaagaagaaaaaaaacggacaactccatttactccttacctttctcggttcacatgcggatctaccaacgacagcgaggaccctggttaactgttcgtgcctgctgcaaatactcctcgcctactcggtcttgttgctccatcaggtgatcccatggagtggcagaagaaatgagaagcaacacgctgctcctgctggccggttcagtggacgtacgacgcaaccacgtaccggtgattactgtacgtatatatgcgtagtaaatgccttcacgaaggcacggcaaggtggcacgggaaagatcaaccagtgtcacgaacgccggtgcaactaggcggcagtagctgcctgcgcgcagcaacccagtcagtcagtcaccgcgcgtggcgtgacacggtgtacgtgctcggttgcggccgtagctcatggggttcttgccggcccccggccgtcgcgtgcacgcgcgcgcggcggcagacgcctcgatcatcgatcattcatccgtcgacggcgacacacggccgcccggcctgcgctgccacacgcgcgcggtgcccggccgactgtgacgcgtgtggattgggcacgcgaggcgaaacgtaaggtggaacgcgccgcgtgtgcgtgcgcgcgcgggggacgcagcgcagcccgggccacttggccgagccgcgcgtcccacttgggcacttggcacagccgcgcgcgtgttggagagttggacgccgccgtttcacgggcgacgggcgcaagcgggcaatttgaatatttgatggtgcgaagcactgttgcgtacgtatatatgcgcggctcagaggctgtttgcgcgcgcggaattacatatgtttccatctggaaaggataactatgtactagatcgagtatcagtgagaggatacgtactcttctgctgcttcctggtgtatatgtcctgtgttgccgccttgccgggccaactgttatcgtactgtagtctgtggaatgtactccgtacattcatcagagcaggtacaatagcagcagactattagccagctataaacatattttaatgagataaaatatgaaagataagagcatcgggctacagatctatagccagctgcagcacggacttcaagacacaatgtgtgtgtgacaaatgggactatatattaatagtatagtaagcaattattgtatgaattggctattagagcacccgcaatggtaaaagaaggtctcagtaatagactagattaatagtaaaccacctcaatagtatgtctacataggtatctatagctctatcatgcattgccttgtttttctctatagactatctctaagttagtagatagctttgctctctttcttcatttaatatctttcaagtagaaaaatatgctgacatggatctcttgtagagagcttatagataaccattgtggatattcttagattggctatagatgaattggagctagtagtaggctatactattaaacttgctctcagtgtttaattccggggagataaaagctggaaccgtactggttactggtttgtagaccagattcatcaacttgcttgctgcatggcagtaagccagtaattaatggacgttaatgtgttgctcatcgcttactctaccaccttgctattcccaggctccccgctatggatcatgcccaacaatcaattgattataaggaaattattttaaactctcgaggatacatcctctgcttatttacatgtcatctaaatagttataaatagttataaaagaaatttttaaaaaatcaacaagatagatctatctattatattatcaaaggaatagaaaaaggagcctccacgttcgctctcatggtctaaaaattctcacattaatcggagaaaaagaaaagtcagagtccatatagaaatacaatttagaaatagctgaaattcggaattaaaaaataaggaatattagaagaggagactagagtcaatatagaaatacaatttagaaatagttaaaattcggaattaaaaaataaggaatattagaagaggagactagagtccatatagaaatacaattagaagaaatagttaaaattcggaattaaaaaaataaggaatattagaagagaagactagagtccatatagaaatacaacttagaaatagttgaaattcggaattaaaaaataaggaatattagaagaggagactagagtccatatagaaatacaattaggaaataactaaaatttggaattaaaaaaattaggaatattagaagtagagtatagattacttatagaaatacaattaggaaataatagaaattcggaatgaaaaataaggaatattataagtagagtatagaaatacaattaagaaaaaaaaatagaaattcggaattaaaaaataatgaatattagaagtagagtatagagtctatataggaatttaaaactaactaaaattcggaataaacataataaaatgaaaagtagtgtttagagtccatataaaaatacaatttacaaataactaaaattcgaaattaagaaaaacatgagaagaagagtttaaagtcaatataggaatacaatttagaagtaactgaaatttgaaattaaaaattaaagattattgaaagatgagtttagagtccacatagaaatataattagaaataataaaaattcagaattaaaaaaagaaatattaaaacacaagtctatagtccatataggaatatatataatttacaaataactaaattttgatattaaaaataattaataactaacacgtatataaaatacaatatgaatattacacattagttgtttcgtaaagttattgcaaaatttaaaattatgttgtcattgtaatatattttaataatataatgagaaaacatatatgttattatatgagagaaaatataatgatgctaaccgcgcaatttgcgcgagccaccatgctagttatattatcaaaggaatagaaaaaggagcctccacgttcgctttcatggcctagaaattctcacattaatcggagaaaaataaaaagcagaatccatatagaaatacaatttaaaaatagctgaaattcggaattaaaaaaaataaggaatattagaagaggagactagagtccatatagaaatacaatttagaaatacctgaaattcggaattaaaaaaaggaatattagaagaggagaatagagttcatatagaaatacaattaggaaataactgaaattcggaattaaaaataaggaatattagaagtagagtatagaatccatatagaaatataattaggaaataactgaaattcggaattaaaaataaggaatattagaaatagagtatagagtccatatagaaatacaattaggaaataactgaaattcagaattaaaaataaggaatattagaattagagtatagagtccatatagaaatacaattaggaaataatataaatttggaattaaaaataaggattattagaagtagagtatatagtccatatagaaatacaattaagaaaaaaacatagaaattcagaattaaaaataaggaatattagaagtagagtatagagtccatataggaatttaaaactaactaaaatttggaataaagataataaaattaaaagtagagtttagagtccgtataaaaatataatttacaaataactaaaattcgaaattaaaaaaaacatgggaagaagagtttaaggtcaacataggaatagaatttagaaataactgaaattcgaaattaaaaattaaataatattgaaagatgagtttagagtgcagatagaaatacaattagaaataataaaaattcagaaataaaaataaataatattggaagaagagcataaagtctatatagaaatacaatttatagaaaattcaaaatttaaaaaaagaaatataaaaagacgagtctagagtccatataggaatatatatataatttacaaataactaaaatttgatattaaaaatgattaataactaacacgtatataaaatataatatgaaaattcagaaataaaaataaataatattggaagaagagcatagaatctatatagaaatataatttatagaaaattcagaattaaaaaaagaaatattaaaagacaagtctagagtccatataggaatatatataatttacaaataactaaaattttatattaaaaataattaataactaacacgtatataaaatataatatgaatattacacattaatagttttgtaaatttattgcaaaatttaaaattatgttgtcattttaatatatttgaataatataatgagaaacatatatgctattatatgagagaaaaaataatgatgctagccgcgcaatctgcgcgggccaccatgctagttaatagtatgtgataaatcactctacacaaatgcaaagtcaaatttaacttctataagttgcaataaaaaataaatttaactgcgaatatacattaaatagtcatagtttaatttattttttttccttacagtttgtagaagttaaattttaacttacatgtttatgtagtgattcatcatatattaatctatcttagaaattttttaattttttcataaccatttagatgtcatgcaaataacaaggggatgtctcttcgagagtttagaatccactcccttattatgtgtcgggctatgtgcttacatatgtgggaataaaatcatattgccctctcttaacttcttaactatgcgttgagcttgattcgctctcattcacaaaatcacatataaaggctcccttaactactattataatcatgtcaattgatctccctctgctattttaaaagagtttttggttgatgtgtgatggctacgtgtcacattaaattctaatctttatcctacatggtgcttatgtggtatcaaaattgaaaaaataaatataggaaccacttgtaagtcaccaacctttatcttctttctccatctgtccaacttttccctatcctatattctctcttccctctctcccctctcacctttagacgggcaaaggtggtagaggggcggtaggataggctgagagggcgacaattggtgttcctcttcagtcgtgtttggcccttgtcatgctaaccgccgccttctcggccgatgccttaatctaccactgtgtcatcctagtaagagaagagagatggtgctcactgacatatgactccacactatattaaaattcttgtttatgattataatgtcttataagcgtcacgtggttgtcacgtaggatgaagattggtcaacgtaccacgaaaacgtcatgccagccgaacctgctgtaaaaacagtcgagggaggtcaattaacctggttgtaacaatttatggagtccgtgcatctgaatttatggctgagggagttaaaatgaacttttttgcttatgggatttgtgatcgtttttgcctgcggagcccatcgtgtatatgtggttggtgtctatggattgacatagaaccctttcctgattcctgacttgaatttgtttcatgtgaaaaattttagataatcgcctcctcttgcactgtcccaagtctcccagacgacgagattagagttgtctttctttacttgtacagcagggaccctatcgtttcccccaatatggaccaactgcggccatgtgtacaatcgtgccatgtcaacccatctttatgagttacgagtacctacactgttcatgcatgcaccaactagctagtactaccagtagtactctactcacaaaaccttctacgaaatctgcgccaaaaacgagaaccaattttcgctttcactggaaagagcgcgccgggccggcgctttgcgtgagacgaaatcaaccagatgcacatgccatccacggcctcctcttctcccttgtcaaaccaatttacttaccctgaacctgaaggccatccagtactccagcagtatgtacaagtgtcagctttggcaaagcagatgatacacactacacagaataggatggacacaagtgagcaagtgagaatgacgcgataggtaaaaaaaaaaccgaacgaattataagctttcggtggtcagatacgtacgcagcgaacgtccaaaaaagggcccaaacgaggtggtagatagcaccgcaccggccaagggaggtgatgtactgatgtgcctacgaatccatccaacgggagccggtccaaaacatttttacagcagagtggttggatctaaatcccgtccttgcaatcaccacctcccagtccccagtccccagtcccccacacatgagctaccagcagagtggctgctacaactacagcataatcctttcaccaactctggcactctggctgacacgctgggcccactcccagtgaagttatactcgtaaaaaagaatcctaagacgccgggggaggcatctgaccatctgttctttacatgtgtgtgtttttgccaagattctgatgatcacgtgcagctttttttgtttaacactggttattactagtagcacggttgcatgcaccacatttgtgtcactttgtgcgcaccagcatgcatgcctcccttatcataacattgatcgattgattcaccaccacaagggcacgatcatcttgctcaccaaaacacagacaagattggaaatcacgtgtaaagaagaaagtaccgggtgctttgaactaattgaaactgctcctgtttcctcttcttctaagagtcctgcattacaaaattcaaaagaaaaaaaaatgtgctacgaaagaaactcctcagagtctgcttctaagggggaaaaaacactaaaaatctcaaaaaaagaaaaaagaaacttaagaagctgagaaataaagagtaaccaaaaatgcggtttgcaggacaaaaaaaaaattagctgtttttatcgctgaattattcctgggctaatgaatagtttcctaggtagcctggcgccggtagtccgggcttatgcggttatggatcaggaattcgtccgcgccggcgaagagcggcgccgacgacgtcggcccgtcgaacagcagcgggctcgtcacgtggagcagccctccggcggcgccgccgccgcccgcgcccacgtgcggcggcggctgctggtggtggtgcaggagctgcatctccttctggcgccgcagctccaccaccttgcggtgggagttggagtgcttggacaccacgaacgtcgggctcgccgccggccggtactccggcacgagccgcccggacttgtaccgcaccccgcacgcgttgcacagcgtcttgggacccatgggccccgtcctccactgcggcgtcttgtccgtctcgcagtggaggcacctcctcccctccgccgccgcctgcgcggccgcgttcggcgccggcgcgggggacggcccgtccttcttcttggcggacttcgccgccttcttggccgggaatgccggcgccgcggtgcccgactcggacggcgagatgaccgccgacgccggggacggcggcgacgccggcggcggcggcaggaccatcaggcgcgacgaccagctgcacggcgcgacgcgggaccgcttgctccgcgccttccccggcacgggcgcctccgtgggcagcgcgccggcgcctcctgccggcagctgcaccgcggagacggccagagcgggcggcgcgcgcggcgcggcggggatgccggagatgagctgaagcttccggagatcctccgtgggcaaggtctcctcgcccatgtaggtggacacccattccagctccgcgagttgttcatactgcgtagaaatttcacatcagacaaccgtctcagcaatggcgctagttgttaaactcagtaaattaacaagatattgtcatgaaaattagaataaaaaatacagtggctaagttggctaagtggggcgagtggacataggatgctactatttttggacgcagatttcctcggttactatttactcggcaggatgctatttatgttccctttattcatgggggagttttaacgcggggtggtgaattttggaaacgaattacgggtgaattgtacacagttggccaaaattcattgaaaaatatgtgccatatttgcgacgccgcgacagtaatcaaataaacggaagccaaatttagccctcaccggctcgcacagcccgccggagaagtccccgtcggcgaggccggagaatgagttgctgcagctgtcgacggccgtcaccgtcgacgagtcggccgacgcgttcccggccgcgcggtcatccccgccacctccgacgacgcccgctcccaggccggcgccgccgccgccgtacgccccgcacaaccccgtctcctcctcctcctcgtcgcacggcaggtcgaggaggtcatcgacgaggaacatgtccccgctgccgccgcagcctccggcctccttcttgacacggaccccgccggcgtagtccgccgccgccacctccatcgatccctacttcaccaccacgcagttcttgaaaaccgaattcgtctatatctcctctcctttctacctcaccttttgctaatgcttattctttcatgattttctttttctcttctgtgcgtgcgtggagaaggaggcggagataacgtgagggcggagagagagagagagagagagagagagtagggtttaattgggaagcgttcgcgttggagagcggagtggaggacgacgaggaggaggggaggggagggagggcgagagagcggtggtcaggtcagctcgaatgaacgattcttaaggagtaaataaagccagagccactaccccttggggtgaaaacatggacgagtttaaaagccggttaaatccaaaatcccacatttatagcagtaatccttgggagaagacgacaactgtagtgtacaccaaaacggaaccatgtgatcgttgccaatgcagcaatgctcattgcatagtgatagtgctactatctctatctttactactataaaaattaaaaatattttcatccaaattttaatacatcttatccatatttgagtctaactttactattataaaaattaaaaatattatgtttgagtgatttttttaagttggttgtacgtcgtctgtatccaattcatcatgaaactagattatctattatacacctcctttcagtccaaccctcctcttagctcaacccaatcgaaccacaccatccgggcaccccgtcatgtgcaccaccacaacacactgcgcacccctctcctgttttttctatcttttttctcgttttctttttatcttttttcttttctcccaatcatcctgatcctctcctgctctttctaatggcctctctttactcgtccttttctctctgttttctccttttcttttatgttctaattttatattttcataaatatttttcttttaaaattataattgtttaaaatgtgtatgcgataagtttaatactttgcaaatgtttttcatttatagtaaaaaaaagacttttactaattgaacaattaaaattccaacctatggtcgatgaagtataacaaaatacccatgtatcaacttatgacattgccacccatcaatttgtgagactatggaatggtgtatataaggtattcttcgcgtgatgacgcatgaagcgaatacaaccgggttcaatactatatatttcgtgtgtttttctattgttttgtttgtcttattttggtttgtcgtataaattggtaaagtttttttcaatcgtaaaattgccttcacctgttacaatacacagaattttttttctagttagcatatatatgaggaattaatttgttttttagggtaggaattaatttgttgtagtgggaaaaaaatcctatacaaagacgtgtacacacgcgtttccttaacacatgctagagagatagagactatagaccgctgatatcactaaagaagcctttgtttggcacttagttaggggtaaaacaaaaaaaaagttttcatataaaattaaagagaaacaactcaacctccattgttggcataaagttgtatagcggatttcaggcttatctatattacacaaagatttgaaaagtgtattacggagtagttgttagagtatcgtgagtttgaattgtatttttcatatattagcaaaacagaaaaaatgtgtaactttgctactgtcctcaaaggagaaaaaaaaagaggggaacaaaaccattggcctactaagcaagccttcgcttagctcttagttagaagaaaaaaaatccaagtatattaaagaggaaaacaaccgaacttctattataagcataatgtttataaattataacaaaattttaggcttgtctgtattagccaaaaaattgaaaaaaagtgtgaattggggttatttgtgaggatggtgggggagaaagttctctacacagtgggtgcaaattgtatttcacattttttttcaaaaaaaaaaatctattcacgtattatcataacagaaaaaagaagtaactttgctactagcaaaaaaaaagaggggacaaaacaaaaggtaattttgctactgaatatgaccattgagcaatttcgttttcattaacgtgtggggctgactggtgatgcacaaaattgagcatggctgagctattgtgttttgtgcacttcaaaagggaacataatcatataaaaagtagcatcacatgtttggccatcatatcattcagtactatcatagacttatctactccaaaatgcacctatcaaattttgtgaaaaaaaaataaataattacttaaattttttgaataagaaaaaaaaattaatcaagcctaacgtggtatgatctgaagcattagtcagtgattactagctttcaaacaaagcccagtaaaaaaaagtattctactgtactatccatactacttcctccgtttcacaatgtaagttattctaacatttcacatattcatattgatgttaatgaatctatatagatatatatgtctagatttattaacatcaatatgaatatgggaaatactaaaatgacttatattgtgaaacggagggagtacgatgaatcatggaagcagtaagcattgttgcacgcagcacctgcacttttccatttactgtggtacggttaaaatagcttcaaaaaaacggtgtttattagcccccaacattagtagaagggaccagcgtccaggattttttagtagttgtagactggaccaacgtccaggatattgccacgtcgcgccacccatccgtaggatttcgccttcgtgggagacgcgcatgtcacgggcctgtctcgtgctaccacgtaggcaccacgtgggccgcccccgccgctaggcgctccgtggccgttggatgcgtacggcccaccacgtggccggcatcagagtgggctactgggctggattagataagagggtccgggccctgcaggctcaccgatcccgaggtggattggcctcgggagacgtgacaaatgctggggccggttttgttttctgtaaatttataattcctgacctcgggagcggtgatccaccagcatgttaccaccacgaacctctcaacctcatggctgaatcatttgcttaaaaacagtggcccaaaatattaccactgtgcagcacatttcatgtcttgtttacattggaaaagatcctaggaagtcaaaagtattcagtttttgtaaaaaaaagtcccagaagattagtatttggaacaaaagaatgatgatacacccaattcaattgtattgaaataggaattgccattgaatataaattttcaaggagaacaattgtgagatttaaccacttgttttttcccattcaagctgacaatttctccatgcaacttctaaaactttcatgtactcctttgttggtctagcgtgttggtatgttcacggttcagatacacttaatttttcaaaattttagcaacatttacacaactatagtatatttaaaatattcagtaacaaacgacatgatttttactctatatcttcctaggctctcacctagttttgttagggtagatagccaaacaagctattttgaataagatgtcgacaactttgtcaatttggtattgttccaagtgtgaaattgtatacaagtgtttagaatgttcctactacttatatgttctgaagatactgcaactaaacgcattaaaattaactctaaaattaagtactaaaatttattttttaattgcgtatgaaaagctaaagagcaagtgatgaagctgtaattgtactggtagaaaagatgtgctatgctagagtactctctctctctctctctatccattatataataataaaccaatttttatataataagtctaaacatatcccctctataaaaaacaatttatgactacaaatctaattgtaggttatatcgaaatctgtagctataaattttggaatagacgaaactagaagaactgtcacttggattaaattcaagacatctcgtaacggtggtactgtagaaaagtacgtactagtagtacaacaccttgtgctttgtaattttaaaatctaccgtcctcgtttatgtaccaggccgattatcaacgcactgcaaattagaagagatgccctgacaaataaaatcacgcataattttgtgggccgttgacattgtagtagcactgtttaaggtggagtggaaaacatccacacttctaaacaaaaatactcatcacttgttaccctacaacgtccaatgatgcatggccgcacaaggaaaaaccaagagaacgatgggaacataatattatcgctgtccctaagcttttctctcatttttttatcttttctttcatttctttgacttcttttattcgagggcttttcccctttctctgacaaagtggactacacgggccaaatattctatccgctcccacgttctccacggcacggcccatttataaagcgaggtgatggggtggtgtgggtcccgccggccacgtgagtgctagctggcgagccgtgtcaggagtcatgtgagcggcggggtccgaccgaccgacgcgcgggggcgggccgcaccacccgcaccgcacggcccgcacccggctccggtacgtggtcaatgccacgtcgcgcgccacctctcgtcgtcgtcgtcacgtcacgcgaggctccaccttcccctgtgccgccgtgctcccgtgtacagacgcagtgattggtgaaggttgatagggagggcaaaaatatctccgacgcgaacgcgacgcgagagcccgtgaacctgtctgcgattttctgatgtgcaagcgctgttcgagtcgtgagatgagaaatgatttttgataaacagggggcgtcgtgcagtcgtgctcgttagtactttgcttggagtggatgctgcgtttgaagactttctgggggatgaacgaactgttccaattcttcagacccaaaaaaaaaagaaaaagaaaagcagaacagaagacgtggggggtgacagctgatttattgcggttcgtgaacatcagttttgggtgtgtttagttcactctaaatttaaaattttggttgaaattgaaacagtgtgatgaaaaggttaaaagtttgtgtatagggaagttttgatacaatagaaaaattgaaagtttaaagtttgaagaaaaagtttgcaattaaactcggcctttgctttgcgagcttatcacaactgtgaacgcgtgcacgtccaagaaagaggcacgtattcggtattccatctgagccaaactatcgacgacaacaaagcaagggcgtactctgaattccggtgcaaaaaagtagtgctttcatttgccgtgcagcgggcatgtgcccaacttaatttttcgcggcgccgggatgcctggccaaatcaggaggccccgcgtacaacgcatgaagctgctaagttctctgttcttgtatggaaagcatcgtgctttcgttactgggtcaaccttcgagctatctcggagcatacagctcactctaaaccatgttcgtaccactacactttgtactagtagatagtgagagcataattgaatttgtacaatattcttcctgctgtttcggatcctatttagtatcttatttagatcctacttggttgattgagcgttaggaaaacatatccatactaatccaaaatctataaaaggaaaagaacatctcaagtaataaacatgatgatattttccaactttatgattctgcataaagaataagggagtaactatatttacgtcgccacattttttatatgaaaaacatatcaaaccaagcaatatcaccatccatctttacctgaagggtttcgttcaaattctaactaaccgataaggcccaaacatacaatacggcccactggcccattatccttacgagacaagtaaaccatcggcccatctggagatccgttatcgccaggcacacaccctgccccgtcctctcctcccccttccccccacctcgacgaaccgacggtttccccggccatggctgctccgccgccgcggcgaaccccgaaccccgagcgcggcagcaggaggaaggtgagagcaccgccgctcgccggacttactgctcccgatccctaaccccgctcgtctctctgctctcgcagggcgaggacccgtggctcgcggcgagccttcgcccggggaatttcctcccggggctcgcgattgggttcctcctcggcctactcgtcgacttgacctcctcatggaggccccaatcgagtccaccgctggctccggctgccccggcgccgcggggctccaagcggacgggtggttcgtcgtccgctggcgggggcatcggcggcgaagagcttaagatggtagcttaaaactttctaagatttcttctatactggattgcatctcaatataccaggaattgttcgaaagaactcgtgtgatatcggactgtctgctggtgtaattccgcaactgtagagctgaactttgttctgagttttggcactccttttgcaggttttggtcgtgcgtaaggacctcaagatgcgggctggaaaaatagcttctcaatgtgctcgtaagctcaacttcggaacattagtagaagcatttttgtttcctcaattcctttttttttttttacttatcctcgaagtgtaggctattgtgctttgctcaaatagaactaatttttgtttgacttatcctagaagtgtagactattgtcaacagaacagcaacaaccaaattgtaatgaaagctgctccagtttaagtcttctatcgactaaaatattcaaacatttttttttggatagacctattttcgttgcccgatcgttgaatgtttccatctcttgtactatgaatcacctacaacctacattattttgtttgcagatgcagcaactggtctgtatgcagaactgatggcaaggtgctaacgcggtttgcaatttttctcacttaggtagttctaattgaaatatgtagtagactatctgtacaaacatattgcttacctatgcatctaaaactgtattgacactgcttacaagtatcggttcatgttttggttatcatgagtttgatattttgttttatttgtatgaaagaaaatcacatagcatccatgaggtttgagttgcactggattcatatagctcttgtaagactagtctataggtgccagtatcaaggagctatgtcctgaccttagcagtgttgaagattttccaatcaccattcatctgatacatctgtttgcagcaaccggggtcttttgagacagtgggagcaatttggacaagctaagattgttttaacatgcaagaatcagcaggaaatgtaagctgttgctttgcctagcacacatgttcctttgaacaatatttactggatgatgatgtagcactccttttcttatcatgcattacaggaataggattaaggaaaccgcagaacatcgaggtatcccaacatttgttgtcgctgatgcaggacgaacacaggtctgtttatagtgcttctacaactctactttcttattcatagggtggaatttttcatacttgtagcatttgtgactttccagcataaccaataaattgtggcagctatgctatgaaactattgctacattatttcctctttttttttaggagacaatcttatttacccgtgactgtgcacatccatctggatgtagaggccgggtttttcattatctaaaagaaaaatcttatttaccctgatccttgctatttcttattcttaatgtaggtacaagctgggtctaagacagttcttgcagtagggccaggttggtttctcactcagaatgtcacgtttgtgtctcttagctgcaaatgtctcagatttgtgcgtttgaagtttgaacggtatatatgagttggaatctatctcatagttttcatgtaaaaaaaagtccatctcatagtgttcttattttgtttgttaatgcaaca

SEQ ID NO: 83375 - DNA, 11538 bp, Oryza sativa
agggaggggaacttcaggcgtgacaggttggctggttaaaatgctagtctgactgttcagaacttcaggcatgacctgcagaggcataaaatcttcattaccatgttgttgtgaaggagcagcactggcttgctgcttttctgctcatatatcttccttcctcttcttgcagcccttctttttgtgattaactccttgacagtagctacaatgcatttgcacaccatgcttggatatttttgttcctccttcaagttcatgtggctgctttcttctacatctcctaggccttccaactttcttctcataaatcggtgggttcaccttggtccattcatcttcacccaagatgccttgtccctaacaggcattatgttaaatccataggcctccatgtatttttcagttgaataatagaaggataccacatcttcaggttttgtcctctcactcctcaagcaagaaattgcatggttgcatggtatccctatcaattgccatctcctacattcacagtgttttgccatgaggtcaacaatatattggtgttctttatcagttgcttggaacacccctttaccagcaggtaatatatagcatgtatttgacaattctgcatttttatcaacctttttctatatttttgggcatatgtttcccgaccacttctttacacactcctcttgtttggtatgtatcctattcatgatttggctcctaatcttttcaagcatggataaaattggaagctctctggcttcaagaatgtacttgttgaatacctcggaattgttgttgagtagaatatcacacttggggaaatcactaaagaatgctctgcaccactggttgggtggtatttcctccaggtaggcataagcatctttgctaagagacttcatcttttccatgttaaattcccactctggtatagtacttgaccttgcaattgcccacaactgattctttagagtctcccctttgtatagaacatgaaaattttggtacaaatgcctaacgcaaaatctttgttctgaatctgagaatttatccctcacagctggtaccaatccctacaaaatttaaaaaggaagggtgagtaccaatccattgaacagtaaataattcaaatattttaaaaatgacaagttgaacaaaatcaaatatgatggaataaagtcacaccttctgcctgtctgtcatgatagtataaggtccagtgttgtcgataaggagatcttctttcaaagtattcaaaaaccaaccccaactagctctactctccacctccacaacagccatggctataggatagatgcagtcattaggatcaatgcctactacagtcaacaaatgtcccccaaacttggttttgatgtggcatccatcaaggaatatgataggtctacaactacttaggaatcctcttttgcaagcatcaaatgacacatagcatgtatggaagcacatattttgtaggttcaagaaaaatttactacctggatttgaagtcctaagctcttgtccataatcccacaacatatcgtattgtgctatttcatcaccatatatcgctttcatagctagtttccttgctcgacctaatttatgtcttgatggtgttacatttagttccttttgaactaccttagagaaactcttgagtgtcatcctatcattatccctaaagctttcaacatatctatttgcaagatacctagcagttacataattcaactcccactccttctgacatttgtggccatctatatatctttttaccataagacaattcgtcctgctgtcctcagctacatccaacatccatgagcactcttctttacatttagcctcaatttttttcttggtatttcttgtaaatttaattgcgactctattcttcacactgtattgttttattgcttgcctaacttcaatagcatcagagaacaacatcccaaccttaaagattggtgactccatgtccacagcagccacaaagttcttaaatttcaacttaatgccttcattatcttcatcagatgactctggaagcaacaagccttcatcatcagagtcatgttcaggaagcttaacaaccatcttgctgctagccacttcttctatctcaacacagttgtcaaaaacatcatcatcccccttgttagcctcataatcactgtcaacaaagtcaggatctacatcgatgtcatcgtcatcgtcaatgtcatgaccttctataggtataacacctgaatctttttgattcattgtagacctctcacggctagccacgataggtatagaagcaggggtagaaagagcaacatcatcccaattgatggattcaagaatgtcttggtgatccacatacaaaagcaatgtcctaaaccttggtgctaatacaaccatgctgttagtgcttgcatcagagttaattctccttagcccatcactgaatgtcttcccaggcaataaccaataaaccttggccttctcagacatatcatatcctagttgctcaataaaatcatcaagccataatgaagaccatgtgtcactgtcacaataatcaaaccaatccaccttttcattcaaataaattttgctactaccaactccagagaaaaaaccaccatgatgtagttcagttgtgaactgttcatcctcgcagcctatattacaagacaaaccattctgatgtgtcaaatcgtaaataattatctgatctattatacacaaaaagattatacagagtacatattcatgcttagagcaaaaattatttctaatcacaaactattcgtgaaggattacttatatgacacctagccttataaaacaccaaagcagtggcggaggcagcgccgggccaccataggcaattgcccaggctccatgcatacaacaacactgccccaatgcatatacaacatattactcattaatcatatacttaatcactttgtctcataggttataatggagattaattagatgaataaatagaaacgaggaagcaaggaccaaaccatcaaactgtagctacagagaccaaactatacaatcacaagattcaagaaaaaacagagaaacatgcaattaccggtacaaatcaatgaaaccctaactttatcaacaacaatcaattgaaccaaaaacgaaaatatgtaatcactagggagttatttaccataagaaggaggggacgccccaagaattcgccgagtcggcgccatcccagcgcacgaggcgatcacgtcagatcagttcgtaggtctgaattactaagcgcaccagtttgggatgatctcagatcagcgtggctcatatatgatgccctcgcaaccggtgcagaggcgatgcagttttgctgtgcactcgctgctagccgccgtcgcctcttgatctgttgaggtgagtaaatcacggatagaaaaacagaaccaaggcacacatattttttgctatgttaaaacaaaagaaccaattagaatataaaaactactaggaggttttttgtaaaatgagatgggatatcactccatgatgctgatgctaacgtgggactttgtccaaggtggaaagctgacgtggcaaaaaatcttatgtggcagccttttgaaccacaaacgcacccacctagccaagttgttgcattggtatgtccaattttcaagttctcgcacttaatcgcacccacccgccaagttcttgtaccgtcaatgcaatttactctaattgtaaatagctaactattatatgtgtgtggctaagagaatgtggcaaagaatcttatagccaacaagtcggctgtattattagccttgctctaagtagtagtaggagatactccctctcagtactcataaagaaagtcgtataggataatgtttaaatcaatcattgggaataaaatcatgaataactcttagtttgtttagtttgaaaatgtaaaaattatatgaatagatttgtcttgaaaaatactttcataaaagtatacatatatcacttttcaataaatatttttatagaaacaagaagttaaagttgtgttttggagaccgtgtcgctgtcgaaaacgacttcctttacgagtacggagggagtattaaattccgacaaataattctctaaattattacgagaatatccgaccatcgtaatagtttagagggattaatcgtcagactttaatgtcttctactactcatcattcatgagctcataaaaactaaaatttatgaatattccataacctttctacttttcaaaccagacaataagaaaaacccatataaaactagtcggcggtagatttggtctaagctgacttacttgatacaaacgtgacagatcaattagcaaaaagcattaaaaataattcatagaacacatgtcatatgcatcacctctccctctctttatctccttctattagacggaggcaactggaggcttataattaggtcgaggacaacgtctgttggcacaggtggaagcagttgaaagctcaggctgtggagctcgagctcttctctcggggatttgcatctggtttaacagatactttcacctagtgccaagtggagcaaaataatggtcacacacaacaccatatcataaaaggaaaaaagatatcacaaacttatttttctcaccatatcataaaaggaaaaaagatatttgtaaaacatgtgttctacaaaattaaactattgcttcacccagtcatatgcaatattatttgagaacttattttaatctcttagagagatgtactcttattttttacatgtcatatagataattaaaaaataataataaaaatataagttagattaatatgtgatatatcattctaattgtttttttttaattttaacttgtacgagtgataatttgcatgcttgtaaaatgatatatcgcatattatatattttattattttttaactatttggatgatatttttttttagaaaatggattaaaatccggcattacatccacaatgaacttacacagccggccactatttggatgacatatatatgtatataagaaatgatgagatagtttagcatctattttcgtattatttcctttgcagcggacatagtacatgacccacagttaatttttggaacgagtaaaaaaaataaaagaaatgatcgagatgacccacagttaatttactcctgactgaatcaccggcgggcaattcagctatgcaagtttgtcgtgcatagcagtcactactgttagtcctgcataatcagacaaagacgcatacgcattgtcgtggagtgagctagagccaatgtgcggcagagtgtgttaccacgactgactgtcactgcatgcagcactaataatcgcttagcatgtgatgcacgtacacattattgtcagtcaatgtcatgtcatctctgcacggaccaatattatctgcgccaatcaggaatataatcaactcagctagtactaattgttgattactttgatcttccctttttttggctgtattcttctcctctctttttttctttagcttagctagaccagtaggagtacgttgtcgtagtaatagacgcatccaattggcttgatttgtctcgagcatctggtttccttttctaacaaaaatcattagcgcataattaattaagttttaattattataaatttagaaaactgatttatttgatatttaaaacaacttatatatagaaaattttctcacaaaacgtattgtttatcaattttaaaaaatatggaaataaaaatcaagataaaacctatttcatatgtccctaaatataagagattttgattgaatgtgaccaatctggataacttgtccaaattcgttgtaataggatgcgttacatctaatcaggtactccctccgtttcgaaatatttgacaccgttgactttttatcacatgtttgaccgttcgtcttatttaaaaacttttgtgaaatatgtaaaattatatgcctacataaaaatatatttaacaataaattaaatgataagaaaagaattaataattacttaaattttttgaataagacgaacggtcaaacatatgctaaaaagtcaacggcgtcaaacattttgaaacggatggagtatataataacaaaatagcacgacctagatccgaacaaaatctctccaggctccatagtatttatctgagcaacttgtgtgggcggcgagaggcagctttacgctcactcaccggccgctgatgctgcccatgtttcatcagtacgaggaaatgcaatgtatactactatctacatattttatcttggcacacagatcaaggataaataattctacttgtcatctatttaaacatgctactagtcattcctcgtaaataaacaattcattaatatttacatttctcaatgcctatgtagccaatcatgtgtggaagaatggagagtcacacattaaatccgaaaaaattattaaaatgatagattgttggattgaaatatgactactaaaaataattttttcagatttagaaatatgactatcaaaaataaatggagggagtactccccaaaccagctacacacaaagggagtggtcaataattacctggtccatcgatcggttccgacgattagtcagaaaaagaaaaataatcaagagaaggccaatgagcatcgcgatttgtgttcgttcagatcgccaatcgatcggtaccatgattgtgattccaacgacggaattgttctcttcctagcctcagggccctataggcaattgattaaccgtcacctgcatggatacactgtacagtacctgagtaccatacggggttcaccaagaattctgtcaagttgaacagtattgtaagtgcaagtagaataaaaaactataagctagctaactacaaagacctgtggaggaggaagaaaaaatggcttcatatttattgtcagttattaatagtactgtagtactccctccgtccaaaattatagggcaaataaacccggtagcttttgactaataatcatactaactatatctatactaattattatgtacattatatcactagatttatattttcaagtactgatgttaatttcatatttcttggaatcatagaataaaaaaatactagtcaaaatatattattgaaaaccgtgtaaaaaaatataggttttataatttggaacaaataaagtatatatttatatgaaactactatgtgtaggctattatattagttataaataacatggttaatttttagagctatcagctgagtatactattaaacgttgctcttatgtcgttagctgtgatatgctgcctcgggcaacctagaaaaactcgaggagtcgcgcggccacttgcggttgcgggggaaaaaaaacacgaaagcataggcatccacgcgatcctacgatgccagcgcgtgcggatgccgcgcccaaaaaccggtagctggtttcgccgccccgtagggagcgcaggcagtttcacgcgcgcggcccttgtttcgctccgcgcaacgcgcgcgcgagcccaaaaaaaaaaaacgacgggggaatcatcgcctccgctgctgggttgtggcttttttgccttttggcgcctagctacgtaccaacccacatcacgcgcgtgcgcgtggtggcacactggcatgcatatggttgcggggggaaatcggggaaaggaaaacgcgcggccctcgtagactcgactctctacactcgcgcgaggcgagcgatgttggaggggaggggggttgcgtgtgtgacaccgctcgggttgtccctctctcgctcgcggatgattccctcgcctccaccatcgatcaccaccaccagcagcaccaacccaaccacagcctacgcatacatgcagagcatatatgctgctttcctttccatagcctgttgacaactagaggaacacccggggtttttcggctagcttcataagatgattagtctagatgaactggattcaaaacctcacccccttttaattatttgatattagattattttctaatattcgtgtatttttagcctatagccattatatattatgatgacgataataatccgacgacgtctaaggatgaggcaggttaattgggatttgtcctcgcaaaaaaatgaaaaaggtttattgggatttgtgaggaggatacgactacgaggacgatgtttgcatgttgacctttgttgtggggcaggtcacaccgggcaacaatcatatgtgccgcaccatgctagagtgctttattttgtttttgttggttattcgtgtgagttatttaatttgctccacgctttttaaatatttaatttatctctataatcaagaagataatccatcaaaataatatgcttaataatcatgtgtgctgtgatatgcggcattgttgtttttgctagtattccataaaaaatattacaaaagccaaaacataaatcaaatatgaaaatttaggaaaagcaaaaccataaaattacaaaatagataaattaattacacatgataagctagtatgcgttgatgctgagattctagaggattctttttcaatttatttcttcaaaactaaaaacatttttatgctctctctctcccctctttttaaattgtatttgacatgtagatctcacggagtaggttgaagcccatttggactaacccatgtcatgttcagggactcaaaaaattgttttttagagtgtagagattagatgtcatacccacataagtttagggactgcccgtgcacttcacttttttttatgtgtttgtgaatgtaaacacaaaaggaacacaaatttagattaatgcatcgcatctcatttgtactacactaaatgaatatcaaacaaaaatttccaaggtactgcacccgaagagatagggaatagaaagaacacaattttttgggaagatagttagattagaggaagacctttagttgagaaatatccaacactgtattacttttaccaaaaacattactagctgttgcaaaggaatttaaggagggtgggggaggggctatcaaatttagaaagaatatgcgaagtgagatagctcatctgtttagtttttctagaacctatgtacccggatttgagttctaaacttggtctttttataattctatggagagtaataatctgcaattccctttctcagagatttgaatgttgaaattacctttcaaaattaaggtggtctcatatatggttgctccttagaaatggtatccttaccaaagataatttccttagatggggctggaaaggggataatttccttattggtataataatctaattgtgaaactattggacacttatttatgaaatgtgctcaggcttgatttgtggagaacgtaattaatatcactttcaatttgggtgcaatttagaatatcccacacatatttgagggatgaaacaattttggaaaagaaatgaggaagctaatagaggtaggtgtataaccgttgttccgtgagcaatttggacaaaaagagaaatggtgcttttttttaaaaaaaaattactgctaatagaggtaggcttgattactcgcccgttggagcgaatcagacatgtctatttttgagtttcattccaaactattttaaataaatcacaggaagagacataagaaatataattttatgagtgagagatgtgggtaggtcagacgctaaataggatggcaagtgacatatatataatgcgagatatggccaacgaccttggagaagaagactaagatgaattctctaagtcttggcatgaaggttttatttaagaagaaatgagtgaaagaagtccagggttttggaaaaatgctacttatgtcatctaattttggaccattttctatttttcggttgttaaatacaatacttatgttaagtgttttttctctctgtagagcaacttgaaagacaatgggatggcattattaagtcaagtgtcgttgataatggattatgtactatttgcccatttatgtaaatagaaatgatagaggccttgacctctctttttggaagaagataacatgacttgagaagcatactaacatagactatcttcatgatagtgtgagtgtgatgtgacgtctcaatgccatttgaaatctgtaggaagccaacgacatagtctatttgtaccaccataaacattatctgcatacatattcatactagtaccaagtttaaaatgtcaaatgaaaaagttggagagaaagataaacatatattggggttgagagagggacaatacaataatgggtggagaaagtggataagtaaaggaacaccaatatttgtgtggacgatgaggctatcatgttacgtatttttacctatctcgactgagggaaactattttaatcccttgaggggatgtctcctcattgtttgcatgtcacttaaatggttatgaaaaaattgaaaaaatttaagaagatgtattaacatgtgatatatcactccacaaacatgcaagttcaaattcaactttcacatctcacaatgaaaaaaacaaatttgactgtgaatatacgttaactagttgtaatttaatttgttttttcgttgccaaatgtaaaagttgaatttgaatttgcatgtttgtggagtgatatatcacatgttaatacatcttctcaatttttttttaaattttttcataaccatttgagtgccatgcaaataacgaggggatattctctcgagggatcaaaatccactccccctcgacagataaataaccatttttttttgcgaagaacaataactttttatgacattattaatacagatgagttttatatttataccaaacttcaaataaaaatatttagcagtatttgctactcgtgttaatctctacagtacaagttctcaagaaaattacactttgccccgtggggagttctaatcttccagtatttctcgtcgctctcgatgcaattgaaaaaaatacacacgagttgtaacgaacaaaaaggaaaaaccgcacgggtttatcatcaaagctggatctgcacaacaaacagcctcgcaacagaaagagaatcaccacgggacaaaggcggtgacgtgtcacgcggcgcggccccacacgtccgcgtgggcccggcacgtgccccgcggcgcgggggccacctggcgccgagctgggctcgcgcgggtgtggcgacgtcggacgcgtccaagacatcggcgtggcccgtggccaccacccccaccggcgggccccgccgtcgccgccgccgccgtctccctcctccctctccaactataaatacctcactcctcctcttcccgcctccacacaagcaaaccaatcatcacctcttcttcttggggtgttcttgactggaaggtttctttggtgatggcgaaggcgagcgtggtggtgcctgagcaggtgggcgcggcggcggcggcgcaggtggggtgcccctgtccgggcacgacgctgttcc

SEQ ID NO: 83376 - DNA, 2844 bp, Oryza sativa
tgctcactcaaaatcttgtcaagagtgtccttacccttgaagcacatctccaaactctgttgagcttaaccacttgctccttaagctcattgttctcaacaacaagtgaggcatcacaaatagaaacacaagtgctagagctagagctaggcatatccacaagatcatcacaagaggtagaaatgctagatgatacaacatgagcaatatggcaaatagcactatcatcaagcaaatcacaagatatgccaacatcaatgagaactccatgttgagtagtggaaaggaggttgtcatgagcttccttaagcttctcatgagaaatggtgagtctctcatgagaggtctttagctcctcatacaagacctccaaagaagcatgatccttctttcgggccttgaacttgacaatctccttctcactataagcatagagctccttaaacatactcacaagctcatcataggaaacatcatcacaatcatcatcactctcactatcactaagaaatgctaccttagaggagtcctttgccatgagacaaagtggagcgaagagtgatggagcctccttgatggcaacaacggccatcttcttcttcttggagcttgcatcatcaccaccttcttcttcggacccggatgaggcggagctctcctcatttgagtcccattccccgataaaggcctcaatattcttgccttccttcttgagcttcttcatgagcttgtagcctccactcttcttcttggatgacttgtctccatcatcatccttggaagggcacttggaagcaaagtgtcccttctcaccacactcaaagcacctcaagttgggaagagtcttgttgggtcttctatttcttctcctattggagttggagtcccttcctctctcctttctccttcacaagagatcattgaaccttctagcttgtaagggcaatctcttcctccaagtcctcattggcttcattcaccttgcccttgcccttgtctttaacttcggcttgtagaacaatgcacttcttggaatgtgagacttcctccatctccttcttcttcaacttgtacatgtcattggtgttgatcttccccaagaggcttgcgggtgtcatccttgacatgtcagagttgatgagcatggtgacaagggtctcatacttctctggtagagccctaagcatcttttgggcaacctcaagatcggtatagtttgccccaagtcccttgagatcatttacaatgacattgagcctcccatacatgtcattcacactctcatgaggcaacatggagaatgtctcatattggatcttgaggaaatgaagcttggcatccttgtactcgcttatgccctcatggatctccgccaacttgttccaaatctcatatgcagtctcaaggttgctcactctatcgaactcctcttggctcaaagagttgaacaaagcattcatagcttgggcattgagttggaggttgcggtgatcaatctccatcaagagcgtgccggtgatagcaaagcctacatccacaatactccaaatatggaagctcatagctttgaggtgagtagacattttaatttttcaagtggagtagtttgttccattaaacatgggagccttccctacatggttcacctcgttcgacatcttctctctaggcggtgaagcccaatcaagagagaccaagctctgataccacttgtaggatcgagatgtcgactagaggagggtgaataggtgatttaaaaactaaatgacacctaatcaaaactaacctaagttgctaggcttggtgagggtcaactctaactaagcaactaagttatgttttgcaaacctagggtgatagtggctcaattatatctctaggaaagtaaatcacactcctatgtcgatgcttagcaatcctagggtgataagatttcaagtttgtctctagaaatgtaaattgcacaaatgtaaatgcaacaatcaaatggacaaggagacaagagatttttcaccgaggttcggaaactcgccggtttcctactcctcgttgaggcgagcccaactccaccgctcaaccacgaagccaccgcacgcccccttcgtcaaggggtgggcaaggcgggagccggcccacggagaggactacccaagcctcgatcactagggtagttcttccttcactccgaaggtggtgaactccaaaccactcacaaaccagcgccgggcctcctccacaatcttctcggagaggtcaccgggcaactcctccacaagccgtctaggaggcggcaacctccaagagtaacaagtgatgacctggctcggagatgatcaagtgccacactagctctacaatgaagcaatgcacgtgactcctagctaatcaaccctcaatcacactaaatggatgaacacaaacattagagagtgtgagagtagtcaactactattaggtatgtggtatccataaccctgacagtagcccccgacttcaatgcaaatgaacgaattcatattctcaaccacgcgcagaccttggagtaactattatcgagctcatgtgaccgttctcggtgagttcagagataacgtttagacttccctatcagcctcgtgcgggcacctatagggtttgtctgatctccgatgtcaaccaagaaagaacagagcatacgactaagtctcccgtcttgctgtaatcgagaatttagattgaagtcaagaaattttatctcggtgggtacaccatctcttcattccgtattccttgtcgagatccaccaaccgttctcgagtaatcgagtaggcgtagagtctgcgaaggagccttgtcaatatttgt

SEQ ID NO: 83377 - DNA, 956 bp, Oryza sativa
cctttcacaataattatggatgtaataactggtaataatttgcttagctcctggtttggagttagatctgttcagccgggtatggttgttcaggatggttgggcctgtacagcatgggtgtgctgttcagtgttgattaaaacttctgattaattaatctactgttttactactcttaactctttgctaaatgctgctttcgcaaatgagcctatattatgccatcctttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctatgggagtggagctgaagccatcgctagaccgttaattccgctgctgtttttcttttcttttgtaagtatgtaacgttattattatgatggatttgtatattaaattgtcagtttgtgtacctcggctgattcctggacgaggatttcatgcacaaattagttcggaaattattagtgaatttccgggcgtgacaagttggtatcagagccatctcgactgtaggataagccaaatggtcaaaccttaaggactatttttccgaaaacataatttgtgaaaattttcctttcttccttatctagaactctttgcaaattgtttcattgtctactctcttctctcgttcaacttgagtagttctgaaactagtggttgaaacttgaagacaccaatgaggtctacttaaggaggttaagtaaagtggatcgaggaagaactgaagtgccaagtggtcaagatggaatgaagtttggatcctgtcttagcacctataccgccaaagtaattttgaagaatagttagtagggtagaacgtttgttgtttgctttgtgtgtaggtatggttgcattcccatcattgg

SEQ ID NO: 83378 - DNA, 6706 bp, Oryza sativa
aattgaaaaagttcaaaaaccctttccctctaggcaccgacatgtggggcccacatgtcaggcccttcttcttcctctagcagccggccggccgagcccaagccgtcgcccgagccgccccttttctccctcaaatccgctccaatccggctctttttcttccgggtttttgaggggattttatcctctcgtcctcctctatctttcccctcaataatcggagcaaatggttgagtatcttgcccgaatcaaactcgttttcgagtttatctccaaaaccgagttttgattttctcggatcgatttcttgcgggaggagtccgatctcttcaatccaaggctataaataggaccccctagttcccctctttcgtttgccccatctcccgtggtctcccgtgctccgtagagtcgccgccgcgcgcacttagttcgccgccgccgccggccgtcttcagccacgccgcgccgtcgcttgcgtcgtcgccgccgcttgccgccgccgccgttaggtgcgccgtggtgaggagaacctcggccgcccgtcccccttcgccgccgaccaccggagctccgccgtcgccgtcaagccgagccgccgccgccgtcctcttcgtcgccggccatcatcgttcgtcgtttgtcgttgtggtgagtaccgttgggttcgcctcgtcgtcctctacgcgtaggtgtcctccaatcacccggccaaggtccctagctccggcgaggtcgccaaccctagccggcctccgtgggtgatgtcatgctgacatcatcatcctttctttttttttccttttttctaatagatgaaatcttcggaaaatcataactaaataaccatagatccgtttcaggtggttcaagttgctaaatttttctaaaataaagatctacatattaaaattgtccataaattgaattaaatttatttaagtctttttaaatggactttaattagatttaatcttgtaaaattcataataaattcatttgaagtcggaatgaggccgttcaagtctcataattcatctaaaattatgatctacatgtttttttactttttatgtactgtttatttggtttttattagtctttttcttcgttttgcgtgttagcttgtcgtttccgtcgttgcgaaggttcgtgagtgcgtcggaagtgatcaagaaggttaattgaagatcgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgaatgccctattccttgataccttgggtaataaattgattagcttgaaccttatgtattggtttggttcagctaaaagttatatatataattgcttagcaatgcttagaaacattagctcactaatgggatgaatcatatatactacattattatttatggttatatttaatggtagctcacgatggttaatcgtgtgatgttaattaattgataattaaaacctggttaaggtgggttgtgagcatatggttttgatggttgtgctcatgacaattaaggaccggttcgcgagctactgttgtgagacattaaccgtaccaaccacaagccagcgtgggcaacggctttatcctttgtatagcatggttcattatagtgcgccagactgagaagtggcgagaagtccacgggggtcgctggggagtccatgccttgtttataaggggttgattatgatccaggaacggtgcactgttttgagttgtgttgtgcaaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctttcacaataattatggatgtaataactggtaataatttgcttagctcctggtttggagttagatctgttcagccgggtatggttgttcaggatggttgggcctgtacagcatgggtgtgctgttcagtgttgattaaaacttctgattaattaatctactgttttactactcttaactctttgctaaatgctgctttcgcaaatgagcctatattatgccatcctttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctatgggagtggagctgaagccatcgctagaccgttaattccgctgctgtttttcttttcttttgtaagtatgtaacgttattattatgatggatttgtatattaaattgtcagtttgtgtacctcggctgattcctggacgaggatttcatgcacaaattagttcggaaattattagtgaatttccgggcgtgacatcaacgcctccgacccaagaagatgtgcgtagggggctggatgcccgcctcagtatcgagcgctggcgcaatggtcgtcacgcttcccacgcaacggaaggcgcttcctcgtccggagcgccacttcggttcgggcgcgggggccagccccccgtgcccccgattggtggtgtcggctgtcgagcctttgtggcgagccttcggaacgtccgttggcccccaaggttccggcccaccatcaccgaaaaatatgacggaagcgtcaaccccgccgagtttctccaggtctacatgaccgggatcgaggccgccgggggtgacgacagggtcatggcgaatttcttccccatggccctgaaaggacaggcgcggggttggctaatgaacttgccgcccgcgtcggtccactcttgggaggatttgtgctagcagttcaccatgaacttccaaggcacatatccgcgcccaggtgaagaagcggacttgcatgcggtacagcgaagggacgatgagtctcttcgctcgtacattcagcggttctgtcaagtccgcaacaccataccatgcatccccgcacacgcggtaatctacgcgttcagggggggcgtgcggcacaaccgcatgctcgaaaagatcgcctccaaggagccccagaccaccgcggagctttttcagctcgcggaccgtgtggctcgcaaggaagaggcctggacctggaactccaccggttccggtgtggcagcttcggccgcccccggatccgccgctcggtcagggcggcgggacaggaggaggaagaagaggtcggcccattccgacgacgagggtcacgtcctcgccgtcgagggcgcttcgcgggccacctgaaaggggaggcctgcgagcgacaaaaagaaggaggccggcgctcccagcagggagcgcccgaccggcaagtggtgcaccgtgcacaacacctccctccacgacctcgcggactgccgcgcggtcaaaagtttggctgagtggacgaggaagtgggaggaggagaggaggcaggagcgccgtgagggcaaggccccggcggctccctccggcaaccggcaaagtgaggccaagcagaaggcccccgcagaggacatcgacgatggcgacgatgacctagggttccaggagcctggggccaccatcgccaccgtcgatgggggagcatgcgctcacgcttctcgtcggagcctcaaggccatgaagcgagagcttctggccgcggcccctacccatgaggcgacgcggcgggcgcggtggtcggaggttgccctcaccttcgaccagaccaaccacccgccgtgcgttgcccggggaggacagatcgcgatggtggtttcccccaccgttagcaacgtgaagttggggcgtgtcctcatagatgggggtgcagccctcaacatcctttcccccgcagcctttgacgccatcaaggccccggggatggtgcttcggccgtcccagccgattgtaggtgtgacgcaggggcacacttggccgctaggtcatatcgacctcccggtcaccttcggtggatccgccaacttccgcacggagcgggtgaacttcgatgtggcggacctcagtctgccctacaacgcggtcctagggaggcccgcgttggtgaagttcatggtggcggtccactacgcctacctccagatgaagatgccgggccccggtggccccatctctgtccatggcgacctcaaagtcacgcttgcttgtatggagcagcgcgcggaccacctcgccgccgcgtccaagcccgagggtggcaacgagaggctcagcacctccgtcccagccgccccgaggcagcggatgatcacgtgcgacgaggtcccggtcaaagaggttgccctgggcgacggcccgtccaagaccacatgaatcggtggtcttctggacggcaaataggaagacgcgctcgtctccttcctgcgggcaaacgccgacgtcttcgcctggagaccggcggacatgcccggggtccccagggaggtgattgagcaccgtcttgccgtgcggccgggcgcaaggccggtccggcagaaagtgcggcggcaggccccgaaacgtcaagccttcatccgcgaggaggtggcgcgacttctggaggccggattcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccattggaacttattgttatacgacaatgcctttcgggttaaagaatacaggtcctacttttcaacgtactactcgaatttctttgggtagccaaataggacgtaatgttgaggcctatgttgatgacttggttgtgaagacgcgcaaccaagagaccttactctcggatctagcggaaactttcgaaagcctccgctccgcccgcataaagctgaaccccgataagtgcgtgttcggcgtgcctgcgggcaagcttcttgggttcttggtctctgcccgaggcatcgaagccaaccccaagaagatacgagctatagagcggatgcgcccccccagcaagcttagggatgtgcagtgcttcaccggctgcatggccgccctaagtcggttcatatcgaggctgggagagaaggcactacccctatttaagctcctcaaacactccgggccgtttatctggacggaggaggctgagcgggccttcactcagttgaaggcgtacctcagttctcccccagtcctggtcgccccggagccagatgagccgctgctactttacctagcagcaaccccgcaggtggtcagcgcggcgttggttgtggagcgcgacgaggacaaccctcaccccgcgcatccccaccctgtgtcgactcgacccgggagagagcagggaggagaggcccccgagccgaacggcggcccgaggcccccgacggccggagctggccctccgcctgcttgtccgacggtgccaggcgcccccgacccccaggatggccccggggccactgcgggaaggccgcgcctgtcgccctccgaccccgaggtcgtcggcacagaagccgagtgcgccccgcgcggcctctcggacgaagagcgccctggagatgcggcccctagtgaagaagatcggccccgccgaaaggtgcagcggcctgtctacttcgttagcgaggccctccaggacgctaagacctgataccctcaggcccagaagatgctttacgctattctgatggcttcgaggaagttgcgccattattttcaggcgcatcgggtcacggtggttacgtcttaccccctcggccaaatcttgcataaccgagagggtactggacgggtggtgaaatgggcaatcgaactctctgagttcgatttgcactttgaaccacgccacgcaatcaagagccaggccctcgccgactttgtggcagagtggaccccggcccctgagcccatctccgtccccgaggccagctcgggcccctcgcagctgcctcacaccgcctactgggtgatgcagttcgacggctccctatctcttcagggcgccggtgcgggggtcacgttgacctcgccaaacggagacgtcctcagatacctggttcgcctcgactttcgggcgaccaataatatggcggagtacgagggactccttgcgggactcagggtggcagctggactggggatccgtcgcctcctggtgttaggcgactcccagctggtcgttaaccaggtctgtaaggagtaccagtgctctgacccgcagatggacgcttacgtgcgccaagtgcggcgtatggagcgccattttgacgggatagagcttcggcacgtgcccagacgggataacgcggtcgccgacgaactttcaaggctcgcttcctcgcgagccagaccccacgggcgccttttaagaaaggct

SEQ ID NO: 83379 - DNA, 7089 bp, Oryza sativa
tgtgtgcccatggacagagaccagagatgttatccatttcattatataaagaaagctcaatatcatctgcgtttgccgaccaggaccttcatggttggtggagccatccccaggccaacgttgtcgacgcagtaaatctgcgagcagcagcttttcccatagttgtttttactatcgtcaagatgaagccctcaccgctgtcgtcgcaaagacaaagcccgacctcaccaccgaggcttgtcgctacctgatctattagtaccgaggctcaccgccatcattctgctcctcgtcatctaaatactgacgccccgatcgagctcgtggcggtgacggtgtggctatggacatgaatggtggtagcaccgtttggcaatagtacgacagttgatggtggcggtggcctattgagaggcactactacataaacattttttctgtaggaaaatacatgtatattacaggcggactataaccggttgtgtatgtaaaaaatcgacctttattttcacatacaactccttaaaaaaatctgaacacgaaaatgtattttttaaaaaattcttatgcactcctcctggatcactccccttatcctctccactcatacctcatttttccttatcctccctcatctgctagcagcggtgggctcgagagcggcgatggtgagtgggagtgccgggagctgcacagcatttgcatgtcgcttatccgagcgtttgcgtttgtacaatgtttcttaaaaaaacaatctcttgagctaggtgcctttgaaaataccactattttcacaggatgattttttcaatataatagatacagaaattaatattacagctgttttggatctacaggacatctctttataattataagcagagttgtttataacttctatagtttaatttttaagtagtgcggacatctgaaagtatgaaccgcaactggcaaattaagtcaaaagagagcagcaatgctatcttgaatgatatattagtcacaaaggacaaaagcctattcgtctccatttcaacggaggaatatttagaagagcgtcgtcacgtgaacacatctgtgtggagaccggctttagaaagctctccgggcgtccaaaagaaaataaaaatccacgtttctgtgtaaaccgggctgagtcgtttgtcttattaactaaacttgtttaaatataatcgtatgttggtcctaaacaagacccataccctcgttactccgtcaagaacgctgcatataatttagttatccgctcgaagggtttgcacgcgcaacagatacaattaatatttattaattagcgtcacaagaatttgtcttaattacccgtaggcacatgcatgtatgtgctaagctagcctgtaaagcaagctttggcttcaaataattataatacgatagtatcatgttgaaactagcttaattagactcaggttttcccaattaagtcagggccacttcaaggtaccgatcaatttacctaacttttgacattaatttgatcgtgtgatatcaatggaggatttcccgtgcaattttggatggtctcgttgaattggatttaatatgtgcagttctaactttttattttcatatacacaattatattatgtatatatagatataaaaattaggattggactgatataaatctcttttcttctgtttttatacatacaattataacttgtatacaacctgaactatcaatctatacctatactgttataatttggccccacttcatctgatggattagattatttttttcgattaatgttatattgcttttagtatttatttatagagtgaatgtggtgagcccatttgaagactgttttaataatataatagatttagataagaatgtcgagagtgtgtgtgtacatatatatatgtcgatccagctttcattagtatcaaagccaaaacagggttcaacgagtttacagaaagataaaacttaggacttaaatttccgatcaggcatactttcacgtcaacttgagaagacaccagaactaccgaggatagagacaagcgtttataaatccatatgagagatgagatatgtaatatgttctaccttctacgattacgattgatccgattaatccatgtaacaagaatctctcttcacgccaaggagataataaaaggcttaaggcggagcactgtgtgatggatactacctccgtcttaaaatatagcaacttttagctatgaatctgaacacacagttgtccagattcatagctaaaaatgcttacattttaggacggatggagtatatatatccgaaattaactctcacttgcacgatgcaccggtcgaaacggtttgtcaaacgaggttctactactatactccctccgtttcaaaatgtttgacaccgttaactttttagtacatgtttaaccgttcgtcttattaaaaaaattatgaaatatgtaaaactttatgtgtatatgaaagtatatttaataatgaatcaaatgatatgaaaagaataaataattacttaatttttttaataagacgaatggtcaaacacggtgtctattttgaaaggagagagtacttcgtacgcgtgcggaggtcaaaatattccaccacttgctgtgccattgcacgccaacatcccgacaccattacatatatttgtcctaattgttttgatcattccattataaaattaaccaaatacagcaagcagctagctggggggggggggggggagacgagacgaccgtcgtgtctctatcttcactatgtttgtctgggaaaaaacaacagactgaaaaaacaattaatcttgattcagacagagatctcagctggatggatcaaattactcctcccggtctccacgtatagacgtacgctaataaacactagctaagagcacccgcaatggtaaagtaaggtgctatctataaaacatgtacacctcaacaatagactagattaatagtaaaccacttcaatggtatgtctacatgggtatctatagctctctaatccattgcctcgtttttctctacagactatctccatgttagtagatagctttgctctctctcttcatttaatctcttccaagtaggaaaatatgctgacatggatctcttgtagagagcttatagataaccattgtgggtgccctaaccacaaccaacatcatcattcagtacagtaccgacgccaagatttcaaacccgtagggtcaaaagagggccgcataagtatgcgtgtaattaagttccagcaggcaattgtaatttgcatttttcagttttgctagcttgttaatttcagtcacaaccagcaggaggacgaaatcgtacttgatgtacacgtacgtgcgacataaccaactgacgactagtacttgaggtcactcggtatgaactccacggtcatcacacgtaacgttaacgcacgcccactactcattactcatcatttagttaattatctttatcctggaaaaaaaatgaggggtttgttttactacaaatcatcttaggaatcctacagttgttggcatcatatactccctccctttcaaaatatttgacaccgttgactttttaagcacacatatgaccgttcgtcttaataaaaaacttttgtgaaatatgtaaatgtatatgtctacataaaaatatatttaacaataaatcaaatgatacgaaaagaattaataatgacttaaattttttaaataagacaaacgatcaaatatgtttaaaaaagtcaacggcgtcaaatatttaaaaacggagggagtatatgtgactcgtcacccgcgtaccatattccttcgattttgctagatattggtcatcaaatttctccccctaatatttgtcgtttttctgaccataggatttgtgctacgattcgtgcacatatgggggtggggatgcagctgcgtcaagtgtaatcagaccgcgcctgtagtcaaatttgggccatccctgtcaaatttcgggctccgcgcttttctgtccatagccgttgtgttttcctcaactctcttctcgctctctttccttctctttttttcttttctcttcagggcatgtttagtttccaaaaagtttttcccaaaaacatcacatcgaatctttagacacatgcatgaagcattaaatataaataaaaataaaaactaattgcacagttaatggggaaattgcgagacgaatcttttgagcctaattagtccataagtgctacagtaacccacatatactaatgacgcattaattaggctcaaaagattcgtctcgtggtttccaagcgagttacaaaattagttttttcattcgtatccgaaaaacccttccgacatccggtcaaatgtatgatgtgacacccaaaaattttcatttcgcgaattaaacggggcctcattgttccttcgattttggaaaaatgtttggcactatcgtagtacttcatcactgtatcgttgtgaaaaatcggcccataatctcaccatttccagttcggcctatttgcaaaaaggaaaaggttaacttttcatccctcatctggctgagtttcaattacttccctcaaccataaaacgagcataatgtatccctcatcttctaaaaccataaaatgggtataacatatctcttatcttctaaaaccagtgtaaatattgagagtgattttgaatgatgtggcgctgatgtggcactaaataaaaactcatgtggaacccgcatgttagtgaaccaaccactctcccatcacccacatcacatgtcagtggcccctcccattgagcacaacaatgttgcccatggcttacgaatatcagggtttacattaccggttgacaattaaatttcgagccccatcggtatcacggttttcgataaatttcgaccaaatctattgtttaacctttgaaattccaatcaaaacttaattttgagccgtgtagaaacgtcgaaattttgcggaattcgaccggttttcgtcggaattataaaccctgcttacgatgacttcttcaagggctgccgctagtcgtcgctcctgcccaccgaagcagagcgtgcagagttcccatcgctgcctctgcccccgcagagtttgcctgcggagactgccaagatggcggcccttcgtatcccgtcagggcagcggcgggaagagcttgctgtgcagccgctgcttgaggagctcctgcgcttgatcggcctcctcccacacttcttctcatcttcgtcgtaggggccaccatggccaaggaggccatggcgcagtcatccccatcgatttgctccctctgcttgctcacctgccgccaccaatcgagttggaagaccttgaggagaaggcagggaaaccaagagaaagagggtgtggaggcggagggatatggccgcgtccgtacccgctcgctctccaatatcggttgccgatggtttcggtattcacccgcatcgccactcttgccaaaccaagcttgcaccggagttcccactctggtttctagtgccccggtgccacattggagcggagcgccccatcccctccattgcttcctcattgacgcgtctacctgctgacaaaagatgggagagagggacaaggtagaagaggaaaagcctgcgaacagagaggatgggatcatgggacaaagggagaggatagaagaggaagaagttgatgccaatgatatgtgggtcctacttttttattttttaaaattgtgatgccacataataagcaccacataaaaaaacgactgggtcaacacgccatgtcaaccaaaaccaccatccaaaaccaccaagggacgtagtttacactacttttagaagttgaggatagtctatattttgttttatggttgagacacatgattctaactgatcccctatggagggatacaaagtgaactttctccactgcagaaacagtgtgagatggagcccataaatagttagttacccattaggcccatgtttattattttatatatagtttttccttggaatcagattcggaaatgtgtatttctttgtatcttaaattagtaaatattaaatctagggaggcaattagagtgttaaaaaagtacatcaaggaaaaatttatgcaatattacttgtgggctcgtaaaatagtgattaatcaatcttttattatgtttgtagatgaattttataatatgttttcatatacgtttgataatatgggacatacggaaggttataatttttcccgtatcctaaccttttatttttgcatattcgaattcgaatattactggatatccatttttctctccaatatctatcctttctacaggccttgggttgggtggtcagaaatacacgtcctatttcaccccttgttaccgcgcccttagctttcatgattttaggattaaatttattgtgaaaatcacataataagtaaatattttttttagtttatttttgagtgacgataggaaagggagtcttgcagattggaaagcatgcatctgtcttcactgaagcagtctttgataaggacatcgttcctttgcatacatacaatacttctcaaattgctatgcaagattacatagcatatactacaacttattttttaggaaatcctacggtttgttaacatcatattgttgtagatatagtctcaaatcagagagtggttttggatggcgtggaactcatgtggagcctatatagatggccatgtgggcctcccggcacggcatggcccaggcccggccgtgcctgggccaaggcctgtcgggccggcacggcccaaccgacgcaccgagccgtgccgtgccagcccacgtcccacactcacggcccaggcacggcacaacacgcctcgggtcgtgccgggccggcccgaaggcacgatgggccatcgtgctttttctcagaataagtctaattttcgtccgtcctattgggctgtgacacacacacacacacacacacatatatatatatatatatatatatatatatagctcaaaagtctattttcctccctcttctttgggttggagtacataaatag

SEQ ID NO: 83380 - DNA, 5379 bp, Oryza sativa
tcacagataagactctacccgaggactgcgaagggagtgaacgcatccagcgcatctccaagcgctacgtgctggtggaagggaccctctatcggcgcgcggctaacggagtcctcctgaagtgcattcctcgggaacaaggcgtcgagcttcttgccgatatccatgaaggcgagtgcggagcccactccgcctcacgcaccttggttggcaaggcctttcgccagggtttctattggccgacggctctcaacgatgcggttgacctggtccggcggtgcagggcgtgccagttccacgccaagcaaacccatcagccggcccaggccctgcagaccatacctctttcatggccgtttgctgtctgggggctcgatatcctgggtccgtttaggcgggccccgggcgggttcgagtatctgtatgtcgctgtcgacaagttcactaagtggcccgaggcttacccggtcatcaagatcgataagcactccgcgcttaaattcatcaggggcattactgctcggtttgggatgcctaatcgtatcattacggataacggcacccagttcactagtgaactcttcggtgactactgcgaagatatgggcatcaagctctgcttcgcctctcccgcccaccccagaagcaatggccaagtggagcgcgccaacgcagaaatcctcaagggcctcaaaaccaaaaccttcaatatcctcaagaagcacggcgactcgtggatcgaggagttgccagcggtgctctgggcgaaccgaaccacgccaagccgagcaaccggggaaacgcctttcttcgtcgtctacggcgcggaggcggttctcccatccgagctcaccctgaggtcccctcgggccaccacatgcataagcttatattttttctcttccgtatttcaataaaagcattttcgatttcctaaggactgtgtctgtgccattgtttcctttcgaagaatcttggcttgaattagcacgctcgtgctcgatcctgccctcggtggcccgggccggctaaaatcgccaaacggggcccagaaccgagccgtgccccggggcgtggtgaactccgggggggaatcggcaaaggcccacaatcgggtcatccataaccctcggtcaccacgttcccggcctggccagtctcgacacgcggatctccccaggcactagccccgacccgcgccatttgaggctaggacctgggcacgagccctcgttcaagccaagacacagaaggactgcggcatagaccatcctcgtctcatacacacaacaaacagagctgacacaaaaatttcctctttatttgattgcagattgaattagtttatacaagaagggggcccgaaggcctcagaagaagaaagaaaaagctatttaagattggcgggggcctgggggctcacgccgacgcgcccgggtcgccggcctcgtcgtcgctgtcgtccgcaccaccgtcaccgccctcctcgtcggagtcgagggcgaacgcgagccgaggggccgtaccctcgaagctgtggacgatgtggtcggcggcgtcccggacctgtgcgcgcgcgccatcctcggttccaggagggaactcgtccagcgttgcccacggggagaagtcagggtccctggcctagtagcttgccagtacgagctccaccgccccccgggcgaggtccctcgaggatgacttgatcgtctcctcgagctcctcggggagccgctggagggtcccggccatctctgagaggcgctgggcgaggcccccctggttggcggcatatttcgcggtccgcccgccccagaggctcgcctgccgcccggcgcggtctagacgggagacggcgtcccgaagcatgccgggccctacctcacctgccaagcggagggcctcgacctccccggcggacgagtccagcgcgccctgcagctcggcgatggtgtgttcggcggctgcgaggcgggcggctaggtcgccgtcacccgcggccgccccgccgctgcgcgctctcgtgtccagctccttcgcccgcgcctcgaattcagcggcccgctgatccagtgcggccctctcggcgcgggcgccttccagattgaggcgcgcctgctcctcccgcagctgcgccgcggcctcggcctcctcgagagctcgctcccgctcagtgagctcgtcctcgtggaggcggagtgcggactcctcttcggcgcaggcggcctcgtgcgccgccagcgttgcctcccggatggcgacggcggcctcgcgacccgccagttccctctccttcgtgtccagggcgcgggcgcgctcctccagcaccgtggcgcgagcctcaagggcctcttcgcgctgccgggacgcgtcgagcttcttctctagctccgccccccggctcccgtattggaggcagaggtcgtcccgcgccgcgttaaacacggcggtggcaatgagggcagtctcccgctcctcctccacctccctggcgatctccgccaggtccctacgacgggcctcgagctctgaggcgtgccggcggtgtgccttgcggcccgcctccaccatggcctccaccgagcgtcgcccctcttcgacacgcgcccacgccgcgtcgagctccgcccgctctgcctgcaggacctccatctgggcacttaacccgtccaacaccgtggtgttcgcggtggccaaggcctgcagaaggggctcagcgctcagtggggcagcggaaggcatgggggagagccgcctcggtaaggatgccgcacggctcggcccgccgatcgacgtgccggactcggggacgtcccccgaagctggctcgtcctgagcgtcgcccgaggggtcgggcccgagcggtgcgcccgcgacctcgtcgtgggtggcctcggaagtcgtcgtcgcctcgggcggagtcgggtcgggggcttggcaggccgcccggcgtgcgcgcgccgcctccgtctcccggacggactcctcggcccggtggagtctggcctcctcccaagcggcttcctcagcctggcgagcccggacagcctcctgggcagcttcctcggcttcccggaggcggtttgcggcttctcgccggtcagcttcccgcctccgggcctccgcggtcgccgtctcctcggcctcagaccggccggacttggaatggcgggaagggcgcgacgggatctcgctgaggcagaagaaaaaccagaagacgaaaaacgggtgagtgaaaacttgccttgggagatgtgagaatgaatacggccgcagtgggcgcagggacgaacctgcgaggaggtcggctaaacgaccaccttgggggggagatgaggtttccccggcatggttcggtcccccccatcttgcggagccgcttcttttttcgctccccctcgggctgcgacgtcggcacagcacccttcgggcgcctgctgctggcacgcaccgccccgccccctcggggaggagatggggagggggtatcctcctgtttcctcttcccccgggcgtcggtagggcggctgccccccgggcccccgtcacggggcccagaagcacgaccccctcccggggtagattgttcccccctgcggctcccgcccgcgccatcgtggcctcggggggcccgctcccccgacgccccgacctcctgcatgatggtcaggatgttggcgcgctctggatcgcagcagaggggaaggaccccttgagggatgagggatgcctccacggagctgagattcagcacccgttggaccactatcctgaagtcctcagggtcccagtcccatttgcgcccctggtgggtcctcatgatgtcctcgggcccggtgtactcccaggcgccccgggcgtgccgctggagcggcgcgatccggcgacgaaggtagtcgccgaacaccatggcccccgtgagcccctgggatcgcaaaccagccaggcggtcaagaacggcgtcgtagccgtctcccagatctaccggcgcccgccagctggaggcctgcgctgggggctggctcggaagtcggaggcgcgcttcgtcggcgagaggggtgtagaaccagtcgctcttccagtgatcccacttcttgcgaaggacgcagggaatatagcggttcagcaccggcccccgcggctggaagtagcagccaccgactaccgacggtggcgacaccggctgtacggtgaagaaccaccggaacaaccagagagatgggcgcaccccgatgaacatctcgcacaggtgcgcgaagatggccaacgtcattactgcattgggggtgaggtgcgccatctggagatcataaagctccagaacatccatgaagaaagaagagaatggcgggaccagccctgccattgcgaaggaaaggaagaatacggaccgccccgggtagtgtggcgccgggcgtccctcacccagcgcaaccacctcccggccggtggcagattccggcatgaatcggcgcggcagcccggcctgcctctcgctcacgatgcgagaaggcagcagcacgctaccgtcgagcggtgcggagccccgtgccataacgccggcggaggaggggtttgagagcgagtgagtgcggcgagggtagggcacaggaaacgagaagttagagcgcaagcggcgaaggcaaggggaataatggcgagaggaaggaaacgaatctcttcctcggcgtctttatacccttgccaaacgctatgcccggctcctcgcttcccgcgcccactatctcgccccctcgtttctcgcgccaactcctccactaatcccgctcgcccgtttgcggcgcacgaggcggatgtgcggccgtggcagtcgagatgggacatatcgtgcgcgcgttaactacgctcgccgaccgatgcaccatcatcacatctccaggcgaaacgaaccggctcgtcccaattcgcgcgctactcgagtaatgtagcggtcttgaagaaagccgctcattattgtcggtcggtttttcccttgccgatgcgcgcgatttgcgaccactggattcctgtccgcttttagagaccggccccacctgtcaccaggcctgaggagtggcgtcacgcccgagcgttttcctcgaggagggtgatcgccctggcataaccccgggggctactgtcggtgacatgggaccggggatatcttgactagaggtttggggcagccgcggtcacccacgtggcctgaccccctcgggggggtcgggcccgagggtgatgagaccgcccctccctctatctccccgaggggtcgggccgctcccgtttcgtccccgagggctggggcgccccgaccccctgagggtttggcgccacgtgtgtgggttagatgagcacagcggcgctcacctaaccgcg

SEQ ID NO: 83381 - DNA, 1330 bp, Oryza sativa
aagacacaagcccaaattaattaagctgacctatatcaatacatgttgacgctgattcttttgcagcctgttaatttcaactgttccatgccgtccgcatcctccacaagaatccttcatgggacacgttctgatgactcctcgccgccgccgccggcgtcaccgcccagctggtgaccatgatcatcatcgtgttagctgatcttgcggcggaccagaggaagaagaagaagagcggaagcatggcgccccttctgatcgtgctgctgctgattgcggttgctgctgctacaggatgtgcagctgcagatgcgagaggctcacgctgcagcaacgatcccaacttacccaggaggatccgtgcttgcggccccccgtcaattaagcctcacaactagtatacatacgctactgtgagctcgatgcagcacaatatatactactaaaataaagcttgtgctgctcatatatactatataagtaccaatctcgatcgcgtctatcatctaaggatattagtggcccactggcgcgcctaaaacaaattaatactttgttaattaatgcctcatactaccttgcatcgatagaagcttaatttctcacatttaaataaggtatggcacttggatgatatgtaattcctgcattatttcagtcctcttagttttctccattctcaacgtggatgtgctgcattattgtatgtgcatcatcaacctaaattcggaattctagtagctagtgccgaacgtctcgaataatggtacaatacacacaccgacaacatcaaataatggttcatgtatataagatcgaaatggttataatatgaaatggggagtgttatcgtaatcgaagccatcctaaacatatggatctaaattaatttgtaacctgcattttggagaagctacctgatgaaatgttcagagcactgaatatactttctacagcaaaacaatagaggaacaactcaactcaaaagggcacgattttgcgcacaaacacatgctcagctcaatatatatcattaactccaatgtaagatccgcaagagaatagtctaatgggaggtaaaggtaccactaaaattaaagtatttatgtggttccttaaaaaaataatcttaacgaaagataaccttataaagagaaaatggaggggaaacaagcaatgttgttttttaatacacaagagaccatccaacatctctttctttgactgtcatgttccacgttttgcttgacgatgtgtcttctttgcttcaatatcccacctccttacaatgcaaaagatattattggtaacttgctaagggggctgcagg

SEQ ID NO: 83382 - DNA, 12510 bp, Oryza sativa
  unsure (1)..(12510): unsure at all n locations
tcgatccagagaagaggatttctcttcctttcatctgacagtgggcccaggggcaaaacagtccacaaagtttgagaaaaaatacaaatgggattaagaaatgagaaataaatgaaaaactaagaaagtggtaccaagtagagcaattagcagtcctaatgacatattatagagggcacgcgaattgggtggtaaaaaagttaaaaggcatacgaattgaatggtaaatagtctaaattctccaccggttgccaaaatttggtactaagccatcacggcttattagcaagaaaaaaaatttgtgtgtcaaaattttaataacttcaaaagcaatgtaaaataaaaggtgcgttgaaaatatcttaaaatcatcttcaaaattaagttttaacattacttagatataatgagtacacttaattttcttttattgcaggctcctagacctatgtggtccatttgaactgttgtcccattcaaaaccacatgttaggtaatgttgcgtcgatgctaagatgtatccaacctggttaatgggttatgataatttgagatctaaattctagccaatagaaacagagggggaaagggaaaacggaaattagctcatataagatctgtttatgtaacattagtcatatgcacttgggttgcaatggggtgagatatggtgaacatgattcaatttttattttgttttctcccatttatcttctctcggttggttagtttattttgcatcattttagcatatttttataggtaaattttactatagagcacccagttttttttaatgtgcggataaacatagaaaaagcatgtcatggttaaaagacatcttaaaattggtgatttgctaatggacactttcgggccagttggagagataaaatcttaaagaaagacgagaatgccctaaaaccacatgcttcaacacatggcattagagtaaaaatttagaaatcatgtaactctaaatctatcatcaccctaaatacatcactaatatacatcatatttcattttcactttaggcttagctcaaaagttttttaccctaggggtattctcatgtttttgaataattttctctccaattgagtcgaaaatatgctccagaaaattatcaattatttaaaatgtcttttagccttgacgtgtttttataatgtgtactagcaaaattacataaattttaaatgtcaattagctatttttacttttcttttaatatgtggaattagggtaagaaggaaagaagttttaaacagtagagatatgtactaatggggagaatgatatcgcttttaaaattaaagatttttggaggtatttaaaatgaacttttgattttccgcgtttcataaaaacactaaaatctccaaaggatttactatggcatatttgacttcggacgatgtacaactcaagattttaacaacaaaaaccattggaaatttcaaaacttgcagacaaacatcccacatttcgtatcgtgccgtttaaacaaatttcagaaaataaagcattgccatccatctgatctgatgtcccggagccgcacgccgctgatgatccattatcccatccctctcattatttatttcctcgtatctccagccgcacacggaatattaaattatttcatccatcgatatcgtttcaaaatatatttattacttatatcgatttatcacaatcaaaatcaaatcaaaccgaaaagggaagtcgaaaaattcagtcaaaaaaaaaagaaagcgaaaaatacttcgccgtcgtcaagtagacgtcgccgtcttccgcagccagcctctcccccatctcatcgtcttcctcctcctcgcatcgccggaggccaccggggaccccaagaatccgaccaatccgatccccaatctgcttctccctaggcccgcgagaatcttgcgaggaaatctcgctgccggattcgaagaaaccgccggattccgtggagaatcaagaaacccccgcaaggtgttcgtccatggacacggagccgctgctgtcgccgctgtcgccgtcgccgcacctgctccacccgctgccggagcacgcggaggtgtccaccttctcgccggccctctcgccctgccctttcccggcgtcctcgtacaaggagcggatcatcttcggcgcgcacccgccgtcggcggctgcgacggcggcgccggcttcgcccccggcgcgggggaggcggtactaccggcgtgtgtccggggatgacctcgacgtgccgtcgtgttcgtcctcgccttcccctcccttcgacgaggagaacccgccgccgaacccgccgtcgctgttcgacttcatcggggggcgcacgaacctncaccgctcgcgcaccgcgccggccatggcgccgctcaacgcggcggctatcgccgcggccgccgcctcgggggacagccggaacccgccgccttccccacggcggccggccatcgtgctgcacgcgttcctcttcctgctcgcctacctcgccatgggcgtcaccttctacgccgccttgccgggcaacttcacctcctcggccggccctacccaccccgtcgccgacgcgctctacttctgcatagtgactctctgcaccatcggctacggtgacatcacaccggcgacccccgccgcgaagctcttctcaatctccttcgtcctcatcgggtttggctttgttgacatcctcctatccggcatggtgtcctatgtgcttgaccttcaggagcacctcctcatcacggcgctcaagaacccccgctctgtgcgcaagcaccggcacaattacatctttgatcttaagaagggccggatgcgtgtgcgcatgaaggttgcacttgcgctcaccgtggtggccatctgcgtgggggtcggtgccgcggtgctcaagagggtcgagaatttggggtggctcgatgccgtttaccttgctgtgatgtcggtgaccaccgtcgggtatggcgatcacgcgttccggacactggctggacggctctttgcatccgcgtggctgctcgtgtcgactcttgctgttgcaagggcattcctctacttagcggagatgaggattgacaagaggcaccgcgctatggctaactgggtgctgtcgagagacatgaccgtgtcagagtttcttgctgcggatatcgacaacaacggttatgtcacgtaagtctccgataccttagctattctttacctgcctgcatttacctgatttttagaaaatatgtgcacagatacttcttagtccttgctgatgatgatctagcaatttacaactgaaatagatgtttgaacatccaaattagagactttgcaaggtataggatttccgaacattaagcaacatgtgctagttggagaatcaatcattaacactgcttgttcactaggttgttgggtgttgacatattgtgtctgctgctctctagttcttggagtatactatggttcattttagtatgatgcaattttgttacaactaatgtaaggtggaacagaaacctaatttattggaggaacaaatggaatagtgagcaaggactttcggtttagaattaataaggtctcttaaaggaacttagcatcttagttctgtatgctttcttttgaacactatgtctcattacgtaggctttaccttatcttccttatgtatagttgtagaatactttcttttcactacaaatgtagtcttttcgatctgcgtatgcctgagattctagtatatgtgggtattgattttttttttcaggctcacaatttgcatggttgattattgggttgtgtggattgtacattgcatttgggaattcagaacgcctgttcataagataaataagaaatcagaatggggaaactgggaaagaaactcttggcttagtactggatatgtgagttttatagtattggaattttgaatttactgaaattgtaggtatgagaagtgttgaagaattttgtgcttggagactgggcactgttttagatacatggatatgtcatactacaagagaaattaaaatgtgctctgaaaagaattacctttctgaatgtaaagtagctaattctaaaattttgatcatgtgcatttaactggcatgtattcgggaacacgggacagaagcagtaccatttatgttgatcatgaattcatgcaacttcttttctgatggcatacaaaatgaatgactaacaaattcgttgtgtagcccatcagtggaatggaatcttctttttcttgtttcttgatacatctcagtatgagcaatgaaaatatattgtgcaattatatggctattaaaacttaaaatatgccaaatcgaaagagcttgacaatttgtcaatacaggattatgacattcgatgattagaaattctaacatctgaagttgtaagaatgtgttgtgtaggagagcatttgaattaataaataataaggtagaacctgcttctttcatgatcttatatttctcctctgtgtccagaaggtggctggacaaatattgtgaaacagatggaacactttttggctcattgatttgaactgtattttgttggtcttttgcttgatgtgttaacaatactctattgagtttatggatattaataagatatgtgcattaaatcgatttgtgtttacaaatacctcgaaaaagcaaaccttttactgtggtttcataaaagaaaatgtggggactttgccttctctagcaacccaggatttcagttgctattccaacacaacattttagaccacaataataaatcagttgcatgtacagctagcctctgatgcctgaatagctactgttataaagactttttagctcattgatttgaaccgtatttagctgctactccctccgtccctaaatataagggattttggttggatatgacacatcctatgttcagatttgttgtactagaatacatcacatccgaccaaaatcccttatatttagggacggagggagtattttgcttgatgtgttagattgagtttctggagattaatgaaatatttgcatcaaactaatttgtatttacaaatatccagaaaacaaaaagtttttagtgtggtttcacaaaaaggttggcacttagccttgtttagcaacccaagataacaataatacatcagttgcacatagcctgtgagaactaaatataagctaataaaaaaacattttcatagtacattgattgtgccagactgatcagctctcttaaagtggcatttgattacatatgttgacagcatgtgcttttaatttagtgcggatgcaaaaggcagtttttttttcttgaaatgcttacgaggttatctgcacaaatttatctcacttagaatgatcactctaatctccactaccagacttattagggagtagctacagcatgcaaccacaagcctaaaaatagttcgttcacttaaattttgcatagcattttattttatagcactttttacacatattattgctacaagcctgcggtataaatgtgttcacaatccacatcgacacatagattgcaatcacttttagttagataatagcttaatagaatgttagcaatgctatgtattgatcatcactgaatttgccacaatagttgagtgctatcttcttgtaatagcatggaattttattgcttgtcataatctctgaagaatacagcttcttctagctgtatggattattgttctaaccatcactttttctgttcaggaaatcggaatttgtagtttacaagctcaaggagatgggcaaaatttcagaaaaagacataatgatgatctgtgaccaattccaaagaatggactcaggaaactgtgggaagattacactttcagatcttctcgagagtcatcagctggtcactgaccttaacgagaagaaaaaggggaagaaatcataatacatcacaagacgcagaaaaaaaaatcgtagggtagtagcattttgctcatgaatcaatggtagaagagctaggaggctttctcctacgctgaattcagaaagcatccattgatggtaggatagcttcaggaaaagtagtttactgctctccagctatgattgtaccctagaaagggtgagaagatcactgctgtgaatagaagctgtaaataggaaggataatacaaggacatttattcagattctttataaatatatattatatggaggggttggctggtggccatttggcttttcaagttcttctgaaaattatcatggccaaagttgtggttggttggtgagacaagaaagatgagcacgccatttctgtttatatgcatacaatatagtagacaccacacattttttttctttatgatttgattaagtcgtttctgctgctgacactaggaaggcgacattagcctttgtcatcaaacctgttttgtattcttttgctctgattgacaattctttcggactctctgaattcaatgtattcttttgctctgattgagaattctttcggactttccctgaattcatggacatgaaattaatagcataataatttatttgtttgtggacattatattggacgtagaattatggggctttctgccacgccacgtggcatgaaaggattaggtaattaattggaaagtgaagtgttaattgagtgaaattttggatgacagtttccgacatctagtggccagtgggtacgagagcaggtacaaaagcaggtataaataagctagctgcaaatatattttaagaagataaataagccagctgtaaatatattttaagaagataaatgaggagagagaaaagcagcgggctacagatttatagccagttggagcacggacttcaagacacagtgtgtgtatgacatgtgggaccaggtgttaatagtatagtatgtaactattgtatgaatgagctattaaattagctatagatcaattggagctagtactcggctatactattaaacttgctctgattaggatcgtctggtccatgatcgagaatttcatcgacagcaaatcgtgattctgaagctaacatcgacaacaaggtaacaatcataaatcaccacgtaggatgagaaatcggacgatgatattatcgtttcagttttgggatgcgcttcaaagaaacagagagaggcatatggtacagagaaagaacgatcacaatgctaatccaaagattgatttcccaagaacacaaacttagaaccataatgactagtgtaccattcaccctaaatctgcagcagcagcagcagcaaaggcgactgttttcattgatcttgaattcttgatcgcatcggcgtcaggtggacaggtgctacgatgattggggtggtggcgccgccgccggcgccggtagcggcagagtcttcttctccttcacctgcggttctgtaaaaaaaaaaaagaaaaaaaaagaaatcaacttccatcaatattgagtcgtatgcatcgaatagtcctctagtttggaatcaaaatggactataatcattatttaattgcgtactagtcagaattcgaactcaagacctctggttgtaataccatgttgagttgtgttgcatgcacgattagtcctacccagaagcttaagttgatgataaaagacggaaaattcaatttatattccaacgctcaaaatggatcgaaggattagtagtagatcgattacttgagatgagagccttgggccggtccttgaagaggatcttgtgccggatcacgccgatcaccttcagctccgtctccgccgccaccgccgtcgtcttcttcttcctcagcacgaggagaggcttcttgagcgccaccttggtgccggcgagctcatggtaccccacggtgaaggtgaacgccgcctgcacatccgaatcaatcgaaacgtgagatggccgggaccgggagggagtggggtggaagaccgccgccggcggaggtgggttcttgccttggaagacggggcggcggcggcgcaaaggcggccgatgtggaggccctggatgcggccggagaagcacggctgtggctgcaccacgccctgcacctccacgatggcccactccgggcaccccgcctcgccgcacccgcaccgcacgcggatctgcatcgcccgccggcccgccgccttcttctctccgccggccgcgggtggaggcgaaggcgaaggcgaaagcgaaggaggaagagaggagagattttttttttctgggcgattggcgccaaaatggcgtgctaagttggtcccttcccgccatttctccccccggaaaacaatatttctttgcttcgcgccaaaacaagaaaaataggatttcttaggagaattcgaattgggctccggagtttaggatagccagcccagaaatggtattcaatatctctactcctccattctaaaataaatcaacttagaataagatacattagtagtaaggacatgtacaatgatctttattagcggtctttctttattgtcatgcaagcatatttggtgatgttgaagagagagaaagaagaaaagagaaagatggttgctacgcatgacaacagcatagagtcgactcttagcatttattaggaaattttttattgcattgagtctaataaaggaaagatgactagtaagaaagtattttggtacattaatgattagagaccgtattgtcttaactattgtaacgtgatagcctctaattaacgtagagaccatatcggtatctacctttgtacttgccctaagaatctgaacaacgttacttatgctaagtaatattttgttttattttaggttggtttattttaggatgtaaagaatatcttttgtttctcttttctcgaataccccatcatatctctatctagattcgtaatattggaatgtgtcatattatatactagatttgttttttagggacgaaaagaagtacatgccatcagcacataatagaagcttccagtaatcacacagaaattatggacagaacacaagaaattatggagaaaagtaaccatgatagtaacatccaagtgtaacagcataacatcaacagcttgtgcttctgaccactgaccattacaagtttacaacaaattacacgcgaaaaattgttcatgttaaacacttttgtcaataaagatttacccagatgagcagaagtcgacgccgcgacaaagcgcaaccttcaaacttcccaactcaacagctgataataaaatttacaggccacgaaattacaagcttaaatagctgtcatatgtagtatcatgtaaacaatcatctgaacacctacaacatttttgtctaccaacatctccattgggacttagaaatatactactgagagctacaacacggatcttagatcattacttcgtctcgaacaagctagcgaagatgctgtgaggagtatcaccagatgctaatgacctgagtaggacatggaacattgttggaactctgaccccgaactcgactcgaagatagaatgaggaagggcgaagtcagtttccgagaactctgcaccattacctcgttgcctctttgctgccctctcatgctttggactagcggtaggagaaccaggctgacagttggaatcaggggttagtggttcatggcgggacagagaatcatcgcgctgggggctcttggttgcttcgttttgtcctccattgtccctattcgaaggtacaccttgagttggagattcagatgtaggtgcaggagtcgaggggtcagttctttcggaatcagggaactgatcgcttggcaatgtgacggaagcaccagcagcaggtgtttcagatttcactccaccgagacgctgctgctcctcaatgatcttcttgaggtacttgccctgcgcctcaatgcgcaactgcagctgcctttgtacctgaagagaatgtttatcatatcattagggcctgctctttgctggatatttcacaaagatttgaagaatatgtgcatccagaacaatttctttgcatagatttggaatattttagtaacttcggaataggcttaataaatatataaggatggagtacaaatgttagaagctaacaattttatgctgaaaggaacttccacaaaaacttacttctaactgttcatgtagacgcttttggacctccatctgcagcttcagagcttcagatatctgtaagccactgtacaaaaaaaatatcacgatgaatattgactattgaggtggagaacagcaccaatcgaacagtaacataatggaactgtccattgaaaagataaataggcattgaaatcttacagaagataaatagaaagcacaataacaaatgacttaattttttcaactaaaaggaaaaagcatattaatcagacttaagttatttcacatattttgttgttttctagtatctaggatttatgttcttgaggatgttgaaagccaaaaatggtgggcagaagaaattatgtgtaaaatactagtagtagtttcaatctcaatccagcagcagcctattattccttgatactttcaactacagagggactacaatctagaaagcgatatttgccgagcagcatggcagcatgcaaacaacaatggtaataatttcaatagttggtcatggtagatttactggtaaatggtaaaatgtggcaaaccagcatacttccatttcataccataacagtatgtcagtagcatttcttttttctttttacaaaacgactgatatgatatcggagaaataattaggcttatgtatacttacgaggatccctcaagtccagcaagcaaatctccagggtctttgttttcagccttgttacctaccaaggagacaaaaattaggataagctaaaagaatgccagagtactaaaaaatgcaatgcatgatgaagagattgtccgcgtaccatcagctgaagagtcgggaatgtactttgcaagcctgtatttctagaaacaggaggggaattaaataggataaaaaaaatactagctacaaaaaatattaaagggaaagtgacacactgtaacaagatgtacctgcaaatgacttttcacatggtatatcgtcaacccttgtacacccataattcttagaactcctttcggagttgctcctgttgcatttgaggaattcaagtgttagcagaagcagaaatttacagttaataagttcaatggtaagagagcatgattacatgcatgcagtaaagttattgtctccaagaaaagcatcatacagaacagtctctatataagtttgataaaatcaaataaatgaataaatgaaaacataattgcaacaattgcagtatgaatacatactatcaggaccaccaagttgagtaacagcctcaacaaatcgttcgtgcagctcatttgtccaccgtaagcgttgccttgcagccaagttggaattgttgtttgctccattatctgggcccatattgttgccacctaattccatatgctgctgataagtgactgaattattacagtagggccaacactaggttcaggttttggttaatacaatgatcatcacctgggaaaaaatacatcagagagccagatatcagttttacaaacagcgatcacaaacaatgtttgccggtgataaaagtacaaaaacacaactaatcagtgcaaagttgcagtggcagttttctgtccatctctaagacagtcacaagtgtttctagaatttgtgagcttaactacatagggaagttttcattgttgcagaggaaagaactactagtactagtatagacaaggaaaatgccatttgtaccaagaaaactagcgtgtgcaacgctgtccaatacatctatccaatttgattcatcataccatactgctttacatggaaggttaggcaaatagagtgacccataaaaatggtagatgcaaagctctaacagaaaaccagccagcatacatagttaaggcgaatacttgcatccacagcttgcatggtgcatcaatcgaattatcatccattagtatttatttattttgctctcaatttataaccaggcaaaaaaaaggtaaagagctccatgggagcaacccacacaacctatcgccagacatatgaaattagctttgatacatgatgttcttgatgcccttcaattgcacagtagaaaaagatgaaatcaaagcaaagcgaattgcagctccatgctcaaagcaaagagcaccccgtatatgccaacctactaccaccagagaactcatcacaaacagcgcaagccacacgccatctccggcggaggtgggcccgacctgtcagcctcaggaagcccttttttttttcctctcctcgcttgcattttttcccttttccattgggggaacaaaagcgagagcaataacatctcaacacggaaagcaaaaaaacacgcacaaatttaccgggaattctctctacagaggcaaagtaaattttggggggggggggggggg

SEQ ID NO: 83383 - DNA, 18809 bp, Oryza sativa
caatgctagaaagtcttataacctgaaacggagatagtattagtttaaaaacacaaaaaaatgatgtgcacaatttatttctcaaaaaaacttattataacatcataaacttattctattatcaaagttttacaagtgtgacagaacttttctaaaaaaaaagggttaaaatatcaggtacagagttcaatagtggtttgcaacataaaacaaaagagaaacacagtgtgcatcacatgagcaacagttaccaaaaatagccttattattattaacaggcaaatcaccgaatcacagccgccggccaccaaaccggccatttccgcttccctattccgccccccttcctccgctcccaaccgagtccccggcgccgccgccggctacatcctcgccctgcgtcgagggccacggcgccgcgcccaccgcccgtcgcagcgcccccgctgctcggccacggctcgcacgaccgcgcgggtgagagaacagccggcgctgccttggcctcggctcggcggcgcgacgcccccacccactccaggctccacgtatggttcaatcctatgcaacttcttttttttttgttgattcgggaattcatgcctatccttgggtgtcgattgcgcatgtagtttcgaatttggattttgtcagtttttctagaatcgaatttggccatctgtagaatggcgctatgacaatgggtgtctgatgcatgaaccatcctagcgtcgtagtatttggcaagaattgggttcggtgagaagatgtcatgtaaagttggggaaaggaatgccaacgttttgagtttggaggtggggtttctcgttgaggacatatgctcggtgccgtttctggtgacaaaatcctgcatctgatagggagagaacaagatgctccaacccccattcggtttggtttctgcacggtgaactgccgtttgctgttcagaaattttggaggttcctttcaattgaacatccatgtcccatgttaggtcattcctgcttacacgtgcagctaaataggcatagcattatgacctgctatagagttctatgcagatctcaataggtttcccatacccccatcaatattctgattccgtcggtgttgttgatcaatggttctccacattttagttcgtctctcatatgtgcggaccagtatatgtgacggagctattttcctatatatggtaatctgtaggacttataaacttgtgaaagtaagttcgtgtgttatgccttcctaaaattttgcagacattcactctacattgttgttcaaagcttcctctcttaccatgtatgtaaggactccttcaccggtgtataaccaaggataatagttgttgtatattgtttgctacaatcttatcgtagatgtgtataaaatagttttatctcttaaatgttaatgatttgtatgtgccatggtgcatcagtgtttgaatgtatcagaatcaaatgaacttagtacaatgtgaggggcacatttatagatgtgagactatgggactatatgctatgtaaacaaatcattggcagaatatgtattaaacattttagtcttatcaccctaagagtatccttctaactaactgtatatctgagatgtccgctattaaaagcataagtacttctgaaaagcctgcaatgcaaaatgaaaattcaattgctatttgcttttttaatcacatgaaattagaaactatttactgaactccttgcaatatgttctcatatggaacagtatttaacgccttctgtttgaactatgaaatgtttgtatgcttttgtaagcacacttttggtgtaactgtggaaattcgatgtatggtccaatccaactgtatcaaatttgctttattttatatggcatcgcgttaaaaaaattaacagattagagttgtatctatttttaattcattttgttaatttacaataggtgaggaatttttaatgcttgaaatgactgaaagttggatagaaggctcaaaaaacacttcagctccagaatcagtttcttgttcagtttctagatatgaatcatcaccgccaagaagactggggaaaaggtaattaaatgctaatgtaccattattttttatttattttaggttgtggggcatgatgtagagtgtgacttttattttctttactatccccagaaatatttatcatctattagctcaacgggagatctctcctcggacaaaacaccaagctaaaaatatttggtctggatctccagaatgtgctactggttcaattgagttagcattttgggttacagatgctagacatgatcttttttcttggtaaggcagatttcttttttaaccaagatgagtactttatatttaaagataaacttgaaccgttgattttactactactatctgattgagcatgcatcctaaaccttacctttttacagggctgaatcacaatccttgcatcggtggtctgccaggtattgtcttctcctgcctgctccaaggtcaaccattgcagctgcattcagtccggatgggagaacacttgcatccacacagtaagctaaaggatatgctgaatatatgttctgaacggaaaaaaacttagactaactacacttttctctagtggtgaccatactgttaaaataatcgattgccaaactgggaaatgtttgaaagtgttgcttggacattggcgcactccatgggtggtatgtctattaaaactggcaattgtttttcctagtgtacttcattttctgagatgctctttaagcacttctaaaagaattaacactaatactagtttggtttttagtgtttccttaacgatcacttgcttaaataacaacagtttgttatctatgtgtccttgctgttttccccctatgtacaaactgttaattcagaaaaatgttttacaaaaaaaaacaatgttgaattttgtttcacttttttattacttgccataagaaattattgttgcaatgtaggttagatatcatccattacatcctgatatcgttgctagcggaagtttggataatgaagtttgtctatgggatgctaaaacctcccgttgcattggatcacacttcttctgtaatatctcttaatggactcattgtttttcttctctattcgtgagcatttctaaagcaacaattgtaattattttttacattatgttggcagataagcaaattgcatcaattgcatttcatgcaaagggggagcttctggcggttgcttcagggcacaaagtgagatgtttaaacaaatgaactttctatggatcgttctgatctgtacttcatcagtaactgttaaagtttaaattttgaaatacatttcagctgttcatatgggactacaataaacgagatgaagcttctgacccaccaatgatattaagaactcgccgttcactgagagctgttcaatttcatcccaatggggctccgtatctactgactgcagaggtagaatttgtctctctgaattgatgatttatttatattagttttctaattttctccgtgtctccctgtcctagtgttgatgtttaatctcaccccaaggttcacttgcaggttaacaatcttgattctgctgattcagaactgacccatgcaacatcttctggctattcaaactcgccttcggctgtattttttgcaatcatgaactccgcatgttgtccatactctgagtctaggttttcatcaccgtgcttgatctggcctgcatatgtcagagatgatggaagcatatgtctgcttcgcaatgactgggttagtggttcatccgatgtgcagcagccatcagattctgaaactcaacaggctggccatatggttacacctatggatgtatgccctggagaacctggggtgaataattatgatgatgaagattctgcatctttatcaaatagaatagaaatgcatactcccagttggcagaatagctcaagatttcacaacagtagtgctgctactgatcttcacaggattgatataagacaagtttctgacctgagcagtgatacgccaaatccagaaatgcctgcacattcaagaattgatgttccaaatagtatgccaatggatttgttcgccttttcaaatacaatagatgttcaaatgttcctaagagacgtagaggccggacatcaccataataattacactggtggatcacatagctgggaactgccttttctccagggttggttgatggcacaaaaccgtacaggattgcgtgcaacacttcctaacaatgaggttataggagacttacctatcggtggcactgctgggactgataatgtgatgaatgaatcatcaaacatgtacagttttgaacgtgtagggccttcatcatcaattccaattactacggacagtttgagagggctaagtaaacatcgtcatatgctggcctctgtacctggtggagcagggacttcgcttcaaggtgctcaaaatggtgaagctcatgttaatgttgtctcattaggtgttgggtcagaatttgctacgtcactgtttgctggtgacggtactgaattaccctgtacagtgaaacttagaatatggcggcataacattgacaacccttgtgctgtgttagcacctgaggcatgctgcttgacaatctctcatgctgttctttgcaggtacactttggcattcctcctctttcctctgctttattgtgtagtacaaattgccaatcttttcctgttgttatttgctaatgattttgatgtattaaactaaaaatcgttgctattttcttgtgctagtggtaggcagcaacaaccatgtgacagtaactaataaaacaattaatgcacaaatgtatatttatctgaattggtgcatttgagttgcgcttttatcatggttgataaattttgtgctgctgctgagatttgagactctgaacttattaattgctgcagtgaaatgggcacccatttttccccctgtgggcgttttttggtggcttgtgttgcatgcttactgcctcaaacagaagttggtgagcatgtaagccaatcgcctgtacagtatgattcaactggggctggaacatcaccaactcgccaccctctcccctctcgtcgagttatttatgagcttcgtgtttattctcttgaggaggaaacgtatgttttctcgatgctattttttttattatttgatttttatctgccagtgtctgtaaattgactagtgaagtcatttattgcttttgtgatttccttgtaggtttgggacagttcttgtgtcccgggcaataagggcagcccattgcttaacttccattcaggttattttctttccaattttttttgtaggtgtgaccattaatacttttgaggtagttgtgtacttgcttgtgtgaggcggcaaatatgagtttccgcagtcacttccattctgagagcattaacactttgtatcgaacttaagtgtgttcagtgaagacgtgttctctaacccttttggtggacaattctgtagttctgatcatttaattttggactgatgtgatatgaaatctgttctgcatgatgatatttttattcgctgcagttttcacctacatcagagcacatactactggcatatggtcgtcgtcataactcacttctgaggggcattttcatggatggcaagaccacaatccctgtgtacactgtcttggaggtagatatgatttacaacttaacattaaacattttacaggaaggctgatacagatgctctcatgatacttgtttctgtgttttgtattggatgtaatatacttcttgttttttactctactacacataagtttgacaaagcttaattgtgaccactagcttctattgtaattctttttgtaggacttaataaaattataatatcgtgaaaatatatttttcatatgaacgaagtattaccattgtgttataaatctaatctgaacattgctaaagatattattagttgacgttaaaatagtttataatggaaccaaactgtggggttacgatttatgtgcagtaatgactaatgacctcatactttcaggatataaggctatgggctaatactatttctttattgcacttccataggtgtatagagtttcagacatggagcttgtaagagttatccctagtgctgaagatgaagtcaatgtcgcatgttttcatccttcccctggtgcaggtcttgtttatgggactaaggtgagtgacaagttaggtcaatatcaaagatggaatgaatattggtatatctgatgcttatgttgaatcacaggaaggaaagctcaggataattcaacacaatgttgcagactactaggggaaatattcttgaggtactacttacccgttatttacttttaggtctttaatgtgctcaaactggtacctagtctgccaagcataagcagaatttttttttttttggtattgtcctgaatacaagtttgagataccgtgcatttggtcttgatcgaaccgtttaacatcgtttattttttgaagcacactgccaatcgtattaatagaaaatggactggctttcagatttttagagaggatcaacccttttggcttgagcttccttgtgtccaaattccaatctacctttgctgggggtctcgctcattctagataattctaaggctacagatggtgttttatattaatcatttttctgtataatgtgaggttctggtattcaacttttccattactggtaatgaattcatactgagctaggatccactagggttcaatgcttaagaaaatgttgtgccgaggattctaatctattgtttgattggtatagccagttaggccagtttgattggttctacttctgagtgaacccaatgctaattcttttcgcaggaacttatctccacagattcatatgcccaatgaatcatatcccatcccagctaaatcatggtggtcaattttgaaggaccaacatgcagatgttcgccttcctgagtaatccacaacatgattgcactgagactccggaaaacattttgtgacgatcatgaagacttcgctctgcacctaggtaacagtgacgcgggtaagaactaagaagcaagctgtgagagaacagtcaaggaaaccgctcccggtggcagcatatgtgactaagttagtggttgactaatttcattgctagaggtagagcaggaggatgctggtgtattgatgctgccttagccagaaaatggggtagcagatgaaatctagcaattggcatacatgtcaatgtgtcatgttgctctgcatgacgttgtcctaatggactgtaacaatgggatgttgctgcaatcagaagcacatacgctcttattaacatgatttgctgttatgcaaatcttttttctgccggtatatggactggggttggtgtatgttgggcaaatgaatcccaaaaccacattagtaaatgcgagaaaatgggtatcatgatgtcatcgcatatcacttcaagattaattagaaaggctcgtttgacaaataggatagggaaataatatcccatccattaaagggtaatattgtattctaaccattcattctttatacctcatttaatcttagtcattcatccttttttttctttcccaatcccacatctcataaccatttgccaaacaggccttgaggattttgttgtcttattcctcacttgtgaatgactatgattagcgagtgatgaatttgaggctcctttggatataagaaatttaagaaaaaaaaaatactccctctgttccttgatatagggtgcaactggtatagggtgcaactggttttttaagtgtaccagaatataaggcatccatacacatgcaagcaagcagcattaaaacaaaaagtatgaaatctggtcgacttccgtgcgcatgcatgcaaaggctttcaatgcgtggagttagctcttcgtttcttgcgttcgcggggtcgttcacccaccaaatagcaggttgtttgcggggaaggatgcgaagagctgcatgcatgagcaaaggccgatgcacacggagaagcgaagcgtcgcaggcgtcaccctgagaaaatcagttaagcctccttggtattgccgtccagagcatttgcgccctatattaaggaatggagggagtacaggattatagtgttctagccccttaaatcatatggatagaaaaacgtaaaaagaaaaaaaaagtaagaatgataatttgaatggagtgcaacgagaaagaagagaggtagacacaaatgacccattttcccaataggttgatggttatgttataatttttctaaaagttcttatgttttgagtcaatcaaaagaaaattataggacttttgatagctattctttttaatccaaaaggctgcatagtaaaaaaaattataggattaaactccaaaattccaccccctttatttttgtcaaaatggccattttaaaaacttatttcgaaactaaccatacaaaagaattcatccaaaaataggatgggggcttagcgccaaagcagttggcgctgaggttagccgtctaccagtgtggtggccgagccgatcccccgtcaacgtggaacaactaacctcagccttggtgctaagacaactaacctcagcgctacatgcgttgatattgaggtagtggccataacctcgcttagggaacaaccttagcgctagcgtaaatggtgccgagctatacgaccttagtgccattacgctagcgctgaaccctcaccgcttggatatcgctatgtacggacctcagcgccattccatcttgcattgacctatgccggctcagtgcttgcaggctgcctaacacaggagaagtgttgggcgacccaggcacgagtgcttagtgctgaagatcagcgtgggaaggaaaggcgctgataagggttcaacgtgagggtaattggcgctgacatccttgccatgtcggcggggggaacggctcggccgccgcgccgatagggtgtcagcgccaaggcggttggctccgagacggcttatattagcgctaagaacattggcgctgagtccgtgatttatttttggatgaagttttttttacacggtctttcgaaataattttttgaaaatggctaatttgtcaagaaaaaccgtggccatagccatctgcgtgcttcgttctttgcgaagctcttcatggatgctttgagattagtgccagatcgtgggaggtaggtgtgtgcctgtgcgctgcgtcttttgaccaacccagtcgttgacccaagacgaagcgaagcaggcgaccattttgtttttttccttttaatttattatttccaaccaagaaacggaggcgtggcagttggttgggcaacgaatgcgaacctacttctcctagtatactgcttttactttagccatcgccaccaccgccattcctggaacccccttccctcttcctccctcggatctctcctcgctcgcgcgttcgcgccgccgccttcccccttcccccgttgattgattggttcgtgtttttcttcttttttttttccttctgaggggtttcttgatgtttcctgccgtgtgatttgatttgatttgactttccccttcttcttgttttctttttcttgcagggaggaggatcaatggagtgcgtccgctccggctccggggttcttgatcccaggtgctctccgcggttcctggggaagaagggtggttcgctcacgtgagtgcttcttgatcccaagcgctctctgccttttccccctgtttctttccttctttgtgagtggtggtgatctgtgatctctcggtggggggtttggtgcggactggatcttgctggggtttttatttattcaggcgtgttgttgagatcactgctttttttttgggtgacgattaaattttcagtgaaagcaaattagtatatctaccagtctgtagtcagtatgatggagaatgattttttttagttcaaaaacattgcaatgaatccgtggactaatcagttatttggatctcctcaacgaacaattatgttagctcaattttgttctcaacaaatacagttttcccttgtgagttctgagcatctggtgcacacaaaacttagtatatttgtactggactaagattactgtctacagctccaaaatcaaaatgtattttttttttgagttgataccatttagagacagtaagacatagtactatgggtttgcctatcaaatggttgggtgggaggaacactgaatgttcaatttgtcttgaagaaagttaattgcatatgtgatttcccccctttttttattgggagtgttgatttgtaatctcaacggagggataggtgctgtagaggctggtgttttattcagacgtcgttgcaatgactagttctctttttgtgatgatttggtaggaaatattcagaaaacgaaaattaattctagaatttaattggtgtgccatgtaccatagcatatcaccttgatatctaccagtctgtagttaacatgatgcataatgtttttcttttagttgaaaaaaatattgtaacgaatccatggactaatgaactatttggatctcctgaacgagcagttccattccttacaaatctggcaaagacaaaactcaaaaaaactaaatgtgttattgagttagtgattttgtctgtcaaatggttgagaggaatgccaaaggtacaaatggtctggaagaagggacatatcttttattgactgtatacaacactgaaggatgtgaagctcaatctaggcactttactgttatatatatcaataaagttataaatcaaattttctgtcagttgagatttgacgcgaattcacaatacatttgatgttgttattgctaagttaaccaggctttctgatatgtgttgattccactgttattaagttgcccgactagtcacgattagttgtaaactagtcgtaaagtcggtcaagctagtcgactagagggctatgactcaaccaaatagcaagtcgcatgactagtcgtggttactcgtagattagttgtgattagtcatagcaaatcaccaattcactatgccaattggcttattgtgtttagtacttcagttttgtttcttgttgacttattgtcttgcttgctacttcatagtccacagtttatactataaacagtgcttaatgcagtataatagtagtaaagactatatattgtatatcctgtttttgcatgaccaagtcatggactagtcgaccaaatcgataagtaggtccaggggtacctcgactttacaacttgacaaccatggtttgttatatgtttctatgagaatatcattaggttttttaaccatcaaaccatacatcttgttattgattttgatagctgctaccattgacaggtcatgtggtaaagccacttctacaaatcttgccatttgtaccaaacacgagcaaaacttgcatgggaatgttaaaccctcacagttagcagcaagtggatcctcttattctgttcacagaagtccagtgcttaagcagagacagaatctttctgctaggtctacctctgcagatgtatatactacttttgatgaaaatgtcagagctgtatcttcacatgctgctgaagaaaaggttggagtactcttattaaaccttggtggcccagagacactggatgatgttcagccatttctattcaacctgtttgctgacccagtaagtgatcataccacatgctttatacttgttcattactgactatttgtagccgatttgtcaatgctattcggcaattttcactatttgtatattggtatgtgtgtgttccttttagtttatcattatgtagtcccgtaacgttgactaaaatggtctagtaattcttgaccattaaaaaatggttcagtttattatatcatactatttgaaccaaacaaaaacatgtcaatttgattttattgtgtatgccactatgatatgatgtctggattcagaatttgtctcctatctgttccttatttagtatataatgatttacttatatttgtactgttcaggatatcatccgtttgccaaggctgttcaggtttcttcaaagaccattggccaagcttatctccacttttagagctccaaagagtaaggaggggtacgcttcaatcggtggaggatcacctttgcggaaaattactgatgagcaggtaaaatcttgccatcctaatcacaaacatgtgtggtttgtcaaaacaaatttatcagcttagttaaatattagctttgcctactcataagttttgtgatatgaaaaaaaaaatgtattgttgagtttcctaactcagttaactgtgttacaggcaaatgctttgaaggtggcactgaaaaagaagaatttgaatgctaatatatatgttggaatgcgatactggtacccttttacagaagaagccattgatcaggtgaaacttcctgtctctagaagtcctttaaatccttcatttctttgttaagtctcaaaaacagtgccttgccatttttgttcaattcgttttccatggtaattactttattgtttttcttctaacttacttagatattgctactcaatgttattttaagtatcttcttttcatctgttgttgagtattcagcactcaacagcatatgctgcatcgtaaactttagatatttctgttgttccctgatttttgttgttagtttccaattgattataactgcttctaagttttggttgatcatagattaagaaggataagattacaaagcttgtcgttcttccactgtaccctcaatactccatatcgacaagtggatcaagcatccgtgttctccaaaacattgtcaagtaggctgctttctcatttgaattctcatctagtcatcttccatattactagatctttaaattctaatctttcagacgctgtagatcattaaattataatatttcagatgctgtagatcattaaatattaatatgatggcatcatgcagggaggattcatattttgctggattgccaatttccattatcgaatcatggtaccaacgtgacggttatgtgaaatcaatggctgacttaattgaaaaggaactgtcaattttttccaatcctgaagaggtttgaccattcccttttccttctatttttctccctacagtttcccacctttggattgcagactgtgaacacaatcatagtataccttttttggtagaaatttccttagggatacagtttgacatagttcttgtatttacctgtggacaaaattcgacattagatacatccttaatcttgtctacaactaattttcagtatcactgtttattcaattatgtatgagtacgttgtgacaaccacatcagagaaactaaattatttaatgccaactacttttaagaaaatgcactgtccattttcagctaactttttgtactagactgtggatatagggagtataccatgaaacttgaaccacaaaaatgcattttctgaaatgctacattgtagtgcttacctgcctactgtatatttgactatccagttatccactctagttacgtcaattgatgaagggaaattaacactataattttgtaaatgagtattaatgtatgattcagggtgattcaatagacagtgcaagtatctagttactttgttgtttactcagtctgttataggtacatgtcattttagaatgatacacgtaaacgtaagtctgaccagaattatacaaaaagttggaaattgaatagatagaataagtctgatatactaatcatgattgcaaatttgtaatctttaggttatgatattcttcagtgcacatggagtaccacttacctatgttacggatgctggagatccttacagagatcagatggaggactgcattgctttgatcatgggagagttaaaatccagaggaatcttaaacagccatactctggcttaccaggtataagacaaattaatacttatttttatgaggccatcttgtttagaatgaggaaagcatcttaggatatttctaggatatataaagtgttcgtttcatctctttttaaatggctatttttactttgaatgtatcaactgaactttcaccatctagaaaattttgtactagtgtgttttattcctttgctttactggttaacacatcattaacctttgtgtgcacacatggcagagtcgagtggggccagttcagtggctgaaaccatatactgatgaagttctagttgaactaggtcaacagggtgtaaagagcctcctggctgttccagtaaggtaataataactgcacatatttcatattttggcgattcagcgttttcttttttttctttggtatttccttaagaacagcaacttaaacctgtatctctttatgatagtttaatcttctgcctgcacttatctcttgatgcacatatattattgtaacccagcaatattttctggtataaaatcattatcaacgtagaaattttgtttcatatggcataagtttcttgttgatggaaggcatatgccattgcttgtgtgtgtgtgtgtgtgtgtgtgtgttgtgttttattttgaatttttctcatgttcactatttactgcatggttaatttgcttatccatcaagtacttacaacgtaaaactggaaactgccctttaggttcatctcattaaccattcaagaatggcttgttcagtttgcatttttcttccctacatcaccttgtgattaccttctagtcctaactaatttatcatcaatcagctttgtgagcgagcacatcgagaccttggaagaaatcgacatggagtacaaggagctggctctagaatcgggcatcgagaactggggaagggttccagctcttggatgcacctcatccttcatctccgaccttgctgatgcagtggtcgaagccctgccctccgcttccgctctcgtgacgaagaaggtggacgagagcgattccgacatggacctgatgcactacctgagcaagatgttcttcggctccatcttggcgttcgtcctcctattgtcgccaaggctgatttccgctttccggaacaccctgttgtaggtgatggtggcttcttttgtttggttttttgcactaggggtttggcttgagtaagtagaaaggcaggctcgtgggatgatagtgaatagtgatggttaaagttccccttttttacagaagtaatatgcatgaagtcattgcaaggtagcttaagtggtggttttaagcaaggagcctctaggggtaaattgccagtctgtaccagttttcttgtgctggtacaaggcaagcctatccttttttttctttttttttctttttgttacatgagcacattgataaaacatcattgatatattactaatgcataaacaccataatttttcctcgtttaatcatgttttcccccttttttccaattcaacttctgccgttctgcgtatgtaaagatcgttacagccaggagatgataccggtacggtatgatgagaaaactcgcaaaaggttctctaattcgcaagaaaaatgcaaatgtttgccgagaccggctcagtacatgcgggagaatagatcatataacctccatttagattataaatcctcaatttcaatctgacgtaagggtatacgatcaaattttcgcactatacgcaggccccaatattaattaacctcaccttattatgctctaggatgctagcgcctggtactgccattgtgctttggtttaaaaagttgatcgctgcataacagtataagaagcatgaagtaaattcaggcgatatttcataccgccagcttaaagaaaagcatgcacggactatattcatgtaggcaatataaaggacctgcagttacacatttcttgacacagcatctgtttccaattttacatccctcatactgccaattttgccaaaccagatcacccttttcatccgactcatctccttaatcaacagccacccgacgaatcacgaggcgcaaagttggactcggttgttggtacacagaaagcagggcatatatcaaattgaactagaaaacaattaagcgcgggagccagataaatacaagttgatgatgttgaatctgaattctggagatgagccaggaggtaaatactcctctagaagaacgtcccttctggaggttgcaccaacttgcgattctgcggggttgccatctccttcttgagctgggtaaggatagtctccatggtgtactcgcgctgccagtttgctagaacaccaaacttcctcgagtcaacctataggatcacagcaccaaatgaatatcaatcagagggagtagcctgcacaaaataaataaacttggcatctacatttgggaggagagaataccgctccagtctcatgattaacacacgacatattgattcttgaatgaaaccggacagatggtggcttctctgggtagtccttgtcacagaacagcttcagctggtagatgcgaccttcatggacactctgccagattgaggaagaaacagacacttagtaaaagttaataatattttatataagcagtacaagaggagctaggtggactctcaaactgtcaaacatgagaaagcatctagagctaatatatgtaagttttagcttgtagtagtgattctcctgcctttatggtcaacataaggaagttgaaaagctcaagtgtgcctcttcccagaaatataattccataaccttgtcacacatatcttaatgccattcaaatagcctttttccactaataaagacatcttctccactaataaaaacccaagatgaagcacagtacgacggtaaagatataaagccacaggagaagattttccatatgagtaatatgatatattgtgagtgtatcaggatagagtccataatctcacattatgtggaccaatgatggtgccagtccaagaccgcatgtagatgtcatctgcatcatccattccatagctcacggttccatctccaatgcccttttcaccacgttcaagctcttctagcaacctgaagtttcgcggaactgcaggcattttacatattagtcaactcctcaggatataatgcagttaccctcttaaatctacttatatagaaattgcataatggtgatatcattgcacagaacaaaagaagacaaaatcaacctagaaacagcatgagaagttttcatacccatgcatcaagtactgaattacagagcaaagacggctacaaccgagataaataaaatggcaatatcgattcccagtttcagaatttagtggatttgtagatgattactattttctgaagaaaaaaaaagaataacaccaatgtatcattctcccgaatgagggacaagagcactgcagctcagctgttgttttcttgtgaagcaaaacaaaattgaatatatctgccattggcgtggggggttaacaacaatgcaaaaaaaaaaaaatgtattgttctgtttgcaagacgatgaagaatcttgtgactcgaataccatacacccagaacagatatgtcggcatttgttaaacgcaagtcattgttttatctagtgcacagacactcagagtgcagtggctctaaaacgggcaatcatggttttgacttctcagattgaagcctgaactttgacttgagattgattatacaatgtattatctcaaaacagaatagtagacagaaatagtgtaacttcacacacaaagttcatcagtggaatataatgaacaaataacatgatctttggcaagtagtctgaatcacaaggccgccgaggtgaaacaatttcagtacaattgtttgaatggtgcaaagttccaacttgtgattagaacacaaaaaggcattacgttcaaacctccaaaccggagacgctaaaagctatttaattccatctaggaaagaaaatattaagagaagaccgaacttaacactgcaagaaaaacgcaatatagcattcaatacccaggtttttataaagcacacaacctgcatgcccacacgaaaaaacagatccagcaaaaagaaaccaacacagtctcatccagccgcgatgaggcctatacaacagctatctaaggaaaccatgatcagaagagcatatctatcttcattaaaaacatttccacttaaagtcaagtgatacaactaataatcccgctgataattatgcctcatagtccacttagagctaatggtcccaggcacttctcagctctccccttgtaacacccaagcagctaaaggaccacttgttagcaaagggaacaatttcatcctctaaggataccacaaatttactgccaaagccaaaccatcatcaacatgccgtaaataaattcgcaaaccgagcaaaccaggccatctagagagatcccatgaccgctgcacgcatgcaaaccaagctaaatcaccagatggatggaacccatatggtacaaaaaccgcagatcgctaattccaacaaacaaaccaacgcgtcggcgtctcgcctgatcaccaaccacatcgagcacagcacagccatggcgggacacagcgccaaagttacgaggcgcggaacggagcgaaacccgcgtggattctcctcctcagcctcctccgatccgaaggccctaggcactcgcgagaaaagggggggaagggaagaagggaaggggggattcgatcgatcgctcacc

SEQ ID NO: 83384 - DNA, 46957 bp, Oryza sativa
gtagcaaccaaacacagcctgctaggttcgcgtccccgccttgccttcggcaagcatcacagagttgccggtacaaccaggctagggcagccgacccccagctgaaggtacccgcctcgtcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccggtcgtcgaacagtatgtgcgccgtgtgacctctgactcgaagggtcttcaagcgctgcatcaatagacaaacataatatgtgcaccggcctcaagtgcttgaatgcttctatggactggccaaatatccaatatgcacgtccaaatactcgcctctgtactccatccaccatcctggacttctcgggatgagcctcaacacggaaatgcatggtagggttctttgctttgatggcacgcatcagtgtaggcaagcgaacatacgcctcgtcccaatctccccaaatgaccttcatagcaacttgcttagcacgccatgctttgccatacgtaggccgatagtgccatatttgctcaactgcctcgacaatcgctgctggagataaagttggttcagctcgcacaaatgcctgtaacctgtttccaataaaccttgaagtaagttgcaaatgcttgccggttacttccgcactacagcatgtgtggtcttcgcccaccctagtcacccgccacctatctcctccactcttccttgcattaatctgccatttgcaatggcgatcgagacaagccacagtatactttactgacgcgttagattccttcacatggtacggccggtggacacggatagaataactctgtagccatatttttagatcatccatcgatcgaaactccaaccccttccttggttcatcacacattggttcgaaggcaccgtcatattgtggatccccatcagcaattgctagcccagatctggtaagatcctcgaattgtgttatttccgggtttctacccaccagtttcgcaaacacagtcctttcatgctctgacatcttacgcactggacgatcatcatcggagtcggaagcggactcatccaattcatcctctgtatcatactccaaccagcctgggttcaatccactgcgtatcatagcctcctcacactcctctcgggtatagaatttcagcctagccaactcccttaggcccatacttacattcttagcattcgcttcttcctcaggcaactccacatcatctcctacctcccgaccatcctcaacatctccttcctctcttaccggcacattctcctccacattaacttcctcccttaacggcacattgtcctctgcatgtacttcttcccttaacggcacattctcctctgcatgtacttcctcccttaccgggtcattctcttccctgacctccacatccgccatatcatttactccctcgcccccctccacgtcttcctcaatcaattcttccttcctactacacctctccgacagttcgtgacagctaatgggtgattctatgagtggactttcattaaggtctataagttctttcttccctatcctaccatatttcttccatgcaaacacctcaagagatttgaaatgtgaccccaatactatatctatatatgtttgccattcgatctctccattcaagtctaacataaatttatgtgacatgacaccgccgcccacatcgtatctcccttgcataccaaccgactcatcattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaatttttaacccatgcataaacattaattacttgaaaataatatgtaattaccattgcaataccaatacttcaaaagctaacaacatgtctaatttttccaataaataagtacattactcaaatactacacattattgataaaaaaaaactctactcctacaaattacctacccttcaccacacatcaaccccttttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacttccacacttcatccccacccatattatccatctaataatccatccttagccaactattatcaaaccacgtctacaaccaaaacaatgcaaaatatccaataaaactttggggaacttagggtttatagaggggtttaccttctcttccgatcccaaactcaatgccgcacaaatcaccttcgattagagaggtttttgggggagattgggcgaggagaacgcggtggcgaccgaaccctaggcgggcggctggggaaaaaacggaggaagaactggctggggcgacctcggccgggctctaagtagccaaggtcagcgccaacttacttggcactgaggttgggcacctcagcgccgaagcggttggcgctgaggtagctgccacgtcagctaggggatcggcccggccgccacggtggcacaatgtcagcgccagtctcgttggcgctgacacggccaacctcagcgccaatgcgattggcgctgagccgatggcctagttttggttgaagtttatggcaggggttagtttcgaattaagtttttgaaaagggtcaatttgtcaaaaaaaacgggttaaatcggacactatatacggatgaaataatgtcgatattatatttgttttcatattcctttttaaaatattgtattacagttttgacccatttttattgccaaagtttttactttgagccaccgttaaatcaacttttttttttattttggattgggtaacttgtggttattttttcggtttgaatcacccaactctctttattattcatgtttacccttcattttggtgattttggtgaatatatggctttgcacgtagatggagaagtttaacggtgtaccaaaaccgatttaattagggttgttgatgggtgctaaagaagttatttgggatagtctaaactggaaaaaaaaccgagacaaagttatgcagtccaaagtgaaaagattggtttaaaggtgatttaaagtgaaactttaacaataaaatatgttccaagctgtaattcgctctattgtttatataggtaaataagtatattcaatatgaaaccaatataaattaattttaacatagatatgaattgaataagcctaaatggggaggtctaatgagcaccgctcaagcgtgacaagaggcacaacccatcacacgtggatctagccattcacttttctaaaataaaaaaagacttcatatatgtaaacttcgtacataaactttaaatccgaatcgacatatatattagcttgttgttgtacaaacttttagaactctaggtatataaagctttggtgtatttttttttaaaaaaggaaagatgcaaatgtaaaaaagaaaaaaaatgtaggtgtttgcgcgagtataccatgtgcgaacatttggtaggtagtagcattttcacatcgaaatcgctcactgcgacaaacactatcacgattaacacataattagctcatttaatggatcaaactatgttcattgagtccaacaatacaatatgacctgtataaatgcatgttgttttatactctaattagtaaatatgcttatagcactgagtaatgttggactgttggcaagccagactataattaaaggaccgaagaagtagactggacgcacagacttaagagggcataaatgatgtatagttgtttggcagggattcgcctagcaacaattcctaaatatatgtaaatatttttttatctatttatgacttatacatcgtacttaaatttgtagtcgggaaacattattcatattcaaatttgtattcacactatttgaagattgttcacttcaattgtatctatattcatttatgtctaagagtggacaaaacctatccgctctatataagatcccgacaaatcgcggaaaaattcaaacaatttttaccataaaaaattgaaatttggttgaacttagccggtttatttcacatattgcaacacatctatatatatgtccgataaccgtcggttatcgtcgatagtgaaagtttcaaatgtatcatctccatttcataatacatgtatatattcacgtattttttaaaaaaaaactagaaaggtagcccacgtacatgcgcgggcacattgctgacaccttgtttaatgttgcttgaatttttatgaataatattaacatgtgggtcattttttggtaatatttttttattatattctaaatctgtttttgtccatgatttgtttaggattgctttgaatgctggtcatgattttcttctaactaccatatcaacatataaattctacactaaaattatttgaattcgtaaaatgttgagtttatgagaaaatatcgtatcgtggaaatggagttgattcacatggacctatcatttgtactatacgtgtttttaatatttagtataacttatttttggagtttctaaactttaagtaatagcttttcttgtgtactatagatatctttattgaatttaggatattttaatggaagaaacgttcaattaagatatatggtaagaggaaaattgtatccaattatgacaaatttatatttacttctactacctccttttttcatatgcttactatgttcttggaaaaatgaatttaaaattgaaataagagagtaattatataaataaaattagtatgtgtagagtatttataaataaaattgttgatgacatttgttgaaattgggcattggtcaatagcatttttggattttgtcatcctatttggtcgtaaatatttgtcaactgataacagatatataatgatatactttctactgtcatttgttatataattttcatgtatgtttggattacatgaaaagaatcaaaatgtgacctaaaatataattttattttataagttgaaatatattcaaaacagatagtaaaatataatttaatggtaaataatatgatggtctaaacttcattttcaattgtagagcaaatttagttatgtatgtttgtaaaagtgatatatgataaaataatatatgtcgccatttgtttgtcatatatgatgaaaagggtcaatatacgacccaaaaaacatttatttatttattataatttaaaatatgtcagcaccagtttaatcatgtctcaactattacattatatgtatgtaaaaattgtatgcgtaattttgaatttatagttgtttagaatttattatgataaataacaaatattatctcaactactataaaatagattaaaaagattaaaggaaaaggaagagaaggtgaggagggtcggttgcgtgcatgcattatgaggatattttataagggttaatggaatccatgccactacaaatatgccattttagaaaaataacattactattcacgatattggctacgtgccactggaatttgagaaaattagaaccatgtcactccatcacattatctgtcaaaaatctccgttagccccaactgcacgtgggacctaagtgtctgtttcatcttcacctccctcccatcttttctctttcctcttcctctctctccaccactgtcgtcgaccaccactgtcactgccgccgtcatcgaccacctccgtgaaggcctcgggagccacagccgtcgccgatatcatcggccctatccacggcaggaggcttgggagccgtcgccgccgctgccatctgtagcaggaggctcgggagcagccgtcctcaacgccatccacgcgggagggctcggaacatgcagccgccgctatccttgacgccatccgcgtgggagggctcgggagccgccaccgccatctctgtcctcgatcgcatccacgatgggaggtcttgggtgccgtcgccgccaccatccttgacgccatccgcaatatcgtgaatagtagtggcatttttctaaaatggcatatttgtagtggcacaaaatataagtgattttggttgaattggatatcctattactacgaatctaaatccatgtccatgcatccaacaaaaatatcttatattttgggacgggggaatatgtattttctaattaagttcttattattttaatcttattaattagttttatgtgttttatattgtctagtgtaaactacgtgttgttaattacatggtttaaaaatctatgtgtttttccaattcaaaatgtgtgttgagtggccaatagctggtccaaagcaatgtatttcttttacttgttaaatacagttaatttgggatttgaattataagttttgttataaatgatctaatagtatacatggataaaaaaaattagctatatatatgatgtagatgttatagttgttcaagaaaaaatttacaacaaaatatgtttcaatctaataaggcatgaaaatagaaaagaggagatgcaccggccggttatgggtgtacgtatgtgcagtttgcagcacatgtacctgtacagggccttttcttttattattaaagtaaatgcaatgaaggaaaatagtgggtcctttgttaaataaaaaaattggtgggtccaccttatttaaaagtgccacgtgttgaatcaagagcgtttgtagaaagatatgtggcggcttaggagtgtttatatgaagtttaatgaacttttagtatataatagatagatgtatgtggacaatttttacatacaaatatattttagaaaacaaacaaatgcctttacattttgcgaaatggcctgtagcctagtggttacaagagcctcggtagcacctgaggtcttgggttcgactccccatgggagcgaattgactccccatgggagcgaattttctaggatttaacggcgctgtgctttcagtggtagacgaggcgctgtgctttcagtggtagacgaagcgaggcgcatgtggtgactttgtcaatctctccaggatttgccgatccagtcttcgaagatactcataaggttcatgggggtgagtgcgcgtgcgcatgtggtgactttgtcaatctctccaggatttgccgatccagtcttcgaagatactcataggattcataggggtgagtgcgcgtgcgttgtgagtgtctgcattgtactgtgtaattctaaaaaaaaaggcctttacattttagaatactgtcatacagcaacagagcgagaaaaaaccgggtcacttgcacacctttcaggccgagcccgatcgagacaccggagtgtctgcaaatgcgtctccgaatacgaatacgattacgaaatacgacgaaatggactcggaataccttctccgagacagacttgtacacgcacacacgtagtgcaagtcgaagtagacgaagtgaccgtatcgctataaattcaacgctcttccgcgcctcgtctcctcaacacaaaaccaaccacgtcctacgaattcgatcgcttcacaccaagaaaacctcgctagctagcttgtagctcgccatgccgggcggcggcgcgatggtggcggcgagcggcgccggccggcctgagtacccgggcgggctcaccatgttcgtgtccatggcgtgcctcgtggcggccaccggcggcctcatcttcggctacgacatcggcgtctccggcggcgtcacctccatggacccgttcctcagcaggttcttcccgtcggtgtaccgcgcgcagtcggcggcggctgcggcggccggcgggaaccagtactgcaggttcgacagccagctgctgaccatgttcacctcgtcgctctacctcgccgcgctcgcctcgtcgctcggcgccgccacggtgacgcgcgtggcgggtcgcaagtggtccatgttcgccggcgggctagtgttcctcgccgggtgcgcgctcaacggcgcggcggcgaacgtggcgatgctcatcgtcggccgcgtcctgctcggcgtcggcatcgggttcgccaaccagagcgtgccggtgtacctgtcggagatggcgccggcgaggatgcgcgggatgctcaacaacgggttccagatgatgatcaccaccggcgtgctcgccgccaacctcatcaactacggcaccgcgaggatcgccggcgggtgggggtggcgcctcagcctggcgctcgcggcggtcccggccgccgtcatgaccgccggcgcgctgttcctcccggagacgcccaactccctcctggagcgcgggaggcgcggcgaggccaggcggatgctccagcgcgtgcgcggcgagggcgtggacatggaggacgagtacaacgacctggtcgccgccggcgaggcgtcccacgccgtggcgagcccgtggcgcgacatcctgcgccgccgcaaccggccgccgctggtgatggcggtggcgatcccgctgttccagcagctgaccggcatcaacgtgatcatgttctacgcgccggtgctgttcaggacgctggggttcggcggcggcgcgtcgctgatgtcggcggtgatcaccggcggcgtgaacatggcggcgacgctggtgtccgtgctcgccgtggaccgggtggggcggcgggcgctgttcctggagggcggcgcgcagatggtagcgagccaggcggcggtgggggcgctgatcggggcgaggctggggtggtcggggacggcggcgatcccggcggggtacgcggcggctgtggtggcggccatgtgcgtgtacgtggcggcgttcgcgtggtcatgggggccattggcgtggctggtgccgagcgaggtgatgccgctggaggtgaggccggcggggcagagcatcacggtggcggtgaacatggccatgacgttcgccgtcgcgcaggccttcctgccgctgctctgccgcctcaggttcgtgctcttcttcttcttcgccgggtgggtcgccgccatgaccgccttcgtcgcgctcttcgtgccggagaccaagggcgtccccatcgaggacatggccgccgtctggagcgaccactggtactggaagcgcttcgtcgacggcgacggcgacggcgcacgacgccggggagacattgagatgggacacaagtagtagtagaatttactcactgcaccgtactacacttcatgtttttcttttgttgttattcagctattattagatgcggattttctttaattactactaaatttcaatgagtgaagatgttgtaacaaggattacatatttgtgttgagttgagtatgccaagtacatatgaagttatgggatcataaacgagttaacacgtttaaactttaaccattaatatctcttggaataattttgatttaagtttttgaaaacaataagaccgaaagaaaccaccaccgaaatagaacctttacgacactctttttccttctcttgtttgtcattaacatacaccaacattttaacttgatctcgagatgcgtgcaatgataagaagtgtatgatttcaactccaatatctcgtgttaaatctccaacacgctcataattttccttttttaattacacggcagacgcatacgcacacacaccactacatacgtaacaccacactcatacccctacaaatgcatatcccaacacatgctctaagagacggaaactaacagcacattcctaatctcactaaagtcctattaaaaatccacttgcatatgcgtagtatttgtgggcaccaggatttaaatcctagtgagtgaattcatgcacccacgactccatcactacaccgctggtgcttccccaacatgctcataatttctttttaaaagaatatttggagagatatctctcggcttcaaatctcattctcggtttatgagctgacttatgcttccatcttcattgcacctctgttgctggcatagtatttcctaactgcattctccaaatctgcctctgcaaccctggccaatatcgaacaacaaacaaatacaaacacacaatttcagtaagagtattggtaattttaactcaaagcaagttttcttacgttctaaatggcctaataaactgcaatcgagccgactatataaaccttcttatagttaggccgataaatgcatatccaaccaaaatattgaccaaaattaatcgggcagcaacctactccaatagcagttccgaattccaactacacaaacaaaaacggaaggcacgtattcaaataaaacaccctcatgttgttgacagaagcgatacactaagtctgcattccatctatttttcaaaaaattatacttaaacaccctccccagtccccaccctggttcaaaaataagtcacataaagactttgctttaaaagtgatttttgccttctccaaactttgcaatggacaaattgttaagtgatcttacacaaacaattacaaagggctctaacagtgtacctaaaagatttttcccatttccaacgcatcatcaacaatggtccaactctaataatttaatttagagtaaattttacaaaactatagatttagcattgaatttattatgatcctacagatttaagataagacgaagtaccataaatctacatgttcagtcacaaaattatcacaaagctacaaatttagcaccaatttaatcacaaaaccacaacacttatagctccaacacaatggtagtactagggactataatttcaatataaaatctatctgcggttttatgataaattactaaatctgtagttttgggtttgcatacatcttaaatgatagtttgatcaagatatctatagttttatgaaatttactttttaatttataatacaaggatagtaatacttccataaagaaacagagataatataacgttatattgcacgaaatttattgatacaacaaaataattgactgttcaagcataaggtggtaaagaagacacaaaaaccttgccacgattagcacgctagtaactcaactacaaacgatacacacagcagcatcagttcactggatggagcttctccaaggatcattctaagctaaggcactcattccgatggcgtgtggcaatgcttctacggttcttcacgatagataccaagacacaatcaggcagtcttgggcttgggtttaagccgcttcaattgtgagtacaggaaaactccggcaagagcgactccggttcctgcagggcgcaaatatttggatatgtaaaggaggtgcgatgcagtcaatttgatacagaagtgaacagaaaatgattcttacccagagagttgataggcgaaacaggggtgcggaagaacagaacggatgtcacaatgaccaccactcgcttgacacagttacccaccgagtgagtaacaggggacactcttgccaggatcatgtacgacaccttcaagaaattatgtgagatcagcaagacatgggctttgcacatgtatgatgattcatcaatgtaacaactgtaatgtattcagcacatagaatctatctgaaatgaacaagcgcatccagagatttcaaaaggccaagctatttttagaaaatcaattagatggctgacctgttggtatgcatggaaacagaacgcagcaatcagtgaccttgtgtatatctgttttaagttcagaccctacataagaaagaaaatagtcaaaaattgcaccaaacaatatgtaaggagcaatttgtctataattaaatatcaaggtgctcacagcagactgcagaactgtcggagtgactttgacaccctctgttagcaaggttactggggccaagaggaagaatgacatcactgtaatgattgagaagagggtaatgttgtccagagattcctgatcagaaattgggaaagaagatcattagaattaagttatgtaagagccatggtgacaaacaatagaggttcaaggaaaaagccacagataggcaagtgtggacataaataaaaagctctgttaaaatacaaattttatcttgaaacagaacattatgaagtgacacatcctaaaataactgatgaatattactaaagcagactattcaagagaaacacacacttgtactaattctgcaattcagttgccaatatctatgatgaccgcactctaattattcagttacctccttcttcaccataagcttcttgctcaacacattccttgactggaaggtgacatttgaggccattgcactccaaaatccagccctgatatcatataaattacagacgaatcaagcatatagcactttgttagctctgctatcagcaggcttatgttatatttgcagtttccacagcgaagacaaaaatagctagctatatcccttaccagttaaatgaagcttcagtaagagatgccaatgccacaccaccaacaattggaacaagagacaatacaacaaaaggagtaggcatctgcaaagtgattatgtatgagaaccaaaccaagaaacagatggtttttctaagattatatgcggttgcatagttatcactgggcaccagtgcagaacattaaaaaattacctctccgaggaaaagtgctgaaagcagaactgaaaagaaaggctccatagccttgatagtatgtgtaaatgacactgcaacctttccaaggctcatgttcgtgaaaagattgcccatggtgtggaccatagcgagaggaaggatagcagcaagctgaaataaggacagttacaatagttggcttcatagtgcaatacatgtgtatcgaatgttgtcacgatgtatcttatagagaaatataattacctgcgcaccggagatctttggtcttttaaggataccggtaatccacatgaacagagcaatgacagtgccgacagcaaactggacatttgtgatgtttatggggtatggaaaaaccttcaaaacctgtcacacataggaacaataaaggaaagttgttttatctacacgaagccaatgaggagatcaagaaatttcaacagattaaccataagtgacaccatatataatgaacgaaaacaaacttccatccctagcacaatttgttttggtagaacattggatatactcactataagacatggatacatatgagtctggacaactttgaagaaatgtttgttctttttccttctatattctatatttctaccagaagacatgggaaattgtctactgcactcactagaagacatgattttagcaatattacccgttcgacatcttataccagatacaaacataaactatccacaaatgtaccttttagaaagttgtgacaaaagtttgatagaaaaggtgtaacgtgggggaacatctctaaaagcccaacgaaataaactaaatcgctcttctttccacaatatacattttgagtttgtactaatccaagatctagacgagcttgagcaaattcttgcacccattcagtaagtgggttagaaacatttacagaaaacgacatataccagcatatggaggcaaaaaaggttataattagaagtgattcacaagacaaataaaatcaatttcaaaatagttccctcttttgctcaacaatctcaacggagcgagtagatctttgctgaatctaaaaggcgaatgcccgatccaagatcagattgccatcagcgaaccattcaccactaacagaatcacatgtaataaatcccaaatgaaacatcctagtctcccccaaatctccgccaaattggcgacggcaatggatcaaagttaaagccgcctcacctgcttgttgtagatgttgaagtagatgttgaagaggtaccacagcccgaagagcgcgccgagctgcagcgtcttcgcgagccctccaccctcctccgcccctgcctcacccgccgccgccgctgtcgccgccacggccacgtcgcgtgcgccccgccgccgctcatcctcctgctccggggaggccggcacgagcccgatgcgccgggcggagatgcccgcgcgcggggccacggcggagaggcggagccccctcggcgggagcagcggctgcccgactccgacgccgaagccccgggggctagggttgcggagctggagcggggcggcggcggtggtggcgccgcatggccggaggagcccgacggccgccgcgctctgcattgccgcccgtgggagccgcggcctcgaaggttctagaagcttcggctcgcgtggggggaagcggatgcgtcgaggcggcggcggcggcggcggcggagtgctcgaggatggcgagagcgtgagagtgggagagaggttttaagcagcgacgcggccgagctgagctggcaccggccgagtctgcatgctcaatgacacgtgggccccgctgattttgtggaccaacatgtcagtgtgttggtggctgtgacgttggctgggcccgcgcttgccagctgctgggtggaccgggagcacggtggtccagcgaggggcagttgtaggtaatggctgcggggcccacttgtcggtgacagtgtggttgtcagatgggtggtggagcaagctcagcgacgagtacgagggtgagactgtgaggtggggcccaagtttggcataggtgcggcgacggcgatgaccagctagctcatcgtggaatgcagattcgggcagaatattcttgacgccgatgctataacagatcttaaatgaaggttgagtaattattcatttggaaatcctgttagtatataagccaaactaatccccttttgtaattttattgagttcatgtgctacactgctctaaagttgtactatgcactaattttgtagtttaactaaaaatgtctgtgcgttgaaatgagcaagactttttccaatgctataacagctattaagagctaagcaacgaattaaaacattggtatcactatacactttaattggaaaaaattaactaaaatcattcattggttttgggtcgaaagcattccttcattccttttcaacccccggcccctagcctaatccgttgcttcctacctccttccgctcgacctaacccattatgtgacattctggcctaattaagatatagcatgtgtggtccatgagagctgtgtgtatgtttagtaccaccttattgtttagcaatagtggagccaacttatagggcatcttccctccaaccatattattcctgagttaaccctttaacacgaaacgatgacaaaaagtgtaaatgtgatggtatgtgtaagtgagcccgcccgtcgaatgagctggctacgtggactagtgacacctataatattagtgtctaaataaaaaccgacacctataatattagtgtcggtcttttcagaagaactgacaccgataattaagatcccaatttttttaagaaccaacacttatatttatactataggtgctggttttttaaaaactaatgcctatgaaaaaaccgatcgaagccaatcaaccttatctccgattccccacacctcctccaccaccatctcctcctcctccatagttgctcccactgccccactctcacccaccccaccaccactgcacagattgaggtccagtgcagttgctattgtgactgcacaatagcaactacatataattagccctctatttcttgatccaatgttccaaatcgcttgctatagtgaattcagaaatatatatattttttatagtaaagcgctacaatacttgctacagtcatccatttcaagcccagtagtgcttgtgtgactgcttaacttgcagtcacactagctactgcacatgaaccagatcccagttgcacgcccacttcctcaccaccacccccaccacctgccgcatccgcctcccccccacccccccacctacctccgccagcctcctcggccttgtcgtcattgccttcctcatccctttccctctcaacatctccctggtgcagtggccgcacggtggctcgggatctagctcttccctctccctctcggcatctccccggcgcagcagcgagtcggtggcttcctgacacaatggcgagttaggatctggccctgatctcgagacctccatgccggtgaggcagcgaggagcaacgacggcctcccactcacccctccctctcctatcatctcttttgtgatttattttgtcatttctgcttctactctcatcttctgtgtgacttattttgtgattttcaattgaattctcatatcctgtgatctatccggatgattttgtgatgatttcgattggattgggatttagtttttgagtttgatttgtgatggtttgggatttgaagaggtgtatgcgatgtggatgatggactaagacggacgaaaatcctctaccagaatccttattatgtagtatttttttattatactagcaaatatgcccgtgcgttgcaacgggtgaaaaaaatataatgataatatatgtttttcatgcataaccatatatgacaatcagaaaatcagaaaattggaacatcttaaatgtaatatcccaacctcgatgatggcaaccttacgatgtttgttttacctaaaataattagattattcatgtgacaacatgcatataatctaaaatattcttttaatctcattattgcaaccaatcaaatcctaatcactgtgcactcttctctaaataacaattaaaatatgtttattttctaagattatttccatataatatgttatcaagaataatagctatacttcacaaaatagtatgataattgcctataaagatgtgcagggtctccaatacgggagaataggggtggaaacgagccgagccgagttggctcggctcagctcgtgaaagcttgctcaactacaggctcggcttggctcggcttgattagttgaacgagcaaaaagtgcagctcggctcggctcgtttcaaagctcgagccggctcgagccagcttgtgatgtacagcagcaagtaaatacttcaacaatagagcaatcaattagcaagccaaatcaacatgtacgatcaacaagacagcaacaacatattatacatttcacaagctgacaagatcacaacttcacaagaccacaattccacaatctccatcattcattcacagcctcacactcacaggacatgccccaacatgacacacataatcttaatagtcatgaccacaccataatagaagcatagagtaatatagttatagtcttatagagagtacataacttagagtagaccacattccaaaagtccaaagtctccattctcaaattcacaaaataattatagaacatctaattattatttcgcaaaatattaaaaggaactctccaaatctccaactcctagactttctccacactccacagcaacatgttccagccatgagccatccatttgcctacataaatgataaatcatcatgtaattgaataatatactacacaaaacacatggctcaaagcctcaaactatagtattggtacaacatttttgatttatttgcctcattctttctgtaattgaatcattgacagtttgacactgacacacacacacacgctactccactgaccacaacaatctacagctacatgcctacatgtacatgcatcacaaaaatgagaaaatacatcacgaacctcttcatcctaggctcgtcgttgcggcgtgatgcatgaattgtcgtcgatcggttggcgacatggcgtctcggcgaggtcatgatggacggcgtcgagtcagggacgccggcgacgcagggggcgtcgagctcggctcgagcggcactggggacggtggacggaggccggaggtggtgcagggaactagggaagggaggcggcgccgcggcgggccgacggcacagggggcgtcgccggggagggaggacggagccgacgcagccacagacccacagtaggggaggtaggcggcgcaaggagcgaggcggcaggaagggaggtggcgggccggcggcggcggcatagagggggcttcgaagttcgaacggcgctgccggcctgccgctggcggtctggcgctggggaggggatggatgcggcggccggcaactcctcttgccagtcgccgccagcgccagtggctgaggaacggaggaaggggattaggggagggatcggatctggggcgtcaggcgctcacgggccacggctcgcgctcggctcagctcaggacttagggtttctctctttcatgggccagacaattgttaatgggcttgggctcgcttagggaactcagttttccataggcttgacaagcctaccgagcagcttgcgagctagctcgggctcggctcggtttggaaacgagctgtggagggagctcgggcttggctcgtttagtcttcgagccgagccgagcttcgcgagctcaagccaagcccgagccgagctcgcgagcctgagctttttgtccacccctacgggagaatagatgacgaaacaaaagtcgtgtaggagatggaaaaaaaatcgatggagcctatccgaccaagtatccatcaatttagtcttttattctagcagttttttcctcatatgctttttttatttttacagacgatggaaatatttttttctcgcgtgtttttttactgactacggaacttttttttctagcgcgttttcttttgcgcttttttctggcatttttttcctcatgcgttttttaaaccgtttttattttctcgcgcaattttttttcttttttaatatacggtagaaacttctctttttaaatatttagattagattagattagagataaagaagatatataaaagaactactaaaacgacgaatagaaattagacttttttccgccgctcttttttccgtcctttttattttttttctcttgtattttttttacgaatggttttttggccactttattagtgtcggacctttcataggattcgatttttttatcgagtcacatataattcctttttctttggaatcagatattttttattttttcgcccttttttttaccgcggcgacggagtcggattagtttctatttttccttttttttatcggacagatttgtttttttttcacccctctttttatcggattttttttattttttcgcttggttttttcgttcggtttttttcgtccagtcgatttttttaccatgtcatatataatttctttttctttggaatcggacagttttttaaaatttttttcgccctttttttaccgattcgtttcgtttttttccttttttttgccccgtattttttttgatcggactgatttgttttttcgctcggttttttggatcggacttttttctcccgtttttttcgctcccttttttttatcggacttttgtttcacccggtatttttcgctcggttttttccgcccgatttttttttgacagacgaaggaatcatcttttatttttttaagtagtagagagtagagatagagatagagatagagaagagatatagatataaatatatagatatatatatatatatatatatatatatatatatatatatatatatatatatatatatatatatatatatatatatatatagattaaaaccaaaacataaaattgaaaccgattcaaatacggatgacgtaccaaacttccggtaaaaacatccttaatttataacagtagagataggtaatagagatcagatggtattttttccttttcttttgactttttttggacggtgtttctttttcttttcttttttgcatcctgaacggactttagcgtttttctgtttttttccgtttattttgactttttttagggtgtttgttttcttttcggttgcatcagatcagactttttttccgtctttttagtttcttttacagccggcatttttttccacagtttttttcgcacggtttgtttttcgcccggtttttgatcggacaatttgttttttttttaattttatttttttcgcccttttttaccgtgttgacggagtcggattcgtttttctttttcttttttttttgtcctttttagatcggacagatttttttttcttttctttttccggttttttcgcccggtttttttatcggacatatttggttttttttcatccggtttttttacggacgatggaagcatcttttatttttttaagaggatagagaatagagatagagagaatagagatagagataggtacatagatatggtttcttatatggattgaaattggaaatgaatttttaaaacatgcatgttaatggtggcaatcttctgggatctctagcatataatgataaacacatgcattcggattacaggagctccgaatttgactaccacatccacaagcaactgcaagagcggaaataacaggttaattaattaattaattagattaattacgtcgtaccaccctgtgcagtgcagaaattaattaatttcagatatacatatgatcgatggggtcgatcattcaggacacgataagcatcaagaacgcggacacggcggcgagcacgggccgcgcgacggcggcgacaatggcggcggcggaggaggcggccttgtcctctccgggcttcatctggggggtgtcctcggggcactcgaggccattggcgccctccttgcaggtgttggcgaagaggcccggcgggtacttgccgtagaggttgatgtagctgaacatggaggcggcgcaggtggtctgggcgtcgttgatgtaggcggtgaaggggcacgccaggtccttgagcgcctggcagcacagcgccggcgggtacatcggccccttgcacctgctcgtgatcaccgtgtagttcgcctcctcgaagttcaccgggcaatccttcttcgcctgcagcaagctccgccccgcgccgccgctcgccgccgacgacgcgcccaccgcctcatctgcacacatacatgcatatagtgttcgtcagatctccagatgttgcgtttgacgacggtgaggaggacggacttgagatgaagccggcggtggaggcggcgaggacggcggcgagcgcggcggcgaagagcgcgacgcgagcgtgcagagacatggcgcgcgccctggcgggatgactagtggccgcgcgccgcgccggccgcctctcccgttttctcgcgtgcagagagacgacgacgacgacgacgtgcaggaggaggagaggagttaatcgctcggcggcggcggcggtggcggcggaggtggaggtggtggtggctcgtgcgggaaatgggaggaggcggtggcggtggcgggagagatggagaggagagcggaagcggcggcggcgggcgcgcgcggccgagccaaatttggcgggaagagcgctcaaaatagccaacggtttttggacggtcacgaggaccacacctcacagtaatctaatgatagagttattatgagtttcatcagtttcagagtttgaaatttgagacatgtcgagtgtttgaattttgaatttttgaacatgagtgtcctcgatctcctatgtttctattgctccatcttggccgatttatgaagaactgcagttcaggtttcctatgaaatgtagagaattttttttgttgttcttcgaagaattgaactggtttttgcgagaatcgtaaaaatatttctgatagaatttttattcgcttgaaattttgtgacggtgtagtaaaattttgagcaaatttgaattggcaattggattaattcaacgggttgttcgtttcttgtttcattggtactccctccgtttcataatgtaagtcattatagcatttcccacattcatattgatgctaatgaatctacgcatatatacttatttagattcattagcattagtatgaatgtgggaaatattagaatgacttacattgtgaaacggaggaagtagcaagatttcggcgtgcgcgcatgattgcaagattcatggagaatgccagatttgccagcaaaaaaaaggcaccaaaatccatacgaaattggttgatttatctcgcaaacatcgacaccttgggatgcttctgatctaaatcctaacaaaactaatcagaaatttattacaaaaaaaaatctgatcagtccgtcagattcttcagacggcgaagaactccaaggcgttgcggaggagccggccggcgtacgggtttgggtggtcggggtacgtgcacccggtgctgaacagcagccagtgtcgccggcagcgcttcaccggcaggtcgccgacgacgcgccgctcgccgccgggcgccacgacggacaccgcgtcgtcctcgaacacgaggcggcacagctcgccgccgctcgccgccgggtcctggcacgccgccgcctccggccactcggtgtcgaacagcttcaggttggcgaggtagttcccctcgtagccccagctgcagagcacccaagcgacccgctcgggccccggctcgatgaggacctcggcgacgcgcgcgccgccgcggggaacgcggccgcgcggcaccacgctgagctccgggtagacgtcgaatcccgggccgagcgcgcggcagacgagctccatgccggccgcggcagggaggcggttctccaccgaggcgtagtaggacacggcgctgcggcgggcgggcaccgtggccgtcgccggcgacggcgccaatgcgaggaggaggatgaggacgccgatcgccggcacggtcgtcgtcgccgcggcgaggcggcggcgcgccatggtcgacgatcggtcgccgccctcgcttgggcgcgaacgtgatgtggtggcttggcgcgttgcgtgggccatgcctccgcgcgttttttaagatgcaaacttagctcgcacgtgctgtgcgttgcaacggaagaaaccgcatggaagaggatactcacccctctctgtttagtttaggcatcaatcgaaaacatgtgaactttttcttttttttttttgctactaccttcgttttaggttattttacgttttgagtttggttaaagtcaatctgttttaagtttgactaattttatagacaaatatattaatatttataatactaaattggttacatcaaatcaataattaaatatattttcataataaatttgtcctgggttgacaacgttactatttttcaacatacttggttaaacttaaagcagtttgactttaaccaaagttaaaacgtcttataacctgagatgagggagtatttgatattaaactgttggtctgtttttgcctctaactctgaccgaagattatctgaaattcttgcattccgtacggggtgctagtaatatttttttcgcatattagaaaccgaggaacacaatctcgatccattttcaaaattttgaatcaacttttggggaaaaaatattgaactttcatacgaatttgacagttttaattataaatgttgcctgttttagagcatagctcttagagcatcttcaacagaaactccaaatctcactcttcaaatgactatttgtccaacttgccaaaccaaatggaaagtctaatttgcatttcacttcaacagactctctattacactatcgaatctaaatgtgggtctcacctattagcctctctactatttcaccgcttcttcaccctctctctcctctctctctcccccctctcctcttctctgtcgtgccactggccaaatccccgcgggaccgtaggcggtggcaatggtcactgtcgccaccaccatcctcgtcgtctcgggcataagcggtgaggttgtgcatgggcgtgatgatgacgaagcggtgacgcagatttgggcaaacggcgacgacgtggattcagccaaatgggtggtgcaggacctcttgctcgcaccggcaagggcggtagcggcactgggccaacaaacaaaggcggtggtcctgtagggcgttgcttcttcttcggattctcctgcagggtgccgccgcctacggagatcttgccattggcttgccactccgaggggaccaggtcccgtgcctccgtatggtcatcggagatctcgccatcctcaagcttccgccgtcagccactacctctcccttttggccactctgctcccgaacggagaaaaagtgaatagaaggttgtgggacccatggatggcaagtgggataggttggccaagtttggcaagtgagggaaggagtttggccatccgaatggcttagagagtggaatggagaggctgttggagtacgattttctttcaaaataaagttgctaaattttgacttggagagtgagatggagaggctattggagatactcttaggcttggttcgaacctattggttcgcaactcattccccgcatggaaaacaaggtagcccattagcgtatgattaattaagttagctaaaaaaattgaaaaatgaattgataaaatttttaaaacatttttctatcgatttcttttttacaaatgccacaccatttagcagttggggaaacacgtgtgtagaaaataagagtgtagaagatgagaaaggagagtgtcaaatacaccctttgacgaatatagaatcactcatacttctttgttaaaaaaattcggacctacctatgtaataaccaacatttcaaacttcaaaaataaggaaaaataaaataaaattactcatagaaaagaaatattttggcacaattttggatagagctaggcgttagtcgttgtttcgtaagttggagaaaattgtttcatccctggattaaatgtttcagctcagttcatcaattgttttaaaggatgcaacatttaataaatattggttgcaacaccaacaaaccattgtatgaaatgttgagcgccaaccacactcatccaaaaatattacaaaatcaaaacttaaaatgtgcaatagatgtatgaaacatcaaattttatttgttaaaacatatatatttatcaatcggaatataattacatgagatcttattgtaaatatttaattacaatgaactcgttagcagatcatatatcagataaataatttagaagagaaaattgttttaaaaatatatttggagagatgcatccatgcatagtcctccttggaggcggtgttgaggtatgccctctttccttctctgacgagtttccccgaggaaaaacctcgctcaagagtccttgggcgggtgatggtgatgctcccgtgtcgcaacctccttggaggcgtcgtccgtggagatacctatgcctttttcgctttgaattgttggtcctcaactgcaacggtgcttggttgtcatgatggtggcgagtctgtgtgggggaagagcgcatctttcttctctctcacatttttcctccaaagctctaaattgtgatgatgttcgggagtcctcacttttggtgattagctgcctagcaaggcttatgctggttgggcggtttgcggtgctcttggctctatgttgacgggtgggtctatagggggatgggaagatctttctactctctcaccctctccctatgcaatctaatatcaggatgtcatttgcgagcgcttgtgtccttcagttgtttggctctatcagctttgagcggtgtcgcgatgttgtaggcctagcagcgactggtctcgcatagcagtagctagcttggtgcaaggttttctccctagtgatgtgtggtggtaccgtcggcatgtggttggcttgtgggtgagctggctgagtttttcttttcagttttcttttgcttttccttgattttagtctccccaaggttttaatctaactgcaggtgtgcgcgcagtctgagtggcgaggctacggcagtctgatcggcggcttgggagcggatcgaccgatggcaacaggggttcgtcatctactatgttcgaggaaaatcttttattccgcaaaagattttgggtttttggtttacctaccattaacaccccctcccccggtagctttgtttggtcttgttcaatcctggggctgtttggttcccagccacactttaccattacttgccaacaaaagttgccacactttgcctaaggtggggtgatcaaattgttagccacaacttactaagcctaagggaatcttgccacacttttttgagccattgacacgtgggacccaatttgttggaggggaatcttgccacaactgtggctacaaccaaatacctgttaaatttgcctaaccttaggcgtggcaaactgtggcatagtgtggcttgcaaccaaacacacccagcattcctgcactcctaattaatatatataaattcattagccataaattattttccagctcgtgatacacgccataatctgaaactcagatagttaatttgcagaaaacgaaaaggaacattagaatgagatggcaaagccaatttgctttgttgtgacaaagaaaaaagagaaaaagaaagatggccaaggaatgtcttgccgagagatgtaatccaatgtatttattgttgaaagaactttcaggcaggggcgttcttacgttattctacctggatctccgaatcccgagtagaattttaatttttagttgttttagcctattaccatattattagttcaaaattatagtaatatactccatatgttatgatatgtatgtgacttctgatgatttttttctgggttggctattgctttcacatactaacaaaatgaaaaaacagacatcacatcaaattttgcattacatgaaaaataagcaacacagtaactaatcaggattcaggaggaacataatactgtttgcaatgcaaattgtttccagcctgccaagttttgagcaagcctctgtgcctgtctgcagatggaatgtggagctgagcctatgtgggctatgtgtaggcgtgtagcctgacaattctgacggcgcctagctatgcgaaatgttcccgcgacaacgacgatcgatcgtatcaacctcgatcgtccaaacccgtgggatcctagctacgaatgtcctggattcatcaatcgaatggcggaatgggaggctttcagagattctgcgcgatcatctttcctgttcaaatctaaccatatgcaggcaacacagattcttcagcgtgaagaaaaaaaaatcatcagcaaagtgagcatagctatcaactactccctctgtttcaggttataagatgttttgactttgatcagttaaactgttttagtatcaaagttaaatttattatataaatatgtttaattattaatttaataaaactaatttggtaatgtaaatattactccatccgtcccagaatataagtatttttagagttggacacggttattaagaaagtaggtagaagtgaatggtggtgggttgtgattggttgagtagtgaaagtaggtgaggaaagtaaatggtggagagttgtgataggttagaaagagaatattggtggagaagctgttatattttgggacaaatcttgatggctaaaagttgttatattttgggacgggtggagtactatatttatctaaacttagtcgactttgaccaaagttaaaacatcttataacctgaaacggagggagtagttaggtcttttgtaatgcaacgtgtttatatatctcggtccaagatataaacttaacatggatactctcgtttacagctagctgtgttttaagtggtaagagacatacccttcaacagcaagatattcatgataacttcgtcgatatcaagatgcgccagcctagtcttcggaggttatcataggggtaaaatgtgtttgtgcgcgtttataaaagtgagtgttcacgcatttatatcagcgcatgtgtctgtactgtgtattgaaaaaaaaagaagaaagaagaatcactattgtatcaaccgtcccttcgaaagtccgagttagaagacttcacatacgccggcgaaacgagtgaaaaaccacccacagagaacgcacgaaacggcgagagagcaaaaacaaggtttggttttgttgctttctttccaggaggccggcgacgtgaaagggttccaacaggtggatgctgaccaacgcaatgcgccgacgaatcgaattaatggttgtttaaattttaattaaatgggagaacagaattttagcctttgatgatggctccatggccccaattatttggcttttgcaaaaggagacaagaatttagcatcgatcacccactttaatcagttctttaattgacgcgtgaaatcgatcctaggatttgatttttttaaaaaaaggttgatggcacatagcatgtttggacttatgttgctgggattaattttgtttgtgatttaatcttttgttttttttcctccgaacatttctccaaggatggcccacagactgcacatgtcactcaccacctggttctagatggtcactccacctgaccaatcacagctctacacaaaactcttgagcatcaacagtccaacacatagaccaattcctctaaaattgtgtggaatttcgataaatgttcacaaacaaagcccaagagagggttctgtacttctgttgtgatacttattatggtcagatgtatcaaatatttttttgtgtaggcaggttgattttatttttcttaaaaaaaataaaaataaaaaggtcacctgcatcctggcaacctagaaggccactccacttgaccaatcacaattcacacagttgcacccttgaacatcaaacacacagacaaatgcaacaatggaatctggggtcaaatttctgttggtgtcatcagagggccaagaaactgcaggagcaccaaaaagtctcactttcttcttcttcttccattgtctccctacaaaaagggctgcaagaacacaaggagaaaaaaaaaaaactgcaccaagaacaaattgcaaagtaagtttgtactttgtactttctttgcagcaagaagagcaagaagggagatgtccatgaacgcggacctcggcaagccgagggagctcaccgggttgcagcagaggagggctctgtatcagccggagctgcctccatgccttgaggtttgcaagctctccttcatcctcaccacttgcaagctgcatcaagctactttttttcatcactaattatgaaaagttgcaagttttgaacacagtatgttcactttgtatttaggtccttgtatttgtattctctcaaagtttttcaaccaacatgttcagggaaaggccatcagagtggagtttggcgattcgacgacgaccatcgacccgacatgcgcaaatatggttgtgcaggaatttcccaacacctttggtcagcctctggtacatttcctgaagccgaacaagatggatgcgcaagccaacgatgaacatccaccaatcaggttcgttttcctttttcagaatggtgctaaaccccatccatttttcagttgagaaaaaaaatcagaacaaatcaagtttggcttgaacaccgaattagtgtgatagcaactagtgtcaattctttatcattgaaaacttgatatttgatctatcaacacacaattctcaggcttgatatttacttgaatctagggttggtgtggtgttctctgggaggcaatcgccaggggggcacaatgtgatatggggcatctatgatgctatgaaaactcaaaatctacaaagtgttttgcttggatttattggtgagtaattgagcatactttcaatttctagattttaaatggactaacaagaagcagtgtgatatttacattattggattgcttgttgtgacatttattggcttagtatatatatattgatttcctgcaaaaagatatgataaaaataagtctcatgaagaactttgtatttctaaataggtggcacagaaggcctatttgcaaatcagacattggagatcacagatgatgttctttcagcatatagaaaccaaggtttaaatttattgatcttgattgctagctttctaaatatattatggcctatataacaagaaagtctttaccttcttgaaggtggttttgattttctcggcagaactgttgatcaaatccacacaactgagcaagtgaatgctgcaatgtcaacatgctgtgatcttgacttggatggcctcgtcatcattggaggtactaataggttataccagcaaatttgctgatgaaaaaaaaaaacatcacaatggattttacatgagcacttccatgccatttcaatctagagtgaataaagagctgtgaaaaaattggggttacatgaaaataaggaccaagcaatcaaccttatttcaaaaacattctctgccttaaggacttgtgtaattcttgatgttatcttgtcttcaggggtgacctccaattcagatgctgctcagcttgcagaaacatttgccaatcacaactgcaagacaaaggtatatacacattgttaattccacatcctcacattggaatataactcccattttcagatctttatcctgtttgacaggttgtaggcgtgcctgtttcattaaatggtgatctcaagaatcagtttgttgagacaactgttgggtttgatacagtgtgcaaggtgagtcttgcaggctatgcagcaaataaaattccaatttaaagctaagacagtatctacagttccccaaaaaaaattaaatgaaggatacaagtgtacgattcccccaaaaaaattaaataaaggatacaaagtgttacatcatgacatgtttttttaatgtaaatgtcttctatgaaaatgtcttttcaggtgaattcccagcttataagtaatgtttgcctcgatgcaatctcagctgggaaggtacactctattatagtctatcataataaattggacttattaggatcacttattatttatctaatttatataatttccctgcagtactaccattttgtccgtgtgatgggttggaaagcatctcatgttgccttggagtgtgcacttcaatcacaaccaaatatggtctgccttgtcgccttgatcaaatgcatcgtaaaatctagcataagtgaacagttgtagaattatttttataattgtacattttcacatgcaggttattttaggggaagaagtggcattttccaagctcactttgaaggaaattataagcaagatatgtgatggagtgcaagcaagggcagcacaaggtctctacaattcattggctgtcttaagttgatgaattctcactaaagactgaattgtgcatatatcaattaaatagaaacatgaggtaactttgtgacaatctaatatattggatataatttttcagagaagtaccatggtgtattacttatttcggagggactaatcgaaagcattccagaaatgtttgcacttattcaggtttatacttgttactacaataaaatgcagtgacatctcatttctatgaaatcttattggtttcctttatgcgtattgtaggaaattaatattctccacagcaataaagttcctgagaacaacattccatctcaactttctccatgggctactgccttgtataattacttgcctcctttcataagaagagaggtattggtgtattaaattactaacataatttattttattaataaaaattgtggtctgaagatttggaactttctgttatagttgctgctacatcaagactccgataactcagcacaattgtcccaggtttgtgttttctggaatgctcagcagtcagttattcatggaaatgcaatttttgatgtcaaactttttattgaaattttcagattgatactgagcaactcttagctcatttagtagaagcagaaatgaacaagcgaatggtaagttcagttaaaacttgagctttatgtgcccagttcagtattcagttctttttttttttaatttgattgtgcttgattctcagaaagaggggaaatacattggaaggaaattcagctccgtttgccactttttcgggtatcaagcgcgaggatccttaccatcaaacttcgattgtgattacgcctatgtaagtagtaaacctgaactatgttcgtcacaaataaaagatatatatatatatatatatatatatatatatatatatatatatatacacacacacacacacacacacacacacacatgctataggctctaaaccttgaagaatgcaggttcttggtcatatctgcatgcacatactagcagctgggctgaatggttacatggcttttgcaacaaatctgaaggaaccaacaaacaaatggcgatgcgctgccgttcctctaacagtatgctttttagttgactgtattgttttcattaattatgctcatttaaaatgttcgagtttgtgacgtgatacactgtttctaaatcttaccaggcaatgatgagtgtgaagaggcactcacgcagtcctggagctgttcctactggaaagccagttatccatccttctccagttgacctgcaagggaaggcttatgcgtaagtccatagttaacagccttaaaactattaatttgctgcttcaggcaaaagactgaacactgacatccatgaatctcattcagtggcttgtcataaaaaaatcatgtgttgattcctccggtaaaatgttaataatattgccacaaaagtttttagttaatgaggcaacagtaagatgatatagaattagtttagattaactctgcataatatgtagacacataaatgcatcattttttgtgttaatatcattgatcttttacagtgactcttcagattataaggcagaggaaaactataaactaattcttgtttctctcattactctaggctcctgagagagaaagcctcgagcttcctattagatgatttctacagaactccagggggcattcaatttgatggatctggaacaaatgttaagccaatcacactgactgtcgaagaccaagactacctgggtgacattgagctactgcaagactacttggagaaggtttgtcaacaaaatctgaacctgttaacttcataagagctaaaaaaaaaattcagtacctgtagttgaagcttgtcaaactgatatcccaggtgaggaacattgtgaagcccggatgctcgagggagatcctgaaggcggcgataagctcgatgtcatcagtgaaggatgtgctgaaggttatgtcggctcccttctatgcagagctccctctgttcaatctgaactgaaagttaccttcatcagacaagaaatttttgtcagttagtcattgggttcatcatatgacatcagtccatctagtagaattggatcagaatcatgagtgagtagtggttactgatcttaggtaggctgttttgtttgctgttctgttctgtttgtgatatgaacagaacccagctattcatttttattttgttttgaggggaagaaccctaccattcatgtcagtaaacactgcacagccgtgcatatgaccagctagtggatatgaataagtacaaattgcagtggcttcctagccaataatcatgacatgtcattcctacatgttagctgctttcaacatctgtaaatttgatccaacaaagagagggcttagcgaaacaaactataaaatgatttacaatcaaatgttcatttgactgatagctcaactgtagaaaatcagtattgtgttattttgcatatccatcttgatgtttctattttcaatatgggcatgaatagttcctgccagatcaaatcacacactggaaaatataaattctgatttctgaagtgcatgctaatggtcaacagcatcatgcaccaagataccaaaatctgagactgcaggccacacttaaacctctaaatcacaccatcatattcaggcgatcccttagatctaggttgcttatgtagcattttggtttgatatatgtgaatatcaaggacaaaatccatgacacaaattagctcctctttcatcagcaatgcatggaacattcaagcattaaaaagaaatggcatctaagcagaagaggtagaaataaacacaggatatttaaatctgatcatgcaaaaggacaaagattatacacatcaaaatacccacatttcagacacggttttcggacttacaacacctctaagctctagagcggttgctcatactagtaacagtaaaatggtgcctttaagtggcacctgtttttattttttattttttttatgatatccttgcaagttgatgcagagcttggtgaactggcagcatggaataaaccacagcgttaaaagttgattgcttgatgtgcactggagatcagatcaccatatgctgcaaggcccaacctgcattacagaacaaaagaatcacttatttaagcataaatatgaggcttaccagctactaagcaaattctagcattaagcaaggcagtcgatccaattttggtagaaattgtttgtaagagggaaaataaaagacgcttcccatttcatggtgaattggtgatgtccaaacgctctaaatagaataaatatgagaatttgagagaaccttatgtacagtggtgattggttgcctttatatgactgttccgctagggattaaggcgtccttgatcacagtgacaatgccacttttgatgaagtatccatcagtctcccttgaagcttcttggatattgtcgacattgattatctgtacaagcaacagatcatataagattgatcattaattaatgcaataaacattgcacatcattttgttcagttcagtatcaactggtcatctctggaaaagtgagagaaacaatatgtaaatcgatccatatgggttgcctggattttttcagtttgtgcttagtaagtaaataattaaagatccatactcaacaaggcaaaaacccatggcaagaaaagacatatagcatttgaaaagaaagataatttagggggaaaaagtatgatgacatagtagtattttttaatgataaagggctttcaaaccagtgatgcaagatgcacatttgcaaaaggccacctttaacaaaaagcatgagaaagtaccaagtttgtattcaaacaaatatgcttgtccctctcttttctttcaagtaatgaatagttgatcagttaatacagaaggcacacttcatcagattgacaaccaaaagtataaatatatatgaaataccttaacattttctccaatacgagcattcttgtcaattattgcttttctgatgtgtgcattctttccaataccaatgggaatgccaccagtctcagaaagggctttcttgtccgtctccgtctgaacaaaaagcacaattaagttcccacaacaccaatacaccataatatagtatagttttgttttattttacctcataatagtctgcacccattagcagagagtcctctatcactgcgccttcagatatacaggaccggagtccaaccacagaatggttgattgtgcaatgctagccaaaataaagggggaaaggcatgtcaacaaatttagggtctctgttttgaagcaatgaaaaagaaatgttcgactaacaagtaataactcaaggtcctaatatgttatgatctaatactatccacagatcatagaaggaagcgctatgataattcatctgaaaaggatacttactctaataacacaaccttcaccaataacactgtctgtcacatcagcatcaagaacttttgatggaggcaagtatcgaggttgcgtataaattgcggcagaacggtcatagaagctgcacacaataatgtttgctcaaaaataggaagaaaattcagcagaaatgcacccttttaaaagtaacttgttttcaccatgcaaaatgtaaaccttacctaaaatctggcacaggtttcttggttatccccaagttggcattgtagaatgcctctatagtaccaatatcttcccagtaaccatcatataagtaagcttgcacctatcaaatacattagcagcataagcaaacatgcaaagtaaaaattaagtaaagaagtaacatttcacaataaatgatgtaactgcagtttacataccaaacttcacaaaacctacagcatgaactgagagaaggataaaaattccctacatgctacaagtttcaagagcatagcgtaccctcattccaatttctgttgctccaggaataacctcgcttccaaagtcatttgcagcagggaaattttgacggagaagcttaagcatcacatctttgctaaaaacatagattcccatactagcaatgtaaggcaattcctttgccctctcagtatcaaggccaagtatggtagtgtcaacctgcaagatcaaaacatgcagacaatcactgaaatgtatgcttcaacagatcaggttgcatatggtctcaacggatgactcatcaattaccatcattgatttcaacttctctccttttggcttttctgcaaattcaatgatcctcccttcatcatcaatcttcataaggccaaatgctgtagcacgttcttcatccatgggcagcgcagcaacggttatatcagcatttgtttctctgtgggcctgaatgaacttttggtagtccatacggtacaggtgatctccagccaaaatgagaaactccataacattgtgttcctcaaatagccataagtattgtcgcacagcatctgcagtaccctgagacagaaagaaacaaaataaattaggcagcgtccttaaggtattgtcatacagaaaccatataacatgaaagttggtaacctaagagctcatctatcaatgttaactctagtttgcaattccaaagaaatcattggaacatctaaactagtgaacagtttcacttaactataaatgtgagaaaatatggaagagtgaatcaacaggagtacattaaccctaatatttcttttgttccgtaaaacagggtgtatgttcatattaattatgtatccccttcttttctttgtaccctataaagtataaactttaactggcattcatgcatctttgcagctaaacgagaccattcaataatacacagaagcagaaacatccagtacctgcatagtacaaaaattaccacttaccgagtcaattcaaactaatacagtactactataaaaaatttggcaagttaatacagattaaccaagatacctgaaaccagttaggattctctgggctctgctgcgcagcaagaacttcaacaaacccctcgttcttgtaaccaccaatgttgtttccataggccctcgagaggtgacgattgagcgacgcggagttgaactgtgtcaggacatagatcttcgacacattgctgttcagacagttgctgaccgggatatctatgagcctgtaattagcacccaacggcaccgccggcttcgccctcttctttgtcagcggatacagccttgtcccagcaccacctccaaggatgatcccaagaacactctgcaggattaaaaattggatgtaaaaataataatacaaatcatcatcagactatatatagataacagatgaaatgctcttgagttccaagttctgtacttctagttctaccacagaatctaataaattataaactcaaaagtactacaacagatctggagccaattattaaattcaagccatggaccacgatagatcctccactaattaattattatggggttctcactaacaatcacctttccaccgttaaagatatgtcaatatttcatccaacaactaaactagagatactgtcaccatcatctttccaccgtttcttgaatcacagagagtactgaacgcaacagctgatagaatcaccgagaaatcgacaccaaaacactctaaaaaaacaaacacttcgcactcgcaggaatccccacaagaaacatatcaaacacatttcgctcatccaaatgtgtcgagtaaaataaccgcaacacatcgaatcccaagaacgacccttcgattttcccaacccaaaaggatccgaacttttctccctcgtgaacgcaaagaaaaaagcgagcgctggaagagtagaatttttttgggcaccggcggcgagatcgcggcgtaccgtgctggcgtccggatcgaggcacgtctgcgagctccgggagtccgacacggcacgcggcgtgaacacgaacggcctcctcgccgccgccccacgccgccgcctcgccgccgcaagatcgcggccgggatagaatgcggccgccgccctcgccggcgccgggatcggggcccaggacgccgcgcccatcgccatcatcgccatgggagagcaacggccgagagaggtggccggagtactgacacactacagtggagtgtcagaggcttcagcggccgtgaaaagttccctctttttttctctttttttttctttttctttggttgtcccagtgatgatgtgtgcaggtgcagaggacgatttttgtctgaatttatagagcactttctgggcttccacagagatggtactatgtgtgtgtcgaatgaccataatgcccttaagaattttcttggaaaactttgggtgtgtttagaggtgcttttcgcagctgcaacttctcttagaatcttcggttgctaaaaacccttttaaacaatctagatcttgagatgttgtaattttagaatctagaccagctgtttattagaatattaagcgagtgattatggatcaaggatcaatcatgtaggggtatttcggggtttattaggttggagggctgagaatagacaggtgtaatgtcacattgatatcacgtgaagcactagatgttgaaacagagtgagttgtttatcaagtgattaagctgttaattagctagatggatgtatggatgacaggtgtctatgcagtgagagatggtgtgctctcctcaccgttggtttggctatttgttactagtaaactttgtttgttaccagcacaagtaggaaaagaattttgtgtttagtgaattgcatcaagggagatggaaacgtgcttgagtggaccacacaatgtcatcagaattggatctatatatagacaatgacaaatgattgatatgcaaatttcacgtttcggccggtcgccctgaacgagaaataaaagtaaggaaaagtagaaatgatcttgcacggctagcgaatttttgtgctgtgagttaggtgcaatttgtttttgttattagctaatgtgtgacagatgacatgatttgcaatgattgaacataatcaaacatgtttgttggattccatagttgtgaaatagactcgtcggtaactaaccaaaagtttaaaatttaagtatataactttagtcgacatcctttaccattaccaactcgtgttatgaatgataattaactataactattgtcacatgctttctcggaaaacccattcttagatagagcctttccaagatataacatccatataaattttatgttctttgtagcttattttacaaaatcaaccaaataagataagtgacatagccatatgtaatctttaaacgtgttgcatgtatcgattatcttattatcaccatcatgctgacatgtctatagatcacttaaagttacaagaatataatagtcctgagtacactgttgacactagcaccaaaaccgcaatacggtggattttcgctatgctatggatacactcgactatgataactatattattttattacataggagtatatattcctccttgttttttaggtgttagaacttaatgtgccatgaattaatgcataaaaatgattatatctatattattattatatattgaaagttactaatttcactaagtatagatattgcaactatttaggtatccttaaaattattacgcctcttagagcaagtaccatattgaaacaaagagcttaaggagagatatcttgagcgggcgactatactaatcccggttgtacgcaacctccaggaaacggatcgtctactgtacagttaatactgcacaggtgctgtagcgatcaaatcaagctatcagattacattggatggctctgattctgctcaatctgcccaccacttacttgacagttacatggctaaggccatgaaagcttcggactctgtttatacatatgtcatgtgttgttcatcaaacgatatgcctgccatttcacatcttctacaaatatcataagcagagcatcgcctcactgtgaagcctacacttattccaaagtgtaacactaaaaatgttgcatcgttcatttacaccttctacaaaatagtgctatgatgaaaaggtttcaggaagattaaacacaatgctctaatggaaacatgtacaaaggtaacttcatgtgtgcaaatagttcagtactaaacactgacagaaactgacagaagaatgcatagcataaattttctgtggcattgcaaaaaaaaaaaaagaatggatgttctcaaaagtaaatgttcaatggcctgatttgttaatctcaatttgatacctaggcatctagctatctcccatccaaatttgcattgaacccaaaattccaggtagtatcaaatatgttatgctccatgccatcaccctatgtttcatcatacaaaagagcggctccaaaaatgactctctctaaaatggttgaatccaacaaagacaccaaaggacctgtattctttgtttgtcccaaatgttgtgtcaaaagtaacaacatctccaaactgagcatagtcgattatcatcttagcatcagcccaaaaaatatttgttatttgttcttcacaatccaactgaagggcataatgaaatgaagtgttctctgcaactttgtcctgaaagtacttcaacatacttccggcttcgccatacatcaactccctttgacgcttggtttgtaaatggttcttgagaccacgacgtgtataaccaaggtttactgaaccaccaacttgccgactagcaagctcatgtgcagcttttggtccaatgcccgaatcatccattgtttcaatttcaaatgcttgcaatgacgatatctttctttgtgatggcatcaaatggcatgttgaaggcaattaaagttcatggttatgttcaagaactaaatcatatactgaataatcgcccacttctctatctactgtgattccgatccgagctttgcaacctgttcttgtttcagcacgaggacgcttggtgttgtgatctcttttgtctattgcccggtatccctcattggaacaaacatatcttgcagaagtaattactccatcaactttactcttattttcataatttatcctaacatcaaaaccagtatgacctccataataagtccaaaattcccatgcctcttttgtagatttaaatttcacgccaaattgaggaatccaactaggaatcatatttgtgctgtaaaaagaaacagggatcaactctttttttttacaacaaagaaatacagtgttaaatatggattgctatgtggtcattattaagatcctattcagtaatgagatcaacaacatagtcagagaaaagaaaaatgtagatgataaaactatgttgacccctgaatgaaattgatcttacctatttgaattatgatggttggagtttgagtcgttcgccataaggcctcagatttgtatgtatactctgtttagcactacacgagtgtagagtgtatccactccaatcataagaatcccacaacaatgcttttggttttttttgtgaggacatgatcacaaaaagggtacaagacatggcatacatacctgttcgttggagactgatggcttactttatttgatcatcaaagtttctggacagaacaaggcaaagtgaaacctctgtatctccttttggcaccaagtcccaaggaggaagaaagcaaaaggagaacctgtattattttggcgccaagtactctggaggattcgtgattttccctccatcaaggttatcttgacttttcctccttaaaatcagtttgttagtttccaaattatcaaaaatattttcggtgtttaaggacagaatcagagccgcttaatctaatcggatggcttgatttgatcgctacagcacctgtgcagtattagctctacaatagaggatttgtttcccaacctccaagactagatgaagttgttgcaattgtgctagactcttgcttgcgcacaacgattagggttctagatgttcaagatgaatggtgagagtcttggaataaatggggtaggcccaatttaattcaattaaaatctcaagagcccacaagtaatgttagagacaataatactgccttgaaaatttaggtggaagaacctcaacttaaatagggtgatattggagattccctattgaccggttgaggtgatggttggacttccacacacgcgcgcgtgccaagttggcctcggctgtgggcgtggcgaggcgagacggccggccgagccgagcctgcttgttgctctttcattttgtaacagacgagaataaagtcactattaacaaatcaaattcattgtgttgtaacctccaaagcaaatgagagatttatttgttgtaacctccacaacaaatgagagattcattgtgttgtaacatccacaacaaatgagagatttatttgttgtaacctccacaacaaatgagagattcattgtgtggtaatcttcgcaacaaatgagatttattttgtggtaatcttcacaacaaatgagatttatttgtgtggtaatggagatctctctctatatataatgcaaggcagaggctctcaaagatcgagtcttcctcctgctgctgttcctaggcgatactctccttatgttcctgcgttgtctctccatttccccggttctgttcatcccgcacgcacgggtgatcggaacaagcaggtgcctccggaactccgtctgcttgagaacctgcacgggtaggtgggcgatcaagtttttagggagcgctatgcgtgactgcttttgttcgtcttcctctgcatcgtcttcgccaatatgtcgaatatcagcgacaacaataacactggagacaaggagaaggaggcacccatcaacaccaacggaggcaatactacctcaaactccagcggagggccattctcggggtataataatttactattaccgttcgttcttaattttctactactgtcagtcgcaatgttattgggcgttgccttatctatgttggtgcttattttatattaagtacgctcatgttgtacacatctagcactgtcactagatctactcaaattataaatgtcatgtttattgtcttaatattttggattaaaatataccgaattatgaacaaatttccaacagagaggacaacaagctgtctgtgcatgcaaattttggcctgcccaaggagcaaaaagctacaactacataccatagcccactagatgatatgacaaatttttcagccatcaatgtgtcacaccccaatctggtaccgccgtacaacggcacctgacaggagcatgtcatagggaaaacggcgcaaaccgcttcctacgaaaccgcgatctcagtaccagtcccaggacacagcgctggtacccacggtgacaaatatgaatcattgcaatccttaaaataaatagaggacttatttaccttaacttaggttgcaactcagaacagcctgagaatgcaaccgacgacgcggacgaggaaacaccaacaacagcagcagcagcggaaccaatggtctaacacccaacaccacaggcgacggctggggaccaggacgataccctaatcttcacttcacttcatcttcacttcaagacagaggaactatatatatatttatatagagcaagggtgagtactttcgtactcagcaagtcatgggaatttaggtgtttaatgcaagcttggaagagaggcaaggttgttttgcaaatcctttgtttgaaatcatttttgaagtcactaagtgatttatttctttttgagtttggatcgaaaagagacttgcgtctcgatttgacttaagagatacttatcaacaattcaaatggtaatgtaccgacctcccgggtcagatcattacttatcggctcccaaagccatttcacttgattaatcggctcccagagcctttttcattttctcggactcccagagtccagctgcccagcagcacaacaatccgcttctactcaggaagcctagtctatgatgcccgcagacatcccgaatcacacagattcgtttccaaccactcaggtcatccatctgccacataggctaattctggtaacgattcccacaccacaaaaacttttcacaaagcacaggtaatcaaatctacgcaacgggaaccacctcacatctgcccatgaccgtaggcatggctgttcgaacagttagttaacctctgcagaggggtacactttacccacaagacacgaacttaccccagacactagccggtgtcagaagttcgcgacaaagcctttcccaagccgacccagggttacctcatgccacatagaaggatcaaatcctcacataaatataggacattttaggcattcacaaatcaactccaaccaccttgatcggtaagtgagcaagcttctcgtccttgccttaccaggaacccagtttgtccgaccccgccctggcgttcccaactattggcatgcgaggtttccctgaaccgactagttacttagccagggtgtcccattccaccttgtggttgcactttgattatgttcgatgagtttcccacaggaatcggtccttatatgcgaatacaggacagtgccacataggcacaacccccgcatcacgagttttcacaattcattttattttcaaacacaccgacaccacatgtcgggttttcaaggcttctcaaacccatttcccaaatttttgacaaacaacggtgtatgtgggataattggtatacgcgctcagagagcacggataccaaagtaccacaatggtggagcgacaagggatcaaggtatgtcagcctacaggaagtagtgcgactacttggtaggtccgtcggtttagcatgcaaaccgaggccaagcaagttaagtgtgtgattctaataatgcaagttgcaaacaaaataataattatttttcaattataggagcaattgatcaaagggtgacttgccttgctgaaggtcttcactgatcttcacgaatcttcgagaaatccacgatcgacgaaaatccggtaaccgtaactatacgcaaacaatcaaaaacctagacaaaagaccaagaaaaagaccctatttagactaaataatagtgccattaaatagatctcaattttacggaattatgggaagtggaacggagtcaatcgaatgaacggttgagaagatatgaatttcggaagcttaattggaatttctggaataggagaaatggtttatggaatttttggaataaataaatgatctattgaatttatggaaaagagtattcccaagaatattctttaattactcattgatatgtggggccaacaagggggaaagatggacttttgtgtatgagaattgatttggtggagggaggaaatatagactttttaggccgagcgtgaggcacggcccaaaggagattggcccattagggcttgggtggggagagggaggcggtctggtggaccggatccaccgcgtgggggtcctaggacgggggccacttggcggcgacctggttcacggtgggggaggagtgcacgtggggtgcggtgctagggttagtaggctcggctcatgccgcatgcgccggatggaccgggaagaggcgggcccacgcgtcggcggctggcgcaccgtggaccgcgcgcaccgggatgggggagggaggccgacgggttgactcggcctagccgacgtggtgcctacgtggcggctgcgtcgaatggcgagaggaggaagacgaaggccggccggatggacggcgggcggcggcgcgcgtcggcggagcggcgcgaggcacggcggaaggaggggagaccaccggagcgaagatagacgcgagaggaggcgagccaacggctcggatttcgccgggagaggtcaagggcggcggatagcgacggcggcggccggcggcgagcaaaaggggaaatcgtggcggggcgatgagaggtcgattcaaggtggcgagagtatctccggggtgcaaggaattcatttccggtgccggatgggacggaggggccccgagggaggccggcgatgagcggcggctccccggaacgggcggcaata

SEQ ID NO: 83385 - DNA, 18915 bp, Oryza sativa
aaatccacgcagggacgggccgccggatcaaggcggggtggtggcgcccactcctgctcggtgatgagaggagagaaagagagaggagaggagaggaagagagagagaggcgagaataggtaaaaaaattacaatggtgagaaggaaaagagagaggaggaaaaaatatatgtgcaaaagaggagtattttcgcatgcagaccacttaagaggcccgtatatgaaaatttatttttgtacgcagccccttaagtgaaccgcgtgggaaaatatacttatttttgtgtgtagccctttaagtggttcgtctacgaaaatagattttttacatgcgggcctcttaaggagccatgtgcgaaaataaaaatcgatttttgcaggcgtgatcagttacggtccgtctacaatctatagggattattgtatataaaaaatatttctgtagtacagtgtttaaaaagtctaaagcttcaaatcagaaagtccaaatcaacttaaatttgcaatcgcgccatctgagaaagtaaaacaggtccatcagaatcatgcaaaataaatgctttggaacctgtctcaacaacaacggaacattgcttctttggttgggtagccgatcgatcggcgtacggcaggagcaccaaatagcccaaaagcgttaacctgcacttagcattttcacaaattaggtgtccacatcgacggccgtaccaccatatatatagagagacaaaggcatgacggctaccttgcctcttctagcagtaaaaattcgttcagggagaagcaaaaaaaaatactatcaatgtataagcacgtaggagtacatactgttcagcatttcagttgcatctaaaatttaaatttcaaatctctcttagagttatttccgatattttgtcattgtacattattttttagttaaccttactgtcctaattagcaaggtatcgagagatattatatttttcagtgcaaaacttggtatctccaagtcttggatagcttgatttaccaaaattttaagtgtaaaattttagtatgtacacgtacaatctcaaaaatcatgaaaaaaaaattcttattcttttatattgacctttaagctgtgtttgaggtgagatgagaacagaagattgattgagatgagatgagaacaggagattgagaagatacgtaaaacgaggtaggccattagcacatgattaattcagtattaactattttaaatttcaaaaatggattcatatgatttttaaagaaatttttttattgaatttttttttaaaaaaaatacaccgtttagtagttcaggaagcgtgcgtatgaaaaacaaaacaaactcacaatctcccaccgctgaactgagcctactaagaacatatatataaaagtttacgcataattttatttctaataagcggttacgggttataattagctgtaggttacggcttatatataatactacctccgtcctaaaatataataacttttggctatgaatcagctaaaaatatttatattttgggacagaggtagtatatatttaatcacatgtgggcaaaataatactagtagtaagattgtgataactgaatcttaaattcaaattaactagtaattgcttcgtatgatgtgagtttcagactgatcagaacttcagaaccgatgcttctgattaaagatgcggacgcacaagtagtaggagtactttctttcactgaaacctgattctggagatgtaccaacttgtacttgcacattaaaataacgagagttgttagcatttctgtatttacttcagcttgtcacctgcagctgcaggcaagtggcttcttagcagtaatggccacatcggtatccatgtgaccagcatccatagctagagagcttaattaccaagctttatactagtacttaagaaaatcacgggattggcttaatcaccttaatgacatggttcagtggctcaagctggtggccgtctcatgaacacgtagagatacaactaaggaagaatcgcaagctttctctttctgttttcttttcttttttatttgacatcgatcgattcttcgtgcttaaactgtagacgaacaatctgcaccactaactctaagaaccttttatatagctttttttttcaaaaaaaaaagtccaattctcacaaaattcatatgaaattcctctgttccaggaggccatagattccccacaacattatatatgatcgatcaattaatcaatttatcaacccatcatcactgatcggcaagaactctgcaactaattaacatctcgatcgatccaagtactgatcaggtgatacatacatggattgatcaaaactaatggtatctctctaaaggcagatcgatggatcgatcgatcgaaccatacaataatggtggattaataatcgattcttgctttgctttcttcgtcgtcgtcgtcgtcgtcgtaattgagccgtgtgcatggtggttgtagcttgtagtatacttaggtgtgtgatgctgatgagctcggcgttcttgctaggtagctagaggctgtggtggctatcgatcgatcatgccgccgccaccgtgccgccgctggtggtggtcttgctggagcggcggcggccgttgggcggcgccggcgcctccttcttcatggacgtcaccccgcacttgtcctgccactcctcctgcgtcatgtgctgctgcctgcactccaggctgcagaacgccgcctctcccctgcgaagcacacagtgcgtgcgttagccgggcgccatggatgaattcatggaggaacaagaagaggaggaggtgttcgtacttgtacatgaaggtgtcgcggccggggccgaggcggcggcggcagaggccgcaggagcggaggaacgaggcggtctcgacggagcagtagtcggcggagttccgcctcagccccgccctcgccggcgcggcgcgcgcgcggtacgccgccagccagtcctgcccaggcgcgcctcctcctcctcctccgccgccgccttcgcggccgaacgacgccagccagtcctgcgccccgtctccgccgccgccgccgggctggcccaccatcatcatggcctcgagatcctcaccctcctcctccaccaccgccgccagcacgtccggcggcgagaactccgtcatgctcgtcgtccgcctcatcgggttattcttgctccctcccctccccctcttgcccaccatcatcaccaccacgcaggcgagcagccagaacgcagagagacggcctcctcctcctccttctccgacgacgacgacgaggcggcggccggcgacggcgagcgtgcgggcgcgcggcgagcgtgtgtggaggagaggatctgggaggagggggtggagataaaagaagcgggagggggaatctgggccgtcggatcgggatcccgcgatccgtcggatccacgtcagcgcggggggctcggctctgcactgattgttcgttctctcgagccaattgtgtttcttttgttcgcgactgatgattgcgtttttgttcgcatcttggctcggtcggggagctgtcgatgcggaatttatttaaatttttattttaaatttattggttggttttgtattatatattggtagtggcactaccaacatttactagtgtgattgggatatctcataaatggggagaaaatttgtgtgattgagcagctcgatgcatgaaagctgagtctggtgtggggttctttgtgcgtcacataccagttgtcatgtatgtgcaaccaaacttaattattagggctccttaagatttttggaattttaaagggaattgaaggattttaattcttcgaaaaaaattcatgttagcttctttggaacaaaggaatatatggtctgtttggcttgctgtcttgctatgccgcagccaactgcagcagcaagcagcaaaaccgtgcataacgtgcagcgtaactatagcaatagctatggaacgtgcctctaaaattcataagtttgtttcataaaaaccattcaatgcgctaaataaatatttctatgttttcaaatcctataggaataaggtggagtaaaaaatatattcttgtgtgttttttaatcattgctccaaagaagctgttaattttttttatggacacagtacaaacgtaaatgctaacaacgtgcgcatactcaccacaataaatgtagcatatcttgagattgatgaagttcacacttttacaccctaccctatggacacctccgaaaaactaggctagagattgatgaagccatcatggatggttcgctgttgataggaatatcgtttatcactaaaagaataactagtcgtagatgtaagcatccgcttcaaatctattacttgaaacagggtgagtaagttccaccacaagaaaccaaagtctaaccagttaaactacacatgagtttaacttgccaaaaagtcatttgtcacagtatgcctaactaccaagatgataggaaaataatttactcctcggatctcacaggtcccttcaatcatataaatgcttggtgccttttctttaaaacaaatatttagccaaaattaccaaaactcgagcttctcctcttattttctgaaagatcacatttggtcgtgtaggtttgtgtacatgaaagatgacaatattactaaaattttagcatgatttcttatgtatttatcaaatttggcaacaaactaaacgtagccattttttttacaacttttaaaaaaatggtatggttaaaaatggcatcaaagtgaactagcctttaattgctcaagtgattttcaagaacttttgtttaggtttaagtctgttggattaagtttttaagttagctttcttggttaagtacctaacttttggtttaacagcataatattatattatagctttaaaaacatatgaaaaagttaattatttttaggcttaggtttttaagttttttttttgcctatatgatttataagctaatggatttaaagttctaagtttaatggtgaagttataactctacctcacttaagaaaaaaaaagtttctccaaatagtgtaagagtggcttatgactttaaaaaagtgaaatggaaaagctacttgtttatgtatggttagacttttcgactcataagctagcttataaatctaaataaagatgaccttagactttttttgttgagaagtcagcttataagtctaaacaaataggacctcggcattgttattgttagtatgctaatattccctcagacgcttttcctataatataggaacattataggaacttaagattaaatttgatacggtatatcataggtttgtttagaatcgttgtagtataaagtatttcatacgatttataagttgtgatattatatgatggagggagtactaattaatttcataatcatgattcaatttgtgattctttgatatattttggtgggaagagattctgctaaatgttttacacccttagaaatctcaatgaggtctgttttttctgtaaaaacgaaatgcaaatatcgtgcttggctgtttggagcgttcacaacgacgttgtgtcactcataagtgaagtgcaataatgaagtgacaggtattatattgcttataaaatatttttgcgcacgaaggacctgttcactttggtgccattttcaaccataccattttgttttaaagttgtcaaaaaaaaaagggctacgtttagtttgttgcaaaatttggtaaatatataagaaatcatgccaaaattttaataatattatcatcttgtcaaatttagtaaagtttattttggctacgatctgatccggtcctaaaagccacggcataataaagcgcccccagggaatcgggatagtgggcccggcctgagctggacgacttggaccggtagaatgtcgtgggccacgcgtggggaaaggtcggcctccagcgcccacccaaatcgcttgccgcacgcggccctcgcgcacacgcgggtttcactgggcccacgcgtcagccggtgtgggtgggccgtggggtatcgtacggtggtcagctcggccgctgtagcgtcgtcggttttgggaaggcaggacgaacaggaacagcgagagtggggcccacctgacgccgagggtcccacacgtggcgggcggttataggtgggattcctctgggcccacctccccttgtgcttttgctggattctctgtggaaaatgccagtactacagtattgtaaggtgggccgtctcgcttggtgggcctgtcgagcaggcccagcccaacgcccttgcaggatagggccactttcgataggcccaacgctaaaagcccaataggacacttggccccgctcggttccaccacccaccgtcgcgattcctccgcgactcctccgccgcgccggcaatgagcgaccccggtcaccaccacgggccacggcggcattgtaatgctgaaaaatccgcagaaattttgccagaggaaggatttgaatcttgcattgctctcgttatgcgtagaaaacataaaagcctcatccgttacgacaacgcaaaccaaatttcggtttcgttgaagcctgaacttctaggatcattggtgggttgagagtcgtttcagcagagatcgccattggactggtgctgcatctttctcaagctcttacagctatgccttttctttttcctccagcacatgcaaaagcttcgtcggtatattagaaagaaaacaaccgagaatggttctgacaggagctcggcaatgcttctgtgatcgctaactttagcaacctcttatatatctatatatctagcatatttctctaacatgttacccttggttcatttgtccatggaacctgaacatgttggtgaatggtgattacaatcatacggattgagtgaacttgtgtcagatttgaggctagcttagggtaacctgttgttagttgatgcatatctgcattacttttttaagtttcttcattgtttgagataattgatatgttctcggaatacctcggttctaaatatttgtcactatttactgttcatctccaatgtaaaaccatggagattctatattgctatgccgtttccaaaaaggaaagaaaaaaaaagagagagagaagaattgggagatgctacttggagtgcaagcaggaaaggggatcattcaacattgtcctgtcatctccctgctcatgcctaatgtcacaacagtcgatcgtaatatgggatttcttacagctcgttcatccatccatctagaaaccatcgagtatatctaccgcaacaattagaaaagaaaattttcccctgcttgtgagccattgtagctttggtcacattatttgactcttatttgccctcgaatgctataccaggaggttcagttcagaagtcatcctcattttatcactgtaattggggtatcttgagttcttaatccattttagagtacagatttgtgatccaatttagatgtacacgtgctttagtaaaaaaaaaacagaagcaggtaggaggaggcaacaccgcaacaggtagcagaacagatcacacaacaaaacatccacgaattgcaagctgggaattcagaccgtgacgcaggccgtgacgccgccgctgcggtcaaggatgagagaacaatctggaactgcaagcacacaccaaaattaagtactaaaattcttgactgccggagagatagggtgagtgcgtttggtaatcgtgtgtgcacgtttgatgaagcatatcatatccttgtcgaaaagaacaaagaaaattaaggaagcacccgcctactctgtattagcggacgcaatatcacagcaagaaacaatctgtatgtaaattttctcctagcaggtaaaaaactgatactcgctccgtccctaaatatttaacgctatttattttttaaacatgtttgatcgttcgtcttattcaaaaaatttaagtaattattaattattttcctatcatttgattcattattaaatatactactactactcaagtttttaataatattcacaaaagtttttgaataagacgaacggttaaacatatttacaaaagtaaacggcgttaaatatttagggacggagggagtacatgacttacttatcttttgctaggaatagagagtaggcagaaaatatataatgtaaatcatagcgtgaatttaaaaactatagtaggtttttttttaaagaaaaattgagaaattcccaagggtcttccggctagctccacaagatggtgggctagatgacctaggttcaaagcctcaccccttctaattatttgatattaggtcattccctaatattcgagttttttttaaagaaaaatcatctgtgatttattcatgtagtaccttatagtgacgtagataaatcttaaaattttattttcttattattctacgatagttgtaaagtttgcaacaaatatttttcccaccattgcatataggtaataatcacttcatgaggtgttaaattctggctattatccttggtgtaaaataattttggaagcacatagtatgtgttatgtacattttgtattgcctcgaaccatctagtacaacatcctaacaaaaaaatatataacgaattttagttatgcatttgtattgtcaaaatccaaatgcatatatgtatatgccaaaataggccacacccatgaaccaggaagcctctttttggaataatcaacggactcataacagtcactgctgacgtaagccacacacatctccatcgcctataaaagctcacctgaacaacctccaaatcacacacaaaacgcagaagcagctagcttcactgatccacattactaccagcttcttcttccaatcttcttctccgacgagcagctagccagctagcggcgccggccggcaatggcggacgaggtggtgctcctggacttgtgggtgagcccgttcgggcagcgttgccggatcgcgcttgcggagaagggcgtggagtacgagtacagcgagcagagcctcgccgacaagagcgacctcctcctccgctccaaccccgtccacaagaaggtccccgtcctcctccacgccggccgccccgtctgcgagtccctcgtcatcctcgagtacatcgacgagacatggccgccggagccggagaagaagaaggagtcgccgcgtctcctccccagcgacccctacgcccgcgcgcgtgccaggttctgggcggactacgtcgacaagaagctgttcgactgccagacacgcctctggaagctcagggccggcgacgccgcgcacgagcaggccaagagggacatggcggaggcgctggggacgctggaggcggagctcggggagggggactacttcggcggcgaggcgttcggctacctcgacgtcgtgctcgtgccgttcgtggcgtggttccacgcctacgagaggctcgcgggattcgccgtggcggagatctgcccgcggctggtggcgtggggggaacgatgcaaggggagggacagcgtcgccaagacgcttactgatcctgagaaggtgtacgagttcgcgctctacctcaaggccaagtttggcgccaagtagagtgagaattccagatttggtttggttaacaatcgcagcgtatgatctatatctattgttactgtatttggttatcgcgttgtgattttgctcctacctatcacctgtatgtatgtgcttgagcttcacgaataaattagaaagtgcagttgtgtactcgtgtgtttgaattgcgcgctctgtttgtccataatcaaaacaatttaatgtacttgtttttatgggtcgtcgtcgaatcgatctgttgtacgaaacgaagggatatgcccggagaatgaaatgcaggggtgactgcagcacgtgcgacacctcgtcctcagtcctctcgtgaggtaggactttcggggtatcaagggtagcctagcccattacatgaagcccactaagccgatgtgtgcatcgggcagacgagtttgggctgtgtcaacctgaccatgggccgcacgtgcgttacgttcttattccgaaggaaaaagaacacccgaggtccctcaacttgtcatcaagatacaaaatcatcctcaaaccgtaaaaccagatatcccacgtctcttaactaatcaaaaccggttacaaaagatccctcagcggttttgataccggtttggtcctacgtggctgctgggtcagcgtgggacccacgtggaccccacatgtcagggtaatccacgtcatcaccctccctttttctcctcttctctctttcggggagaggcaaagcggcgggtgcagggccagaggccagcaggagaggcgggagagaggagggcgatggcggccggcgcccagtggtgggggctgcagcgggaaacacggcaacgcggcagccccgacggcgatgtcatcgactgcgcgccgatgcacctgtagccatccggttcgggatgaagcatccacgcgccgccggcgtcatccgctgcgactccaccaacgacggtcgcgaatcctcttgctcgcgcatgccgaggcggcctctgtgcgagcgcgttcggctgcccctagcgagcggtgttagcctctgcttcgcggcggccgcgccagaggccgtggacgtcccgcggctggtgctccacttcgacagctctgtgtcatggagtagcagagctcgagcacgggggcagtaccgtagagctcggggattacgtcgtagcggaactcgaacccgagatccacgcaccccttcaactcctccaggttgtcgtcgacttgtcggtcaagctccacgcgtgccgccgccgccgccattgttcccgctcctcgccgtacatgcaccgccgccgaaaacgacgatgccgtagggctcctccttggccaccaccaccggcttcgtccgccgtggccacgccgcctcccactataccccgcaccacacgtcctcggcctcgacctcaggcgccgctgccgctccgcccaccccttcgctccgcccgtggcctgctgtcgtcgtcgccacggtgctctgccagtccttccgcggctccaacacctcccgtttctcccgcctccccttctcgagctccatagccccacagatctcagcggcgagctgtgcccagcggcgagaggaccatcgccgcggccgtgcaaatccggcagctgagcggcgagatccatacggtggcggaggaggaggaggagaccgggagattggccgcggcacgccgctcctctcccgcgagccgctgcgcgccgctcctcttccataggccgccgcgtgccgctgcctcctcgcaggtgaagactcggaggtaatagaggtagagaatggagaggtggacaccgccgccttgccgctcctgctcgcccgttgccatcctcgtcgcaccgtttccctatccaccacgtcgcgccgctttcccatccgccaccccactgcacggcgccgcccctccgctggttgctacctgtctcctcctccccgtgcctctgccgccgcccaactccaaggcctcccccactggcgtcgcggccctcgcacggccgccgaggagctcggccgggttgccgccgccggccgccgtcgcggcgccgccctcctctcccgcctcggcccgccgaccggccttaggctttcaagcacacggagaacgaaatgagtaaccgaggaagagaagagggggagagtgactcagcctgataagtggggcccacgtgggtcccatgctgactccgctgccacgtaggacaaaatcggggtcaaaaccaccgaatgaactattgtgaccggttttgattagttaagggatgccggatatctggttttgcggtttggggatgattttgtaactcgatgataagttgagggaccttcggtgtacttttcctattctgaaatagcgggcccataagcctctctgtttagaccaactcgtggaaagaaaaagtccacttttccccccaagtaccgcaagctgagacatgacgcgaaaatccgcagattactctttatttaacatataagtagattcgcgggttggccgcttgcatccatactgacacgtgggcccacgtattttgttttatttttaaaattgttaaattttgcttcatatgccacagaattgccacgtcagatgaaaaccgagtcaaattagccacataggggccacgtcagctaaaactgccgtccaaactgtcctagaatttattttgcaccggttttgacagttgagggatcccttgtatgtggttttccggttgaaggactaagatcggatttgttaataagttaagggacataagatgaacttattcctttcctgcccgacttatttgcagaaactgcatgagatcgagcccatagatagttagttgtccattaggcccatgtctaggaatcctgcttatgagtttaataaaggaagaactgtatttgcctccctcaactacacgtcgagatcgattcgtatccctgaaccacaaaaccggttacaggtcttcctcaactgttaaaatcagataaaatccctaactagttctgacggcggttttcctttaatttcttgagaggaaagatagagtaggagatatagaacaaaaaccctcaactaatttgagattatctccacgggtttggttaaatcggacgcgggattagggtggcgtcgggtgtaggctggctctagctcggctggagctcgaagaagttactgtagcgacattctgggacttcttttcctaggcccgattgaaggaggacgcaaactggactttaacggagaaagaaacaggaaacagagaagagactaagggaaggagtctggacttttccatattcagcccaaacctgaaagtgaggattttgattccttttttcaattaaataattgctgaaatgatcttttatttattgtgtgttcatgtttccaaaccccagctgtatcccatctgtgttggcacgaagaaaacagttcggtttgctggccggtatgagatcatgacttggataaatctaattctaattataaagatagagcttatatttgataaatctacatcattatatttaaatatggaccaaaactttttctagatcccctatgatcaacggtgtattttttctttcaattaatgtgttgatttctaagccacaaatatgaataaatatttctttattactgtaataaaataatttataaatatatggaaaaaaacatatatgcggtgcttctacacggaaagaaaacatatgtaacaccaggttatgaaaaataatgtcattttaaagttatttaatattttgtgtacttttattttttttctttttcgttgcaacgtacaggtaatttttaccgtagatatatatatactcggtgtattttgagatttagacagtaaaggattttcaaaaacgaatctggaggaagggatacgctagttaattaaatgtttacatataagtcttatattataaaacatcgaaaacgatagtacacactggtggagaaactatctttggtcgatcggcctaaatccacaatagtcccggttcgactaaaaaccgggactgaaaatctttagtcccggttcaaaagacggcaggtggtgtcagacccctcctttatctttagtcccggttggtgacgccaaccgggactaaagatatatttttagttcgggttggtgttaccaaacgggaaaaaagatcgacatgcgccgcgcgagatcgagaggaccgaagctcacgggaggatcagttaataagttttgacatttatctcctcctcttctcactcaccccatctcttcttctacctcctttggatctgcccctcccctctcctccccacttctcaggtggtggcggcagccgggcggccgcggaggcagcctcgcgcggccgggcggcgcggaggcgaaggcagcctcacgcgccctcatgtggtggccgggcggcgaggcacagcgcgtggcgtgggcggcggggccgcgcacggggcggcagcgcgccggttctcctctttttttttataatttgtgattgagagatgtataatttcttttttagaatttgtgattcattgcatggatctgagatgtataatcgatctgtgatgcatttgatttgtgtgtatttttttaagatttatgatgtatttgatttgtgtgtaagtaacttaggatttgtatttgtgatgtgaatgatttgtgatgttactttgatttggggatttggggtttgatttaggtatatgcatgacactcgatttggggtttgttgtttgatctgggtataataaaaagaaaatggaccaaccgggactgcccctatcctctcttatcctctctttagtcccggttggtagcattaaccgggactaaagagttagtccgggttggtgttaccaaccgggactaaaaattgatttttactcccggttatttcatccggggtcctggaatcgtaaccgggactacagggggttataaaccgggagtaaagatggtttctccatagtgacagtatattttgaaattgagagggcgtagcttattttcgatgacagtaaccggctgtttgttcgtcgatcgaggatcgttgtcgtgctttgtgggctcgttcctgtcgtccatcatctagaaggacggcgtcgtctgtttttttcaagggaacggcacttaattggtctatcgatttttagcgtacacgtgaacatagatccaaataaacgggcaatggacataggacttgctcccgaagaggccaaacaccgtctactggttcggatcgatatctcgcctggtattgcctcgtcagacggctgaaccacactatctacaaaatcggtatttttctcaaacggacggtacaaccacgcacgaaaatcgattccacgaatggtcaagttaagccacccgcgtgcaaaacaaaataataaaaaaaaaatcctagctcccatctatactaccgcaatccgtcacaatcatcatcaatgcagtccgccactgccgttgtcatcgtcgccgctgccggagtccactgttgttgtcgttgtcatcgctgagactccacctcacgtcctcacctgaggctggcggcggtggatccgccctagcctcccggggtcgaggccaccggatcccggaaaggatatttatctatcgatcacgtgcgggatcggaccgcgatcagatcgaagtcccataatcccgcgcgatcagcccccctatactcctccctcttctcccccttcctcctccccttcttctctttctactacagtacaccataatttttttaaaaaaaaacaaaagttagagaaaatttatgtatagaaatactatatataaaaaatttgaattcaaattcaaatttgaatcgggtatgtaaacttttgacttataaactttgggtctataaactttaggtgtataaactttagatgtatagaaatactatatatagaaaatatttgaattcaaattcaaatttgaatcagatataattcaaattcaaatttgaatcgggtatgtaaacttttgacttataaacttaggtccataaactttaggtgtataaaatttagatgtatagaaatactatatataaaaaatatcaaattcaaatttgaatcagatatataaacttttgacttataaacttttggtctctaaactttagatgtgtaaatttgaggtgtataaactttaggtgtataaatttactaaaataagaaagtaatgcagtgccaaaaaagaaaactaggtggagggagggggggggggcgaatctgatcgctacccccattgccagggcgatcgatcgcccattagaagcctccactggatccaccaccgcgtggcttgccgctgttgtgatcgtcgctggcattgaggcccgctgcacccgaggccaatgggcggcgggatccacccctcttggctctagggccaccggattagcagttgcgcggcttgcctttgtcatcgtcgctgctgctgaggcccactaaaccctacatcgactcgattgatctgttgccgcgcggtttgctagcatcattgtaatcttcgcgtgctcctttgaaggcaaactgccgccctcttgccgtccgctaaccacttgcggagaccgccattcccgtcgccacgctagccacaggctcgcttgcacgttcgtgatgaaggagagaagaggagacaggggagaagaggaatgatgagatggggagtaggggatgaatgaggaaagacttaattaatgggtaaaggagaggggatggctaatgtaaaatggataggtgggtctctttctaatctgtttacagacggatttttttttacttcgccaacgaaaaataatagcttggtcgcaaaaattgtttttttatagtgtgactggattattatggctggtttgatcgcgactgacaatgactcaattttggtttaccttatcatgtatacgcgcttgatcggtggactattaatggtaaagccaaaggattaggtgatcacacaaagtattttatactgaacgaattgaagacttaagtcatgattctctccagtcatttatgtgttcctctcatctgtatatgactccacacctgtatatatgcagcgggcctgttatgtagtatagatactaactcacatcatgcaatgcatgcatgtacttgttagctcaactaattgcacaatgtatcgccagactcgctacctccacgtacccatatatatatatatggccatatgcatgcaatggacatgactgtcacgttacacccttgcacacctagatgactatattgctctttattgcttactttgagtcgatgactttagatgagtcaaatacaaattccatttcatgcactatcgacttgtcactgtggttgaaatcgggttggatacgtattctcgtatttatagcccatattttcttcaaattcgaaaatggcgcgggtaggagagaaaaatggatatccggaatcctagttcgaatttaaatctgaaaaaaaaaggttaggataccgaaaaaattatatccttctctatgtcctatactccctccattccaaaatataagacacaaccatctttaacccaaagactaagaaataattattattatcttatagtttggatcctttaataaatatgtattgcatgcatccaatagaattagagaatgtgagagtgaaggatttaaaaaagtaataatttaatggagaagatgtcataattaattgcatgtatgcattcatgtattatattatggaacatcttaaaaaaatggttgtacattatattatagaatggagggagtattatcaaacatatatgaaaaatactatgaaattaatctacaaacataataaaagattgattaatcactgttttacgagctcacaagtaatattgcataaatttttacttgatgtattttttaacactaaaattgcctccctagatttaatatttatgaattagatatacaaataaatatccgtttctgaatccaattctgaggaaaaactatataaatagagaataggatacgagatgagtgatatgtagtactattcatacccgcgcctgggggtgaaataggatatgtatttctaaccgcccaacccagggcctgtggaaaggttagattattacctcacgcttagctgtcatgattttaggatttaacttattgtgaaaattatataataagtactccctccgtcccagaatatagggagttttggagttggacacggttattaagaaagtatgtagaattaaatagaaaggggttgtgattggttaagaagtggaggtaggtgggaatagtgaatggtggaggattgtgattggttgtgaatagaatattgagagagaagttgttatattttggaacaaatcctaagtgttaaaagttgttatattttaggacggaggaagtaactattttttaagtctagtttttgagtgacaattggaaagggagacttgcagattgaaaagcatgcatgcatcctgtcttcgctgaaactatagtccacctttttatttgctgcatcaattcaaaaatatggtaaagccgcgtgcatattattgtgtgtttatccactaatcactattgtcttattcccttgcaaacaaaccaagtcaagacctctatatcaaaccaccgacttaatttttcttgaggatagtacgtcacacaaggagcttaactagaataaatggtactcctccatctgaaaataagttcatttataggtttctgtatccaaaacttgattgtccgtcttatttaaattttttttatgattagtatttttattgttgttagatgataaaacttgaatagtactttatgagtgacttttttttataaatttttcaaataagatggatagtcaaatgttggatacaaaactcacaaattaacttactacctccgtcccaaaataagtgcaaccgtggatatccatgtctaatttttgaccgtttatcttatttgaaaatttatcaattttttttaaaaaaatagtcacatataaagtattattaatgttttaccatctaataaaaaaataataatcataaaaaaatttaaataagacaaacagtcaaacgttggacaatgcaaaactgcacttattttagaacgaaggaagtactctacaccaggcctataaataggggcaacgtcctcctcggctcctcatccctctccaagtgatctccagagtgcagacaggacatagcggtattgcaatagagctggtcggtcagttagccaccatggctcgtcgatcaaacccagcactgatcagtacccttt

SEQ ID NO: 83386 - DNA, 5648 bp, Oryza sativa
tatatatatatatatatatatatatatatatatatatatatatatatatatatatatatatatatatatatatatatatatatatatataacccatccagcaaccgggccatgcaactaaaaaaaagggcaactcacgtggctgagccatctttagtcccggttggtaccgggactaaagatcgatctttagtcccggttatttcacccgggactaaagatagcgatctttatttccggattggtagtcccggttttcaagggactacatgggggttaccagccgggactaataagggtttccccaccagtgagaggatggaagaaccgaagaagacggtgttgggtgtttagggtccatggatgacagacgaaggcagcgtttaattacccgtccctaggcttccttgtgtccgttggttccagcttgaacggactagattgaatcacagaaaatcttagtactctcgtgaggtagaataaaagggcttttggatatcacggcaaacctagtctgtatatatcctcagacaattcacatgtacctagcacattacagaagctgaaggcatcttttcgtatcggtctgacaatttttgactgcgttaatctaggctgcacggtggtggtaatcccgttcggtgaagtccattttgcgtacctcaactatagaatgagtttaattcatagcccttgacaataaaatcaagtataaaaactctcaaccttttaaaccgatgtaaatcaacttatccattaaccaccacctacctgcttattcgtacctatggcagctggagcgtcgagcttagtttggaggacaggttttgcgagctacgccacctctctctctctgtgtgtgtgtgtgtgtgtttctcttcagatttagggagtcatagcaatctccttgagctcagccaccagctaccttgtcaagctcttctcgagctcagttgctaccttacgcccaaccagatctcgccaatgttcagccagggtctttgcctagtcaggctcgtgcttgccgtggcggttaagtcggtgtccactgtccttgacaaaggtggtgcggtgggatgcgtctctagaggggcttgtcgtctaagccaggtacgcagacgcgcgcggctggagaggaatggtgataaaagggtgagggagaaaatgggatgggaggagagagattatgacatgtgggccttacgttttgttttaataaatgacttacatgtggatttcatatgtagtttttattttttttaatgctaaaatatcatatgagtgccatgtcacatgaaaaacaggtcaaagccccacttacaacgaaaccatcatcaaaatcgcccaagaatgtaaattgggttgtttcgaacagttgagggaatttttatatcttgttttacggtggaagtatatgaatcaaactccgataatattttgaaggacacggaatagactttttgcatcctgttccaaaacaacggcccataacgcttctgaaatttgttttgttcggacaatctgtggaaattgcacgtctccagtccagtctcccaggctctcccaccctattgctctacgggttgcgaccatgtcgatacggcggcgggccagctgtgaggtttgaattagtagcttgtactcctggtagtgcaatttgcgagattgcttccaaagcaatatttaatgtttctcatatattctctccgttctactatgttataagatgttttgatcttcttcaatctttgtctagatttactaacgctcgtatgaatttagacacatatataaaatatatacatgtgtctaaatgagaaacattgggaagtagtaatttgaataagatattaatctattcaaaatctaaaatatcttataaaaaatataaaatttggttattctttgaccattctgtaaagaggactgaactgatgatgtcgcaggagttagcaacatgcttgggtttatctttgccgtgatcagattttccgaataaattttaattgggagaaggttacatcaacatcaggaaagctagctttctcctttggttttattctctgaccatcctgtatggttgaacagataacatatgtcgcgatcttgcgtttcttatcctaggctgtgtttagttcacatcaaaattaaaagtttggttgaaattgaaacgatgtgatagaaaagttgaaagtttgtgtatgaaggaaagttttaatgtgatgaaaaagttgtaagtttgaaaaaaagctttagaactaaacaggaccctggtatctgtctatctgaccacgtcctgtgattgaactgatgggtgtcgcaatctttgcctggatttctcttgtcttgtcgtgatctttgccgaatacatcaaggaggtttcttgtgcccactcaaactaatctggtgatgtctcaatctttgcctctctctttttttttatctcatgtcatggtcaggaaaagttgaaagattacacgaggagagcgcgtgtgaatcatgacggcaaggtcgtcgagcctgatgtgccggccacagtgtcgccgtcgcaccagctcgaccgacacgatcagcacgaacattcacgtaccggaacgtcatcagccagtagattgaccgtgccgccccggtagatatatatactccatatactagtacgtctattttacaagttgtaggtggacgacgacggaccgtccgccgagcattcatgccctgcacgcacaaaagtgcacaacgcgtttcgcagagtatggcgtcgccccgccccgcgagtcgctcaacggcatgacctcggtggccgtgcgtcggaggggacataccctaatagcaagtttaatagtatagccaagtactgctagcttcaatttatctatagccaatctaatagttcattcatacaatagttacataccacattattaatatctggtctcacctgtcatacacactgtgtcttggagtccgtgctacagctggctataaatctgtaacccacttctcttctctctccttatttatctccttaaaatatgtttatagctagcttatagcctgctattgtacctataaatcagctataaccacatatcgagaagaaaaaagaagagagagaagaaagctggctacagatttgtagtcagctgcaatatgggctccaagacgttatgtgtgtatgacaggtgggaccaggtattaatggtgtagtatatttttatagttaactattgtatgaatggactattagattagttatagatgatttggagcccgtacttggctatactattaaacttgctctaagagcaggttttaattggaggtgatcaagagaccgtacgtatagcagttggctattggcacgaactccaatcaattgatccacatttttctaacttagctttcacacacagatgctctcacatggaccccacaaccatgtttctacttgcttgtgttgtccgtctcacctaggcgtgtgtttggagccgacggcaaattaattgccggcgtacataatctctccacttagagcaaggttaatagtatcacttaccgtacgtgagctataattttatccacgtcacttatagccaacagagtagttaacctgtataataaacaggctccaacattagctaatgcaaacaatatttatttcttgttcatctggttctctcttttatccatgtcacttatagccaacagagtagttaacctgtacaataaacaggctccaacattagctaatgcaaacaatatttatttcttgttcatctggttctctctctcttcttgtttcctctgatttgtctgtgagcctatcaccatcttgggactcgtgtgtagctgggcgactatttagtcgcccactcacattctctctcatacgtttactccgccagcacatcgttgcagtttacgtggttgttttatcgccggtgtagcgcctcctattacacctgctcttatttctcttccagctcatcacttcttcttgcatgcatgcactaccgtcggcttaaactgtctactatacgcgcgcgtggaacaaccgatggttggacctactctcgcacggcgtcatgtccatcaaacctccaggcgtgcgggcgggaacaactaaccacttccctttcgggcgctctcggctcgtttgatggactacggccggcttgacgacgaacggctataaactgcgcgtgccactgccccccgtccatcccccgtccatccagcatcacgcacgcaccgaacgcacgcattcacgtacgcgcgcgggccatggcgtacgtgctgcatgcagtggcatcgatcgccacatacttcatgcgatcgcgagctcgcgtaatcacgtgtccgcctggtgtatgtccctctcgacgatggctactgggccaaaggagacgaatatatatattcggggatcgaccgcggaggggtgcgccatatcgatcacgtatacgtacgcgcgcgtgttccatcctgctccgcacgcgttcgcggagtttcctaattcgttttccttctacccgcgcgagatggtcaaaattttcgactcgtgcattacacatttctggtatgcgtacacactggatgaatagacgaaatatttttaaactaattaatggaggttataggagtataaatgcgtgatacaccgctaaaataacaaatgaatcggatggttttgaaacaaacatgtaatactacatataccacacctggtagaaacaaaaaatcaccaagttcgcggttacaaaaatcatctgctggataggacaaaattggagcgctcataattttactgcaagaaaccagcaaccaccgcggcaatcagagccgtcggatctccaaggatggtgccgatgatgatacgtattgccgtcccagcaatcctgcacaggcgctggagccaatgctcgtcacccctggtggtggtggttctctgcaccgctcctcgaggaacccgaaccaccaacgcgtccgccggctgctggcccgccgacgactcctcgtcgccggcggcgctgccgtcctgcggccggaggtacgcgagcaccgactcgcgcgcggccatcttcttcaggcacgacacgttcagcgtgacgttcccggacccggagcggtagacccagtagtcgctccgctcgccgcagcagtcgcagcgccagcgcgccgacgacgacgctttgcggaggtggagtacgccgccgtcgtcggttggccggctccggtccagcccggcgcagcacgggtgcaggtcgcggctgccgcaggcgcagtggtagacgagccccgccggcgccgcgatctcgccgaacgcgtcgcagaaccgccgtgttcgccccggcgcacggtcgtggagcgtgaacgtgcagcacctgtcccggtggagcgggtgggtgatcgtctcctcggcgtgggcgcagatgtagtggaggtggaagccgcaggcgtcgcaggcgtacagctcgccgaacccgggctgcttgcaggcgtcgcactgccatggctccttcgaagtatgtgcttatcaaatcttagttatgaagctactagacatttacatgttcagatttattattaggatttgatttttttttcttaaatgaagggaacaaatatagctaggtaacctccagtgtt

SEQ ID NO: 83387 - DNA, 1112 bp, Oryza sativa
tttccagtggccaagggggtaccttacttagctagatgtgttaaatcagcaaccaaacttgacttgcagcgtctttgccgtgtcttccccgtaagtgtcgtgcatatgccatcggcgttttcattgatagatacagctctgcatctactctcaacctcaatctttggacactgctgtatattacatggggtatatatatatcctctctgccttccttctcccagttgcagaccaaaggagccagagcagcacaaatattgagaaaataaggagaccggccactgaagagcatgccttctctctacatattccttgggcttcttctcttctccctgcaggctcctccatgtcctgctgcaactgatactctgaaggcaggacaagtgctctctgccggtgacaagctcgtctcgaggaatggcaagttcgcgctcggcttcttcaacccaagcgcaaacatcagtaagtcatctgacaacatctcctccagttggtacattggcatatggttcaacaagatcccagtttttactgtcgtgtgggtcgctaatagggagaggtcaatcgctgagcccgacttcaagctaacacagctcaaaatatcacaagatggcaatcttgccatcgtaaaccatgccaatgaatccataatatggtccactcgtattgtcaataggacagaggccagcatgaacacaagtgttcttctccacgacagtggaaatcttgtcatacaaagcacatctaatgcagtgctgtggcaaagctttgactacccaacagatgttgctcttcctaatgccaagattggctggaacaaggtaaccggtctgaaccgtgttggtgtttcgaagaagagcctcattgatatgggcactggctcttatagtgtacaactatacaccaatggcaccagaagggtgaccctcgagcaccgaaacccttcaatagagtactggtattggtcgccagatgaatcgggaatgaagataccagcactcaagcaactactgtacatgaatccacagaccagaggtttagtcaccccggcatatgttaacagcagtgaagaggagtactacagctacaattcatcagatgaatcatcttcc

SEQ ID NO: 83388 - DNA, 701 bp, Oryza sativa
attattacaagtaacatataaattattagtcaggttctctctactataatctttccacgagattaaataaatacgataccattggaatactctcgggtgaaatgctacaatggtatatccgtgcgcttgcggatgaactctgtaaccataatataccaggagtatttctgcgccattgctgggaattgtatttctagtaatgtcgttaagaaataccaacagttgccttgctcgcatgccccaccaaaccacgttgctccccttttcgacatcttctccttcttgcaacctccgcatcaccatcctcaatcttttaagctctgatacacccacatcgtcgccctcttccatctttggcaagtttcacctggcaacatggctctcttctcctcgcaacctcatttccacaattctcctcctttgtactcggctccaatgctcccacaccgttggcctccaccatctcgtgttgctctagcttcaacacatgcccaccatcctcatcatctcccactgctgaggcgacacaaccatcgtcctagctatccctctaagccgacaaacacatctcactttctcatcctgaccttattctcccctaaccttaaccctgcaaccctatccattcgggagatcacttgagatgaaaccaggccatgaatcatagggcaagctctaagctgtcagggacgcggtactcc

SEQ ID NO: 83389 - DNA, 678 bp, Oryza sativa
caactcactccttcccttccaattcttgaatcagaactgagctgattgacttctcaccagctgataaatacaacctaaatggtactcctttgtaacatcccggcctagggcttaataggattaatagaatactcatattaacaagttgcaacttcttttccggaagccaatctccagagaactccagggttaagcgtgcttggcctggagcaatttgggatgggtgaccgaccgggaaattcttcccgggtgcacacgagtgaggacaaagtgtgcacataagacatgtgttggtctgtgagggcagtctatgacctatgaaagctatcggatgtaagtgggcccggcctggggaaaggcggaacgttacatcctttctgtgggggaatcaaaacagttcagagaactgagatattccttgatattatccaaaactttttgttgctctgccccccaagtgaattgttgatcggctttcaaccgcaataagggtgtaaaaggttccaaccttccagaaaaattagagataaacctcctaacaaaatttatcttgccgatcatttcttgtagctcggttttattttccgggggcttaattttttggattgcattaacgctcctttgggttacctcaatccctctttcatgaacgagaaatcccaagaactggccagccga

SEQ ID NO: 83390 - DNA, 72425 bp, Oryza sativa
aggcaagatcgaagctgtgcggcgccagtgaagtgttgggggggaaggggggaaggattggtgggttcttggagaggcgaggagagggggagagaattccacgagattctcttctctcctctcctcttcttgtctcgtcttctcttccccgcgtaggcgtaggtgtgtgtggccctctgctgctgggtgcctgtgccagcctttctacctgggcctactacgctatagaatgacctgcccatagttaaaaaacatgatacaccttttttttcggtttggaccctgggtttttgtatattatcattgggtcggcaaatctactcctcccaaaatagaatttgttatattttagaacgggggtagtagtattttttttataaaagaaatagggtataacgcaggtgctcacatgagtacacacctacctctatgaacacgtatgtgcatgctctatctctatgagcatctctaataggctggaccatcatattttaagattgacgaaggaactatagacgtcttactgtcatgtcatcgcattgacggattcatcgcctacaagtcgtaaatgcgagcacttatgccaagtcgaattgtttatagagtaaattttaccttgagccatatttttattttctatgttttcactttggaccacttgtctctcttctcaaccatatgaacgatctcaggtatgtcgacacctactcatcaatgaactctcatagttatatgtaagacattttttagcatacgacgagttggatgtaaatgaataaaaaagttgagggtggtctaaaataccacaaaggtaaaaatatctggttcaaagtaaaaaatattggttaaaaggtgatccatagcgaaacatcggtaataaatgtgatataaagttgcattaaactctaatattagctataagctcatagttatctctactattaaacttgctctaagtagattaacaatggtttaaaggctggcctcgagctgctcaactcaacagaccaacaaataaggtcaagcttttgacattgtataagtttaaacctgatatgatgcctcatgaacatagacatgttcataacctgatgcatcatgaacatagacaaacctgatgcaacgagaggccttccatgaacctggacatgattaatcatccatgttcataatatggcgattttagtgggtgcaagctgaattttcatacgcaggaaggagacaacgagcacacctgctctcgagtctcgactcgctggccaatgggccatggcgtctcctctcggcgtgcaggccgttggattgtgccacgtggaagatttctatacgtccaaagtagtaaatggtcaaagcttgctgctaggaagggtaccgactaccgagtggcttttctatgaacactttcaagagaacgcgcactttgaatgggagtttttattttttgaacatatttaataaaattttaaaatggattctctactatttttaaataaatgttttagccataatgttgacaaacaccgcatatattattaaaccttagccacaaatagtattttactagtgtcgtagtattattttatcacaccagtaatattggaaataatataatataacaagattatttcacattttttaggaaaaacttatttattaaaagaactcatttcaacgacttgctggccaccgtaaatcgcttttccttaatggcagagccatggcctttttagagttcatacaaatttaagtttgttggagtagttattagggaaattctattttcaattttaatattaacattaaaaaaattatattgtgcatttgctgacaagcctaggctgttgccaaggatagccgagcaatcgctccacaactgtttttcctcatatgtgctatttacatataagaaaactaaaaggcatcttcaatggctgtaagaattggggaaatttcttcttttctaatataggctaaatggtcagctgaatcatagcattttcttttcaaaataggagcacaacatggttgctcgatggaagatccatagtttttttgcacatgtgttccgagctacaattctctaccacttttatggttacgttttcttttctgccatgataatgatgttatggatttttattcaactaaagaaaaggtcgatgcaaatattagggataaatgagttatatgttgttcctcataaaagttttgcgttctgaaatggcccatgatcaagttgattttgtttattttcccttttaatttccatgtcagcagattttaatatggagaacatgtatactgaagtacatcatatccatatgtgtagaatattgcttcacgagagaaatttgaaaatatactttattttctcatattttgcgtttatatacctggctgtgattaatttccaaaaatatacccaatccgcggaacggttgcgcgggagtgaggacgaaccagccggtcccgcaggctggggatgcagtaccgcgccggtcccatggactgggtgagcgcggcaatgctcccgcatgccagatgtgcgggaccggctctcccacatgccgccccctatctcggttcccgaattggatctgatctcctatgcacggaaaacggagcagaccattaccacataattaattaagtattagcttttttttcaaaaatatattaatatgattttttaaacaactttcgtatagaaactttttttaaaaaatacaccatttaggagtttgaaaagcgtgcgcgtggatgagtaggaaaaattagaggaagaacacatctcaaacaacacgcggcctgctcggttccgcgtgttggaaacacgggacagcgtcagtcccgcgccaccgttctgcggcaccgccgcgttcactcgctatcccacatgctccatcgctcccgcacatcagagccgcggtaccgactcagtcccgcagtccagtcatgtgggaccggctcggttgcgcatcccagttccgcgcgaccggctcggattccgctcccacatccccagtatgcggttcgtcctcgctcccacccatccgttccgcgaattaggtatatttttacaaattaatcacaggtaggtatataaacgcaagatatgaaaaaataaagtatattttcaaatttctttcatggcttcacaatagtcatgtaggaattctgcgttaaaaaaatcacgtaggatcataaagcttccaaaaaaattcaaaccatatatccaggaaatttaaaggattttcctttttgcacaattccgataaaaatcctcaaattccgagcattccagcaaagcccttatcgtctattgatgcacatgccagcactcgaaagtagttagaatcgagaaagtcgtacaaatgcgaaaccctcaacaaggttggagaggaacaagaattggaactgtccatgcaaaatcttgaaactaaggtatatccggtgcaatattaatttctagttttctactatcttgtactgctcgttggagccatgcatgacatctgttgcaagctataaagagatcacttgcatgggagaggcatcgatttcatctttaaatcttagacacctaattcactactggtttgcaaattgtaaatgagctggtcgttgtcgaaagttgcccgaaattatagtattttttggatttggaggcatccgttgcaggaatctttagaaaaagatgcccggaatattccttcgaggttgtccctagggctagtcatcacttgtgagaaatggtttctctgtctcttcttcgtttctgtaatgcttagtatgtgctggaaggggttaattgggcattagggcataaacaaatggggattaaggtgaagacgaggtgtcacgcccggaatttctatccaaaattccaaacgcttacatgtgtgtaaaccctcgtctaggaatcagccgaggcacacaataacaaattgataatagagtacaattattactctaattaataagcgaatataaagtcattatagaggtagatagttcctctcaaacaataaagttctaagcagtggaaaataaaagaaatagcgcaggcgactcctctccacaggcagcttgaccagggctacgcctaatcatccacaccatcagcatcactgtagaactcctcctctgatgaatgattgcaagatgagtatatgacatactcagcaagccacgcagcaaatatgcaagtgcaatggataacaaatgatggcataatataggctcatttgcataaacagcatttaataagcaattgagagaatagtaaaacagttgagtaattaaacaatattaaatcaacactatacaacacacccgtgttgcatagggccaaccattctgaacaaccaatcccggctgcacagttctatctccaaaccaggaatataccattccaaaccaggagctaaacaagttattaacatcatcatttaatatagtgagaagtgtgagactaatcactaaagacattgttagacccgctcataacctcgggcacggctattcgaatagtttaaactctgatcagaggtgtaccactgtacccacaagacacaacctcaacatcatgtcaaccatgcgtcgcgatacttgacaagtacccgaatagagattgtgacaatacctcctgcataacacaattcaaagcagtgcaccgttcccggatcataatcacccccttaaacaaggcatggactccccagcgacccccgtggccttatctccgccacttcacagtctggtgctctactatgaaccatactatacagaaagtaaagccgttgcccacgctggcttgtggttggcacgattaatgtttcacaactaaaaatcgtgaaccggtccttaattgtcatgagcacgaccatcaaaaccatgtgctcacaacccaccattatcagattttagttggcaaattaattaattaaccaatcatgattaaccatcatgagctatcattaagccatcattaagtagtagtaaatcataagttatcccatttatgtgagctagtgtctctaagcatggctaagcatcctaatcactttagctaaaaccatataatgttctagctaatcaaattattaaccaagtgacaaagaatagggaatcaatagcaaaagggctataacaaggcaataggttatttcgacccaatgacattcgaaaataaatgcaatagttgaatagaaacaatagctttaaacgggatcaatatgctcaaagggtcgtttgggatctgtgtgacttgccttgctagccttggaactctttaaagtcttctcctgcaaattcggactctccgggaacgtcggaatctaaagagaaaagaacaaaatcaccaaaacagcacataaacaagcatgaacagtacatgtggatatttttaacatgtaggtctcaattttagaaaaatttagagacttgaaccaactaaattcgagctaagatgaattagttatgaattttcaaagatttaatcggattaaatcatttatatagattttaattgaattatgatgcaataatgaattatttttgaaaagaaaaaggggattattgcgtcagcggctagggttcacggcggtccacgggacacggcgacgatgacgtcagcggtgacgtcatcaccgacgacggctcgggcggcgcatgctcgccggcgaacgacggcgcggcggcgcgaacggacagcacctacgggttgcgggcgacgcggcgaactcaccggtgaccaaaacggcggcggaagatcaacggacggcgacggcggcgaggaagaagcggcggcgaccttcggcttgacgacgacggcggtgctccggtgacctaaggcgacgacggaggggcggacgaggtcggcgacgacttgacgatcacgacggcggcttccctgagcgacgatgacgaccggagcgggggcgacgcacggttggacaaacggcggcgacggcagcgctaggctgcacggtgctagggctctaccggcggcgagaggcgaaggcgagggtggcggcgggtagcgaagggcttgggggtccttttaaagcggctagggggcggcgacgaaggcccacggtgaccggcgacggcgatggaaagttagggctcgggagaagaaaacgaatccgaatcaaactcgaatccgatgatttccaaaccgaattaggcgatgattccaaaagagaaaagatagaggagatcaaggcgatcatttcccctctattgatttcaccggagaaggaaaggcgcggtcgaattggaagggcggcggcggcgctgcacggttagggttcgggcgcgaggaggacgacgggtccgataggtgggccccacctgtcagcggcggacgcgcgcacgcacacgagcggcgctcggctgcgggtcgacttgggccagggaggagagagagagggttttgggctgacttttggcccaaagccaaaagagagatttttaaaactttttcaatttaaattattcatgaaatgcaattctatttattaaaaatacttccttggctcaaataaatcccagaaaaatctaggaactatagaatcaagagaagtatttaataaaaatttatctggcccacttttatattggaatttattatttaaaattagatcttctcttctaggcttttaaaatcaaattctaataattccaattaaacaacaatttatatatttaagatttttagggtgtgacacgaggacaaagctttccttgttggaaccttttgtattgtttttgttttagtgagtgtgagaccatgattctctaactttggcctgatgatataatatgtagaaggtagtagcaactttcagctctgcatgggtgttccaagaagtgtttagattggtcgtgtgcaaataatgtttataaattgtaatttgcaaaaaaaaaaaaaactccagtatacttttctgtgtatttattccaacatgttatgattcaaagtagtatggtttcatcttggagatcatgtaggtgaccaaacacagcaatataccaagtgaaaatgatgatggtgatgtacaacttacgactgaaattttgaggaagaaatgaaatttagaaggacaataattgaatataccaagtggcaagagccattcaatttgcaagtcatgtttaagaaagatgatgtagcctacgaaatgctactgctttcaactataaaagaaataatttgttcctgttgacttacaaattcaaatattttttttattattgatggtgcatacagtatttggatattgatcaaattttatttgctgattctaagaaatgaagtgttttctgaagcagtttagacaatgaggactctatgtggtacatgtgtagacaaaaacgacaggagcattttgcattcccctatttgcatagaaagctaggaactgatattcgaaattgtttcagatggatatatcagttaatcatgtcagaacccaaatctcacggtaataatattatttatcaaggaaggcacttgatctagcacattaggcattttatataagatatgctgattggattgataacataagagagaaaaccttgctacttgacaatgttggcatgcattagccagagaacaagatggcctctacaagattggcagagcatccccccttcttaccgaaattcgaattccgaaattcgacatgactacccccatgacaagaaaactggtgtttgcacatccagattgcgtcgaacgacacggctcagcaagacttgcgcttaagctcaggtgacttctggaggatcatttggccttcgatgcccgagggcgtcggcttgccctcaggactatgcaggttgattgggctgacagagagctggtggaagatggaggagctcaatgtgtcagcggagccgcacatgacaccaccagagagctccgggagatcattgtccgagatgctgaagccgcttgaggcaagctgctcggagacgatcttgcatgccttctctagtaaagtgtcgatgtacttctggtaggcttccattctgatctgcacatgcttctggacctgatcatgggaaaatgaaatagtcaactattgtgtgttggacaatgtattcctgattacaatgaaaatcttaaaactaacagatcttcaatagagcttttcatgttgacatattgtgtggcatgctaagtgttaaaagtgcagttgtagaaatgataatgaacaagtgtgttccacatttttcggtaacacgagatgcagcgcacaaatcctgaaggaccggctgttctgaatattggtgaagtatcagcctcacggtatatcatttgttttaaagcttgagggctttattcttatgtagcaaatactgaagttggtgagcactagctcttctttcttgctaatggcatgtataaaaaccaaagaatattatgacggatcaagctttcaaagttacctccacttgttcatgcagtcttcgttgcatttccatctgagctcgcaatgcttccttgacctcttgatttctgtaacaagtacatgtgacattttaactctttttaaactagcacaacacgagcactattattaaaatattcgtatttgccagaatggagaaacaaatgtccaggatgagtatcccatggagcttactctttaacatcttgagtagaaactctaggcgacacactcattccaccttgggcatctagaagataggatgctgcaaaccatagcagaggtcagaggttagtaaaaggtcaaaagaactcttaaaagtgtggttttcaagtcaaaaagacatatctgcataacaaagtccagaatttgactagatgagcaaattcaatctacaaacgtttccatttgaaacaattacaataaactgcaattcaacgatacatgtaccaacactacgcttaatattgccaacattttgtgtataatttctcttccatttcccactgatgaaccttgatgtgattattcatgttagtactcctacttagcaatatgcaattattactggggctaaatttaactcaagactgaactttttctacacaaggcaaaagtacaacccacaaattctccctactggacaggacctatagcttctggatcagcatgtgtgccactacgaatttgcatatacccatatggaatcgctatatttgtggcgacacaaatattgatagatttcagtcagttttttatgcatggagtctttggtatttgtacacagcgcacctgttagtgctagttttgcaggtacatgggtgtttacctatcagtcgatttctggtttgcttctactacactgtaaatcctatataaaaattatggtgtaaatattggaatttacaatgtaagttttgaaaactacagtgtaaatttgtgtaatacagtgtaaatatatgtaatttacaatgtaaaaaacaattgactattttatggtgaaaaatgtgaagtcaaaaatatagctagtccctgaaaaagaaaagcttgtccactgacgtaaaatactcctccacatacagattccctctcaccattcagtccttggttgcctgcagaccactcaactacgaatcctcccattatttcccacatcaggtccactctattccttcatgtccctacagactggtgccccagaacagagatttatggtaagcttaaaggaaattcataacactgttaacatagctgccatctccaatccatacgatttccagcaatccctggtcttttaagaagttgctaccaattgattcctcccaagatgcatccaaacttaacaccagtaaacccaagctaccatctccaaatcatataacttcaagcaatctccaatcttttcaagaagttagctacatagtgattccttgcaatacatcaatattgatcaaattgcaatcgatgatcaaccaacttcataagacaccagttcatgagcagagccgtatttaacatgtccacagatcaatggtaggatagttgcatgacttcagaatgaacttccacaatgtgaacaaattggaattgttgcagcaagacttggaagttggaatattaatcgaaattaacagtgaggtcagtagattgctttgtgtaacttaccatctttagattgctccgatgcctcttttccagattgtttccccagtctatatttctggtcgaggaagatcaaacttaaatagctgtatttcaaactttgcaagacatgcaaaagtattatgaattacctgaagatgactcttcaagtggaaaagagtgagccccttcacacccattgtcctcaagatagttttaggtgttgcttctgcaagataatcatgcattgagtactcaatttaaaaatatataatgaaatcaaatcttaaactgttttactggattcccctggatttttcacattttagaccttttgggaaacttattttacaaatagaccccaaaaaaaacttactccaggaatagaccctttttgcggtgccaacatcattgacgctgtagtccaacatgatggcgccaatgacattggcaccgtccccctagcatccccacagaagctaactcactaatgtaaagggggacggcggtaatatctttggcatcattatgttggaccacggcgccaatgacattggtgtcgcgaaaagggtctattcctggaataagttttttaggggtctatttgtaaaataagtttttagaaaggtctaaaatgtaaaaaaaatccatcttgattcccttagcaattgactaatgataaaccagcaatttagagtgccaacatttactttttttagataatggaataattatcccaggcactgcaccagcaatttagagtgccaacatttactttttttagataatggaataattgtcccagggactgcactagaaggtgcacaaagccacaggcacaaccttttttagactacctacatgattcaattaagatttagaattttgatctagtgtgagtttcgctgtgctactgattatacctcctacaagaaaataaggaacagtacaatacacgcttttctttgtatagacagttgtccaggtgcatagctaaaactaaggccttttatggacggaggtagtaatcacagaagcacttgtaatgttggtctgagatttaaatggttcatcaaaataattagaacctaaaggtaaaagtgaatccttgaatttttataaagaaaatagagtaaattacagaaaactacaggccaaaatttgtgataaatttggtgttaaatctatagtttggtgatattgtggcttaaatatgtaaatttgcatagttctgtgaaatttgaaacaagtcccaagaaaattgacagtagtaaattgaactaaactcatgtcaacaaaattgagtaagacctcaaaggagaaaaatacagccacttctattcactgtatgtccttaataaattttaatgattgaatcaaagacttcttgcagacaccacagtccactaaaatcaaagcatcaagctaaactaaatcagtatagaactattatagctctataccataagttaagcattttggcatgtaagcaccagattctaagaaatacaccaaaaatgcctagactgcgcccaagaaaaatcaaacagtatcatctttgaacaactatgttgtttttaagataaatgaatgcctttattccggcctctgcataagtcatgcatcaaccattagtgattagtcattacaaagttttaggcatagactagcacagacaatgcatagcacccatctcacaaaattcaaacatgaacgaaaaacttatgcacaaaccctatcagtcaactatgtaatatagtcaggttaaaaatatgatgtgtgcagggattactgttcactagtgcaaacagctccatggttacgtgttgaaccaagattcatacatcagatgctagagtaatcaatcctttataacttctgcttctgaataccctttgccaccaaaaacatgattatatgataaaacattcaatgcatactctaggttgattatatacggtggcaagcgcctaacgcctaatcaccaatcaggtggctctaggtggaacgattggctatacaggtgaggcgggagttgcacacctatgcaagctaggcagatgtctttctgaagtactaagcatagcaggtgaaccgtgttggtggcaacaatcaagccgctaccttagggcttattcggttcataggaattccaaatcaaaggaataggtaaagttaagaggtctcacctcatgctaagaatcctacagaattagcttgaaagactacaatccttaggaatttggtaggatccattcctatgaaacgaatgatgcatataggaaaaattcctaaggattcaattcctacaataatcctatgaaaatcctttaaaccgaatgagccattttctccaaatactgatctgctctatgcctgtgccaatgtgagatactgcacctcatcatgtgggaaattgcgaaatcgctgtatttatcccactgcgttcacttacaaaccactgaaataaacccaaaatgagcagaaacttctccctcatccttgtcccaattctaacacccgaaaccaccaccaatttcgtattaacaaaacactcttgattgctaccggtgcagaattcgttaaagtacaggacaagcaagcagctcaaatcagtagccgacctcgatttttcacctccaatcagtaaactccccaaacttgtaatttgtaaacaactaatgggtacaagtttcccctccaaatcacaccaaaaccagcctagagcgggctaaatccgcttccctaagcgctggccaagcgggcatttctctccttgccaaaatcgaagacttattataaccaaacgaaaagatccaaagcatttcctgaatctccgaacaaacaaaacaatgccccccaaatcccgcgccgaaatctccgctcccaatccgagctttggcgcgaaccaccaccaccaccaccaagaacgaaggagcaacccacccacccaccaaccaaccgcgcaagcgcaacgccaatgcgccgcctctccaatgggggagctaagctaccggagatcggagagaatgggggggagagaagcaagggggaaatctcactctcggggccgccgagctgggcgacggcgtcgacgaagcgctcgtggaggtcggccgtccaccggaggcggggcttgggatcggcggtcagcaccaggctgggccctccccccgccgcacgccccgcctcgccgccgtccggccggtggtggatcagcccaggcgggaacatctcctcctctttcttcttcctcctcgccggcaacaaggaagagaagaagagaggaaagacgagacctttgctgctcctcccaaaagcggaggatccaatgaaaagtcccaacgctttctctctctttcttgcttcttgcttctcctctgctgctgcctgctgcctctcccctgctgctgctgctttccagtggcagaggcagcgattctcctctctcctcttgcttctcttcttgacctcttctcttctctctcctctattgcttctttctctctcttcaacttctgtgtttatagattggagggttgtagtataatctggagatggatgggaacagcagtggccataatgatgcgtgttactactagtgcagactgcagagcaacgtcattttcttactgttgttagattattacgccctaacttactactgtcatcagagctaggagtaggtgataattatttgtgattagcacactacagccaccctccctccctccccatcgacgtatagtagcgagtacaatagcaggctacaagtcgagtcgactgtaagcacatgtgaaagagacgtgaaagagagaagataagagagagaaggaaagcaggatttatagccagctgcagcacagaatccaatgcattgtgtgtgtatgagatgtaggatcatacattaatggtgtattatataactattgataaactattagattggatatatacgaattagagctattagttggctatactattaaacttgctctaattgagttcaactcttaggctctgttcgtttactggagttcccaactcccccatctcattttccgcgcgcacgcttttcaaactgctaaacggtgtgttttttgcaaaaagtttatatacgaaagttgcttaaaaaaattatattgatccatttttgaaaaaaaaattagcaaataattaattaatcacgtgctaatagactgcttcgttttccgtaccggagggatgggttcccaactcaaccaaaagaacagagccttattaattaactcgtttagtatggaattaaagtacaacgtctcaattatgctctcctagctcggcttaaatcatgaaaacattagaatctggtcgtttgcttgctgttttagagcacgctctaaaaattaacgcgtcattttcaaccagtttaatagtctatccatgttataaatatatgatatattgtaacctgattttcatcttaaatctataacctgattttttttctctctcctcttctccattcttaacctaagcataaatttgatttggtaatttttagagtctgctttcatcatttattatactcgcttttaaaacttaatttttaaagttaattttgagattttttttatcaacttatttttagtcttcttggcttttaaatcgatagcagcacacatagatgttttatccatgataatttataggtgtttagtttatttttccactgacttgttagcactatatcaaactatcatagcattaagagcaagtttagtagtatagcccactacttactataagccaatgttaaagctaacatgtataatagcttatgctttcatcataagatactccctccatctacttttgatagtcatatttccaaatctaaaaattttatttttgataagcatatttcacttcaacaacttatcattttaatgactttctcagatttaatgcatgactctccattcttccacacatgattggctacatgggcattgagaaacgtaaatataaatgaatcgcttgtttacgaggaatgactagtagcatgtttatatggatgataagtagaattacttatccttggtctgtgtgccaagatgaaatatgactatcaaaagtagatggagggagtaggatttatttttttcatcatctctctttatctctttatgaatttaatgcttatttcttggagcttgtgtggagctagctcttgcatgagagccaacactccctattttttttatctctctttttcacataagcatttagcttgcttatagctcacttagctcactgtaatccttgctctaacacaaacacaagtcaattaattgtagaaaatatataataattgggtttcttgcactttggtgctgaggtaggtattgggagctgggcaaatgattggtgcatggaaaattcagcctggcctctcttatctgtctaccatctcccaatctctatctctgtgtgtgtgtgtgtgtgtgtgtggcgtttggtgatgctagcaaattgacaaatgggattagtttaattggggtttttttgtgccctttttgcttagaaaaaaagctagtgggtggaggatcatgtgagagctgaacagacagctgagtggcccttctccatttgtttaattttctttcgcgtgttatttaatttgtaaaaacccttgcttacatcggctttgcacatgctcaatgtccatatccagacgtcatgtgtgtttcaacgcgtacaaatgcaggaaatgtggtgcttcaaatggtctctttcaccttgctaagagtgtatatacaatagacctaaattagtaataaagctatcagcctgattacatcggaatttgtttgtcgtgtcgactaaaagctgtgttgcgctggggttttcaacttatctctctcattttcgcacgcacgcttttcaaactgctaaacggtaaataatgtgtgacaaacaacgtgtaagcttccgattgtgttctcttaatttgtgttgggtacttgggtgttggggtcaaaccatgagaaaagaatcaagtatatgattgttgggaggatgtatgtagtccgggtgagactggtatgaaaatggaaaatgtacaaaatgcaaattatgtatattttgttagggaccactattttgtgaagattgcttgtacggtgatgcctctagctatatatgatagaggtggtatgtagacaattgaggatgggagctaagctccaaattaagttcgatgggctgactctacggctatattcttctcgatgagttgggaactcatctcccaggcacacagaacagaacgactcattagcacatgattaattaaatattaactattttttttaaaaaaatagattaatatgatttttaaagcaacttttttataggaaacttaaaaaaaactgtttagctgtttgaaaaacgtgcacgcggaaaaaagagataggtgagttggaaaagaagggaagaacacaaactacgtatatatagagctaaagttgagttagaaatatttagaagagaatatatgccaaagatgctgatgtcatatttttttacaggagattgactcgaccagggaaatatatacaaaagacaaaataataagcttattaaaatttgatgtgttttgcatatattatccttccctatcaatacaaacgatgcaaagcttttgcccttttaaaaaagatataattaatgattgatgcatagatttttctatgaacttaacaaaccaaaaaaaccattttgtatgtcaacagtgtgacatgcagtctcctagcattgtcacgttatcaaaatcatagacagaaagagaatgtgaaagaaggtagcacactacgattttctatttatattttcttgaacctttttaattttcaattaaaaaataaaccaattctaaacttattttcaaatcttaaacttttggtcacgccacgtggtaagacaaattgctgttattgttttggggttgtgtggccaaaaagatgatttagaaataagtaatgatctattttgtaaattaaatcattaaaaagtttaaaaataataaaaattcgtaccctacaagatcctaatttttacctaggtgtttataccatcggccacctataaaaaccgtcggccttgtatatttctaagcgtatatcatcggccactactccctctctgtttcaaagtagttacttatgatcatctatgcgtatagcgtagaagatatgtttttcaaatgtaaaaattgctttgttttaggatccctttgaatcgtagggttgaaaaaatagagaaaaagggagaaacacatgattctgataggaattgaagtgtaaaacagaggattgtaaaacacataaaaaaactcaggaatgatcatttgattagaccgcaagaaaaaacgcaggaattagatgcgggagatagactcaaaggaaattttccaagaggttggagctcttgctaagtttcctctaaaatccacatgcaatgtgtcattacataggatttgaaaaacttcaatcctttgaatctgtgtcattacataggatttgaaaaacttcaatcctttgaatcaaagggctaatagaaaaatttcctataggatttaaatcatatgaaattcctacgtaagtcctttatttactttagagcagagataatatttctctcttgatacagaggataaaatattcttacgaacgaccggtatttagcaaatatcctatatttagcaaaataggatggacgctaattctaatagcgtccaaaaaaaggacgttgctttccatagcgaccaggtctggacgtcgttcacctcagcgtccagctatgttgtgcagcctaactatcccaaagccatatccattctatatacgagaaatagaagcgaggaatccctgcagggagaactggtgcggcatcgaggattcgaggctagggcctagggcagttactggcttactgccgccgatccaacaggaggagactgggaagtgggaagccgctgctgtccccgccttgtcgggagcctgatatggcgatatccgccaaggacacaagaaccatatctatcagttcttttagaaacgacaagtaattttaggattagtagtggaaatctaagttataatttttgcctggggttgtagttaatggtgctgttgtagctcaaagatgtgttttagtttagaagcatatgtatgtgtattcatgagagtttcagactttctatgactcttttctgtttgattggttctatgtgtactagtactgaattacttacacgcccatagtcatatgatctattgtttggtactgttgtgatattcttctgtagtgtgaagtttggaagcatgcacgtattctgaaatccgaaatactcaattatatgaatggacttatttttcttctgcttcatgtgaatacccacaaaaatagttacatctgtatttcatctgagttgcgaggcagtgcgtgagcttcttcaataacgattaacgcacaagaactcattgtgcctgttcccagcctgggcctgccatcggcggcacaggtgaacggcggaaacgaaagcttcatggacggaagcttcatgccttcattacagcgagatgccgagggcggcaggcgacaaacggaaaatttcaagggctgccgcttagtccaatcctgcctgggaggcgagcgtcgcctaccaaatactccagttgtttgtgttaacgacgagatatatgggtatacgtagttttttctttctgtattttatgggatataggttggtaggcggcgccagacagtggacgctgagatgaacaacgtccagaggtggacgtcgaggtgaacagcgtccactcctggacgctattagagttagtgtccatcctattttactaaataagagctcttagggagtgtttgaggagaaggggattgaggagattgggaagatatgcaaaacgaggtgagccattagctcatgattaattgagtattaactattttaaattccaaaaatggattaatatgattttttaaagcaactttcctattaaaattttttgcaaaaaacgcaccgtttagtagtttgaaaagcgtgcgcgcggaaaacgagacacaatctctcctatctccacctaacgaacagagccttatttaccacatatttaatttgtaaattattaattactataaataaaaaaattggggtctacaggctacagctccaatgagcatcgaagtggtttaattaatgatcgatgcaataaaaaaaatgattatccgataatatatatcactgtatcgggacgaattatcactccaggattcatgggcttaattcatcgtaggattcttgtttgattaattaattagataaagtttggagtttcttcaagacaaaacaaaatgagatcgagtaatgataccgtaccaacaactagtggaacttagaacggactaaaagtttgcatttaaaaattttgggtgatgctgatgagtggctcagtcgtaggaggatagaaaatagagcctgtgttactaaacactgccatactacaggtaagtgctattggctgtctacactctttggggtgggtaatgtttgtaatttataatccctcattttttatatatatgtttttcgaactattaaggtttgtacatgaaagttatttaaaaatatatatttgtcatttatgtaagtttttatagctgatacttctaattaattatgcgctaataagccatactgttttaatcgcgcacgagagaaagttccattgcacattgaagaaattaaagacaaacttgttcgaaattgggctattattcttcatttctggatttagtgcagtcgcttggggagctggggttgtgagaggaacgagaagacgaggaatggaggcaagactgcaagatacgcgaggattacgtgcatactcttgtgttgactgctgccctagtctctaatgggtctcaaacaaaacatacacatatacatggtttggggggcctccgtcgcccctctcgccatggcctaggaacggccctggtctagacttaaccctagctcaaaaaagcaaatgatcaacactcagactataacaagccgattatattaaataactccctctaggaaatccaacaacttgaaaaaaattccacgcttttttattaattttttctttttactgaaaattttggtgcagctcttttctttctttcttctttttttcaccttctgccttttcttttctttttgtttctctcttttttttacaagcagctgttctgcgcaaggagaagccaacaatcggcttataaaattacaaaccaatttaaagaaaaccgaaaagaaaagcggctactcggtggacatagtggaatgcatgcgcatgtgtactgctatggaaatattcatccgttggttgatattgaaggagaggttggtaccaaattaaacgagatagcgatcaaaggaaaaaattgcatgcggaaatctcggcaggaaggaaatggtcacgcaacaatttcaagatttcagaaacaaaaccaccgtatagaaggctgatcttctatttttcatgtgcacatcatgtctggctgtcagtagagatatcaatctaatctcaatgataggcacatagatgagctcctctagaaacactgtagaacaacacccagcacataatcctcaccaagcaattgacgatctgataccaaccgatgacaccctctctcgggcccgatcttctggtgagaggataactctcgcttttatcgaatgtgatatttgcgacgtggctaccaaccagaacaggttcaggatgtcgtgcaatcactacaccacaaacgatgtcataccaaccgtgacgcgtggttgataatccctgcaatgcaaacgagagaacattgcaagaacaagataatatacgatctaaatattgcgaataggtaattaagcacaacgaagtagttgcaattgaagtggtagatataatctacccggcaaatcaacacaccaactattggggtctctgaatctatagtcgccaactaatcgaacaaggattagagacaaggtaaatagcacttggaaaaattcaactaaataaaacccaattgttttttaggtgtacaaagctatttatagatgaaaataaagctagagataggtgttggttcatggaggtggatagagacacttctgagatgggactagtatattacaaggcccaaggcacaagttcggtttcagcaataacacaatattattttgacaattcccattgatttaggatgaattttgatatgatatcagatgggtttgaaaggtgaggagataggctttccaacaagtactagatcatccaaatcggagttggcatgaaggcgctaggtccgttcgaagtcaatgttgtctctgcctttggaggccgaacaggactttgacttgttattggaacttgtgaaattatgtgtgtatccgatgaagtgatgtcctcatcagcaaacaaggctaaaactcgacaatggattcattgtaggaacactcatttgataactaagcatagcttcaaagaagaagctgcaaatttgtcaaacaagcatcgaatcatcgcggaacaaaaaagaatatccaatccgaacaaaatccagaaatagctaaacccaatccctaatctgaatcattttgatacaccatacaaacagaacccaagccacatcacgcccaaatccaacccacgacatcgtctccgttagcgattaggcactcggcgatgttgtgcaagccacggagcgcggcatgcagttgttgtagtcatgagcattcatgagcacggaatcctcctccaatagcttcatcatggcgtcggcgtcattctggtgcatatgccacatgatcagcgacgtctgcaccactagcctcttgtcgtcgaaccgccactgctccctgctgcttctcgatgactccgtcctgctcatctctgtcacgcccagaaattcatgaaccagaatttctaagctgaatgtgcaataaatccctgtccaggaccagccagggtacacaaacgacaattgttgacatacagacccatgtcttacaaaaaatagaaaagattacaaatgcagcggaaaagataaaacaaactaaacttggacgcttgacttctgcagcagggcaactccactccacaggcatcccttgacggtagcgacgaaaccaaccctaacaagacagctccaacttggaagatcttcagctctggtgtgggggaaaagagagcaagactgagtactacccactgtactcaacaagtcataccggaagagaaggtatgatgcaggatataaccaaaggaggctaagggttcttttgcaataaagcaggcatttaaaaacaaaagttgaaagcagtaaaaaaattgtagtagattaagcaatattaaccaatcactgtccaacgctacaccacgttgcaacaggcccaaccaaccacctgaactacaccagttcattaagctaaactagggtgagactaatcacggtgaatctagttgatcgcccataaccgcgggcacgactattcgaatagttttactctggccagaggtgtacaactgtacctagaagacaagattccacacatgtcgccatgccccgaagtatcaccatgatactgcaaagggggaaatcatgacaagaccctccgcataaccctcccctaaccattcacaccacgctaaggtttcacccccacccccaacgggcaatgggcggtcccctcttgcgccgcggtaaatctggcagctggacaaccggacaccccggccgacccaactccatcacgcccaccctcgccaccggtgcctaggaaagggtcaagctatacttcagatcaagcagttacccactcccgcttgtggtaagcacagtaagtctcccagggtttcccgtgaaccagttcttaattgccatgggtgcgaccagcaaaaccatgcacccacagcccaccatttagtgtattttaattaactaacaccattgcggtggcaccaatccaaaactatgctattagtcaaagtctatgtaataatgtgatccccatttgtgtactagttgaactaggcatggctaagcatttcctaaaccaacatctaatctttctgatacccaagttatcaatggcataaggtaaacaatatatgcgggatatttgtaaattaggtataatatgatcaattgtaatgcatgacttgccttgctctcgcactgatgagaccacagcaacgtcttcgagaaaccgcggatcgacgaaatggccgaaatctacgcgacaaacagagcacataagcaaaacacactataagactactgaaacaggaaacaaaaccatttttaatggattctagggatttttatgaatttactgagacttgaatggacttaaacggagctcggatgaattacttatgaattttagaagataaactgtgtttttactaataaagaaaagcctaaataacttttattgcgcaatattacctagggctgacgtcagcgagagggggcggctcggcaggcgggccccgcatgtcagcggcacaaggggagagggagggggcgccggcacatgggccccataggcagtggctaaaagtgggcggggtggtccaccggttggttggccccactggggcagcagcacaaggcgggggagggggtgccggctgctggctcggcacggctcaagccggccggccatgacgaggcggcgatggcgcacgaccgacgacgacggcaagcggcggcgcgagaggcggcgcggacggcgcgaaaggtggcggcgtcggccgaaggcgacggcgcacacgcggagggtggctgcgctcatgggagggaggaaaggaagaaggagaggggatcccttaccgaggcgatgacggcgatcggcgcgggaagagacgagcggcggcgacggtttggagaacggtggacggggtcgggcacaacctgggaaaggcgatgactaggttaggagaagggaaggatgaccacggtgactagaacggccggccggagttgggcggaaatggagagctcaccggcgtgcgagggaggcggcgcttcggcgagtttggctgcaagcgagcggtggccgaggtagcacttgcggcagcggagctaacggcggcggcggcttggcgcggcggaggccctagcggcgacggcgcgtggccggagatgggcagcggcggcggagctcgggtgtggcgtggggagagcggcggagtgcacgggcaagcgcggcaatagcggaaaaaggtcgagggggctcgagggagtgatttataggtgcggaagggggcggacgtggccggggaggtggccgatttggccggcgatgtggggtggagagaaagagagagtggggtgggattcaaaatgaatcccgcccatttttgggcgcgtgcgagggcgggaggagcggggaaggggcggcgacgtgggcgcagggcgcggagtgggcgcggggaggcgggaaaggcggtggcatgggcggttgccgccggggcgcggtcggctggaggaaggggacgaccccgacaggtggggcccacctgtcggcatcccggagggagggggaaggggaaatgggccggcccaacaaggggaggctgagcgcggggtgaggcgaggtggactgggccgatggcccaagaagagggaagatgaggaaaataaaagggaaaaaggaaaaataaattccctgggatttaaaattgcactttagtgatttttaattggtaaaaattatttacaaggctctgaaaattccactaaaaatcctgttaatatattgcaacatggggaactcaagaaaaattccaccacgccatttccgattattaattgcattgattaattagggattcaactctaggttaattaaacaatttcttcgagcaatttatttaaccaattttttttagcaagaaaagggggaaacttcagggcgtgacaatccccccctccctcccttcatgcgtgctcaaatatgagaccacatctgcggccagcccatctcctccccatctgcaaaggaagaagaagaccaaggaggaagaaagtatgttcttagatggaggttgacaaaatattcaactacaatgacatggcttcaattttacaaaattatagtgacacacataagaccaaggaggaagaaagcatgaccttagacggaggttgacaaaatattcaacggcaatgacatagtttcaattttacaaaattacaatgacatgtaacaggtatcacagatataaaagacatttttcctaattgaccaaatttgcaatgacatagatccaattaaccatttcctttttggccccctcccttttggtctcaacaatcaacatcaaggcacagccaaaactcaggtatcttgatatcattgataattgttgctatatgaagcaaagctttactagtgtatcatcacactacagttttcaaacagcccataatttcattttatcctttgccgggggcactaaattgccatatattaataaatgacatttattcctagccacctatcattttcagcatgcaaatacatacttacccaaattcatcaaacacaatgcatgtagcattcacttgtgacagctccttaatttccaaagaatcatcttctaatatcgcctgtttatttttcatgtcatttctccagacaagatataatgtggtgaaatgaatcctgtgaagtagtcatgatgtaaggaatcatgtgccttattatgtttagatatgaaaagacatgtgtttcccctcaaaaaaaatccaaaaatgaaccattatttgtgactaaagaaaaaagaaaaactgatcagttaatatggcaacaatttttgttaatatctatgattccaaagttagatgcactggcaatgacagcataagggattaaaagcaccttatctcccctcaccactgccttgtccaatgtccaaccttgcccttctttccttctctactacacgtgcatacacccttgctagcctccctacatttcccatttccatcaccatgaataggttgcagcacatcgattgaatatcacaattttaatgtgaatatatatatatgcagagtgaagcagaggaacttggatgatgcgtgctgaagttatcatggaacaggtttttgcttcaccatactcatgcaactttcttcaaaatcaattatgtttaggatttgcaaccatattcctttagatctatgatttgattaatgatttgtttgtggtattacaatcatttagagtggattcaacccgttctcttatatctattgtgtgtaaggattttacaatcacatttcttcagatccatgattttagtagactacgtgtgatataattatcatttagggtgtatacaacctatttttttagatctatcatatgtttatatcttttacaagcagattcctttaaacacttgattcaactagtaagattgtactgtactaaatgtgttgctatcatttattagggaccaaaacagattggtagtgtgtgcaatggctttatttaaaaaaaatatctcttttgtgtgtagatgattgttatatctcctcacaatacaaaatattgatcttaaagccaaacttgatttggcaagaacaaataacccttaaaacacataacacatttaattttctattaaactaagaacttactatatatcgcaagatatatgggcctcatatgaaaaggagtattatggatagtgttagaagaggtgccaaaatttagttaaaatgattaaaagagtgcagccaataaatatggactaagcaagaaagaaagctcctctaaacattttttccgaaaatgttcttttagttgcaaaacaaattgtagcatgacaataccaagcgtctaattgcgctgaatgcattcatcttatttaactatgtgtttttttatatggggttgtttgtgaatttaaccctcctagtggagttttcaccgtaggctaatggaacttgaaaatattccacctaaaatgcacccaggctgtaaaaaaaaaaatcatatcttctatataattgatgctgactagctactaaactcaatatatgagtgtaacacatcatcattcagtagcaattaatgcctaaagtattttaaatgttatacaagtatagtacatcatctatattttattatattttagaactcaacatgtaagcatggcagatcatctcacatcatttgatatacatatccatcatttctataagagctctttttccatccttgaggaagtaccatgaggtaccatgaagtactaggtaccatgaggtaccaatctaatctagccattgattaagcaggggcatgattggaaaaataagtcaatagacaagattatcgttcattggtccttccaatcggcaccacccaaatcgccaatagcgatatagagcgccgcaatccctttccgtctgtcatgagttctcgcccaaattgctaaaagcaaggtgacgccaccgctgggagtgcccgagcccaacgccgaccccttttctcagttccgctgccgccgccggcggatagatattagtaaggaattggtgaatacgcatgttgtgtttaggcaatatggtgcctgctattaataattgaagtcgtgtatctttgggtggtgattatgcgaattgattttattagtaattgaagttaaattccagtggagccgtagctgccgcctgatggtatgatgcaattagctaatttcaaaccaaacttgatactgtccattgaacagagggagatagtataacagcacaaactgctactacatatagttttgacgagattacatcaaagggaggcagtacatattaccaaacaaaataatgatgttcatcctgtcatccatcacacaaattaagaacatagaccttgagactaaaatcatcagctttacctatgtttcctcctaaaaccatcagcttcttatagctaattccatccgcagcagcaacgaaaacatgcaaaaatatgaacctgaagcttcggcggtagcctcactctccattcagtagggccctcgatctccattattcggcagcaccctagccgtagcggctcgctcgacgacttatcacgatgcagcaagtgacgttgaccacgccaaattcacacctccccaatccccaccccgcgtgcggccgattcacttccacagattgacgagaggagcaagcatgaccggatggagggatctgaccgggagtgcttgatgaagatatgctttccccctcatctgagatggatctgaacttggaacgggctccatctcttatttgcaacgtgtgttgagaaggaagagacgcagacagatgcgggcggaagagacgcggaagaggagccccttctctcgctgctgcgcgtggtgatgcactaatgcggaagagaacgcgaaagtacaattctaccctcccacctacggtaccgcctcaatctgggtatgcggtaccacgcggtatgaataaattccagtcgtccgatgctaccaaatcgatggccatgatttggtaccgcatgccctcaaggatggtaaaaaatctttttctataatattagcatgcatgtgcttaactctaaaatatatggatggatatattctaagttttataaatatgatagatagaaatgttgaaatattgtggaaatggtgttgatttgtagtattcaataaatcgtactcccttcatctcaaaacataagaagtttttgttgaatgtgacacattctaatactacgaatctggataaactagtatgtgtttcatgtaatcaaaactctttatattttgagatagatggagtatagatatgatattgtaagcttataagatttgatatgcattaattattgtccagtgataagccatgcttgcatccattttctcggcaaacgaaaaaaaacacggaatggaaaaatagtaaagggcagcaagaaaaaaaatggaaaaacaattgcagagagagagagagagagagcacccatccatctccccggaggcgaaaccctaacccacccaacccatcgccgccggcgaaaaccctaatccatccgccgccgaaccgaagtacacggtgccctctgctccctcccacgctcgatccactacccgctgctgttgacgggaatgcggtttccctgacgaaatcgcggttcggcttcttggttcttgcagatggggagacctcgaggccgcggcggaggaggaggaggagggagggggaggttcggcggcggcggggggtcccgcttctccgccgcccgcgatgacccgccgccgcggcgctcctcctccgggtggggggtggcaccgccgtcgcggcacctgtgggtgggcagcctctccccgggcgtcgccgcggccgacctctcggagctcttcctccggtgcggcgacgtcgagggcatctcccgtgaccccggccggagcttcgcgttcgtgacgttcgcgcgggaggaggacgccgtggcggcggtgcgggagctgcaggggatccacctccgcggggcgcccattaggatcgagttttccaagggggttagtgtcgatcgtcctcctcccgcccccttcgccacggtttgccacgcttttaccgaattgttcatcatattccctgtctcaaaatcaccagtatccaccaatgaattgtgcttatcttgtcatggttgcaaacacgaatcgccgaaaaataaagcaaaaactatgtttcacaacagaccaagtgtcgcgataagttaaaattggtttggagttttgctcttagtcaaaaatcagaccaaaacaggatcaacctagtatgcttgaacaatgaactataagttctccgttctcaggcatgctcggataacacagaaccttaattttgttcatttatccgcatccttgctatcatacgagtctttcatacaaagagacttgtcagacctttggtttcactgaaacggatagttcattcccactatgtttgttcatcaccgaccaataaaaggtcgaatgctctacagagaggaagactgacaactcagattgcagatagttaggactactattacatggttttcccttgttatcccactgggaactaaagttctcgaactcaatcaaagattcaaagttcactaattgtgataagcacaacagttagctgatgtctcaagtctgtgaatctacaaggagttaacttccataacaccaaagctccaaaaacagggattttagatctgatgcagtacattgctgtggcctgactgcctgagtgataaaaatttggggaaaatatattgcatatgaaactatctggatattcagttttgcgcacatataagcaaatttaaacagctcatgagacatcaatgaaggccttccgaaatcccagaacgtcaagatcatttaataatcttggcatgcccacattaatatttttgggctagtcggtaccctttctatcttctgcagcttatgttttaagtttgagatggaactcaaattctattatgaagaagataatctctccttgcttggttaaatagagaatgcatatgacaaccactttgctatggtataccggtgcaggacttggtttccataaattaccacaggcactcacaagagctttttgctattattgtgcaaccagaatagtctcatttaaatccttaggcattctattaattgacagaaaataacagcactagtttaggaaatgtgattgaaatgctcaatatttagtttggtctgaaggaccatgttgaagttgccacttgcacatggctgaatctaacagatcaatcttcacctttctcacccttcatgtcatgacaagaactaacacccaaccagaataatatcatttgaatcctgatgcattctattaaatgacagaaaatgacagtggttcagcaaatttgattgaaattatcaatgtttagtttggtctgaaggacaaggactacgagatgttgccacttgcacaggcttaatctaacagattaatcttcacctttctcaccctttatgtcgcgatacatgctaacaattgcaataatatataggttcatctatatccctattaaaagcagggtttgttactttgttagtagtgctttggtttatttgtggcatagaaatgcatacgtttgtcttgactagctttgtggcttgaattcacatagtgtatgagacagttttgcaattgatcacaggttatcaatcgagctttttgggtagttgaattgttgtaaatagctctatttccatgaagtttgatcagtgatacaccataccaccttgatgctaaaactgagccaaagattcatgtcagatgatggaactatatcttaatcaatgcagcatcaatattgaactgtctcgtgatgttgtaaatatggaactataccttcgtaaagtttgatacaccatacaatctagtttgatacaccatacaatcttatgttgttatactaatattgagccaaaggttcatttcagatgatggaactatatctcacccaatttcatcatcaatatcaaactggcttgagttttttttccccaaaaaaaagacttcatacaaaactcctagttaaaaacctgccattaaagatgacccaaaagtgccataacactataacagaagtcttgttcatgatatagaaattatagaacaaatatgatattattacagatgatattcacaacagcagaagtaccaaatttctacattgttgtccttgtgatttatgagtatcaaatgaaaaatggattctagcacttgatagagttgatcccaactctccttttgtggccttattccaagtttgaaacagcaggctgtgattgcggttctatgtggttgtttgactgattatttcttatcattcatattgttttaaactgcatctggtagggctaattgatcagaagcagcatggacataggtagagcagaccaatcttatgtcctagagcttgtcagttaaatagcaatatgagcatacaagtacttatggtatctgtgttcatcatgatccatttgctactctggacctgaaatatttgaatttacaggataaaggttcaagtagctctatggatgacagatactcacaacatgctgatcaaagacgttttactgaacgaggaaggaatcagcaatcaagtcctgaaaaatcaactgataaatccaaaagaagcaggccagcagaacctagtgaagtattatggataggttttcctgttggtctgaaggtagatgaggcaactctctgggaagccttttcaccttttggtgaggttgtcaagataactacattcccagggcgtacttatgcatttgtccagtacactactattgcagcggcatgcagggcgaaggaaacactgcagggaaatattttcaataaccctcgagttagcatttgcttttctcggagtgacagtgtttcagcagaatttggaaaaggttccttagatgccccatattccccccatttaaactctagtgttagacctatattcagggagcaagattttgaagattttcctagggctaggccttttgatagtcctccaagagatatgtacatgccatctccacattatggccctaagagactttctagagatcatgatgatgtgggtttcagcagggataattatttgcgatatggacctggagtagagcctgatcctagatctaattttgaaccttttaggatacaagggctcggtccagaaagaaggatgtctgaggacccatatgaacagcataggcgtagccctgctggtgatgcaccatggcacaacattccattcgagcgatctcagggagccttaccattagaggattctcggtatgctagggaagatccatacccattttcaaagaagttgaggactggtgaagcacatgactctgaacttcctgaataccctttctctgaatttgatcgagggaaggttggctctgcctacccaaggaggcccttctatggtgtgccagatgatgacatacaccccagaggctatcaacttgctcctatgcatggtagaaatcatgttgatcctttaaggaatccaactccacttgtagataggcatataccagggcatgcacaggacagcttttctaggcatgtagaagtggaaagatcaactcctgaataccatgaaccccttctcaaggaagaatggaaatgggatggtacaatagcaaagggaggcacaccaatttgccgagcgcgatgcttccctgttgggaaggttcttaacttcatgctgtaagtctgggttcttcactgtattttcttgttcattctgagtatcattattgacatctacaacattagctctgcttatcgtcttaataaaaatcacaaaatttccttcatggttcaagatatataatacatagcaaatatatcatagatatcgttttgccttttacatctaatttatactgcatgcttttgtttgcacctgatgaaggcttttgtagagctatgttttgttcacgttgttcttgatttaattatatctctgcaccatttgcctctactcataatcttaataaatacagacgtttgccttcacggtccaaactacataatctagttgatcaatttctatctgcattcttttggttgtatctgatgagatgcctttggtgtttatgctctgttctattgttctagatttgagcatctctaagttcaacatttagttttaaaccgctgttgatttcatactttcaggcccgaatttttggattgcactgctaggacaagcctggagatgctctctaagcactattaccaagctgccagcagctgggtggtgttttttgttccagaaaatgatgctgacatggcagcctataatgaattcatgaattaccttggtgataagcagcgtgcagcagtttgtaaacttggagaaaggagcagcttatttcttgttccaccctcagacttctctgaacaagtactgagggttccaggtaaagtcagcatatctggagtcattctgaagtttgagcagtcagatccagaagtttcctcgccaactcgcaaaccagaaacatttgtgagtcatttgaaccatgatgttcgtgctcatgaggatctagatgcattgagaagaatcaacccaccagatatcaggccacttcctcagggttcagattatctcgggttgtcgcctggaagctataatccagcaagtgcacatttggttccgccttacaagtttggaaatgctccttcatatctagaatctgaattagctcatcaaaagcatccacctgactcccacagggagatagcacatgacaagcagcagcaacacccagatgtattgccctcaagatggtcagataacatttacaatccaagtccaggttctggaaatttgaattatttggctgagagtgcgatcccacatacatcaactgataggacaccagaggcatactcatttgctcctcaaggagtaccaaaagtgagtacatcagggtatgcaccagttgcagatgaggcatcaaacatgtcctaccctcccatgcaacctgcatcacagcaggtagttagacctcaacaacctccatctctcccattatcgcttccaccagagcaacttgcacaattggccactcttcttgcacaacaaaaccaaccaggaaaagagcctgtggacagcttaaacaaagaatcaggattcatacggaatccacatggacattcttcaatgatgccacacagctcaggttctatccctgtccaaaactcattgccacctgctccgccatctgcatcacagttacaggttcatgcgccaccagttcaaggttcagtgccaccaaatccatccattatgcatacaccgaatgctcctatgccttctcacaacactttgcctttaccccctatgcatccttcgggaaatccagctcattcttccatgcctttgagatcgttcgtccctcctcttcctgaaggccctccaccccttaggcagcacacatcaagtgctctacaagcgcaacctgcacttccctctggaccacagactagccagcaaccgtctgctcaggaagaccatcacggagaccctcaaaagcgccttcaagcaacattgcaattggcagcaaccctacttcagcagatacagcaacaatctaaacctggtggccagaagtagatgcgaggtaattgtttgcctaaagatctcttttaatttctgtaccatttacacaagaatatgaatcattgtcctatttgaaccaaatcgtttatgccatcaatgtaattgctaaatggtttgtatattgtttaggagaaactcttgccttgtattgttcgtttggtcattgttttccaaacttttacatgataatcaaacatcaaggacattgcattatcatttttactcttaatgcctgtctttacacaagtgttgtatttctgtcacctgctagatagaattatgtttggaaccctggctgtcaattaaccagtgaatgaaatttcggttcaaaatttcagaaacaatttcattattttcgaaccccctggccagtcattctctcagccgaaattttccagtttttctctctttttttttaatttggtaaaagtttattcaaattcagtcaaattatgttaattttttcaaaaaaaaaaatcagtccaaaaagtgccgaaaatcctgaattttctggaatttcagtgctaccgaaatggctgagattttaagcgaaatcaaaagtgaaaaccctgttattaacatataaattttaaggggaaaagatatttgttgaagaagcaggatgcaatccctctctgtatgtgatacatttaattcgtctgagtatatatatattcgtaaactagtgggacttgggcaattatgagttggaactattttatttactttctcatgtttatgtagtaattgtggcaaaagcaggacaactttagtgagatatatttagtatgcttgatttaaactaaaaaattttcaatacatcatttgtgcttatgctgatgatattttcaaatgccatagtctgaacccgctcttcaatttcagcattccatgtcagtagtagaaacaagaaccacctttatttgctgcaatcaccacttacaacagttatattacctgtcatgacaggttaaggaaatttgcagcctgcaaggatcatatggtgatattttctccttattactgaagagcctgagagtctgaaactgctggtgggcacccatacctataccggatgttttgttaacataggttctgctatgaattagcattgcagtttaattttgaaagcttactcctaggtggcaaccacctccgttgtcttgtctgtataagattgcaccgttcatcttttctctctgtttttgtgttaatcaatgcatagacccatgaataccacttccctttttgcattcatacatcatgcattcgtctcatcgatgtgtcgtctctctgaaattccttttgcatgcttccgctgttcgcctgtatgttttttgacagtgtggtgtacgcctccattcatgaggaatactagtagtgtatactaccttcgtctcaaaataagtttactttgtacactgtctagattcatgtacaaaagcaaacttattttgggactaggtagtatatctcattgaatacaacaattttgtgggcagttattatgaactagactgtgaacagagcatcccaaaagatgtcctccgcaggtaagattgaagtgcaagaagagggaaatgcatatgccattctactgtctactgtactgaaacaagcttactgctatggaatttggagtactccctgggatgcctatccttcagattttattaaggggtttcccatgatgcaggggtgggagctttattaacctttgtgtgctgtaaattctttcactactttcagtgcacaccagctttatctctctgccatgtatggtctgtctgctaaagtgcatagcctatatatttgctgttactgcaaactttagcttgttaaaagtgttcatctgtagtatcagagttcagagttccatggaacagcattgcagcagccaatctttctcactttccttttttttatgtactattgttttaagtactcttggtctcaacccaatgatggccctatgtgtggcttcagtgctttgagatttatttaattctgctttgtttgctgaaagcaaggcaaattcgtacgggtgattcaggcgattgttgcctggtccttttttttatgagaggatttttatttatttatttcttgggtatgagaggaaacctagcagcaagccagaagttatggatataagattcttgcagaaatataaaattatggaggacatttttcgtccttcatatactgtacaaaacccttaaaaaaaaacaaggagaacgagtagacgacacatcaacgagaagctttcttgtacaaattgtgctgataatgttaggccgtttgaaacctaggaatttcatacgatgataatgcaaggaaatataaggagtagctttctatctttacaccaactataaatacatacagccatttaattttgcatatcatgatttgagccagttatacacttgcataactcaacgacggaaatggattctaatcctcgagggatgttccattgtcttccaaataattatgaaaaaaaattaaaaaaataagatagattaatgtgtcgagggatgttcactgttcttgcattgtcttccaaatattgcattgtcttccaaatagttatgaaaaaaattaaaaaaaatataagatagattaatgtgtgatatattactttacaaatatgcattcaaattcaatattcacaagttgtaacaaaaataataaattaagctctaattagtatacgtgtgctcactatcatatttgttttgcagaagtcaaatttagacgtgtacgttggcagagtgatataccatatattaatctatttatcaattttttctacttttatataaatatttgcatggagcatcaattggaatatccatgccaccctttcgaaactactacgatttcttcgtaagattatttcttaatctacattggttaggtaacttttcccaagctatttgttactctatccatcccataatataagggaccagattcatttcactataatgcgtcacatccacccaaaataccttatattatggaacagaggaagtggctttgtaatatataattttaattttaattaatttctataagcaactgtccatattttcgatcttaaaaactgcattgtaagctgaatttcgcccatcaatttaaattatatatttgtctatgatttgcctttttcaactttatatctcacattttagtgacatgtaataagtcgaagatcccaatccaattaggccattaacagcacacacatgtggcattcagcccaacccataacacgtaggagattcacgtagccaaacgaggtccatgtagccaaagctgggcgtgcattcttttgatgaaaagctatcatgcatcgcgggggagaacgatgcggccacgctgtggaagtcgtcgccttgcacttcgtggcatggtgcgacgcccccaccccacaccccgtgcgagatggtgggggtcgttgttggcgaggccaccaccctgagctcgatgggacaacgtcgacgccagagagagctgttgctgtgctggagagggagctcagggtggttggatccatgacggagatggttagatccatgccggagagtgagccttgttgtcgccgttgagctctttctcaccatcgccgacctgctgcccgtcgccccgtcagatccgttggggagagagagagagaggagagaggtgcgtgcagcggggtgagcggcgtcgataatggggaaaaggagagtggcactggttgtgggggataggggggacggcgccgcctcctgccaccgagctcccgctgtcccctgctaccgagccaccgacctcgccgtcccccgctaccgcgccaggccccgccgctggtcagaggaggagaggtggatccccgatggtgttgtcgctgctcggtccaccggtcggaggaggaggagaggtggagcctagctggcgctgttgtcgcttgggccgcgtcgctgccattctgctcagctccgtcgctagggagatgcttggcgttgccgccttgcttcctctccaccaaggaaaagacgttgagaaaggggaggaaaagtgaaggagtgatagtggtgggacccaccacaagtgatatgcattgtggagcatgtagcaaatacagttcttaggtggtgttcttttctcctgaagatgaagatgaagattaagattaagtttttaacgcaaaacgaggtggtattagcgtatgattgattgagttttaattattacaatcttgaaaatagattaatatgatattttagagcaactttcatatagaaaattttcacacaaaacgcaccgtttaacagtctgaaaagcgtaccatgaaaatcttaatttttatctaactcttattgaagagaagaacgggaccttagtctacgtggtgtgcaaggatcggtaaaaatctgtggcagactgctgttgctgagagaggccccgccgagaggagggcgtggccgcttgttgccctccatatgcaggtgggctgtcaatgtagagctccacgcgcggggaacatcacgccatgtcaccacccatgcgtgtgcatgcggaaaccggcgatggaacggcagcatctcatgcggcgtgaacgcatgatgatgcctcctgtactcctgtggccctgtgggggtggcgatcccaaacactgtaacgtctcctggttgcctaccaagtgccaactactatgtcccccctttggcagctttgttttgccttcttttttttagaagggaaaaaaatactcttcacctccatggtgggccccacatggatttgccatgaatatgatgaattttacaaaatactcaaaaatcccacatgaagtagttcgattttcatgtgaattcgcaaaaaatgtcatgcatgatatatgcttgctactccgtagaactcgctcgcaaaagtgttattgttgaggtttcgtgctgaatggttcgatggccgaatgatttctgataattatttgaaggtattaatgaataaattaaatattaggaaaaataaatttaaaaaaattctctaaaaacttgaaaaagccgtatcatttaggagctagagaattcatctatcattctattccttaaaaaaaacatggcataagatttatgcttgtcgcaaactaaacccagttcttccaacatcaaatatttttgacatgaggaagagatgcaacgttaaatatttacagcaccaacgaccctagggcaccgttcatattcatgggttattgggttatgacattgtttagcaactaggtggcattatcttatactctctccgttttctatttcaagttgtttgacttttttctaatcaaacttattttagtataactaaatttgtagaaaaatatagtattattctcaacacaaaacaaacatattatcaaactatactcaatgttagatttaatgaaactaatttcatatttaaatgttatttttttcgataaatttggtcaaacttaataaagtttgattagaaaaaaaaagtcaaacaacttataatatgaaatggagggattacaatattcggttattatggctgcacatctgcagtgcagcagcagtcctgatagaaagtttgttgggtcctatagcagaaatactcttccgaacacaaccataaattgttttgttctagaaaaatccgatataactcttattctagctacttcccttcaagtctggaacatatttttgtttgcctagaaatttaaaatgccccaaaaaaggaaatataaaccgggaatccttggcgtcgggcgctcgacgccagcaggaaaaatcgggcatctcggtcgcgtctcctccagcttacgcgttgcccccaccacgcaccctagcacatactccattgcaacaaatcatccacatattttggaaatcctcttttaaggaaatttgtttcattttttgttccaaaaaaaatatttcacctagtgtactcacaatgtttcactatgtatagatctaatgttgcagtgaattgaaatattcttttgcaacaaattacccacatattttgaaaaccctctattaatggaatttgtttcatgttttgttccacaaaaaatgtttcacctagtatacttataatgtttcactatgtatagatcaaatgttgcagtgaactgaaacattctttcgctatttgttgaaacattgtttttatataaggtgaaacaacgcccaatttaaatgaccgaaagattttcgatctaacaattccgatatacttggtggaacagcgcgcagcatataaaaataattcaataataagctaaaaaaaatttcgtcggaatatatccatgtgtgatcttgttttaaagatttaattgcaacgaatttaatggtgcaatcatatcatgatttggataaataatttaagaaaaaaaatagtttaatgtggttttgcacgtatgcgttatgctgacatcagcacccgatttttctctctcctcatcgggcgcccgatcctgagttgcctcaaaaataaactcatgaagttatctaaagggctgtttgggaaacagggacttattccaaatacctgtcacatcggatgtttggacactaatttgaagtattaaatatagactaattataaaacacattccataacattagactaattcgcgcgacgaattttttgagcctaaatacgccatgatttaataatatgatactacaataaacttttgataattatggattaattaggtttgaaaaattcgtctcgcagattagcttttatttataaaattagttttttattaatctatgcttattactctaaattacgtccaaatatccgatgtaacatgtacttaacaagttttagccccgtataaacactctcgaagggtagagcatcgattaactttctttcctgtactccatccagcaccattacaaactaaagttgatcgagtactactagtcactatagtacactactttgttgatccattagtgattgatgtaatattcaagcaaatcattaattagtactgatgcatcttatgtgtgtgcgtgagaaattaaatctctcaacgaatgtttgtatatgcaggcgcatgctgagctacctagtactggaatctgaacatgctgctccttttctttctttgattctagaatactgctcatctagttgtaacagaaaagtttgcaataactgaaatacagtaaaagttggtagatatcatcgatagtcagctgatcaatgaaggggatactaaaatttcccagatttttttttgaattaatgggtttcttttgtgtgtgtggttaatttcccagagtactgctggcttagtagtaccaaatttaatttactgactactccagaaagatcaacacttaacatactctagatcaattagctaggtagacatcaaaccatattaaccatataataataccactactttaacaaaactggcataaatacattttttgtaaggcaaaccagacgtgcctcaaatcacttttgcatgatactaggtgacaaccacaaaaaaaaattcagtgtttgcttgtgaaaacattttcacctgtataacaggtatacacctatatggcacagtgtatgtgtatgaactgttgtgtttttttcttcaaaaaggaaaaaagaactgttgtgctttgcttttccatttcataaaaaaatctaaaaagaaaatactcgtagataaccgtatttaggtattcttatatcggtaacaactactccctctgttttaggctataagacgttttgactttggtaaaagtcaaacggttttaagtttgaccaagtttatagaaaaaagtagtaacatttttaacccaagacaaatttattatgaaaatacattcaattattgatttgatgaaactaatttagtattataaatattattatatttatctataaacttagttaatcttgaaacagtttgattttgaccaaagtcaaaacatcttataacctgaaacggaggaagtcgacaacatattttgcattcaatatatattactccatccgttccaaacataagtaatttttgcatagtgtcaagttaaatatttttaactttaagtattaatgacaaaaaaataaaaaagatcaatcatgtaaaattgatattactagatctatcattaaacaaactatcatgtaactctttttatttaaaacattttattttatagacattgttggttaaagtagtatgtccaagttaaaaattacttatattttgagatggagtattttgagatggagggaggaggtcacttctattttcttgtaggcctcaacattccaacgtcgcaaagcatgcacgatgggcaatcatcaaggacagggaccttggatccaccatgcaatgtgccatgcaccttttgacctttaatttgcatgcatgattgccaagcaaatccccatatagagtttcatccgaaatagtttaaccagtgggtgaaatcatatacctacgactaattaacataaataaaaaataatttaacatagcttgtaaagtcatgtaccgataatccaatagctctgacaccacgtccaaggtgattatcctcggttcctcacaataagtgatttttgcagaactttataagattcaatttagtttctctgggaaattggaaaaaaaatataagagagtgtgtgtttagagacatgcctaatctagaagaaaaaacaacaatggcgttatatggggcctaattgttttcccaatttgtgatctcggacttgcttccacgcaagcagggtatggttaggtgggtttttccgttttcacgaaattcttccaaaattaaactatgtaagttggttagtagtatactagattatgtgaactaaagtcatttttatgggagacgcagatcagggccctactgataaactattcttggaatatgtgtcccccctgattaattataagagcaagtgagattattttagtagcaggtgcagctaagatttagccaaatctgcttgaaaaaaccgtgctttcagcaacctttctggttcaacacatgattaaaatagagaatgcatactaatttaacttttctagtaggaagatttctaaacatgacttattctgtcattaatggaacggattaaattgcttctttttcatgatgcttacaaagcaaaaggtcaggtaaagacatttattggtgcgtcacaaaatacagagttaacttaccagttaccagcaaattgccataaagaacattgaacactgaattgaccagtttttttacaggtgaacatttacttaaagcatgccaaaaagtgtactacttgtttaacataacacctaacataaacatgcagccccatcgtttagcttattcgagaaataagcgaaacaacatatttgcaaaccaaaaataatttattaataaaatttttatatatgtgttcttaatgatctaaaattaaggttgaaaaataaacttcgatgaaaaaaaaatcccaaaatcaactccaaatttaagtttaaaaattcaaattttgattaagcgaaaagataagtccgattgtgacattgttttcactgagggttatcagctccaacaactcttatctaaactcctcagcaaaatcggggaaaggctgaaagaaccacttaaactcagacagattaacacatttctatcatcgtatttccaaactaaaatccaactactgctcataagttcctatcacctttattattagtggtggagtttgagctaactttttaaagggaccaacagttaaaaggagaatgaaatacataatatttatgggaccattttacagtgtctccataatcctttgtcccgattcaacttggcctttatacattttaattttttttcacaatgcacaattgtttcatatacttgtaaaatggttgcaactaatccaacaacttcacttcaatgcctgcaccatatcttctgcaacttttaagccacttctgctgccatttgtctccttccctgtgactgaagttcttgaactgaaataaagaaaaagaaagtgttaaagatacaaacaaaaatactcctactcctaggctactcctccaagttgtagtaacagtaaaagtagaaaaataaaaaaagagaggaagaagttaaagcttgagctgaacatttggggcattgtgccaactctgactgcctgcctgagactgactgactggttaattgctctctgtgatggtatgggcggctgtgattttgccagggtcgttgatcaatcaccgtccgattgtatggtgtgtgtgattagtccaaggtagtcaagctgggcaggagtgagttgaggcttgtaaaaaaaaaaaaaggtttttaaattgttcctcccttgtccaaagtgaaaaggggagggggagggaccactttgaaagaaaaaaaagagcagctcagcaagcaatggcattttgcataaaggcccctggaggaataattggggatacacccccaagtgtgtatttatttggaaaggactctactttggatgaaatgtgcataggtttagcatacattacatctgtttttttaatatatgacgccgttgagtatttataaacgtttgtcttattcaattttttttgtgcaaatataaaaaacttaaatcatgcttaaagaacatttgatgacaaatcaagtcacaataaaataaatacttcctccgtttcatattataagattttctagcattacccacattattttttgtgtgcctagattcattaatatctatatgaatgtggacaatgctagaaagtcttataacctgaaacggaggaagtaatacttatattattttttgaataagatgaattttcaaacgtatcttaaaaatcaacgacaccatatattaaaaagggtgggagtattggttatgctcaacagaacatgcggaaataacttataatttatccattctatttgggaatttaaacttttgtttctatgagaaccatataaaattattgcaagctaaacaatgctaaattgctcagttgatcaggagttacccatgggccatgagtaagttataatccatatttcatatcatgcaatgatctaagttaattaataatataacataaattgggagctcggttggaacacatgatttccaaaacataaggattaaaaaaacataaaatttgcttgacacctcaaattctatggatgaaaaatagagaaaaaccatgaatcaaaagagagataaatatttttttctaagagattggacctcatgtttaaaaaaatcctccaaaatccctatgcttgaggcaatcttaaggaatttcataggattttggaacaagtattccattgtttcacataaacatgtacgtaaaaaaattcatagaatttgaaccctatataattcatccaaaattgctttgctccaaattagccctaaaagaaaaaaacactagcacataactacagataatgttagataaaagattatgttggcgagaaaagtcacatttacagctactagcaatatatttgtacatcacaatggaccatacagccgaggataaagccaatgcccaggagtgtgaatcgagcaaaaggttccaatccaaccgtttgttttaaccaactatttctatttagttttctatcactcaataattttcatggttttcttccgtggagacgtgttacacacctaagggaaggaagacgactacgctttttcagcacgagagaaatgacccttgtgctatcataattccttccacttggatggaccagaaaatccaaatgaggaaaatgacaagggctatactgcaaatctgctcacctcctacctagagagacagagagagagagagtccctcagctttgctgcgttgttcttacttcctcccatggagtacaaaaggcaacaagcagaaaacgttgcgttcacaccaccaccaccaaggaggccaggacagcaagaccaggcctgggctgtagctagctagctagcttgtagagaaagagagagaaacactggagctttagagagagagagagagagcaagaagagctgaagaggaggaggaagagctagctatcctatggtgctagctgtagctagctccgacgactgaggtgaggagacgcaatggcggggagatgcgccggcggcggcgacggcggcggcgagggcatgctggcgcggctgcggagggcggcagccaggcggatcgggctctcctgcgcctccttcttctcccacgccgccacctccccttccccgcctcccaagaccgtatgcattctctctctacatttcatagattttcttttcttttctaacggttcagatataatttagcagcaatttgttcttaagaaagagtccagctacccaaaatgcctcattttttttctgcattttggggtgtttcttcccagttggtagatgttcaagatacactaagaagggaaaaaaatgaggctgtttttttttcttttctgtggttaattaagttttgggattttgttttcaccatcaatgtatcggtttctggttgttcttggctttcagtttcttgctatgttttgggactgggcattttttgtctctctactaccatctgcaggtgattttcaagttcctttccttctagcagtaaaactcaatgagctgtcactgcctgtccttttcacctcccacattgcaaccctgcttgattctctccttccatttcagatgttgtttcatcaaaagcaaaaaagaaaaaaaaaggtctcccattgccacatctccttgcatttttttccaaaagagaaaaatctcctcccctagtggcctgctgcattgctgttttgcattttccaacagaaagatatgtcctggtttgttttggtgatcttggcctacaaaattttgtggttaaagttacatacgtttgaacatttaaactttgcttctcgttttttatacttttcttttgggcattctagaaatgagtatcttgcatgcccttctattttatctgtattctgtactgaagttccaaccagaatgaggtgtgtactccttttgcatttccccccttttcttgagtttgcgttgtgaacagtgtgctaacagtggctgtgtgtggcctacctggtttatttgatactgatcattcatttattggaattattgttctaggagtagctctcatccatcccatcttgtactagtatcctgagaaaaaagaattgcaatagggggggggggggtaccattcttgtggttcggtccatgtttatggtcccttcatttttctcccagagatctactttggatctacaattctagacatatatagtagtagtagtagtagtttgatgttaaaagctgtgaacaagttgtattttgggtttatttatacttgagatattttttttttgttgttgtttcagttgttggtgaaagttgtgcattctctctggtcttcgtacattttccacgtagaccgtctgttgatggttgttgcgaattgggcacatatttccacggagcttttatgtcttcccttttcctcaattttttttttaaaaatgggcatttatatttctttatcctcccgaagttgtgttttcttggaattggttatcatctttacatattgtccacttatcggtgcattgtactaccttgctaacaaactctagattaatatctttcttcagtaacttaactgttattagtgttaatgtgtaggcactaggcagtactgttactgtatgagatcagtgtgtggggactgaattgtgtgtctagattttctcgcttaacagttaccaaacattgtcgatgcccatgtgcattttatcatatcattgataggtaaataggaggggaaagtaccaaaatacactggaggagacaatcttgtttttcatttactttttctgatgtagaagcagattattctactagtcaagaacagtaggtattttgcctattagctgtattgcaatgtagtaacagattgtggtgtgtatgcagatctcatgctcagcactgaatgcgcctgcagacagcactgatgaagaccaggaaaagctggaggagcccactagcacaagaatggctgacaaggtgccatccctatgtccattttcctccttttcatgttctggaccacaactgcatggatccactatggagttttctatatgtaaatgtgtttctctaaccaagtagtataattatgtttatatttaacctcctattaacttgagaataaatcagagttatgcttgactgccatcaggaattaacaactgagcaagaagacaggctaaaaagaagaattgggttaagcggttgattgcaataggaaatattattgtttatatagattcctcagcgttgaaggttgttgatgctctagatgattacctctgaaataacctattctggttagccaaagtgtattgtcaaatgttgaatcatgatgatctagccaatgtggttagcgttttgccatttccacgactacatgttttgttttgaagaaaaaacagtgacgctattgtaagcattttcttaaaaaagtatgtaccaatttatttagtgaaaatgatgggttgcatggccatccactagcatctaccattgggccatataagcgttatgtttttttgttagtttcaataagttgggagctttagtactttttggtggcaattggtgaacaattatgtggtctcccagataacatgataattgtttccctagtgccacataaaggtacaaacaataacaggtaaataccttacgacacattgcaaccaacatgtcaatgcatcagtattacagaaatcttgaggaagacatgttctttttttatttgtctaacagagaatttggaatgtcggggctattggccatgcatattatgcatgatgccttctgcatgaattaattcatatgtaagtcatgatgcatataaatataatcagcttgtttgtttcagtagtacaagaatagttctgcaaagattgaaatgtagtttgtgaagattagcttcgattggatgcatgtttttggaattttttttgtttgctaacagaccatgaaaaattcatacaatgaataattaaaaaacaaaatatgtccgcgtcgtaataatcgatgaatagttctctgtccaggaattcgctctataatgagtagtttccattgttttataataagtgtagtgattcttttatggtaagttatttgatatgcgattttactttatactctcatctgatgtgtattctgataaataataccattaattgtaatattttattcaattcatttgcagaatctctgtgcaatatgtctggagcccctcagcaccggcagcgttgatattgacaatggtgacaggccagcaatcttcacatcacaatgctcccactccttccacttcctatgcatcgcctccaacattcggcacggcaatgttacatgtcccatctgccgtgcacagtggtctcagctgccgcgtgacttgaaggtgccaccattgctgcagaacaaccagtctgacccaatcctccgcatccttgatgacaacatcgcgacatctcgtttcaacagaaggtcatccatccgtgctgcccggtacaacgacgatgatccggttgagccttacaccttgaccgagcatgtggatccatgccttcgcttcgctctgatcccatccccagtggcggctcaccatcatgctctcggacattacccttgtggccgtgtgatgccactgcagcagcattgccagtacagcagctcctccatgctctcaccgccacagattgcttcaccaagtgggcagaggcgcgcttacctctccgtcagtctcgcgccacagccagccatggacctagttctggttgccagccctaatgggccacatctcaggctcctgaagcaggcaatggcgctggctgtcttctccatgcgcgcaattgaccggttagccattgtcacaaatgccaccactgcaacccgcgccttccccttgcgccgaatgtcatcccatggaaagcgaatggcattgcaggtcattgaacacctctgctgtgttggtggtactgatcctgtaggggcattgcagaagggcctgaagatactagaggaccgggcgcaccagaacccaagcagttgcattcttcacctgtcagaccatccaatccgaagctgtttcggggtcgacatgaaccgtttcaacatcccggttcaccagttccatgtcggcctcggtttcggggtgcagaatggctttgtgatgcacgagtttgaggagctcttagcgcggttgcttggcggtgtcataagcgacacccagctcaggattggcgagcacggtggagtggtgaggctaggtgagctgaggggtggcgaagagaggaggatcccgcttgacctggtgtcggactgcggcttcatacttgttggctatagctatctggaaggtggaagggaggatcagttcaggacaggcgaagtcgctgtcggtttcgaagagaaaggcgataaccggtactgcggggtcagggatgccggtggtctgagtatcggcggtgagaggaggagcagctgctgcgccgagagatgggactaccttgatccgttcatggcgcggcgatgggcgaagcatttcaatgtgtatagggcctgagttaaaaagagggggagcttggggctttgaagtgatcagctcagcaagtctggtttaccagtttgacagcatatgattcttgttggctctttattttttttttcctctcttaacattcctgcaagcatctcatgatcatcagaggaaatgtttgcttttttggcttttgttgtggatcagggatccatttgtaagatgtctggttttgcatcagatgtgtgcaatgtgcacaaggctttctgttctcaatctgtatgtgtgaatcggactgtgaacaaaactcagcacaaagaatgaaatatggctgcattggagtgagttattttaaaaagaaagtgacatgctgtttttcaaagaaatttaacaaatatgatgcgttatactagcaatttgcaggtttactggtctctgatatttcattgtaattattgagctgtcatttcttaaatttgattcatatttttttaagaggtttggtttcatattttcatgctcccttgtactcttacaaaacattgatgggttaatcaatcatcttaatcgagttgcccgggcgatggacgatcgactcctttggattccggattagaaggcagttatcataatttgaggaatcaattactcaaaattacatagagaattgtggcatggaaaaaggttaaaaaaaagaggtgccacgttatattattttggatttaaaagaacgtatggtcataaaactttgcgcccatagcacctgaggctcagtgccacatgatgcaaacatgcagttgttttttccctacgtagacaacaaaacatataggatttctgaaatttactctaacaaaaatatgggtctcgactctcgagtcacaaagtacaatacaattcagttcaagcggccaggacattaataaaattgaagttacaatcaggacccaaactgctgtcagaaatgcagatcagaactcggaaatcaatctacaatgaatagttggtgacggtaatctgctaaccatcagttatgtgctttcaaagccaaatattcggaaaacacctgcaaaaaaacaataaccggtaagagggttaattgaagctatttttataattaataccacttccattttggtttaactttctctcttgttgtgtactgagcagttgcagaattatatactataaatgaaacgcaagtctgaaacaagtgtatctgaagaaaatgaattcactatcttgtagcaagtcaaatgccaagctagacatttctttcatttggccgaactaaaatgagtgagcagcagcaattgtaccttcatcagcctggtacttgttcttgtcgtctcctgcgtaagccaggaggttgtacttggggttccattcaacactattcatagctgccttgcatggaatctgatgaatcgatcgtccagtttgaacattggcctgatcgaaggatagaaatgtaaaagaattattatttttggtaacagctagcttaggatcatattagaattacagtatgttgaactactcacaatgtcaatgaagggatcttcgctagcatatgcaagaaactctccagtatgattgaagctaactgttcttacaggccacctggaaaaagaacaaaaagaaaagatgaagaaagtacatgtttctaagcatcttgcaactgaaggtatactctaattaatctttgtttctttgaatgactatttccaatatgaggtgtggagaaaatagcaaaattagctaaacataactttttgtccaaatattcatggcaatattttagatacattggagagaaaaaaaaaggtatggtttaaaagcagcgaaacatactcgagtttggtaaaggttttaatgcaaaggagctctttgacatcccaaagactgacaagtgaatctgcacttccaacagcaaaatacctggcatcaacacattctgtaagtatccttgtcaaaatcattttaagctccatttagggctcaaagaaacaaaatattcaccagataattgagaacaaatgtacaatactttggcatagctacactaatgcatgaaacatgtttgtataccactatatccatgcgaacaagaacatgatacttttccacaataaattttgttgaggttcatgtagcagctcaaatctccaaacattaacatgaagacttgcaatggtgtatagcaaataatccattcttttacatggagtagaaggcaacaagtggcaaactattttgcaccctttcttttacatgctagtaaaggtgcctgttagttgcaacgggagatgggggaaggacgtgctattcagtttttctatcccagttttttaccagtggggcgtttttatatgtgggtccacttcttttggagggctgtttttttttttctgcgggtaaacaaaacttcactcctgataggaagcatgcacagacgaacgaaacttgcctttcagagtagtagagaaacactgaattcagtgtcccatttatatttaggcatgggtcatcatagaatcacttatggctaggtgctatcacaggtgagattcacttaaaggtagcttggacagaaagttcttttttttacatataccagtatcactatcaactgtcaaaagaccgagatagaatacaacattagtaatacccaaaatatagtatgtcaaataacttcactcatgcctatgctttatattaccttgaaataaaaaaaatcgttaactacataaaacaactagcatcagtataaggcattaagagaattagagttcaaagcgaagtcaaacagcatatagagaacctaatgattatagcataaagttcaaaagataatgtagttacaatgaaatgtcattggctgagatgtgagttgatgttgaacaaatgagcgaagacagaaaaaatcatcacctatcaaggggatccattccaatgcaataacaacccgctgtatgagcattcaatttgccaaccacatgaagggtgtcatcaagggaaggatcaccaaatacctcaacatttcctacataaacagcaaacaatgtaattacactgataccaactggtgtgatattgaaacttaaaacaacatatgggttttgtatcttaccaagtccagtagtgatgaagaataaatctccagttttgttccatgcaatctcatttatctgaggaacaacaaatcaataatttacttcagaaaagttaactgatctgaggagctatatgattcatttttatcagtagcaggtgtacgggcatttagctagttgaaatagaaaatttacaaaactgcaacataagtaatgcagcaaatgaaattaaagtacatcgaatagttaggtaattcacactcagtagtcagtactaattcaaataccagcaggcaattttcctgttccagacaaagatgcacatgctgccgacttatgcccactctactttttctcaaaaggtatatgactatatgtgcatgttcattcagagcagcgaaagattccaaaaggaagaagaaaattgctagaagaatgtttcaacaattcaaaccttcaagtggaaagtacctcataattaaacttaaatttgtgaagggcttttagcttccgaacatccactattgtcaactcatcctcctgcaaatcatagtgacagctgttactacacttgtacaattttataaaactagaactcacaaagtaaacacattggtgtacgcgggaccttgcgaactaacttgtaaactttataaaaataggtttactacaattattataaaatttacacaccactccccagtccccatgctcaataacactttactaactttgcatagcaaaaaaagtaaataattccatctaatttaggatcaatatgtatatattcaagtgtgtccatactgagctatgttgtattgatacttatacagagagcatgtcaaacacaagaatgaacattgcaatttagatgctaatttgccaaataactcatcactcaatctaatataaatcagattatagttacacatttctctttggaaagaattttataaattcctttcaaaatattgtaaccctcttctggcatgatatatgcaaatcaaaaccagttccttagtcataaatgactaccgttcttgaagttaacagggataacagcctaggcaatacataccttgtttccaacagctatttgagtaccaccatgtttataagtgatattgatgttttctccactaagttcgacgacttgacattttccacctggaaaagaacacgtcaaacagtttgagaaatagcgggtcaaataaataatataattttaaaaggcaaactgcaggcccaaatcttgtagagttataaatagagaatcaaaagtatgatgtacaatcctatgaaaaaaatcgaagtacaactaaaaaaattctgaaactaactttcaggtagagtcactacacaaaagaataagacatcttgtctggtaacaacaagttcattgtaaatggaacatagggattgaacaaagtgacaaaaagggattcatcaatttcagagagaagctgagaatgctgaacacaactgtggatatcttagttctttaaccttcaaagatgaagggaaccacttactccgtgcatcccagaggcgaattgacttgtcagcagctgctgtagcaactgtatcaggatgcttcggatcccagcagagctgatctacacaatctgtgtggcctttcaattcaatgtctttaaccttggactgtgcaatataaaaaccctaatcagcacagtactgacttggtacttccagggaaatagaaaccatctggggttttttcccctcctacgttccaaccaaaaatgtcttagtgttctcaaaacaatataatttagcttagaatttattttcctcaaaaccgcaggagggctgcgcttcctttcattaagaagaagaaataagtacaactgagggatccaaaagaacccctagctaagaaatcattcacaatttcacattaaatagctcaaacatatgtctcagagacacaggctatggtatgcttaagtgtgattactgtctgagtttctataattttaaattatacagcgggagatatttccaattaatcatcatgcttatctttcaaatttatagaaatgttcataaaaaaagggtgacagttattcatagtgaatgacaataaatgcgtttatctaataattccataataacaatgaaggttattttgtttgcaatcaggaaaggagagaatgtttacatggccatggggatcgatactccatacacgtgcagtatgatcaatagagcctgaagcaagcttcatgcctaggcagttccatgctacagagtgcacctaacagtaaaacaaaagatcagaattatacaaaatttaaggctgattatgtatgtaagatagataaaaaagaaggcaaaaagcgacagaaccagttaaatgctgcacctccatgtgtggaaggattatttagaaaaacaagaaacagaattcaagaaagaaacagagaaatatcgttgtactatgattctttctgcaagtaagatttttttttccctttgaattcttcccctcagaggagtagcaactttacaaagtcagacaagaagtcccttttcgtgaaaccaaattccttcaaaaattaggagtaattatgaccaggaatcatatttgacaatgcgctcattcaccagctcccagaaggaaagcaaccaaccaaagcttcattcaatctcaacatggcttagccctagagcaaaagaatcagcatatatacggcatgaacgcgaggaatcaatcactatatcctgctctagaattagaaacaaaaccgtacgtgtgaaccaaagatggatgcattttcgtcctaatttttgcttgtaacatccggattttagggcttccccctcgcaggacttttgagggtttaggacctcatgagaaaaaaacttatccccgcgtaggattggtgaggggggaatcgaaaaggttaccttcttcttgtggccgaaatactccctcgacaccaggttcttcaggttcatccccggcgtcgagcttccgccaccgccgccccgccgtctgtcgtcttctttcccctccattgtccccgcggactggggcacgggtctggttttgctattccccactcaccgcgtcacgaggcgcaaggcggcggcggcggtggcggtggcggcggcggcgggcgcgagacggaggagggagagccggggacggcgtcggcggggaagaggagagggttttcgcagaaacgtccttctacttttttgtttattcatgccacaagttcatgcgttatccttaccatggagccatggacacatcctttggtttttgtttaattgaatccatgccattgtaaatataccgataaatgttattacaattcgtcttttttaattgtgacattgaaattttataaaattagaaccatgccactatagtaatattttccatccatcttcgtcttcttagattcatctttcccctctttttttttctcatctctctccaccacctctttggaggggacagccgctgcggctgttggcaactttttgtgacaagtcgacaattacgatcgcagcacctaaacgccttgcggtgatatggagtcgccaaccacctcgatctagccaaacggccaaatcaagatgggttttgtagaaaaacagctaaaccggctagcggagccgatttagagatcaaaaatcagcctctaagccgatttagatcgatatgaggataactaacctgtctcataggcaatacggaaggttttcaggacaaatctacaaagaggtgtcgcactctcgcagcggcggcggacggtttacggcgcaaaccgacaaagatggattaaaactagggtaaaatagaaaacatggtaaaagaacgattcaagtaaattgtattcgggggttttacaatgaaccggccttgtcccttaaataggggttggtcttaccctctacaggcccttctccatatccaactcgggatagaaaccaaaggaaacacgaaacctaccttcccaggcaaggaaacccgagacccgacgaaaacaaactcggactcggaccctgacggtttgaccgcccacatacctgcggtcagaccggccctactagacggtcagaccgcccacacacctgtggtctaaccggccctgtgaaggaaacccgtcactttccaaactttggcaattttcctctatttcgtccataggtgccaaatttgggtgtaaacacatgcccccctgccttttttgtaaacatacgtgaacctaaaagcatagaacatgttatgtcagggtgataatccaattaccgcccataggacttcctaagcatcttgccaaatgctcgggaaatatttcttcaagtatttcccattaattgctctctgaaaacaccgtcttgaagtgtcttcatctccttcaaagtctttaaacgcttgtcgatgacgtctttaaaattgtttcccatcaaggtcttgtaatcttcaaccgacaagtcgtcttgcttgaaataccgaagagagccaagatttaccccaactggcaaaacgacaatttcaacaatgttttattactcaactcggcttatccattagcctgagcgtagtaaagagaagaactcatcaacttaatagcataagattcggcaaaacttctcactccgtacaagtaatattctcgagcggcacggcttcggcccacttagtgaagtaatccattgcaactagcacgaaccaacgcccttttgatgacgaaggataaatttgaccaatgaaatccaaagctcaacctcagaacggccatactttaatgataggattcaacacagcggtaggcgctaattgaacattgccgatccgttaacaagcttcactccctctataacatttgaaacaatcatcaattattttcggccaatgaaaccacactctcctaagcaaccaatttatcttacgggccgattgatgaatttcacaaatcccttcatgtactactctcctagcaactttaaactgatcattatctaagtaatactccatctatttttcggcgatataatatttgagcgcttgccgccgaatcttctgatcaaccttaagtgtaggatcttcaaatatctaatcgaaggaattctccaagctatttctaactcatgggcacaaatgtccgaattcacaattaattcggccttttaatcaattgtaacgtgccccccagctctcggcccgctatcggtcagaccggccacgcaatgccggtcagaccaccctgtctgtccggtcagaccggccatgtagagccggtcagaccggccgtgcaatgccggttagaccatcctaggtctatgactttgccaatttcgtccaaacttttgaaatcaagcatcggcctttagtatataatttttcttcacataatagccaaatgcttggtgtatcaaattattggaccaaaattccttctctctagatatatgaaaaattataacattcaactaatatgtctagatgaatactaattcaattggcttttgaaacaataatcatcatggcatcacaacacttagccaattgaagtatgatcaataatgaatcaccaaagtcatatgtgccacatgcatagattccaataaactaaaaatgtaagtaatcggcttgagcatgtatgcaaaatattaataatgccaatgttcctaaatacaataactctagaacaaatcatgacactgaccattgacattagccgaattactaataggcaaaactttcatggtgcaataaatatgaaatctatatcttatatggtgatccataaaaagacatatgatttggctttaaataaatatcaaagagtcatgagccaagtcatacttcaaacaaattatatgccaacctaccaattctactacctagaactggcattcgcaacatgtatgtataatatcaatttgataagcaaaaacacacatgtgctagatagcaagcaatgttctaacatggcataggcgtataatataacattgaacacaataaacccataccttgccttagcatctaacaaacggcggctcaaagatgtgatgttgtatccatcgccgttcatcttctcttggttccctcataaacataataatgtcttgccccctaagcaaaatcggctttctcgactgcacgatttcgaaggcaagacgaacaccgcaccaacatccacagcatcatgtgaaggagacttatctctaatgaccgatgattcttctctcatgaaattggatttatcactactatgggaaatcaccggtctcttaacttttacttctttaggtctccacactcgcttaggtgtcgttcgaggatctaaattgttatatgttttgttctccacatcttcggcctccttttccttttgacctatggcctggagacgctgtagcctcctcttttgagagcgagataggccagaaggtatccacttcggctgtggttgttttccaggagctaagcaatgattcttcatatttttggtcgaagtggaagatcctatgttgttctcaattttcccactcttctccaatgctccccggtcagaccggccacaagccgtcagtcagaccggccagtaaggtcggtcagaccggccgtagactggcggttagaccggccagctgtctcggttagaccaccaatgttgatagtcacggcgtcggcttcgatctcctttgcttgcgtggtttccaccgtatctccagtaagtacatgaacatcttgagactcctctttgacagcaatgacccccggagctttggcttctttcctcacccacaccttcttcacctttttcacctttgatccaccgaaccgattcttttgtgggaaatagtcttgtcttgaattagatgaatgatttggcactgtcctaggtgattccttccatccttgacaatacggcataggtggttgatgcatccatggcatataatacaaaaaaggataaccatatagtgacattggatatggataccatggcatcacaaccggaggtttatatggagttggtatggttgatggctccgattgctttgatgtttgaccaaatctcttcctatgagatgatcttggtcttttcgaatcactagtttagttatcaaatcgttgaccagctaatcctttcttgtatttagccataagcatctcaaaagtgagcttcggctttttagtcttttgggaactagatgactcatcttttgtaaccttacgatcttcagcctttgcattattgatcctattcttgggccgaggatccccaatagcaacacttttccctttctttttgtcaacaccaataggactagtagggagagaactattaacaattccggtcttaggcataggtgtaaccgaaatagtttcacaagtgaccgatgaagtatcattcggtctttactccatcaagcttgcatctctgaaataatcatgaaactcatactccatttgtgaccatgtagaaattgaactaggagcaagcaaactataccatgtagatgcaaagtttgacaaagaaaggggaaacaacttcaacttaagcaaatcatcactaccggccttaccacattgatcaataaagcgaccgatatgctccattgtagtcatagcattctcatctgtgaatttcgtgaagttgggcacctcaaatccttgcaggtatgggaccgaatctacgtgtttaggatacagtctttgatatgtatgcatagctactttggattctatttcaccactatcccgcaagacattgtcatcatcttttccaacatccacatgaccgatttgtgactcggtcttaggtgataatgctatttcactttcgcttgtgatataacctgaaccgtcacttagttcggctatattttcaatgatgctattttctaagctagcaacacaatccgaaccattacttggttcggctattccatcgttgtctaaactagtaacacaatccgagccaacacttggtttggctataatggttgttgcattatcatccaagctagtaagacaattcggaccaacatttgattcggctatacttgtcacgacatcattgcacaaattattaacacaacccgaaccatcgcttggttcggctatacatgatattacactttcatctaaactagcttgtaagctattgtcatccactcggctttcctgagccaaagcttcatgcaacacatgatcaacatcaagaaatatttggccattcaatctctttttaatagaatcaagcaatccatcatatgcaatgttggccaaatctttgtcaattattttcaaactaaaacatcggcttttaatatctctgaacctttcaatataatcagcgatagattcattgtatttttacctaaccgatgttaaatcagacaacctaagctcagtgttaccagtgcaaaaatgatcatgaaatttttgttctaattgagcccaagtataaatagaatttgccggtaaagaagtaaaccatgtaaaagcagtaccggacaaagataaagaaaacaagcgcaatttaaaagtatcactattagcctcaccacattgcgctaaaaattgacctacatgctcccatatggtccaactatcctcagcactaaatttggtaaattcgggaactctataaccacgaggatatggcacattatcataataattaggatacgacttttggtaaatcttagcatgattcctaatttcaatcccgaatttctccctaataatctcactaattatttcctccatattatcaggcctatattgatttggtggtggatttggtggcctaataggttgtgtttgtggcgcaatatgattatattggtcttgcctagtatcgggaggatatcccctattagtatcattgtagacattagggatatgtggagtagcatgggtaacagtattaacaggtgatgaataataattaaaatcaatactgctagtcgtggtatgaaaacctggagaaattcccagggaaccggtctgaccggctatagatagcctggtctgaccggccaatcacccggtctgaccgacccatggcccggtctgatcggtggtcaatggtgcggtcagaccggctacaggaggcccgatctggccaaaatagggcacggtttgactggctatagtagatacggtctgaccggcataaggtgcggttagaccggtgtcacgaccggtcataccattagctaggttttccatatagccgattcctatttaatcggctgtataatcacccattgacccccatagcattataagcatattgtataggagcaaaactaaaagtagcatatgcatctacacaatgattattaaccttttgaatagcaaagtatgggttgggtgaatcggaggttacctttggtgaagctacaacttgaggtagcgggacgtttcctttcacgacgccttgatcggttctaatgtattgtgtagtaatattattgaacccgttccctctcgttatagttgatgaagaaattccttgattaaatccggccatatagctcatagccaaaaatcgttgacagaatatattaatatacagtcttagttttccttgtaatgctactgtacttagcaaaagattggagaaattgaaccttcacagaaataaccgatacagtaggaatcggctttgttgttgttgtttttttttttgttgtttttatgtgaacagaagtagatcggcttagatagcctgatctttttttagcacgtgcacagtaccagctttgatcaatcaaatctttctgttgccgtgtgaagcaaaaaggaaacaatgttgctaatccggccgctgctccctgtgtgaacacagtttaacgtctagccgtgaccgaacagaacaattaagcttgaagacaaaaccaatgtcggcgacaataataattacagtgtaagttaattccggctgtttagccgaaactaattcgatgattcgacgaaagagtaattattagattaaacgaaattcggccctagtatggccgattagatcgttccccagcggagtcgccaaaaattgtgttgataactttttgtgacaagtcgacaattacgatcgcagcacctaaacgccttgcggtgatatggagtcgccaaccacctcgatctagccaaatggccaaatcaagataggttttgtagaaaaacagctaaaccggttagcggagccgatttagagatcaaaaatcagcctctaagccgatttagatcgatatgaggataactaacctgtctcataggcaaaacggaaggttttcaggacaaatctacaaagaggtgtcgcactctcgcagcggcggcggacggtttacggcgcaaaccgacaaagatggattaaaactagggtaaaataaaaaacatagtaaaagaacgattcaagtgaattgtatttgggggttttacaatgaaccggccttgtcccttaaatagaggttggtcttgccctctacaggcccttctccacgtccaactcgggatagaaaccaaaggaaacacaaaacctaccttcccgggcaaagaaacccgagacccgatgaaaacaaactcggactcagaccttgacggtctgaccgcccacatacttgcggtcagaccggccctactagccggtcagaccgcccacacacctgtggtctgaccggccctgtgaaggaaacccgtcagttttcaaactttgataattttcctctatttcgtccataggtgctaaatttgggtgtaaacagcggccatctcctcctccccccacagccacagggagctgctgcgagaagcaacaatcatcatctatcaccagcaacaagttggcagatacgtagatcagggcacattaatcgtcaccagatcaggtaaacaaaaacaacagagaggaggggtgagggatcatgtcggctacaagagaagggaagaaccaaatatttttctccttttcctctttcaccaacgacgggatatgttctagccttagctcgtcgttgtcgtagacacaaccaacgtcgccgacgccgacgccgataggcggcaggttgaggtcaaactgaaacgtgagctgacacgacagtgaggcggtggcgtccgtgcagtcctcatcaaccatcgacgccgacaacccgcaatcattgtggcagtcaccatcaaggatctacgatggcgaaagccgtggaaggagcaccggtcgcggcctggtgccgaatgactcaatggtggagctaaggctggtggtggctggcctagctagcgatggcagcggagtagggtgggtaggtgaggtggtggtggtggtgctgatggtggtggagctggggctgggcgtgagggagggagagagtgaagttggtcttggccttgggacccggagcgcccgcgctgccacatcgtaggcccgcgcagcgtcgtaggcctatgtgtcttcctcggcggagtcataggtttccagccacacccgcgccttcttcaccgggtcacagatcaccgccatgtaccgcccccatggccgcttctgcaccccgcgaaaccgcgtgcacctcccgccggtggtggagagagatgaggaaagaaaaaaaaaagatgatggagaaagaagatgaatctgatgagtgggtcccatttgcagatgaggaagaagctggaggtggatggaaaatatgatgatagtggcacggttctaattttgtaaaattttaatgacacagctacgaatagataaattatagtggtatttatttaaatttgtatatttacaatggcatggatcatattaaccctttgttttttcaaagcaagaaccaaacatgagaaatatctgaaaatggttggaccaagaattgtcatagtccaccttaattagtacaggtggggactttaagtattaggcaaaaataaaagccacaaactatatacaactccatgatgtagatacatgtacaaaacactacaagcactggacactagtacctaaaaaacatgttaatgcattttttgaaatattttaactaagttaaagttgtttggaggtgtagccttaatatgtttcttggtgacatgctgatacctggcatgcgtcattacgatgtctttgcaaagtcatcaaatcatcttgaccatgacctcatgttctaccaaaccactatcagggaccttccaaaactgaactgcaagtccacaataagagctagctacgcctcccacaactttaaccatttactgaaaaaaagagatggcatagtagaaacagaagctaggctatgttggaacctgtgggttcctaacccacctctcttgcacgaaaaatgaggtagttcattagtacatgattaattaaatactagtgatttttttaaaaaaatagattaatatttttttaaaaaaatctttcatatataacattgttaaaaagcacaccgtttagcggttcaggaaaccgtggaaaacgaaaaagtagaagttgggaaatgggatgttcgaacacggcctaatccaagtttgagttgctcatggtaagggcaatagtagtgcgccatagttttttttttttgctggtcctcacataccacgtagactaagaaccatatttgctacatgctctacagtgcaggtcacttgtggtgggtctcagcactatctctccttcacttttcatcccctctccttcacttttcatcactttgcatgtttgccttttccagttttccctagcatagaggaagcaaggtggtagcgtcggattgtctctggggacaaagccaagcagagcggtggcggcatggccgaagcagcgacggtggctccacctctcctcctcctccgaccggtggcccaagcgggggacggcgcggcaggagctcgctggcgcgagggggggatggtgcagcgggagctcagcggggttaatctggcggcacggtcgaagctgtgatagcgccggtggggctccacctctcctcttcctcctccgaccggcagcccaagcaggggagggcgcggcaggagctcgccggcgcgtgagggggggacggcgcggtcctctccgtcgagctgccgttgctgtggtactcagtggcacggaacggcgacgacaacgaggttaggtcatcagatccaccacctcttcttcctcctccgccgccgccccgacaagctcgccagatctagcctcgggttcgctggatctagcgagcgacaccactttgtgggcaatgcacctgctcggggtggtagcctcatcggcaaccggcgccgcctcgaatgagatgtgggggcgcacattaggacacagcatctctcaatgcgccacgccacccgtgcctgcaacttctgacgaagaatgagtgacttgttttgaccccgtagtcttgacttgacaacgccacgcacgtagctggggaggaatctcctacgtggacggttggggcagaacgacacatcagtacactgtgaacgcccttacagctcaaccaccccccccaaataggaaactactgcttccccctcttatagttttttctaattaagaaaatttttttctcgattcccgttagtacgctttttaaactgttaaacggtgtattttgtgtgaaaactttctatatagaagttgctttaaaaatatcaaacaaactcatttttcaaatttataataattaaaaataaattaatcacactttaatggttttctcgttttgcatgtcctaacttaatattcatcttcattagattcaaacaggacttgtcctctttgcaacagctcggatttagatttttctttagggctgggtatttctgtttttatatatctatggatttagatctaccatctaccatcacattgataatatttgaataaattattttgtacccattttatgtgtaatttaaaattttatattactataatctaacctataaaattcaaatttaccgtggatccaagatctagagttgtatcaaataggaccttaaagaaataaaatgtaggaattttaggtatgggaaataaatcctatgaaagtccttttgaaacaaatgggttgatccctacccaaatccttaaaaatttctatgtaattatatactctagaggaatgttgaagaaaaataaatgtggttttacctcttgttttcttcttattgtggctagagttcatgcatttttatggagagaatcccttatacaccgctctaaattggccagttcctttatatgctactcaaaattggcttcttacttttatgccactggttcaagtttttcatccttttatgtcactcccagcacggtagcatttgttgacggtaagttagatgttagtttttttcgtaaatgaccaatatgccctctcaactaaataatatgtaaacttcaaaaattcataactaatttattttaaatcctttttgagtgaacaaaattttgtcagaactagtgaaaaatttgctttgtattaaaaatattgttggaaagctgcatgttttatgcttatattgaaaattcatttgtgatggtgatgactaaaattgtacttgataataaaaaaatcaattttcatatgttgtatctagtagctatcttggtactaaaatgctatacatatatcaaccaatttctctatcaaatgaaaaatacctatcattggttgtataccaattctcaagggcaaatgcatctttttactatgaagttaacggtcaactagcggtggagtgacaacaatggtataaaagagaggacaaacttgaaacggtggcatagaagggaggagccaatttgaagtggcatataagtgattctctcgtttttatgtgtcaatcaaattacaattatgaaaaattattttgctatgaaattccatggaaatgcaacggtcatgacattttatcctccattcttttctatctatatgtttcaataatattatgtttcaaaggaacccccctaatcattgcctttatgatgtgagaaactatagggtgttatgagaaatcttttgttctaatttgaagttttgaacgggcaccagagtttgcaacattcaaatatttatgaagtagagtttattttgtcacataactaaatttttaattaagtgtagataggccaacgacatctaaatcaacatgatgcctattgtttttttctaatccttcgataaaactatctttatttatataaatatgctataggactatataaagtaggctcttagctaaatttaactcttattgcgtaaccatcaccattgacatgtccgggatcgatgatagggttattggcatactaagagtaggatcaatgttaccatccattgtataacgctccgcttttcgtgagacgttaaaaactagtttgagaaaaatcctatatgcgaaaattccgttcactgtgtgagagtctaagtcgtgccgtggatctcaattcaaatccgtccttgttccctgtcaccgccatcaaaaatcatccacctcaagatttcaacttccgaaatcaaacatcggaattcaatcccgtccttgaactccttgccaatatttctcccgattccgagaatgtcaaatccgtccttgaaatcctccctgtccatcgattgatctatccacttatctaacctatctatccatctatccatctacttatctgtctacctatcgatctacctacccagctgtctatctatctattgatctatctaactacctttgaatccttgccaaatattcgccctgactccaaaaataaccaaattcccattttgaattcattctccaaatccaaatctctctaaatcaatctttcagaaaaagtctattttgcctccctctggtttgtggaccgttttcctcctcggcccatcccctctcggctgctccttctcctcctcccctcgctcgtgcgttgcacacagccgagccgagagagagcgccgcgctcgctctcttcacttagctcgtcctctctctctccgtttctctctcccgtcgaagctcccccaccggcgccggttcccgccgccgccttttcgaatttcgctgtgcccttgcatagcgcgcgcgctcgctcgtgcatggccgaccgcccggtcgccgccgcgtcagccctggccgcctgcgccgcgcagcagcccatgccgccctgccactcgctccacctgtgcgcgcatgcgtccaagacatggaggcagagcctcggctcccctctctcacgcgctctccctcctccctctgctcgcccaaatcggtggctcctttcccctccccttttgctttttccctctcagcccggccgcccgtgaccacctcctgccgctccttgaccgcaagcgccgcgccagccgagctcccttgaccacctaagtcggtttcctcccccaaaaccgacttcccgtgcctataaaaccgcagccgagctcctcctctcaacccctctcgcttcactctccacgctgccgcgccattgtcgcccctgccttgcagttgccctcgccgtccgtcgccgaagcaccagggagaccggtgcgtgcgaaggacgcgagaagaggactccgagcgccgtcatcttccccttccccggcccaaggccggagagctcgctcccgcaccgtcggtcacccatcacagcgcccatctcgactcggtagtgcctctctccgttctactttctcgctcgccctctccctcttttggctcgcacggtagcttggtagccctcccgaacgcgcgtagacaaagccccaattcccgccgccgcccggaatggcctcgccgctattgccgcccgttccggggagccgccgctcatcgccggcctccctcggggcccctccgtcccatccggcaccggaaatgaattccttgcaccccggagatactctcgccaccttgaatcgacctctcatcgccccgccacgatttccccttttgctcgccgccggccgccgccgtcgctatccgccgcccttgacctctcccggcgaaatccgagccgttggctcgcctcctctcgcgtctatcttcgctccggtggtctcccctccttccgccgtgcctcgcgccgctccgccgacgcgcgccgccgcccgccgtccatccggccggccttcgtcttcctcctctggccattcgacgcagccgccacgttggcaccacg

SEQ ID NO: 83391 - DNA, 3353 bp, Oryza sativa
gccttagctaatctaatctagtaatacaatttagccgataccggcagaaaccctaaagcgagagacaaccgatagagctaaattgggatactaaggtggtgtttgaatttcctgaagataaagatgaagatgaagataaagattaagtgtttcacgtaaaacgatgtggtaataacgtgtgattaattgagttttaattattataaacttgaaaaatggattagtctgatattttagagcaactttcatatataaagttttcgcacgaaacacgtcgtttagcagtttgaaaagcgtgcaacgagtatccaaaatttaatcctgtgcatgcagaagaaacgaacagggctttaagactagattaactgaaacatatgataaataggcaggcaaatatattaatcaaatcagagcaatccaagaagtccaatgtactgatgctgaacggcgccaatgtaaccaacacaattgcctgggccggtggaatattggacttaccccttctgctctgataaaaagtaaaaaaggtaaaaggtagcgatgcgccgaattgtatttgatcatggagatagtttacaatgactctgggtacatatatttatacccatggggaaatactagtccttacaggacaagaaagaaacatttctaaaaaaataaaaggaaaacataaagtacttatgggacacttgaactcggtcacttctgtataagctattaattttcttaaccgaatatagcaggaatccgactattggcggcgtgataattctcttaggggcttaccaaatttcactgttaacaacggcccattaatgaaataaattggaaatgaattataaaagaaagtgaacactcactccatgaattattagtgacggcggccgataaaagaaagtgaaccttcactcatattgaaataaaaaaaatattagttttaagacggcgggcaaaaaaagaaagtgaaccttcactcatagtatgttgaaataaaaaagtgaaacatcttctcagtctctatgggggcaattaacttaaaataaaattaaaacgaatcatcaccttaagcatcatgttgcaatgaaatttaaacattgtctcaagctcaattagtgaaataaactgaaaagcatttattatgggtaaaataaacttaaaatcatttgatatgggaaatacaaataactaaaacatcacctcaagctacaatcatctcaagcatatgttgaaataaggttttatatattttcatacaacccgtcactaattacaagtaatatgagaagagatgatgctattaatatttagctgaaatatgaatggaaagggaatcttccaaaaaggttgtcatccaagtgagatcaaaatagtttgcaatggtggtagcacgcaaaatattgtcaagatctcctaaagatagttatagaagtatttgaattgttattttatatgaataatatatatgaatagctcatagtccatattgccgatgagttagatgccctctgtattaatctatgcagttttttctaatatcccatcaactaattttcagttcttttgatatatgactagccgctatcctttgcatatataggtataccgttgcattgctagctcaatagagagcgaccacaaccttatatacacacacccgtttatatatacacccgtttacctaaaccatgtcatgactcatgcaactcagattgttgatcatgcgattgtgcggagatcacggtgtcacgcaaatgaaaaaacctcatcaacgcgaaaggcccgaaggatgaaagtcggaatatatatattttctacgtctctcatatcaggggaaggctggacccgtacgtgacactctgcttgattgtctgctccctctcgcgacactagccgtcctatgcaataaaatggatcggtatgcatgcttagcttgagcagataaattacacatcttcagttcctaagaaactattggattatcctttggaactcaagttgctatgctgggtaagaggagtagatatcctttgggtgtgctacaacattctcgccggtcatttaatgttacgatagaggagcatgatactatgcttttagagttggtagtcaaggctcttttattccgttttattctgttttgtgggtgacagtatatatatgcttacttgttagaatctagtaagtgattgttttaagtgtatcagttggtttctttcttaggttaggaaggtagggattttccccgttacctactatcttactccctccgccccataatataaaagattttggtttttttgactatacaattgatgcataaccaaaatctcttatattatggggcggaggtaatattattcagttaaaaaaacttgttggttgtgtgtcatatggcaaaagtggaggatgtaatatattttcattactggaaaaaattgcccgtgcgttgcaacgggtgaatgctattttaatcttattattattcactgtgaaattctctatgagaattcgcttggatatatgtttttctataacatcatgccaagttagcatgcaagttttttttacagatatttcttatacgattccttctgtatttccaatagcgaacgaatttaaaacccgacttaaatatggatctgtatttccaaaaacaaatgaacttaaaaaccgtctcatacatggatgacgtaccaaagtaccaataaaaatgttttaagattggaaaaaaatgtacatggtccccataacaacaagctgagctctctagatgataccgcaccgttgttgcttaatttaactcacgtgattatttttataaaaaaatagctggtttaaaacaatagtaaaaaataaatttatcaactgcacctaatatccgtcctcgtaaatataactcaaatgaacaaaaaaaaaatcatttcaggctatcatagggaagtgaggtatatgatatttatttctctgtctttatttatttaatacataaaagtatgtaaataaattgcgtcaatatcaatcaatttagaactcatctttttagcaacagtttttcaagatttgcttttaaaaaaagagagcccttaaaactttaattaaaaaacaaaaacaccatactttttaatttacaattaatttgttagacatgttttatacataaactaaagctccattagatagtatgggttgcgaagtgaacataactcaactggttaggttctttgtagtggaaccagcccacccgggttcaaatcctagatttgacataggtgctcgcatttacggctaattattctttcagtggtagggttcaaattctagatttgacacgggtgctcgcatttacggctaat

SEQ ID NO: 83392 - DNA, 2593 bp, Oryza sativa
gcaattaccctgcaggcttttttattatacattatatcttttagttgtacagtggtattcattacaacagatttttttcacactgtataagttgatgttaccattgcttggacagcgttattcattcctacctgtaaagctatttttgattgataagatctaggggtacaatcaatatgaaaagaacttaacatagacaaaattcagttttggtgtagatcaatatttcaaatggttatgaactacagagtgctaaatatatcccctttagtgctgtttttttattaaaaaaaaatcgttggctaatatctggttggtgtacgtatatatccctctctaggtgatcaagagggtacggcaggaagtacttcaaggctgcaaactagtgtttacgcgtgtattcccgttacatcagcgccaacaagatcagatgatctggaagatggccgagcagttgggtgccgtttgctgcacagatgtggattctacggtcacccatgttgttgctttggatctaggaacggagaaggctcgctgggctgttagtaacaagaagtttttggtccacccccgctggattgaggccgcaaatttccgatggcaacggcaacaagaggaggattttcctgtagctcgaccaaaggagaagggtaaagaaaatgccgctgatgctcctatctcaaaggagaacggtgacaaaaatgccgctgatgctgctaacgcaaagaagggtaacgaaaatgtcgctgatgctggtagcacaaaggaggggagtaaagaaaatgctgatgatgctgctaactcagaggaggagtaaagaaaatgctgatgatgctgctaacgcagagaagagtaaatctgatggtgctgccagcggtgcaactggctcgtaaccagcttataccttttgtaaaccgttgcggacattgctgtagctgcgaacctacattaggatacgtactcttgcgaaatagaaattgtggctagtttgaatcggactgtgcggatgatggtgttatggtacatgtgagatttttcctactgatctgggcctccagccatatactttagttgacagtttctgttttgaagatctgtgctagtaacatgggtacccatagaccagtgatctcctttcagtaggtgttgatttctctaaacaccacaattatacatttactcaatgattgggagaccaaaaatagtgcaaatgcaataattatccactgaaagaaaggtgcaccagaaggctatcatgtctttgggatcaaccataacatacatgatgtcaaatgctagccaacagagtcttaggttagtcggtctcttttagaaacaaagcaagaaagaaatgccactcacccgtggctctcatgatttactcttactttcccacgaatgcgacggtggcacagaaattcacatcatcttatcctacacccttttaggcctgtttgtcttatcgtcaaagctctcaggaaaaggtgtaaagcatctcttgtccgtgaattctgcgacggtgacatcaaacatgcgcaatcctacccccattgttgtcaaaggaggttgcatgaatctagattcccctgctcagtcagagaccgaaaccatcatcgtcattatcctgaactctggcaggagttcatttcaacctgcaacatctctcgactagtcaccaccagctcagtccatgtcatctggcaccgggccggtagacgaaccaaggccacaaatgccgcagagaaccacaactccacaagtcccaacaggtactatacgcatgcgcattattggggggtggcacagactcgacgacatgtgtgagatgcgtgtactactccttctgactactgtgatgatctgcaacgccacacgttgccacgagcatctctgcagcaggagtagtaggaggaggacgacgacacggagccgcgctgctggatccatcggaaatccgagccggcgccccaggctagtaccgcagctgctgacctttcttggacaggaaaggccaaaaaccgatcgcccacatgtgacctctggtcgcgctgctcccgctgttcccgtcacacggtcacgcgctccgcgcccccccgtcgacccggcgaccgacctccccctcccccccgcgcgaacgccgcctgcgcgtcggctcgctcgcgtcgcgtcgcatgtgctgcttgggttggggtgggtggctgcatcacatgcggctggatcgcgagcatcttggtggtgctcggcgcccgcgacgacgtggcccgagcagcgcgcgccgcggggcgcctgcgtctgcgtgtgggcggcgtcgtggatcgatcggtggtgcgagcgaggagcggcgaacctagccgtgtggggggatcctaggcggattttcggtttggtggctatgctagctcgatcgtacgttgtactacttggttgtttgggattggacccgctttgagatgtgtggtacgtgacgcgtgggggtttcggaatttggatggaaggaacggcgggcagctgcggtggatccgtcgaccacgcgcggtttacatgcacagatagtcccagaaccagaagggacatcatcgatgagagcatgtgt

SEQ ID NO: 83393 - DNA, 859 bp, Oryza sativa
ctaccatgattcctgggtattcccgggaatacccaacttatttttttttatcaaaaagcaagtatacttctagtatatacacatgtacacatattagtgcacctaaatcctcaattcttcgatccatacacagcccaaccggcctcttgcaacgcctcctaccaacccgacccactccgtcatgacccatttatcatacatcagttgacccatttagccaccactcttctagacggccccctctcactctccctccgtgacccatccctccctggctcggctccttcgcgccgctccccatacctaggcggcggcgcggcgaggaggtaaccggcagcgggagctggaccgtgctaccgtggagggcggcggccggcgcccgccactccgccaagctcaggcggtcaggccggttgggtggccggcggccgcgaggggcaggggcggccagtggctcagcgcttagacgggaatacccaactttgaaatcctggatccgccactgtctattttgctacttcacacaccgtcacaaaatgtcacaccaacgccactacaccgccattgcttgaaactcctaattattagttatatgacggcatcgccattgcttgacactcccaattattaattatatgacaccccattgcttgacactctcaattattagttatatgatggcggccaataaaagaaagtgaacattcattccacgaattattactttatattgcggcggccaataaaagaaagtgaaccttcactccacggctgtcgacgaaaaatctgcacttggctaccccgccattgcttgacactcctaattattagttatatgatggcaccgccattgtttgac

SEQ ID NO: 83394 - DNA, 1130 bp, Oryza sativa
gagtttaggaacctagatgacatacccctacaagtttaaggaccgcccgtacactttactcaattctattcttttcgatgttaatggaggttaattacataaagtaagtttagggaaaataactacagttaacataatgattgcctcccaaaatggagttagctgtatgtgaggtgcatgtttactcagtaagtgataaccataagtatattgcttttttttttatgcagactgtaccaaaactggtagatgcctcaagcttggagaataagaatgcacgagctgtttcttgtggagctcgtcatagtgcaataataactggtacctttgactgtactagtatttttcccctagaaggaatttgctatcctatctgtctaatataactgcatattaataaaatgctcttctcatgctcatttaaatcaaggaaatatttctggcaagggtttgttgaataaacccaattatccaaacaagacctttagggtttgttgaagaggtagagattatactcgatcccttagaaagccatgagtattttagtttaatctgtctgccaaccgaacgtactgagcctaatccccatataagcaagccctattgaatcttcctagatattctgatgtgtaatcatattatgagtcactgtagttattagcgtattatcagtaacttgtgcttggaaagttggaattctacaataagctgttccatgtgtgattgaagtacttaaattcttgttaatctttggcctccctgacaatttgtttaaacatgcccgtagaaagtgctgttcctggtctaacatctactgacaaaatgtggtgacatttatgcagatgaaggcgaggtcttctgctggggatggaacaagtacggacaggtgcgtatttcagctctgcacttggagaagaaaaacattcaccgttgcagttctttttataacttttgagttgcgcgtgcagctcggtctcggcgattccatggacagaaacgtgccttgcagtgttcctgtcgacgcataccacccactgaatgtgtcgtgcggttggtggcacaccttggtgctcgcggagtcccctacttaaaacctgacggcgaacaaacttccctagttgacaattttg

SEQ ID NO: 83395 - DNA, 1558 bp, Oryza sativa
ttctaactccacctagccgtgttgtgcagcttgaactaccagagaaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaggcaaattattatcaggtattaacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaaataatccattacagcgcacctttcctggatcataatcaccccctcaaaaaccagaggcatggactctccagcgacccccgtggacttctcgccacttctcagtctggcgcactataatgaatcacgctatacaaaagataaagccgttgcccacgctggcttgtggttggcacggtaaatgtctcacaacagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccactcggtgacattcgaaaataaatgcacagttgaaataaatagagaatttaaata

SEQ ID NO: 83396 - DNA, 678 bp, Oryza sativa
tgctcaaaggagatgaataataacttgccttgctccaacgcaaataaatccgagataggcaacctgattatccgattctcgaaataccaaaggttgccatccaaaataaaatagactctactaagaaagacgaagaaccaatttcaataaaatccatagaatagcaagaaagagataaacagttaggagggctagggtttagggtatagtctatctcttttatagggtatatggattactgtgctaatatcttatgcggaggttctagagagttggaggctagaggggattaagcaactactatcgcttatatttcatatgtgggtttgattagtaggaggatgggaagtaactagtttggataatggtattggttaaaagggtatgtggttggtattcattggcggtagctaggtttaggtcgtatggaaactaaggtctagttgtcctcgagtcgatactgaaataggatagcatatcagctcggctctataattttatgtgtaggttctggtaggtggagagtaggtggtggagagtatggtggataggcgatactggtgggtgtggaatttggatgacaactggaatttgactgggaaggtattagttagggtttggttatatgctagtcaatgctagagcataacgactagatttggtaccttctctagccgg

SEQ ID NO: 83397 - DNA, 92053 bp, Oryza sativa
tctcatctatctcttccacttcttctctatctctcctctctttctctatgcaggggaggaggggaggcgcggcggcgctggcccggccgccagatccggcagaggcgggaggggcgggggcgccagcgccggcccggccaccagatccggcaagggtgggaggggaggcgcggcggcggcgccggcctagccgccagattcgtcaggggcgggaggggaggcgcgttggcgaacgacggatctggagccgtggcacggtagcggccgatggcgggaggggaggcggccgaggcccgacggcggcatcggtctccacctccgccgcctctgtcggcgacacctccaaccgtgcctctgcctccgcccgcgccagccggccaccacctacgcctccacctcccccctccttcccttcagatccatcaccgccaccccccgacggcgcctcccccgcctcccggctgccaacgccatcgacgcctccctcacctccaccaccgaccgcgctagccgccggatccggcctccacgaggccggggatgcgcagatctgaacactagttgtcggtcagtttgaagtttttgtgatggtgatgcggtgacagcaagcaccaccatggcagcgtgcgccaattttcttgctagggttttttcactcctgtgatgggttgcaatctatttttccttttcttttgctggattatagacatcactgacgtctcacaaactaatgggccgtttgagataatagttacctgtgatgggttctatacacggctcgttataggggctggtcaccactgacggcccttcacccgacaaaggtgaagaaagtcatcactgaccactaatctctgacgaggggccgaatccgtcagaggtgatggtttaggcccgtcacagctagcatggttcggcatagtgaggttgaaactctcgctaaatttcctccaaaatcttaggtttgtccattccataggattttcaaatgatatgataggattcaatcttttgtttcaaaggcattcatagaatttttttcctacaggattgaaatactccaaagttcctatgtttttcctctaaatcaaaggtgccctaggtttcgttgcccatatagcatgtagcagcatatcacgtaaaagttatagatttgtaataattccccacaatattgttacaacaaattgaaatagaccactaatgttgcagcaaaatgatagttttgtcaatatagttgtaattttttgaaatttaatctatatgaatacatcttttatgtactagtacatgttattggctgtttataaaacctaatgccaaaaaatagcctaagatcaagaaaatcttaaaaccaacttaaaatggctatggcagatgagctaacaagcagatgataagatacgtataatccttggaatgataattagatgcgatggtggaacaaagatgagcgcacgctttcgctaaggtggcggtccgttgcaacgaagcattacgtttggttgcatcaaaagcggcataggaaaatggagcgctgcagctgtacgtagtactacgtattcgtgccgccgtacgtgcgccccatgtctgtttcgtttaaaaatgatggcccgatgcgggcaaaaactggtagtgccactcgatcctccacgcctcctcttcctgctttcttcgcgaagagatgggagattcacatgcatgctctgatgctcgtggaagaaaaaggctgcagcaaagcaaaagagatgagagacgttttcgttgttggcactgttgcatcccgtcaccctttttctcggttttgtgctgcctttttttctgcccacttgctgcttgaactggaccatgtgttgatttgcccccctgaatcgttgaatcgtaggaatgaaaaaacagaggaataagaaaaacacaagattctgacaggaatataattgtaaaacagaggattgcaaaacacaggaaaaccataggaatgaccgtttgattggaccacaggaaaaacgcaggaatcagatgagagagatagactcagaggaaatgttccaaaaggttagacctcttactaacttttctccaaaatgtgcataggattacccattccataggaattttaaaggattggataggattcaatcctttgtttcaaaggtcttcataagattttttttcataggattgaaatcctccaaaatttctatatttttcctacaaattaaaggggccctaattctttcttgtcagtatgtttgcaatgcagaaaggaaaaagtacgaattatccccctgaactatcacggttgaccgaattaccccatgaaccataaaaccggacattcttccaccacaactatacaaaccagataaattaccccccctcgacccaatccgctgtggttttgatctaggtgacgtacgcgtggtagtccagcgtggtagtccagtaaccattctatttattaaaaaatgtgggacccacatgtcatactcttcctctctcttactctttgtctcactcttcctctctctcttctctctctcagtctctgacagcgtcgactcctacgagcacatccgtgcagaggagatccgggcgctcgttcgcaacctatttggatgtgccagccacgccgttgccgtgcgcgagtgcctcgtgaacgcgacgctgcggaacatcctccacatgtcggtcggcgagaagtggtcgggcgtctacggcagcgctgatggggaggtgttccggcgcacggagagtagcgcggtgacaatggagtgggcgatggcggagctcctccgctgccccgacgccatcgccaccgccaccgacgagcttgaccgcgtggtggggcgggcgcggtgggtggcggagagcgacctgccggacctcccctacgttgacgccgtcgtgaagggggcgctgcggctgcacccggtgggcccgctgctcgtcccgcaccacgccatggaggacacggtggctgcttgcaacgacgtccctgtcggcacgcatgtactggtgaacgtgtgtgccatcgcgcgcaacccgacgtcgtggccggaccgcctagacgtgttcctgccggagcggttcctccctggcggcggcgccggtggagtcccctgccgccatcctccgcatcacccaccgccgaccacttctccgtcaccatcctcgtcgtcgtcttcctcatcccccgctgtcgcagcctccgcgtcacccgccgcctccgctccgtgtctcccgccgccgccgacctgtgagagagagaagagagagagaggaagagtgtgtgggtcctatatttttttataaataaaatgttgactgtactgccacgcatacgtcacgtagaccagaaccactgtggattgaattgggggtaattcgtccgatttgtgtagctagagatggagaatgtccggttgtttggtttagggggtaattcagttgatcgcgatagtttgaggagggataatttgtactttttctatgcagtaacttctgaagtacaacctactcctccaatagacttgtctcattagctcacagtactacatccgttaaaaaaaaagctaatcttcagctataaatatagatagtctatatccaaattcatagtgaaaagttagtttttttccgtgaaacggaggaaatacggtacttatagagagctcatgatgtactgtcgcgtttatttgttcgtagcagcttattcattggtgacggataggattcatcggaactcggaggatggccacgctacgctaccattgcgaacggaacaacaatcggtgtgagagacagaaggccgcattttctgaagatattaaataaaaatctgatctttatattcaccgccttacaactgaataataattaaaaaaacacaggactagaatactaagcttcgcatctatatatttttcgtctttagtccagcttcaaacttgctcatttttccttcttaagacaacagtgcatcactcattctctctattatatcaaaatcgtcctgccaaagatcagtttttcttttttgcctaatgagatttacagcacaaatcgtttcaggaaaagttagaagaatttgacaaagatcagaattagttacttgtcataaactattatatcaaaatcgtcctgccaaagatcagtttttctttttttgcctaatgagatttactgcacaaatcgtttcaggaaaagttagaagaatttgacaaagatcagagttagttacttgtcataaactattatatcaaaatcgtcctgccaaagatcactttttcttttttgcctaatgaggggagtaggagtatcagttttgtttggggttaaattgattttggccgttgttttcttaaacgatgtcagagtgaatcaattttttaaaaaaatcagacggtacagctctgatactaaataattagattattcagaaaatattattgaccaatgtactatctccaaatcaaaatcaatagtagttatgaaaccgacagttatgtttatatgtgaacgggggagtattacgtgctactacgcaagtatctgctcgtgttgtggtgagtttgttatctgaatccatggtttcctaaacctccggggctggggttaccgtgtcctggcggtaagcacggttaccgtgcagtaaacttggcaaaccgtgtaaaatttatcaaaattttaaaatattttttaaatttatggaggttactgtggttttcctttaaacatacctccgcggtaagcgtgcttaccgtgcggtagcatacacaaattttgataatttgatactttacagaaactaattttacaaatgaatcgtggtcaaaacttatttcagaaataaccattttgttcagcgccaaatcgtatgacgctcaacttagacacctcagcgtcacgtcaactggtgctgaatgccgtgccactacagatgggaggctgagtcggcatgccaacgtatatccagcgccgtgctatttggtgctgagatgtctaaattcagcgccatacgatttggcgctgaagaaaagtgttattttttaaataagttttgactataattcatttgtaaaattaattttttaaaggctcaaattgttaaaatttgtgcggtgaacgaggatgcgatgatggcggtgattcatcggctcagctgctggctgctcgctcgcccatttccccggcccgtgtcagacaaacacagagctcgccatgcccggtgcggcggtgccgggagctgtgcgccgaggagacggcagcacagaaaggggatggatggaaatatggaatgctgtaaggcatacatcaatccatcaccccatgcacatcatgtgtagtactaactccgtcccaaaataagtgtagacgtagatattcgtgtctaacgtttaaccgtccttcttatttaaaaaatttatgaaaaatttaaaaatatttagtcacacataaagtactatttatgttttattatctaatagcgataaaaatactaatcataaaaaattttcaaataagacgaaagatcaaatattaaacgtgaatagtataaaactacacttattttgtgacggagggagtacttgtccagactacatctagctccaacgagctgcagcgagagagatgagatgagcacaagtgaactggatatttttttcacattttagattttttttgaaagattattttacaaataaactcctaaaaatatttattctgaaaattaattcttttttgccaccaacatcattagtgtcgtggtccaacatgataatgccaatgacattgatgtcatcccctagtctccccgcagaagatacagtaagttacgtatacgaaggacaacggtgccaatgagatctaaaatgatttatttgtaataaaaaatacaaatagatccttggtgttaataacactgatgttgaggacttatttgtaaatttttgtattataaatatattcttttattattatttttaaaaaataggtgtgcatggatgatgcatcgacgagaaggctagttggcgatcaatcacgcgcccaccccccctccccgcgcgactggacactgtcacgcgcggagagggggcggcggacgcgtgccgcgggtgaggagggagagccagttttccttttttttccattttttccgtttctgttcggttgtgttttcatttttttttccggtttcttttctgttttttcccggttttttattttttatgaatacaaagtttgtattcgtatgtataccaagtttgtatttatacgtatataaagtttatatacacgtatgtaaagtttgtatacgcgtatgtaaagtttatatacgtgcatgcaaattttgtatacgttgtgtattttctattttttattttttaatacgtatgtatataaagtttgtatttatcatatacaaagtttgtatatgtcctatataaactttatatacatcatatataaactttgtatatgtgtatatattttatatatattaaaaatatatttatatgtatatatatgtgtgtatatatagtatatacatacgtatagaaggctgatcgcgtatcagccgtccccatgcatcgatataagtgatttagcttccgtgggaaagctagcgggatctggcgccaataacgttgacatagtaaaaaatattcattctcagattaagtttttttaaaagtttatttgtaaaataagtttttcaaagggacaaaaagtgaaaaatgcagcacaactgaacacagcaataactcacgtactccagggaagaaaagaaagagaaaaaggagaggtgagggtactggtaatcaatggaggccgctgccacccctgaaaagggccctgtccttgcaaacgcaccgcacaggctccaccaggctcacacagacactgttgaacttgtttggagagcttcttccataatcgaaaactccctaaacattttagttttttcgtttaaattctaaaagactttaggtatagaatttagaaaataattaaactagaaaaaactgaaaaatttattcttttcaattttttaaaaactgagtgccaatcaattaattctcagaatttaattttaagttctcaaacaaacccctctttctcccctctcccaacccatccatcactcatgcacgtctcactcagtgtctctctcctcctctctgggcatgcatgcatgcggctacgctagctagggtgaaagggagatcatcacgtggagagagatgcagatagtagcactccagattacagattgcagagagagtgattggcagagcggcatgcccctcgccccaccactcacttggcatttctctatcatcaccatgtactactcctactgtcctacaaggacaatgtacggcgcaatgctttgcttgatggagtatactcctatttaagatcgaatcttcagaaatttcactgaaaatctaaccatcctgcagaatcactagtactatagcgttaatcgtgttctgaagattagagtggtagtatcgctttaggtcctgtttgggaagaatatgctggttggtagctagcttctaaaaatcggaagaagctggattttctacttctgaggtctagtttattttctagattttacaggtatagattctcagaatttaggtgacaatctgaactgtttggcggagctagaaattctgggagaagctgcagcagttaaaaactccccgaaacagacgcttattttcgtgtgtactccagcatgcacggatacacactctcggaggctcggagcttgcttttttacaccaggatttgcagagcaaggaatccagtagaaaagctcacagcttcacagtacgacagcgagaaccaacggaagaagaagcagcatttgcagcaaacaaacttctaaaactgacgaagcatgctgatcgaatccgctcccaaaatgcagctgctgtttactgcagcaagcaagcaacagtggcccctatctcttcctgccatcgtctcccggttccaggagatgcccatgcctctactactctctgcagtttcttctgcgggcaaaccgatctagctcgctcgaacggtgcaccggtgaacgcaccgcggcttcgttttcctcgccggtgaaacgcaacgacgacgactgcgacggcgacgcctcgctgtgaaacaaacatatactccggcctcgggattactgtactatggtttggagatcacagccgcttggaataaatgtggcatgtggaagagaaatggtaaagagaaggcaatgccttgggagggatgcttatccattctagtaggagtactactgtactaccgatgcagtcacgcagggattctatatgctttttcatcatagatgaatggcttgagagggtttaaaaaatcacgtgcactaaccttctcagttttaaaattacggtacacctcgtgatgatcgttaaaccgtgggatggcgctaactccacccagaacggtttggtaaaccctgcacattgtaggtcgttggcgaaatagctatgagcataatttgccccgtttgaagggatgatgatgaaaattaaattagcgcacgcaaaatgagtaaaccattaacgcacaattaattaaggttagaaagttagaaaatatatttatttgatattgtaatccaactactatatagaatagaaaattttcatatgaaacataccgtttagcagtttaaaagggtgctaacgaaaactgaggtcaaatatgtatcttagcgaaatgaaaaattaatgaaacaatcgaaaataatctaaagataaaactaatatatttacgtgattagtggtttaaaaagaaatattgaaaaataaactataataaaaaaaccctaacattatatctaaagttaagtttcagatattattttttggttccaactaataagctaacaagcaaacgacaagaagctttgataatagctatcgtactttcatcaacaattttgggtgtctaataaacttgtaacaagcaaacaataagaggttttggtagaattgtaccttgatcaacaataggctttatattttttttctattacacagaagacattcatagcatgtaatagaagtacagatactactatcatattgatacatatgttcaccactctatatcatacggagtattggctagatttatttattgtaactgttttttatcttttatggctaaattgcggaaaatatttaataaccattgatgataacttgggtatctgtaggaccaaaatccaaaagtccaaaaatcatcactcctcactacgcgaatatccacagctaaataatgcactcatacaatttttctttaagagagagggagtacaccgattggaatttccaaatttatgcaaggctttaaatgagaagggctcactcaactgtagcatcatacctcaccatgcagagcgcaacagtatgcagccatggtagcttgagccccattcccaaacaccacgggtgacagtgtcacgtggcgatgcacatcgtcaccatctcatggccaaaaatacgccagcctctccaactgttaatcatatccacagtgcacgttgccttcgctgtgcactgcatcatctctactgcaactgtcgctgcaacagaaaccacagtagcctcggtttttctaccaggacacaggcacacagctgttgcaaggctgagttgggtgctaaaatttctcaacttctattcctttcgttctcacattttctaaattgtaccatgatatattaaaaagttttataaaaaattatattaatttatttttaaaacttttagctaatatttaattatttatacgctaataagacatctggttttccgtaggaggaaagttagttacgaacgaaaacactcttttgacgtaatgtcaaagagacatgagtctctacctagtgggatccatccctatggacccacaagtgactcaccctaagggcatcactaatgtatatgacaaagtgatccatatagatagggcccatataaatagtttttatctatggtaatctttacaatgtatatagatataaggtatcactaagagaagagagatgagtagaaatagataatataatttatttcatgtggaaagtccatatctatatgggtaacttttgttattttttatatatggactattctattgcttatggactacttctacactatactgtggatgtcctaaggttgtgtttggaagtgaaggttgggaactctcgtctctccgcacataaaatggagtaatccatagcgtattattaatcgagtattagctaaaataaacttgaaaaataagttaatatgattttttaaaataacttttttacaaatatttttttaaaagcacacgatttactagtttgagaagcgtgcacataaaaatcaggagagtgttgaaacacggcctaaacaattttatatcctggatttataacatattattaacagtggttattttatattaatctaatgagagaatctattctatgccactgagtttatcccagttcaacaatttggcactggcattgtctctttctataatataccgatgactttatcaattgttgtacaatatgctattgggatggacatcttttttaaaaaaatatccaaaatagccttagagacatacatggttaacaattaatttatctcgttagaaagtttcaggaaaaatatgaaattttctatatggcctccttacacaacattgaagtatgtaaataagtttcattttttttggtatttttaatttttagaaaaaaatattttgtggtatatcatagagaaatagattacacaaaagataatagcaaaaaatatcttatgttgcatatgaaatatagtttacattcaaaacaacaacacaaaaaatattgtatatatcatataacaaataagttatattttaaaaaaatagaaatgaaaaaaaataaaacttgtatacaaacttttatactgtgtaaggagtccatataaatgttttcatatttttttaaaacttttaatgatataaatcaactgttatccttatatatgtccataagggtattttaggcattattgaaaaataagctcaacccaatagcgtattgtagagcaattgataaagtcgccagtatattgtagaaagagagaaagtcagtggtaaattattgaactactataaactaagtggtatagaatagattctctctaatctaattgaaagtttcagtaactagtctctgcaaatattagtcctggttaacctggacttgtaaagatgagaataaatagagaagaataaataaaaggatgagaaaaggaggcaaaagctggagataaagaaaagcgcggccctgacatttcctgcaggagcctgataaacatcacgtttcgtgttggatcaatcatggtgtgctgacatgtgggggtatagtgaaccctggccccacatgtcggtattggcttaaatcggctaaatttagtcgtgtgtttttcagttgacgtgcttacatttgctaatccagccaactgaagtttagttcaaagtagtccatgtatttccagttagcgttagcttcgttgattttttgcacattcatatgtttgaaaggaacctttagacagaagagaacagtgaatatggttttcatttttcctgatgaactgaaaaaaaccacattttccattatccattacaaaaactacattttccattatccattacatgaaggcccaactgaaatccatgtttttttcaaatcaatctagtctgagtggaatatatggattgagagtatacttatactcgttttattttttttttgggggtttgatatgaaaaaagtgataagaaggattgtgatttgtgaacaagtatgataagaacaagtactctgcatgatttatgaaactatatatttgttgcttgtttactattagaaggtctacatatgtgaagtactcctttcgttttaaaacataacaatataatatcggattagacacaatcgttcaggtttatagtacttgataatatcaaatcctagttggtctgaaaacatataaggagattcctagtaggtcgaagcaaagcaaggaagtggtcaaggggatcctgcaagagtttcaaagggaaattcgaacaattttttgagttcaatatcacacaattatctggtactacatccgtcccataaaaaacgaatccagaattggatgtgacatatttcagtactagtatatgtcatatctggtactaggttggtttttttataggacggagagagtacttgtcatggtaatctcatactgtaaggccttgtttagttcacccacaactttcaactttccatcacatcacatcatatctaaaattttcctacacacataaactcctactgcctccgtcccataatataagggattttgagtttttgcttgtagtgtttgaccactcgtcttattcaaaaaatttatgcaaatataaaaaataaaaagttgtgcgtaaatactttagataataaagtaagtcacaaaaaagtaaataataattccaaaactttttcaataagacgagtagtcaaacagtgcaaacaaaaactcaaaatcccttatattatgggacggagggagtaacttttctttccaaactaccaactttttccaaacttttaacttttttcaggaactaaacacaccctaagtaataagcctattagtttttaaaatgtttatagtttttcttggtaatctcgtcgttcgcaaaaccatggtaggataacgatatttcctaccaaaacagtagggaaaccctggcctcctcggagctgtggcagagaaaaaaaagaagacgggtaaattgcatcaaccatacacgaatttatcaagttgcaatctaatacataaacttataaaatacttgtttttgatgcacgaacttagaaatatatcacgtacgtagatactaaaaggaaagccatccctgttataacggctagagaaataaaccgtcaacggaaaacaacctaattggaactgaacggcctcatcttttcgcttatgattatgcttatcagtcaaaatttaaatttttgaacttaaatttaaagttaattttaggattttttttcatcaaagtcttttttcagcctttacttttagatcgtaaagaacacatatataaaagttttattcacaaaattattttttatttacaaatatgatgggtctggaagctgctaagcaaactaatcatcgttgtcctcggttaggtctcatccttactgcgtggttcccgtggcgcatctctctattctatttgcagctcaatcgttttggaattgacttaaaatcttcatgcttataagtaataaaaaatcatctatatataaaactttcatacatgtatgttaaaataaattatgacgtaagaactaaaaacattcaaatcaactctaaaaattaaatgttaaaattcaaattttagctttggctagtaagctaaagaggaagtgatcgagctgatgagcctgttgaaacacacatccccaaacatatgacagcatcaaaatatcaaaattaaccaaccccggtgttttgaaacgcatgaatcgcgccccccccccccccacacaaaaaaaaacatcagggtaagtgataaaaggcattttctacccatcacttgtacaacaagctaaagataaattaaaaaatgtgaaatagttttagcttcaggctttaaattttcatacttctagcgtaagaatatgattttctattttaatggttcaaaagcaaagactgagaataaaaaaataataccacctaaattaacaccaagaatcaaagattaaaatataaaattgtctagacttcgctgtataaaaaaggggttaattggatccatggactacaaatatatcattttagctaaatgccactactattcacgatatcggctacgtgacaatggaattaggggagattggcccattagccccaactccatcacgtttttcgtgaaaaatctccattagccctaactgcacgtgggacctacctgtcacttccatctatacctccctcccttctcttctctttcccctctcctctctctccaccaccgtcgcaaccgccgtcatcgaccacctccgtggtgggaggcctcgggagccgccgccgccaccatcctcgacccatccgacgtgggagggctcgggagacaacaccgtcctgaacgctattcacgacaggaggttcgggagccgccatcctcaacgccatctgcaagagagggctcgggagccaccgctatcgctgtcctcgaccccatccgtgacgggagggctctggagccgccgccgccactgtcgtcgctatcctcgacgccatttgcgacgggagggctcgggggccgccgcccgcatcgccaccttcgtctcctcgacgccatccgcgagagagggctcgggagccgccgccgcctccctcgacaccatccgcgcgggagggttcgggagccactgccgccgtcgtcactatccttgacaccatctggaacgggagggcttaggagccactaccgtcctcgacaccatccgtggcgggagggatcgagagccgccgctgtcgttgtcactgtccttgtagcagtcgcggcatgaaggaagagatagggaagacagaagagggaggatggaggaagatggaacaaacatgtgggtcccgcgtctaggggtctaacggaaaacgtgatggagtggcacggttccaatttcttcaaatttcagtggcacgtaactaatatcatgaatattagtgtcatttatctaaaatgtcatatttgtaatggcatgaatccaatgaacccaaaaaggactccaataaacaaaggctaatcttgtatttcctcgttcttctctactctctccgtttcataatataagggattttggaggatgtgacatattatgggacaagaagtatatctactattgtaaaaattgaagatatttccactgatattttggtacgtcgtctattttttagtcggtttttaagttctttcgcttttggaaatacataaggagtcatataaaaaatccttaaaaaaactcacatgctatcttgtaacgagagtcgtagtcctaatttctttggaattcttgtctggcataagaaagcaacgtacaagatatagctatcatcctaataagggttctgaattagatatcaatattatcaaattaaaaatcccatatactttttagataaaaaataacaataatatgattaaaatagcattcacctgttacaatgtacgggtattttttcccgtaaaatatagagtaagagagtagaatcggatgagatatatccagtactattgtgctccctccgtcccaaaaaaacgaatctaggattggatgcgatgttttctactactatgtatctggacagatgtatttccagattcatagtactcgaatatgtcatattcagtactatgttgggtttttatggtacggagggagtaactgtggacagaggtaataataggacaccaatatacagttaggggctgtttagttcctaaaaacttttccaaaaaatatcacattgaatctttggatacatgtatggagcattaaatatagaaaaaaagaaaaactaattgcacagtttgcatgtaaatcacgagacaaatcttttgagtgtaattagtctatgattagccataagtgctacagtaaccccacatgtgctaatgatggattaattaggcttaaaaaattcgtctctcggtttctagacgagttataaaattaatttttttattcgtgtctgaaaacacttccgacatccgttcaaaccacgtacaaatttcaccgactaaacatgcgcttgctagctactagttgaataccggagtaaggtggtgtttggttggagggactaaagtggggctaaactttagtccctcttataaaaatataagtccatatggtaaagacttatattttaatgagagagactaaattaagtataaactgcatcagctactcgtaagctacacttatgagtatactcgactgatgaaaaatatagtggaccaccacatgtcataggcgagtgagaccatgctcctcgacttgcgactcgagttctactcctaccaactctaggccaaccagatagatactgagaaaaaaaaaacaacgacactgatgtgacatctcagtgtccatcggccatcgcctccttttctctctcctctcctctcaccatcttctcctacagcaaatcactcttctctctctctaaaaaacttcacaagcctactagcctactactaggcacgtagctagcccctgccactctatcgcccagcacaagccatacagctacccgctgtcactgcgccagcggccgcagctgcgcaaagaggagcgcgagaacccaagaaaccaaccaagagctgcgtcccataaaggcgcgctgcttcaatccatccatcttctgatcttccatatacttcgcttcctgtaaatgtcatcgccgccccggcggtgcctcgcagcggagcagcagtggccatgacgccggcgccggcggccgcctcctaccgcgctctcgtcgcgctcctgctcgtcgccgtcgccgttgccgatgatggtgggtggatggctggctagctagctggctgttggttttcggttttggttggtttcttgctggggggagtgtgtggttttgtgtactggggagcagagagattcaggggggagttggtttgatgggattagtattttattagtgttgcaagtactcttcctttttggaggcatggtgattctcttgtgggtgatagtcctactactattttttattgtcctaagatctccctaagaagagtctaatactttaactaatccttgtgagtgagttgtgacaagtgccacttccatctcttctcttccttcttgtactagaacacagttgctggcattttgtttatggtggtggtagccactaggtaatccaccaatatttcataatgtgattcttttttttttcactttctgttttgttctacaagggactccgttctgctttggtattctgttacttatcaagaagtcgtctggccatttttgaatctttgtgctcattgttcaaggaaggagctttatttcttcttttgtatgttactaccaatctgatgagccgaatgctgctgcccgcgtcaggaatctttaggctttgtagcaaccttttactttactattgtgctgatttttgtgctttccaatctgatgttcttgaactctttttttttttgtcttgaaggctaagaaacataaatctttatttattagtactactacgtaaatagattttttccggggcgaacaaatctgtgcagattgtgctgttctagaatccatttgctgttgcaggcttgcagtttgtgatctgtgttctaatgtggctgtatttgcattcagggtcgacgctgctggagatcaagaagtccttccgcaatgtggacaacgtactgtacgattgggccggcggcgactactgctcgtggcgcggcgtcctctgcgacaacgtcaccttcgccgtcgccgcgctgtaagaagaacaccaccgagttcgctacttttcttgctgacaagtccactggttcgtcactgatcatgcctgttgattgcaaagcagcaacctatccgggctcaacctcggaggcgagatctctccggccgtcggcaggttgaagggcatcgtctcgatgtatggaagacgtggtggtgtactttgttgttgtttggaaatgtggcttgctggtgcttggactcgcagtaacttgtgagcttgggtttgtacctgcagtgacttgaagtcgaatgggctgtctgggcagatccctgatgagattggcgattgttcatcactaaaaactctgtgagttgtgtggagtgtggacggcattatcgatttcttcttaacttacggagagaatgtgggttgatacatgtgtttggttcagggatttgtctttcaatagcttggatggggacattccgttctcagtatcgaagctgaagcacattgagagcttgtatggcctattcttgctggaattcatttattataagcagtgttgtatggacatgccgatcgtgttctgtgaaatagttttattcatgtgccggtgtttgtggttttctaggatattgaagaacaaccaactgatcggagtgatcccatcaacgctctcacagctcccaaatttgaagattttgtaagttgcgcgaaacttcttatttttgtggtgtttaattaccgtgctcccagttttctaattgttgtgtgccctgcagggacttggcacagaacaaactgagtggagagataccaagactgatatattggaacgaggttcttcaatacttgtaagtcatccttattttgcgctggaagtttgaagattgtgcagtagttctagtatatcagtattttattgtattttagttatgtacctacttgaatgcgatttctttttttttcttttttttgaaaatcatttgaatgtatttaagagcatgtcaaaagtttgttaagctggtaaaaatctatattgactttatgtgaattcactagcattttacgcaagttgcgttatgtaaaatactcatattttttttatgaattgtggctgaattaatattatcctcaggggattacgcggtaataatttagaaggcagcatctccccagatatatgccagttgactgggctttggtacttgtgagtatatgcatactatgttttcggcaaaatttgcctcgagtccaccgtattgtacttatgtttcaatcatttggaccagtgacgtaaagaacaacagcttgactgggccgataccagaaaccattgggaactgtacaagttttcaggtcttgtacgtatttgcagcttacccctcttaattacaacttttctgcttctgtgtttgtgaggttttcctaacatttctttcatgttagggatttgtcttacaataaactttctggatcaattcctttcaacattggtttcctacaagttgctacactgtatgtggtgattatcttgacaaaaaaaaactcaattaaatgtttaatacagtttttgctgatctgcatgattattcacattgtttgaattagatctttgcaagggaacatgtttactggtcctattccatcagttattggacttatgcaggctctcgctgtactgtaagtacaatgatgaactgaatattcatcatacaattggttattgataaatgaagctttcaagatattttaattcatcaatataactttactcttccagggatctgagttacaaccaattgtctggtcctattccatcgatactaggcaatttaacatacactgagaagctgtaagttttcttttctcctaaatcgttaggttgtgaatattttccctgatagattttctactgccagttcatagttaaaaaacaaaagccttagaaggttctgcttaggaatatttcttgtgtaaattaatatgttatatttgttccaataggtatatgcaaggcaataagttaacaggtccaataccacctgagcttggaaatatgtcaacccttcattacttgtaagtgcacgttttattttattcccatagcatattctgatttgttgcgacctgatttatgtcattgttgactaatttcagagaacttaacgataatcaacttagcgggttcattcctccagagttcggaaagctaacagggttatttgacttgtaagctcttttttcaaactcttcaaaatttgttatgttttctataatttattagtaaaacaagcggcttatcttactctttgcttcacagaaaccttgcaaacaacaactttgaaggtccaatccctgataacataagctcatgtgtgaatctcaatagcttgtaagcatgatttaattataattgttatggtggaacttacaatttcagatgcatgtatctaatgtggattttctttacagcaatgcttatggcaacagattaaatgggaccattcctccttcattgcataaacttgagagcatgacttatttgtaagttgtaacaattttaatttcttaaattgtgttgttacattatttttccttttgaacttctatacttgtttaatttttgtatttcacatagaaaaaccttgtttcccatgtttgattagtaccatatgttcatctgttcttttcttaggaatttgtcatcaaattttctaagtggttctattcctattgagctatcgagaatcaacaatttggacaccttgtaagtcctgttagctccatctatgaattcgaaaatatctgttctatcctattgtgtgtgtgatgaggtacctgtatcagggatttatcctgtaacatgattactggcccaattccatcaaccattgggagtttggagcatctattaagactgtaggttttgttgtccccatcttgtatgtatctattatagtgtcttacagtgtttgatgttattgaacttgtttgttcagtaacttgagcaacaatggtctagtaggattcattcctgcagaaattggcaacttgaggagtatcatggagatgtaagtatttgcttaggtgtgaattttttaaccatctagtcccataggtactataccccatatttgtggtttttcagtgatatgtccaacaatcatcttggcggtttgattcctcaagaactcggaatgctgcaaaatctgatgttgttgtaagtagtacctttcatgtcagccttctttttaaacccataaggacattgaatctgtagcctgagagacatctgtctatcattctcagaaatctcaaaaacaacaacataactggggatgtctcttcactgatgaactgcttcagcctcaatatcttgtaagttgaataaccagaaaatttttgaagcatatgctccagtatatgttttttgctcacattatctatctgttttatgatcagaaatgtatcctataataatttggctggtgttgtacctactgataacaacttctcacggttttcgcctgacaggtagtgtgctccatcatttccatcactatcatgttcatttactcagccttggaaatagcagtttaacaatgtgatacttttcttagctttttgggtaatccaggactttgtggatattggcttggttcttcgtgccgttcatctggccatcaacagaaacgtaacaaatattccattcatatcttacataattttttcatacctaatagacaaagtcaacttttcgttacctacattttatttgcagcactaatctcaaaggctgcaatacttggaattgccgtgggtgggcttgttatcctcctgatgatcttagtagcggtctgcaggcctcatagtccacctgttttcaaagatgtctctgttagcaaaccaggtaatgcatctgcaaggagttttgctcaacaaatcaactcatttctctcctgccaagttcaatattaggatactatcttgtccagcaattattgtatttagtcaattgtttgtttttacctgataactgggttaatggtagagcaacactaaagcgctgtatatttgctgtcacagtgagcaatgttccccccaagctggttatccttcatatgaacctttcccttcttgtatacgaggatataatgacgatgactgaaaacctgagtgagaagtacatcattgggtacggagcatccagcacggtttataaatgtgtttcgaagaaccgcaaaccagtggcagtaaaaaagctatatgcccactatccacagagcttcaaggaatttgaaactgagcttgagactgttggtagcatcaaacaccggaatctagtcagtcttcaaggatattccctatctcctgttggaaatcttctcttctacgattacatggaaaatggaagcctctgggatgttttgcatggtaagtgccgactgccaactcattgcacagtttgattgtcattgcaatttgcacagaagcaccaacatgccattctcaaaagcatgatatttgacacattgatatttgcttctgttgattgcaataccaaattgttacatgacatcttgttaccatgttaaaatcttttttttcattattctagaaggtccaactaagaagaaaaaacttgattgggaaactcgtctacgaattgctctaggtgcggcccaaggccttgcttatcttcatcatgactgtagcccacggataatacacagggatgtgaaatcaaaaaatatactccttgataaagattatgaggcacatcttacagactttggcattgctaagagtttgtgtgtttcaaaaactcacacgtccacctatgtcatgggaactattggctatatcgatcctgagtatgctcgcacctcccgtctcaatgaaaagtctgatgtctacagctatggcattgttctgcttgagctgctgaccggaaaaaagccagtggacaacgagtgcaatctccatcacttggtaactatgattcatgctcttgtgattcttctgttaatctgtcattttcttcagcttattttactttggattctggtagccctcaataattgctgaatgatgcccattaggcttgtgttcctacatggggaccaacaacatgaaacctatcctgtgagtagatctatttgcactgtttacgtgtggtggattgatccatcgcatatggctgttgaaagctccattatcaattgcagtgtttaagtcccctaaagcctgccacttttgtcccctgtcatcaattatgtggattgaaagctacaatttagtgtcataaaaattcctcttgcagccatttacattttttacgccttcacttggcatttaaccgacctccgacttggagagtcaccctaatttctcattgattttacatgcttatatggcttttcatttatcggttttccttgctaatgtacagactgttacaattcttggtctactgttgcaaatgcagatcttgtcaaagacggctaacaatgctgtcatggagacagtcgacccggacattgcagacacttgcaaggatcttggtgaggtcaagaaggtgttccagctggcgctcctttgcaccaagagacaaccatcggatcggccgacaatgcacgaggttgtgcgcgtcctggactgcctagttcgtcccgacccgccaccgaagtccgcacagcagctggccatgccgcagcggcctgctgtcccgagctacatcaacgagtatgtcagcttaagaggcaccagcgtgctctcctgcgccaactcgtcgtgtacttccgatgctgagctgtttctcaagtttggcgaggtcatttctcagaacacagagtagaatagtctgcagaaatcgtcatccgatcttgggattcaggcaagcagctggtgaagctaatcaaggtagtgaagtgaactcacgttttgtgactttgtccacatgttgggtgcccagaaaattaacaagagaattctcaagggttgtggctggtgttctttactgtaaaaaaaatgcgtcctacttctttcttcttcctttttttttatctcgtttttgtctaacttaggaggtgtccatgaatctagtactaaatctcaagacagcttcttctgttctgtaacatttctgggattggaatgctggaactggtattactaatagtctctcggtttggacaaattcgcagggtggtgtttcagtttcagcatttctgttttgcactaacatctgtaatggcatctgatacagtagtagtagcaatatagtactcctagtatagcatatggtatcctgagaaggtataattggtcagtgtgacacctgaattctctcttggattttctcatctcctggcatcgccatgtgcttgtattgtaccgttgtcgccgagcccatggaggcatcgtcagtcagtcagggacggtgtaaatgatgcgaggctgtgcagcgatgctggggccggatgggagagaacagtaggggagttcagaagagatgaaggcgtactgccatggctgcctgagatgattgattgatgagtgggccaaggaggatgggcaggggcggtgcgcaatgcagttctcgtgaactcggggtactgaactcaggacgcatattccaaacccaatctagtcgcacaaaagcaacccacaacgattttttgatggaaaaatattgagagtggaagggaaaatgctcaaacttagcccctatctggtactccaggaatgtagcaaccaagcagggattggacacaacttaatacaacgtatctgaatagatcacttgtttagtagctactccctccgtcccaaaaaaaaaactcaatctgactcctcttaggacaatgtatctggactaatgatggtcacatcccctcctagattaagctttttttaggacggagggaatagattctaagaatccggattctatcttctactactttcatcccaagatataaggagttttaggcttgggtatgtggtatttaaaaagtaggtggaatgaaatgtgagaatgttgtgattggttgagaaaaaaaattagatagaaaatttttaaatgctgaaaaattgttattggttgaaaagagaatgtagatggagaagttattatattttaggacagtttgaaggctaaaaattgttatatttttggattgtgtaacagtagcttttccgaatctagattataacttgggagttttttattctgagaaaagttacggtggccggaagctcctccaaataggttcttgatcacacttcaaagtccaaagatcacgattcctttgaacacatgatttttaaaacaaggaataggataaaagcataagaatagattatcacaagctatgtaatattacaggattttaaaatactatatatggacactataggtaacattttttgatggttcacagtaaatagaggaattttggaggaaatcatacgtggaagagtagagagaaagagagaatgtgcattggacttagcaaagaaaaataaaatatgaaatgtgagctcatgctaaatttcctaagaaatagggtgtaagaattgcaatacgtaggaatatttagtcctattcctttgatccaattttttgcgggccagacgggctggcatgcttgcctctggctcaacacggcccgccaaagtgttgggccgttcgtagtctccctgctcggcacgttgggccatcacagcacggcccgtttaaccaatcgtgcctaggccgtgcggcccgtttggcccctttccttttcccacgcttcgcccccacctttggctcctcgcgttcgtcgccggcgccgccgcgcagcaaccagcgttcccctccccctccggcgatgagctcaagccgacgaggcggcaaggaggcgaggggcgccgcccccggctgcgacgtccgcagccgcctccctcctcaattcgctccccaccacatgctcgcgagcttcctcctcgtcggccaccgccgaccatccactgcaagggggtcgccgcggtcgattcgagcggaacgcggatctcccccgccttaccagcagctggtccagctcgacggcgaagcggccgatccggcggtggcattcgacccagcggctaggtgctccaatggcgggattgctcggctgacttctctgaccaccgcctgctgctgctttcctcactctgacgatgacgattgttgtgaggattgtttacttctcttttacatatctcttcttaggatggggtattcgagacttaaaaaaaagtaatagtaaaacaatagttataccgttagtaaaaacatacagtttctaattcaaaatgcaacaaagaggaaaaaaaacaatagcaaattaattttcttgatttccatagtctgcacttttcttgcctccaaatcttctttgcgctcttatctgtattgctcatctattgtgcaatagagtcacacaacgtaaatgtaatgtttgcaattttaggtgcggtagcatgtaatcattataatttactaatctgattcagttttacacgttcttggtcttccctactaattcactactgttttttaggtcatgagaatcaagctgcactaggtgagaactagaaaattggcgtgcccttggcgctcttactacttacaaccaatgcatataggcatatagcttatggtcttctttatatgttggttaataatttatgaaaatatcatgaaaattttttccgcattgaacaaactgatcaaattaccacagattatgcaatcaattatttgatttacagcatttacaagctgatcaaacaaagaattatgcaaccagcacaaagattttcccaaaggaccacaaatcatactttatttcgcatcctttacatcatgtacacaacatttggcagattttcgacctactaggagatcagatcatcatacgaatcaaaatgtcatctttgcagacagttaagctcctacagctctgagcttttcctccttattcctacctttggttagctaatgaatcaaaaatggactgaaaatttactctctttagtcctgcagctctgagctatcttcataaagaaaaggggcatatgagggcagcagaacagcatccgcatcggcttgctggaaatttcttctgagaggaagaagagcagcggcggcatcaccagcgtgctgtccgacgacggggagctcgcgtacaatatttttgtgctgttaattagtacaaatttcgctttacaattaattgagaattgactaaactgaaaattataatattgctgcaggagaactttaccggctgatgtgtttctgctccattgactgacctatccaacccaaattttctctttggacagacattggttgtacattctgaagataaataaagggttatactcaaatatgtggagatgtctaatttctgaaattacaacgcaacggcattcttctagaattaagtggatataataccactgaatattcttgcgataagaaaaatatatgaataaggaattgagctttgacatgtgttcaggaaaattaaagcactaaggaaatgtcataaaaatttgactctgtagtatttattaaattgactcaaattcgttcgagtataacggaaagttagtgaaatctgtgaaatctgccttttcttctgtctagacataatatattatttggtgatttataaatcagtcatttaaaaaatcgaagtagctcaattaactaaaaatagactatcttattgatcatactcgtcatataactacaaaagagatgatcggcgttgagctatcgtcgctacaaattacagaaagttgaagtgtgtcaactggattttacaatgtgcatatgctcatatactgtcgaaaaattatccaacttctcagctctagccatgtattgtagtgtcttacttgcccatgtttgaatcaatttcttttgaactttcatgtcaacattgctaaagaccaccagttagtgctgacaaagcctaatttgatcaagttcgtatctatatcaatacatcattatatattaagggaataaccctgaaacctgtacactataaccggttagtcttctctggattcgcaccactggatacacagcctaaaatggacaccggtggttgaagttgtaacagatcaaaatgtcataacactggttttgctaattctttctccgcttttcactaggagaaatcacatcagtcaactccgccacttcattgagactaatcgcgacaagtttcgtctgaactgaggttagttcaggtagaagtgcaataggtggagaagcaaaggcatccattacattgatgctttttgtctgcaggcaatggcaaggccggtttttacagcactcacgctcgtcgtagcccctgttcttgcctggagaactgtctacaacagccggatacaatgccttcctgcagtttgttgggctgctggtggaatttgttgggctgctggtggcatcgtcaacagggctcagttctttactctgtgacttgttcttgtcgacagagcttggaagaagacccttgcgcttcttaggggatggaacttccggtttagtatgttgagaagacaacacatcatccttagcactcacaaggaaactagacttgctattgtcgaatttggtccctcttctcctatcacaggtaaacaataaacaagtcagcagaatggaatatatatgtcttctattaagacatgaaaaaggacctgccagtaattgctattagaccgagattaacgagctctcaggcaaatgtaagaaatgtgaagaaaattcaaggcaagtgcccaaaaatctaaatacttagtacttaataatgtttatcaacaatagtttgccagctggctaacatatgcatgtgaaagaaagtctttttgtctgtttgatcctgtgcttgcactaattacgtgccaaacacacatgatcatgttcagaagcacatgataaatttctgcttataattaaaatgccatataaggtcaattaaagttttatgcgaataacattgttggcaggtatattagcccattaagcactagtgctagtgctactgccaactgcagaagcaaagctacatgtatttaaatcagcaataaataactcatgtcgctgtaagaaaaagcaccggcagcagcaatattgcatggacattgcttagaagctgcatccatcgttcaaatcaagaaataaaatcattgtgatgcgtatagattacattaaacttgtttataccagtaatattgcagagtgtccaatggacacgagagttaacaaaggttgaatgaattagagaactaattgtgcttcctgtaacatgtctgcgggataacagcatgatcacatattctttggaagactggaacaatgtagtaatagtgtaatactaggtaactgcagagtgctcaacgcaaatataattaagcaatgtttttggattcttgagcattcaaaaggtatcctgctttactgtagtgccagacaatctgacgcgagatgttcctatggatcgatgggaacaatagctagcaaatttgtatgtatattcgtgaaagagaatactagcaccacctaacaaaactactccttcagtttggagtaccaaatatcaagcctgcacagctaaacagctccttagtccttccgaaaaccacgagctccttcagtaaaagttaatttttccacaatgtttcaaaagttcaatttcccgaccacattgttaaaacgcaagtaaaaacgataattaatcacatctgcccactcgaaaactaattaagcacacaacaacaacaacaacaacaacaacaacaacaacaacaacaacaacaacacatgctacttttcacgcatcatcaaaacgatcatccctcataggccagaaatttctcaataaatccccaaattagttaacgtaacatgtaaaaaaaacaaaaaaaaactcaaggatcagtgatcgacatatttcgacaaaaaaattccgaatatatatactgcaatagtacaaaaatatcaccctaagtcttcaaattttccatcggcagaggcacaggatcaatgattctgacaccaaatgaagcagaagtccgaatcgaaatttcagtaaatttccatctacactgctcaaaatgatccgagcagtgaaggcaccctcaacgatttcgctagaaaagcattcgaaatccaaaataacccagcacgacaaccaaagggaagctcgatatcttaaggcgcgcgaagctttgaggcggattgggggtgaaaaactgacctgcggctgcggggcagcgcctgctggagcgcgtccatggtgtccaggggacccctgtacgagctctccacctcgccgtcgctctcctcctcctcccccgccgccgcggcgtcctcgcagtgcaccatccccacccggctgtcgctgccccaccccgccgacgacgccgccgccgaggccgccgcggggcggagagctcccccgaggccgaacagatcgccgccgccgccgccgtgcccgcgcccgctctccatggtgatcggcattgctccctaccccccactcctctctcgcgaggcgcgagctcacatgcgaagagaactagagaagagaagagaggagaggagaagcggagcggcgcctcggagacgagacgaagggtggggggctcgagtcgcgtggggctttgcgcttgcgacgggtgtttcgttgggatttggcaccatggccttgcacacactgacgtgtgggacccaccaagtataaggcagaaacacgctctgctttggtaaaaatgctctagaacgttataaaactggcaaaatatggaagacacaatgtaaagagtagtaccattttctagtgtggggtgcatgaagtagcattgtattgaaagtccagtctatgcagtggcattttagcggttttctcgttgtttaagtttgtggattctcctaatagacgagccacgaacttaaaacatagtctagctcattacttacgcgctctcctctttggtctcaaaatctagatctaggttagcttcaattccatgtctcctttgctgtcatcatctcactatgttgtcacctgacctcaccgacactgataggtgtcaatgtgctagtgcggcttgctcgatcgtcctcctctccgccccatttgtgtcgatgtgctcatgccaccaacattgccccaccgccctatactgaccctggctccggcgctaacgccacctcgccgcccacctttggtccgccgtctcctaggctagccctctaaacccaattccctatctcccccttcccagttccaacctccacttactcaccctcgaaaccctaacccagtacttattgtatgatgtcgcttatcagaaagcgttcacgtcacatacacgtggttgaggattaggacatcaataggtttgtgggaagagaggtttcgacttaggtgcttttcagagagctgggtattctatgcaaggtagtaatacctatttggagctctaagaaataattgatactcctatatatcaagtcgtttgatagtcaatgtgtattttttttccttttagtatccccttccggcaatgccaaaaatatatttggaaattggatgtggtgccatggtaagaaagatggttctatttgggccagtgcactgcattgtttaatttggcattaccgaaatgatttttgacaataataaatcacctaatcctacgtgggttatcttcaacttcaactagcacaacacttggttgttgatactatcacaagaggggaaggatattatgcgtaatgatgttatatttctagataaggtagctatggatcttttgttccgctttggatagtatagtacatataaaattacttgttagaatatatataagtaatttgtcttaatttttaattcagctggttatcttttttagaggagttaactattagaaaaagcattttcgtcgatgttgggcttttttttcggcaggcgggtatggccatcggagcgaaaaccccgccggcgagaatgattactggggaggagttggccgtccgcctgtgaagatagcatatcgcaggaggaccatataaggtgccgcctgcgtaaatgatctttgcaggcggaccacataatgcgccacctgcaataatcgcaggcgggctccttatgtgtgctgcctgcaaagatgtattttcgcaggcggccccttatgtggtccgcctgcgaaaatagccctataaagtcttcttctttctcgagccctgttcatttcatccgaggtttctctctcccctaacaccaaaaatatagggggggggaaggtttttgaacttcaaatcttagggggatttttctacggtggttagatctacacctttacactcttgttatgcatttttttttataattttagaactctctttgtgatgaatctatgcatgcaaaattgtgaagaaaagctcaatgttttttcttttcttttttctttttactttacggaccaaaattctttgcaactgtgcctggaaaagttccaacttggcaaagcatttttggtcagatcatgcacttgatgatggtccatggaagatgagaaggttacataagtggtacatggacgccagcaagaaaggcctaactaatttaacaattcgatcaccgcctgactgcttcgccggcgacggttacttctagctagatttcgctgatctgcacaccatctatcgtcgcgataagatggacgtaaacttcgtcggtgcatggtgcctgtgagtatgagtgcacatttattatataaataaattgatataatacatgtttacatgtgattattattaacaaactgcttttataggatgtaatacatggatgctgagaagacaaatcaatctatcggatatctggatccaacaaggatctgtcaagcacaacataccgtgacacaatcaccaaattccaagcagctcaaggacaagacgcctgaagagatagaatataagaagggcttacacaaacagaagttgattactgtcgcacaatacattggatgatccttcttacgctttcaaaataaaagagtcattctagccgcgtacaactttaaataagtctagtaggttttttttacatatctgtgttatctcatccgtaactaactgcaccttccttaccatgtagcgatcattacatatgtttcattatctacccgaagcacggctccgtgacagtcctcgacccccttgattatcatcacaagacgtacaaacaatttctaacaattttacaatagtaagtgattctgatactcttgcatgtctactattaatatattataattaaatctcctccttaatacgaaacggtaaagaatctgtacagtgtgtacaactactacaagaaaaagggtggagagcaaattcaaaccagggagaagctgctaatacatacatattggccggtaatagtccacacagttaatatatttcaattatttttctaattacaaaatttaacttttttccttctatgatatgccattaagtgtcacaagcaacctagagacatggtcctttgcagggattacgcatgcgaattcctcagggttaatgggagatacaaggttaacgcagaggatgtaattctctcgactcaacgtataagtgcattagagaactacgcatctagaacctactatatatatatatatatatatatatatatatatatatatatatatatatatatatatatatattgtgcaaattaattaagacaagaaagctcagggtaataaatgcaataattagatgtgaaatttgttgatttatactcgcccactagcgatcaacatatagtgcccatagaccatagtaaaagatcggtagcgtgtctcccatggtccattgctcggccaaacaaccaccgaccaactaactaacctacctagctaccaacaacaatacaagatcgatccttcaaatggttaatgaggatacactgcctgataaagcagttgatcctgtgggagtacacattattattagctcactcttgcagcccacagatatttatctatgatgcaatggatttaaggacccatgtggtatttatttggattttgtgcgtctttgacacacaatggtttggtatcttcttcttcttcttcttcttcttctactactactactactactactactactactactactactactactactactattttgctatttatcgtttctcaagaaattctacctatgtgggtatctcattgttcaggaatcaaactaccaacatgggcacttttgaatttagaaattttacatactaatttttatatgaattaatttgattcccatggcacttagaaaatcattctttccaaatataagacttcagtatatgttttaccggcttttcttaaaaaagttgtcttttgtgcaagcaaaatgattttggccgtgaaatagccgtagccatgggcggatccaggaacaaaaaattggagggggggggctcaattacgcagtttctttaacctctagccatttaggggccttaaatttcattaatggtgaaaaaatcgaagggggtgctccagggggtatccatgggtcttgtgggtgcagggaggacttggtgtaggggggactcaagtccccgctgcacccacgttggatccgcccctggccgtagctcaactagttaggtttctagtagtaaaatctgtacacctgagttcaagttctagacttggtacgggtgttcatatttatggctagttttttaggtggtagggcgatgtactcatcaatagcgagatatctacggtgactttatcaattttaaaacataccaatttagtttttggagttgttcataggaatggttttagctatcacaaagatgtactaggggcttgttcacttttaacacccatatgtttgatttaaattcttaccaaattttgatagaaatttttcagagtagaaatttctaaaattgtcaaaaactggtaggatgagattggtaaaaacatgtttggttccttgccatactaaaatttgataataccgaaacatggtaggattagaactgacagtaaagtaaacacgcgctagatcttggtagtggtgaggccaaatttggagaacaaacacatactacccacacaaagaatgtacatccaaaacttaccccaattcaggtccactgtccacatggcacatacatatatactcctaagagtaaatcataaatgtgtaacttttgcatggacaaaactaatcaaggatcatgtgacgatctgtcgcacgtactacgtgcagccgtacacccccacataaatagtcatcgcatttaccgaagatgatttaatttgctcaacccaagacgatgtactactgctaacagcaaagataatagtaaactatatactctctccatctaattttaatagtcatatttctaaatctaaaaaatttacttttgataggcatatttcaatacaacaccctatcctcttaataactttctcgaatttaatgcgtgactcttcattcatccacacaagattaacgacatgggcatcgagaaatgtaaatattaatgaatcgcttttttacgagaaataactagtagcatgtttaaatagatgataagtataattacttatccttggtcattataccaagataaaatatgactatcaaaagtagatggagagagtacaagctatatgtttacgtagaagagagatgaagaaaagtgaaaagtgttcgttctcaaaataagtttaatagtatagccaactattaactctaaatcatccactggttttcttctatctggaactcgcttttcttctatcttcttttatctcttccactggtttatgatttgttattgtacttgctcttatgcaaaagatagctctatacgtgcttaaaaatatgcattaaatttcagaaaaagagagaggaggaaaaacatagagctaatgttaaagctaaattagtatacatgctacttttaaaatgaatttcaaataattagtgagttttactattaaactagctctaaacatattgtggccgggtagcccggatcacgttgccccagccgccgacagacgctggggaagcaatgactaccaggtgatcgatccagttgatgtgaaccaatctttttgtcacctcgttaatcaatcgattcaacgtacagtagtacgagcaggtacatgtacacgtatcgagctgcacatgcttactccctcagtcaaaaaaaaaaaagacaaaccctgattttcgtgttcaacgtttgaccgtccgtcttatttaaaaaaaatatgaaaaaaattaaaaagataagtcacgcataaagtattaatcatgttttatcatctaacaacaatgaaaatactaattttaaaaaaatttcatataagacggacagtcaaacgttggcacgggaacccacggtttgtctttttttgagacggagggagtatttatgccagtgtccttgcttgggattaattgctgtacttaactaattacgaggcagctaacacatggttcagatagatatggttcaggcatgtactgttaatgttggttgatagaattcaactgtcaaaaaagcttcattacatacggatagatatggttcacacttcacaactatcagtaccacggacttagaaaaaaagggtccatgattatgttgcagtagtgtgagcaattctgaatggaagtgcactgatcagaatgcagtaaagtaaaactatcactctgtcatccatatgggcaaaaagatttgagaacttgtattatactcatggaagaggcatctgaatttctcatgtactatacaacctgtcactcctgtgtatgaaatggcagagggtccatccatccacatagaaaaaggaatgggtgcccttgcgccgtaaacagatgctaatcttccatatgtacattacgattttgctttttcttttttcactttacaagttacagatctctcgatgtatatacatactatgatcctcgcctaatctcttcaatgtgtgcttcctcttcttactgtatagaagaatgaaataattggccgactagctgcgtttggtttccagtttcttcagcatttacctatgagcccggctacgttttgggcaatatcttttttggcctgcaatgagaccggtgaatcgccaatgtacataccgaacagagcccctgttcaccaagcaagagttaagtacagttaaaaacaatgaactttatcgtaccataaagatgcactaggcaagaaagtacttatccagatgcaagtcatggacagtgatccaagtgaagcgggtggaaaatattgagaaagtgtgaagtaatgaagtaaatttgtataagttttggtgtgacaagtatacacttactgcagaggtctttgctcttaacagcaccaatttgtctgccatcaactgcatgaaaatgtttttttttgtcaaaatatgtggatgtggcagtagaaaactcactcctcaagacatacagaagattcagttacggtctacggtacttactttctgttattagctggccatcagaagtttggcagaagtcgatctttgtaccctgcagttatattaacagtgtttacttgtatctaaaagttataaacatacggtagccaaatcctgtgttcaaccttaccgcaggaataggaatgtcttcattgaagtaagaaccaaaagttttcaagcaatgataatcagtgttgggattcatctgttgaaaatacaaatacagaagtcacatcagtatgaagaactcgtaaaagaattaaaagtatcagctgaagcagcaaccaacaagtaccttctggaggcgcaggccaagtgacttctcaaatacactgcgagaaaaacacaaaaaggtaaaatgaaacgtcttgaatagactaaagtcatttttttttatgagaaagtaacaatcaaacagatctttacaaacatgacaaatcaaagaaacattcaagcagatctctgtaaacataaaatgagagtactacttactctcgcactgcaccaatgctaaggccgttgtagtgaagtaccaatctaactctcataggaaggttttccctggaaattgaagatacaaaacttcattagtccccggtgcacatgtaatcatccttttttggaaagaagtgtcacatgcacaagaagtatcaagttaagaatcacttttcataacaagtagattcatatagactttcataagatcaaaatatcaataatgtcatggatatatgtatggcacatgaatggacaagtgtgtacacatgttttgaaatgtacgtagatcaactagcacaataacacaaacagttcaatttttaatacatcctgtggatcttgtgagggaaactaaacttgtgcaaacagttgccaaaaaaaaggtgcaagcactaccacatttatgtgtgctaagcatatgaataggcagaattgtaacaacaggacaagactggagatatatatcgaggtcctacctcaaaagatcatcatagaaatctgggttgtccttcaagttgatggttggaacagaagcatacttaggtcccagcttctcagaaatagtattcggttgcagatctatcaagaaaaatgcatggtgcaccgttaaaaagaaatgatggaacatcagagaaacatttttttgtagaatgtacaggtaaacaacataatagaagcacaaaaaatatttactcacataaaccaaaagcgtacagatccaaatttttgaccctcattactttcacacctttgaaacccatcccaacaaggacctgcaattaattatcaataataatgttacatggagacgtcacactaagaattcagagaaaaatgatatgctgatagttcagaagtatcacattatatgtaaaatgaagactaaactgaactaactcaattcaattgtccacagatcatttgtagtagtgtacaattttctgtatacatattaaatcaacacataaaataaaactatgtgattcaaaattgtcagaaatgaattaatccagaggatttcatttccagttcataatacaagtatattggattttacatgactagcctgcacgcctattaaagaggaggtacacagagaagacattcatgataataattttacgacataacaaataagaaaagtgtaccaaaaggcagtacctgaaaaaataaggtaaagtatcccagcaaaataaggtaaattaccgttgtagatggactggagtcatcttcgagaaatgcaggaaacttgattccagtttttggttcaattgcatctccctgaaatattgtgcttggcactgcaacagatctactttttatgcatttgtcctccagataaggcttatccataggtctgctgacatagtccttgatatttcccagtgccattgactctgcgagcgtcttcagtgatctttttaattcatacagtgaaatgaacagtcagtgagatataagcatagagcccaagcaagagcagggcacaaataaagtgtcgtactgtgtgccttacatattttcaagagggggtacaatagccatggcaccagccagagtaagaacattgcaggcatgttgctgctgaaaatcattccagagtcgcccaagtgttgtgcttgcgaagttagctaaaagcagttgtacagcatgctcttctcttactagataaccaaactgcaatacagccaaattttgcatacgggagctcaaatgattgatatgtgactggcaagctccagagctagggccttccatactcattagcctacgtaaattcttgggattagacactctagaaagccagtagcagaaagctctggcaaacttgttgaggcgatcaaatgcttcctgaacaatcaaatttcctgaagaacagatctgcctgtgctgtcgcaaagaacttcccaccattgtaccggcatgcgtaaacaagctcaacccaagatcatgagacattggaaaatctgagggaaacttgtgtaggtatcccaaatcatggtcgagattggacaacattaaccgatcggccttcatgttaaaatgttattcccaatataatcttcagaatgtagaaagtcttcagagaaagcttttgaatgtacggcgaggaaaaactttgtgatctgaaaattttaacaaaactatggaagtcagctataaaacctcttttacaccgtgaattgcacaaacagcatctaataaggaggtgatacatattttgtgaaatttaaaaaaaaaacaaatttcacatcatctattgaaaatggacctgaaaatgagttgtccttcaaatttacccttacaattgccaggattaaatgataaaaaataacactagctttctttgttctcatatcagcaaatagaactttactttgggaatactaagaatgcccccattatatgaaatgcaaataccatttgcaaatattgacaaacagtatcaattcaatcaatctaatcggaccctgtaactacgccagcaaatgcacaaatttacgccctacaagccccggagaacaataataagcattcccgtaaaaaaagaaaagaggaaaaaagaaaatccaatttctcctgaactggatgcattcgcaacgatccaaacctggccgatagactataaatcgcgccgtgtccagatcagcgcactggaggaagaacacgagaggatccgcgagtgccaccccccctcgatcgatcggttgcggatcaaccaaccgaccgaccgaatccgaacccgggggagaagatgggggaggggaatgggatcaaaggcaaccgccctcctccgaatcgccctcctcctctcctcccgtgaggcgagagaggcgaggcgaagaacgcgtgctcctcctcctcctctctcctctcctctcctctcctctcctctcctctctctgttttgctcttcctaattcgaggagaaggcgacaaagagctcaataaaagttccctccctttttgttttccacaaaagttctagaacaaattgttatttacatataggtcctcgtcacgtgcgaactggtccaggggatggggaatagttttgtttttggataagtttagggggttatgcgtaagaatccccgatggtttcggagaaggtgcggtgcgggggggatattccggcgggggagatcggacggtggggagccgatggtggacggagatgcgacaggttaataataaggggaattgatccgcgtcgaccgtggagacggggcgtggacggcgcctgaaacacgtttaaaatggaccgttattttgtctttcttccttctggacacgtgttggcttctcctagtaatttgataatttgatttcacatattactttcccaaaatataaaaacctatgattagatagaacataccataaaattatgaatctagataggggcgtatccatattcgtagtatcatccggttttaggttgtaatattttggaatggatacagtaggactctacgtcacttttgacttctcgatttttaaatgcttcttcattcagacttaaagttaaacattttaattttcaccatcattttttttataaattcatatagtttaatatcgtaatatttgtatttcaagatttatataaaaaatattttcaacaattcatgtattatttaactacattaacttaaaaaattaatagttacagataagcatgtttgacttaaaataaacctaaaatgatagataatttgaaacatgggaaatcaaatcaattcaaaatcaatgcaccaaaatctcagcatttttagcaaatcaggtgcttaaaagggaaatcaaatcaattcaaaatttaaaatttaactaccaaggtgactcagagaatctttcgtctcatccttattttttgctaaacaattttataatgcttatattttagaaacagggagtagtaaaaaaaatatggcaattgagtaggcaagtgatattaaatgataagaaagtaataaattttgatttgtacgataggctaaaatttatgtatcatgtatatgtataaagttgatccccactaagtatagttaatgctaattctcttttctctcatgaagccacatcaacttaattgtttttagcttttggatgatttatcaagggtgtaaaatgcatctcttcacatcaccttaattgttttaagtcttttggatgattcatcaggagtgtaaattacatctcttcctcctaaaaggcacatcatacaacctaatcatttataacctatttataacctttggataattagtaaaggtaaagaaatatataaacacatgaaaaaaaatggtatagtaggtaacaaagaaaattttagaactcgtgtatactatattatcacacaattcttccgcagcaacacacgggatacccatctagttttaataagttttgaatgctagaagacaaagggaatagtatatacacccatactttaaccggatgatccatagtttggccctctttgtttaggcttaggcttattggcctagacttttaagtcagcttattggcttatatgatttataagccagtggatttaatgtcctaagtttagtggtggagtcatacatctatctcatataagcccaaaaaagcttctccaacctaacttttggcttaatagtgttagagtgacttatggcttaaaaaaaccaaatgaaaaggttgcttgtttgttttggcttagacttttcgacttataagttggcttaaaagcctaaacaaagagggcctttaactggttaagataaacaatagtaaacgaaaaagcttatccagattcatactattattagacgacgagcaccttatattttttggatggaggaagtattaggtatgattgttgagcccatcccttgttcctgtatttttattttctaccaagtcaaagcgatggctgcttatgtaccactcctaacaaacatgtcgagaatggaagttgacacctagccgctagtaggtactgcaagcctccaacagaagcggctacataccagccagcggggacgatgttccagatgacacaagaacaacaaaagctacataattcaggggaccaagcatttgctggctgcctggctccattgatccatacacaatcacacgcaacatgccagtcgatcattggaaggccagttttcagagaaaaacacagtaacaacagaaggttacagactacgggagactcgtccatgatcgcatcagcaagctgctgactcccaccctcaatatcaaaatcaggaaactaggtcagagatcatttgttgttcacagagaatgtgacatcagtttcagtttaagaactgatggaagtgcacagggcaacgacgagtgcacaaaaacactaggcatgtgctccggctccccagcacgaacaagaaacagatctacttatttcaggcaaaggattatctagtgacatgtcggcagcacatgagctttcggtgttaaaggcagagatagtctgcatgcgtacatgcttttctgagacacctgcaaaacgttaaggatgccatgagggcatgtctgttgatgatagatatgcatgatctgatcaatcattatgtgtattgatcaaaatttttaatcaagggcaacaactgtgtgcgagacattctgtatcctacttcaggaggaagattatctacctaagcaaatagcatggatttcacagcttctaatgcgacttgtttagacaattaattaggataaaaaatgaaatgatgacgaggagtggtataaggtgatacattgtgaacttcatccgtttgccatcctttctgatgaatctaagcagactgacagaaaaataacataatgttatggtctggagaaggatacgacttataaacaatcaaaattatattctacacagatgccaatgaaaattataatggcagatgttaagaagtcatgtagggtagtcatacaggaagtatccgtgtgcacggctgcatactagaggtgcacacagccacagggcaagagaagttgacatcttaccttcaagccatatgggtaaagatggctttcacatcttcaaacacctcaggggctggttttgtcgcatcaatctgatcaaacaatggattagctggaggtaataaaagcgcatgcgttgacaaaacataccaaccagaaactgatagagcacgtgcacaaaaatatggccatatctgatgatggtgatcgaagtagtctccaactgacagataccattttaacacaaagttcttgcacttacttaaccttcccctgtttgctgaactgaatatcatatttctttgtggcaatgggactctaatcatgcagcgcaaatttgttgctatatgtggagtttcagggcctttattgtacactttctgacatagcatttgcacaatgcaacaacttaatcgagtaatgaatcaagtgatgagaaaggatagaggccatatgttaattcaatcacaaacgatcaattaacataccctgaaaatgacaatctacatatatcagacttaagaaaacatccaatcagctcacaaatatgtgtgctctactcaagggttttatttttccccatggtccctgctaaggatatgatatgttgtgcatcactggctgattgcagtgcacaaaacgagatcagagtaaaccatgctttattccatgtgtactgtgaatttcaagttttgaccctgaaccatacagcagtttactatatgatattgtgtgattatcttaaatgatgacaagtctataaatccggtagggagaataaactgtactgcaagaagcatgcataaccattacaaatgtacacaccttcttaaccatgccttttgactcataatactcaatgacaggcaagctggattctacaaaaactttcaatcttttcctgatagtctcaatgttatcatcacttcttccctgcaaggcaacaagaaaaaaataatgtctgaagaaataaatactcaagtgattgtgtcaaaatttatttaacaaattaatatcagagaagaagcaaacctggttgcgacccaaaaggcgcctttccatttcttcctcagaacaatcgaaaaatagaacaaattcaggagatatgcttatctgaagcagttggaagtaagtaaccaaggtctgtaattgcttttaaaatgtaaaatatgaacactaacatacacataaataaaattctcctactgctctattcaaaacaatgaagactaagtaagcttacaacactctcaaatacaacacgattctcttcgttccgtggaaatccatcaatgatatacttgtcatttccaccttttattatggcttcttgcaaaagctttatggttatctcagatgggacgattttcccttccgttatgatagtgtcaatcatggttctgcaaaatatagaaccagtaactaagtgagtgaaacaataaatatggcatgtgtacatgggcaaatgcatgtgtgtgtttttacccgttctctgaaccagaattgatttctgcacgcaagagttcaccagcgctaagatggataaaaccaaaatgctctacaatattgctgcactgagttccttttccacttccaggaccacctgttcatggatgctacatcagattaaacaacacacacacataaatacagttatgaattaacaacagcataagaaggaactgacagcaagttcacttttcttctataaagtggcagtcaaaggcatgaaattacttctaaagaatagagaaaacaatacctagaacaaatataattttaactttcttgccacccaacatgttctcattaatatcctgcagaaggacaatttaacccatcagattgtatgaacacaaaaagataagcatgagggtcaaattcaggatccaaatcaaattggtaactgaaatggctggctgacttacaggttaaaagaacaagtatgcataaataaatactatgtaaaatacatatccatgggatgcatggatttaaccatattctctcacgatggaatgaactgcagatgaatcctccaggaatctgataagaactgcaaggtaatgtaagaaaaaactaccttcttttcagtaaggacgtctggatcatccatggctgtgctcatggctacaagaatacccccatgattcagactaaacatcaagttggtgcataagtattttgcaatagaaccaagaaatatgcatcattcagaagtataaagcaatagtgcaaatgtattcaacattgcacatgcatagcagaccacaaagtaagaactatccaattctaggttgatcatgaagtccagaccctttcatggtgcacagatgtgttggtttggtccaaatattgaatttagctcacggcgcaagagattatcccaccaatttcctgccaacaacagtacaccaatccccgaagaccactaaagacttcgttcgagggttttagtaaacctctcccccctagtaggttagaacttagaactaaataagcaaagcagtagttaaacatcgacgattctcacatcctgcgagaaattttcaatctaatctacggactacagcaaatcagatcgggaacaagaagcgtggcgcggagagagaagggccggaaaacacgcaccccctaattcctacctgctgagctcgtcgctggagaaaccaccggacgagagggcgagggagtagccgcgcagaggcgaccagacctccacgcatccgaggcaacctggcggcggccgggcggcgagccgcggcgaggggcggaggtcacttgccggtcacggtggcggtggcggcgacggcgaggggaacagagaaagtagtaaagaagaaaaaaaatgaatttcttttttggattttaaaaagtggccgacgaacaagtcaagtcggtgctcggggcttgctcgttttgattcgtcagacttggggtagacggttacgatttaagacaacaactagaaaaagcgcggctttgtcacgcatggtacagtgagcctggccaattgggcctgtaaaaaattaaaacacatatgtaaaagagccgtattaacagtaaagataactaagctgtttatattagagcttataagttggctataagattatctctatatttcgtttcctctctttatgttacttataagaatttaatatatttaccttaaagcatgtgtagagctagattttacttgaaagccaacaatattttttaaaaaaatctttatcctccacataagtttatagtccactattagtctattatctttgctctaagagcaaattttataagcaagttttatagcaaggtgattaagacctctaatttattcatatcatcaactaactaattaagatgtagcatactggtttcaatttgcatccaaaccacaccattcttttcttggagtttgtgaagaaattaccacttgcatgaggggtggttacttctcgtatactatcttagagctcatactacacctaactacaaatatgtagtctacttttgttctctcttcttcgttattcaatagctagcttattgctaataaagggacaaataaaggaaacgtccatcatttttcacccacatgtcggtgtgtttttacataaaaaaatctttagaaaagttaccttttaaagaaaatcatatttcaatttttttcatgtttgaaataattattagtcaattaatcatgcgataatggctcacctagttctatatatctccttaatatttttatctcctcttaaacatagcctaaggtatgtttggaactcagaaaaacaaaatacatgaaataaaatatttgaaatataaaacacataaatacgtgtgtaaaacagaggaataaaaaccatagaaagtttgaaaagatggatgtttggaacataggaaattttagtggatgatttaactatatcctgctaatccgtattattactttgatccacaagaaatagcggcctgcctgactaagctttgttgccagctgttcggtgggaatgtgagaaatcaacgtgtttgcactacaacatgtatgcataccatctcgtctcttccacgtaaaggcgacggattgggaagaaatttctggacgcgcacgcacgcaggcaagagcatttcatcgatccctgcacgcgcggacgcacgtttcgtcgtcgagcctgcaaaaccggtgttgccacgtggcaccattctccttccgttttttggcattgaattcgtattataagattctttcacagctatcggttcaagtggctaatatgtgagccagattattttaacttataaatagattcggggattagtcatttacatatttattattatgctagcttactgctctacgcacattgtgacagtgataagctccactagaacaaaagctttagttttgtgttgggtttcattgggattttaggtagatttggttcagtataatagttaagtttattcagggccacacaggcccccaatcttaaggggcccaaataacttaatacgtgtcacaggaccattagcccaatagattaaatctattgaaatgtgcaattggaaacaaaggctgagcgagcacgtcgattcgttttcggcgcgtgtgtcgatttgagcgtcctcccgtccgtctaccccaatccatacgctgcgccgctctcgcactcgcactcaccgtctcgctgtccagctcgacgctcggctgctcgtcgctcggcttttggccctcgtcgcttagagcaagataatagtataagataatagtatagctcactttttactattagactattttaaagctaacatacataatagattggctataaggttggctataattttcttcacttctctctatctctcacttatatatttaatgaatttgtcttggagattatgttaagctagctcttgcatgagagccaaccctcttgattttttgttacctctcttctccatataagtttatagtagatttatagctcactattattatacttgctcttaccgtctgcacgtctgctgacgtgccgcagtaaagcggcaaggtagcaaccagcgagcaacgtctttgggcgacctccccggcgatatggcagcgagcacaagcggcaagcttagctgccctgcacacaccagcaaggatgccgggtacatgacctaaatttttattctgatcgctaggtttatggtgtatctaatatgtatactagattaaattttattcatcttgtatctatatatgcatagatttaagtagtatttcaacttctaagaaatgtcatctgcaaatcattgaaaactttatttcaagaaatactaaaggaaaaagaaagatactttccaattggagattatgcacaaagacaatttctattaagtttatattgctaaaatatatcatggagtgtaagtttaccggtttattttatcgcttaagttagaagatttcacacggggcctccaaatttcatgggacggccctgagtttattaaggagactgttaatattatgtaattttggtcaagtaaagatatatggaataatatctattttggtttttatatacttttatagtgacattcgtgaaccaaacgagcgcctaagtcccaactcccaactagctaaaaaattgtcaaacaggcccatacactgctgctctagttagcagcctctggggctacatacacgacacgtcttaaggattacgaattacgatgaacaaataagtttccgccctctactgtcaacatgtatcaatacgatttgtctgctagacaactagagtatcaaatcaatgttagcatttcccaaccgatcaaagacaattagcagaagaatacttcgagtacgatggatttcttcgctattactgtactcgccgttgacatatgattccgtaagaaatctatgagctggacgcttgctcttgcgtcaagctttcttctttggtgccggaactccggcagctttacatgaatatatatatacactcatctgtttcaaaatgtatagcgttattgacttttcgcataacgttggactatttttttatttaaaagtttagtacaaatatgtaaaagtataataagttaatattatattatatttgaagataaaacaagccataacgaaataaatgatatttacataaacttttttaataaaacgaatggttaaacgattgtgtgaaaagttaacaacgtcatgcatttgaaatggtggaagtatatattaatgcattaggcagcttgtatatatcatgtgtttacgattgattgactgccatggagttgagtaagactctgttagtcaagcaagaaaactatggcacaaatggtatccatgcatgcacatatctcaagcgcgcgagtgccttggtgttcttgccagttgccacactccaagtgaaaaaattatgcaacgtacgaattgatggaggcgagcaaggcgaagcgcagcgtggccatcgtcggcgccggcgcgagcgggctggcggcgtgcaagcacctgctggcgaggggattccggccggtggtgttcgagtcgggggaggccgccggcggcgtgtggaggcggacgctggcgacgacgaggctgcaaacgccggcgcaggcgtacaggttctccgacttcccgtagccggcggcggcggcggcggaggagttcccgcggcacgacgaggtggccgcgtacctcgacgcgtacgcgcggcggttcggcgtgcgggagcgcgtccggttcggcagcaaggtggtgagcgccgagtacgccggcgtgccggaggaggaggcggcggcgtgggagaggtggtccggcaacggcgaggcgttcggcgacggcaggggtgagtggcttctcacggtgcagcaccgcgaatcggagaacctccaggttggtgaatacgtgacggcatgagcacacagaaaagtgtcattcctgtcggcttatcaccgtcagtttggcttgagccgacggggtttctcaatcactgtcggttcagcaggttgatcgaattttcccgcccaacccacttgataatcgaaactggatgtcaaataatcgaaacccattttaatgagtgttaaattatcaatctctcgcatagtatggtaacaaatgacttgtcaacggattcacctcgcttatcaatccacagacatataagttcgacttcgtgatcctttgcattggacggtatggcgttgcgagcgttccaacatttccacccaaaggagtacctgaagcgttccatggacaagtgctccactccatggactactctagcatggaccatacggccgcggccgagctgattcgcgacaagcgcatagccgtggttggttctggcaaatcggccttcgacaccgttgcgcaatgtgccgatgtaaacggtgagattgctgcaacagaacatgttcaccttgatcacattttccaaattgaatttgaatttgttatgacaatttttaccgtatgatatataatctatctatctattatattattaaaacagccttgaaagaaggcaccacattcgctgtgggggctagaaattcccacattaatcgaagaaaaagaaaaaaagaaaaagaagagtccaagtagaagtccaatttaaaaatagctgaaattcggaattaaaaataagcaatattgaaagaagtttccatataagaacccaatacgatattaaccaaaattcgaaataaaaaaaaataaaatccaaaattagaaaaggaaaggagagtccaagtagaagtccaatttaaaaatagctaaaattcggaattaaaaataaggaatatcaaaagaagagtccatataagaacccaatacgagattaattaaaatttaaaataaaaataaaaataaatccgaaattataaaaggaaaggagagcccaagtagaaatacaatttaaaaatagctgaaattcagaattaaaaataagcaatattgaaagaagtttccatataagaacccaatacgagattaaccaaaattcgaaataaaaataaaataaaatccaaaattagaaaaggaaaggagagttcaagtaggaatacaatttaaaaatagctgaaatttggaattaaaaataaggaatattaaaagaagagtccatataagaacccaatacgagattaattaaaattcggaataaaaataaaaataaatcagaaattagcaaaagaaaataaaagaagagttcaagtaggaatacaatttaaaattagctgaaattcggaattaaaaataagcaatattaaaagaagaatcaatatatgaacccaatacgagattaattaaaatttcaaataaaaaataaaataatatccaataaaataacaaaattagaaaaaaataaaagagagtttaagtaggaatacaattttgaaacaactgaaattaaaaaaaataaaaacattaaaagaacacaatacggtattaactatttttttaaaaaaataaattatgaaattagaaaaggaaaaataatatttaaattagaaatacaatttataaataactaaaatttgtgataaaaataaagactattgaaagaaaaaaccatctaaaacacataacgagataaattaagtaacaggcctataaaagagtagagtgatggcggttgatacgccatataaaaaatgttaataaaacaacaaatagaatcctaatgacgattataaggagggacgtcgggcatgccgtgaagcaaacaagtaaggcagtagccgggacttctagaaagtaaaaaaataaacccattgataatcatattcgatttttaaaatctcaatgacaataaaaaggagaagaagcgggcgggcgtataagagtatggttgcagagccgccgacggttgacgggacttctagaaaataaaaaatgaattccaacgatagttatgttcgatttttagaatcacaatgacaataaagagtaggcgacggacgggctgtagaggggcatagtggcatcgttcaaattttaaaggttcggaacttccaaaaagtaaaaaaaacctaatgataatcatgttcgattttaaaatctcaatgacaataaagaagagaggcagcgagcgagccgtagaagagtacaatggcaaagccgctgatggtttgacgggacttaaagtaaaaatgaacccaaacgataattatgttcgatttttaaaatctcaatgacaataaagagaagagacagtggacgggtcgtagaggagtataatggcaacgtttgacgggacatctagaaattataaaaacgaaacccaatgtgacaataaactctaaaactataaaatacaaattttaaaggttccaaaaagaatgaatagaaatagtgatagatcgagtaagcaaataaagaaagagatgacataaggggtagcaattggtgtgacttttaaaaactatataattagaaacacgaggatgataatggtgtgacttttaaaaactatataattagaaacacgaggatgataatgtttggtctttcaaagtcttaagacaatgagatagctatttaataaattttaagtaaaatcatactaaaaatatattattttgtttgggtgctagccgcataattacgcggccacccattctctattaaaaggacaaatttatcattttttataagttactcactttctaagtatctcacatacgtggttgtcagggagcaagtacccatgtacaatggtgtacaggagcccacagtggatggtggatgcagggcttgtgtggggtgtgaacctccagaaccttaccacgtcacggctggccgaggtgatggttcacaagcctggtgaaggcctcctcctgagtcttctcgccacaatgctgacaccactggtagcactcaaccacagttaatccatcttgtaagaagaaacgctaaatagatcgtcactaatcgttaacagttcaatttcacaacccattgattccttcagagatggttattgtcgaagctaacggagatgtactacaagaggcacacaccgatgcagaggcatggcatggtgccaggctacagcttctcacagtcaatcttggcttgccggctcggcatcctcccgaagagattctacgaccgggtggacgatggcagcatcgtgctcaggaggtgtgacccgtctttcagcttctgcgccggcgggctggtgctggacgtcgccaccggcgaccacatcgtcgacgccgacgtggtcatcctcgccactggcttccaggcggaccggcagcttagggatatattcgtgtcgccgtggttcagcaagatcgtcgcagaatcttcagacgccactgtacctctgtacaggtcattgcgtttcaccaatcactatgtatcgcagaatttaactatgtcagtactttcttaaaaaccataaaattactgtaatatatttttttcttttgaatcatctctgagtggtgtgatttattgatcgacagacggtgcgtgcaccctcgtataccacagatggcgatcattgtttacgcggagagcgcggcgaacatctacccgtacgagatgatggccaagtgggtggcgcaccttctcgatggtgcattccagctaccgagcattgcacgtatggagaagagcgtggtggagtgggtttgttgggcgcatgatatgaggaggtgtagcggcaactacttccgcaagtcatgtattggcaccatcacaacgtgggataatgatcagttatgccgcaatatgggatacaacccaagaagaaagaaagggatagttgcggagtggatagagccctatggagccgctgactatgctgatatctagtcaccatgtgtcacaaactgaataataataataataataataataataataataataataataataataataataagtggagagttaattgtatttcaaatgttgcacatatagaccatgacaaacatgtggcagcaatggtgaaatttcaagtataacttaaaagggataattgaagagagtacttttcatccgttctataatataaacatttctggttataaatctatacggaagctttgtcagtgcttaaaagtggaatatcgttatcccatcccagttaaaggaagagatgtgtaaaagtacccaaaactgttgcttgccagtttatgagcgctgcacgaggaagcatgttgttgtgaaccttttcagcttggtctagagcatggtgcttagggctgtgtttgcaatcctggatttccaacccctctccatcatattccgcgcgcatgtttttcaaactgctatgttttcataaaatgtttctatacgaaagttgtttaaaaaaaatcatattaatctatttttgaaaaaaaattagctaatatttaattaatcacacgctaataaatgtacactgtacatgttgggaacttaggattgcaaacacagcccggtggtaacggagccaaactttttaacctacaaaatataaagaatgggtccaaagagattggagtaagatttaatagatttttaaacttcccagaagtacggatttaaagtattgagatgggttctgaaagggcccgtgacccattaccacctactgatgctcgatggatgatagagttgttgtcctcattgtttatccgtagctttctgtaagacattattcaattattaatccccaaaaaaataagaaggatatggtgtaaaataattctcccttaatgccctctaatcccttctctaaggggattaaccccaacaagggcttaggccatgttacattactactatatatctactccctccgttttacgatgtaagtcattctagcatatctcacattcatattgatattgatgaatctagacatatatatctatttagattcattaacatcaatataaacatgaaaaatattagaatgaataacattgtgaaacggatgaagtatataaatgttcaggctggctagcgcttcaatattctatcgatggatgcgaccaagaagcgtgtggccatcgtcggcgccggcgccagcggcctgacggcgtgcaagcacgcgctggcgaagggcttccggccggtggtcttcgaggccgccggcgacggcgtcggcggcgtgtggaggcgcacgctggcgtcgacgaggctgcagacgccggcgttcgcctaccggttctccgacttcccgtggccggcggacgtgtcgggcgccgaggtgttcccgcggcacgaccaggtggtcgaatacctcgccgcctacgcgcggcgccacggcgtgacggagtgcgtccggttcggctgcaaggtgctcgccgccgagtacgccggggtgcccgatgaggaggcggcggcgtgggagcggtggtcggggaatggcgaggccttcggcgacggctccggcgagtggcttctcacggtgcagcaccctggatccgaagctacccaggtaattaagttcacgtgctacttgaatttttttgtcaaatttatttatgtttgatttgatcaattttatagaaatatttttaacacaaaacaaacatatattcaacgttacatttaatgaaactaggttggtattgtagatgtttctaattttctcatcaaattaagaaaatgactacgaaaagttaaaacgatttataattaatatgaaatggagagggtagctaccaatttcaagctcatttcaattggtttatcacaaattgcacacgtacagttaaattacagtaacatttcaaacggaacttgaaatatatgatcagaatatttcaaagagaaatatatgatcagaatatttcaaagagaggtatcttggtgtacagatacacagggtcgatttcctgatactctgcactgggagattcagtggagttgcccacaccccaacatttccacccaaccgaggccccgaagtgttccacggccaagtgcttcactccatggactactccaacatgggccacgccgccgccgacgagctgatcagaggcaagcgcgtcgccgtcgtcggctccggcaagtcggccttcgacacggtggcggagtgcgccgctgcaaacggtaagatccacatttcgcggcgagagtaattaatcgatctgtgatgaactgttgagcgtgcgtgctgcctgccatggatcaggtggcaggtatccgtgcgccatgatctgccggagcgggcggtggatggtgaacggcgggttcgtgtggggcgtcagccttggacacctcttctgcaaccggctggccgagctcaccgttcacaagcccggcgaggggcttgcattggccctcctcgcaattctgctcacccctttggtttgtgatgttacacgtttgtgaagtgatagatcgtacattaatttatacggttgatttttttaatttttttaattatttaggtgacatacatccctcgataatttagaataattttcccaattcaacttgattatgtatgcatttttacgatggtatttatatcggtatagtagaaaaaatttagatctttcgtcttttcttttttatttgactggttactagtattaccgtagctattgcttgtaaataaataacctcatcttttcgcttatgcttatactcagccaaaatttaaatctttagccttaaatttggagttgattttgaggtttttttcatcgaagtttatttttcagcctttgattttggatcgctaaggacacatatataaaagttttactcataaattatttttcgtatacaaatatgtcgtttggattattccatgaataaaccaaacgatggagccaaaagtagttggacctttttaagggacaacaaactattttggaccatttacggaacatcgatccaactaggcggcggaaagatatattgatattgaaagcatactagtatcaattattgcatcccaattatggaagaaacaatgtttccttattttaatgtgtacacattcgaattatgtataacagacaagtaaattcgaaaatttcaatatccatgttgtaattttaaaatgaatttcaaatttgtaattgaatttttagcatagttggaattattttactttattttttttagaactactactctatcaaaaaaaaatcaaaccctccgtccaaaaaaaaaaagacaaaccgtagatttccgtgccaacgtttgactgtccgtattatatgaaatttttttataattagtattttcattgttgttagatgataaaacataattaatactttatgcgtgacttatctttttaattgttttataatttttttaaataagacggacagtcaaacgttggacatagaaaccatggtttgttttttttttttgacagagggagtaggttatatcaatagtagtagtgtatttttcaccgggcatttcttcgatataatagtgatgataggattctactaagaccagaaaagtgctcacgaattttaactatatcaagtactagctgttttgatactgaaaatgcttttttttgtttcagagatggctgctgtcgaagctggcagagacctacttcaagatgcagatcccgatggagaagcacgggatggtgccggaggagagcttcgcgggatcaatgtcgggctgccggctcggagtcctccccgacaagttctacgacagggtggaggaaggcagcatcctgatcaagagggcaagatctttcagcttctgcacggacggcttggtgctcgacgacgacgacaccggcgagcgcgtcgacgccgacgtcgtcgtgctcgccaccggcttccgtggcgaccagaagctcacggacatgttcgtctcggcgacgttcaagcagcagatagtagcagctcctctgtacaggtgatactccgcacatcgccgtcaacgatccgttcgccggcgagccggccagcgtctcgccgccgatgagcattcattcgttcgtgcaggcagtgcgtgcacccgcggatcccgcagatggcggtgatcgggtacaccgagaacctgacgagcatctacaccttcgagatgatggccaagtgggtggcgcacctcctcgccggcgcgttccggctgccgagcgtcgtgcggatggaggcgagcgcggcggagtgggacgaacacctggcgatgaggaggcacggcgagggcggcggcggcaagccgtgcctcggcggcgttagcacgtggtacaacgacgagatgtgccgggacatggggtacgagccgaggaggaagaaagggattcttgcagctacgctggtatcctctgaagtctgaactcaagtgaaactgatcagtgatcgatcgatcactgatgtgttgatcacgagtatacgataaaaaagaacatgaactttggaattgttgggctttcagaaaggggaaaataagttgggctgcgatatgaagaggaaaataagtcgaggaaataagcgttgttccaaaactttgttgcatcgcccatcgttcttctgcaaaacattgttcgtgtatatctatttccgtctggctaaaatctaacagagagcacgataccttttcgagatatacatgtgtgatgtgtctgaaaaaaacaagagtatatggcctcatttgatttaaaggaaattcataaaaattttagagaatttcattcctatagaaaattttcctatagtgctttgaattaaagaaataaatcttatgaaatcctatgatttcctatgtaatgcctaatggcatgtaaattttgttggaaatctaacatgaggtagaatctcatggaaactttcctttgagttttttatttctcatctaattcctgcattttttcttacggtccgatgaaacggtcatttctatgttttgcaatcttctgttttacactcacattcatattaaaatcctatgtttttcatatttttatgttttcttaatcctactattcaaatgagcccaaaatggtgagtcaacagtgctgaatatccgtacgtgaatgactgcagaaacaaccggaagaagatcgttgattcttcgcctcttcggatcaaaaccaccctattgctcaacttgtcgcagcttgtgctgactgccgacatatgcattggaattgaatccatgaagagagactgtaatttgcatcagctctttgctatccgattgaaaatgcacagtcaagaaacacaactggtacttatactttttcctttttttgggggaaactggtgtcatctttgtgctttataaaatgtgtaatgtatcacatggaatctagacaacagatggtgcagctcaagaacggccatccaaagtgtctgaaagttttacatttagatcattccactataactatagtatactcccaaatcaactcctgctacagccaaatcgactctcaccacgtcggtgggagagaaggaaaagagacgatgattaagaggaccaaagttggtccccgtgtcaagagagatggcgtggtagggagaagatcatgggtggacctagggggtgtgcctggttggcaccggtatacccaatttttttggaaaaatactaggatgtagtacgtaatcagaggacataaaaatagaattctctcataaaatagaatataacaatgatcatggtttgcctggagatcttttaatcatcaaaaaatcaaatcaggagaagaggaaaggacttgatgaaaagaaacagtggaggaaaaaaagaaaaatatctagatagattaggatatgggattgattgttctgagtcttacagatatttactgaatgggagaatagctaatacggtccctaaagtttcgcttcgggctcaatttagtccttgaggtttcaaaacgtccaaataagtcctcgaaattaatcatttgggttaatatagtccttggacccacaaaaaatgccacatgagcatgccaagtcattcttgcatgcaacaatacaaatgaaatgaccattatagccttaccatataaaaagaaagaaaagaaaaaaataaaggaaaagaaaaggaaacaacaggaaggaacgaacaaaaagaccggcccattactctatctgtttgttttctccatctaaaccctgattataatgtgtgaaccatttatattatgtcatgcacaattatgtcatgcatgttggctataacttttatattgcaatttgagttgattgggtaaaatatagttgctacttttacctacttacacggttttgttatttctaggattttgataattccgtgcagtacagagttgaattgttctatatctgtttgcgtgcacgtttaactactcacaataaataaataatatatattattagatacaatacatgcaaaagaagataaatggttcacacattataatcagggtttagatggagaaaacaaacagatagagtaatgggccggcctttttgttcgttccttcctattgtccttttttttcctttattttttcttttctttcttttttatatgataagggtagaatggtcatttcatttgtattgttgcatgcaagaatgacttggcatgcttatgtggcatttttttgggtccaaggactatgttaacccaaatgactaatttggaggatttgtttggacgttttgaaacctcagggactaaactgagcccgaaacaaaacttcagggaccgtattagctattctcccttcatgaattatggacgacatttgaatagaattttcaaaaatccgaccaaaatttgccatcggaattgggttttttttttaaaaaaaaatggtggagtgatcgctagaatgggcacaccaagtgtaattttttttgggtccgccacgagagaagatgatccatgcatccggtgcaatgttattgtcaccgtgatccacgcacaatccgagatccaccgtccatcttcaagatcacaatcacgccacacaaaacttgcgagatcactctctccctatcgcatcttctatctcggctctaagaaactcctatccccaacgattgttgctatctaatcgtcagctcttcgcctcatttttcacgggcacagtggaagtggcggcagtcgaattaggggcataaagtagcaaagtggcctaagtgcaaaactttcatcatgccatgctggatagccacgtcaactcctgatccatctcatttgtattttgaacttcggatgatatattaaactatgattaaataagcatatgtgtatttacgcttttatatatctttcttttataaaataggataaacccggcctctacaacgcctttacgtatctagatgacacatagtctaagtttaatcgtccgaatatttcagttggtttagcgcaccagattgtactgttcacaggatttatttattgttctccttgcatccacagtgtttgtccgcggtacgatggaacatgatccggatccatgcgtgttatcctatatttctagtcgtccaattactactccatatcctaccagaaaactgtgacacatcattattcaaccgttgcacagaacgctgctcgcaaagccgaaacttgtaaaatgggggccagaaagaagcagtgccagaggaagaaaaagtctgtgccccaaatgtggagcatatggcctatatcgcaccgaagtagtaccatgtaaagttacatatgaagtcaactattgcaacaacccaacccacctgtcctacgttaaattcagcacacctgaagtccccaactttacgttatcccctctgtaatagcaatacacgttgtctttgctcagaaagaaaaaaaaaacccaccacagtatgataaaacacggtcaaaacagcacagaaaacgtgccaatttgaaagattagtcagccctggccagagtccggacacgaaccgcgatctcggtcaaggccgtcaagcgaggccccggctcgcgcaggcgcaggccgcgcggctgacggaggaggagtcgcggctagtccctccgctctcggcacgtgagtcgtgacgcgagaaggctcgcggcgcggagcgaaggagagatccatgtctgtttagcgtcggttagatagagctccaattataaatttagcttcaggatttggatctgaaataaagttgtggagcttcatctcattttgtaagagagctctaccaagcttcgctcttattttaggtggagctgtttggctgagctctagctccactatgccaaacagacctttagtagagctttaactcttaaatttaactttaaaagttgaatttgaagtggggttgtggagctgcctaaacccagtttcatatttctagttttattttataaaagagttttacctaactcaactcttatttgagattaagttaaaactgtttggctgacctctaatttgatgagaactagagctagagctagtcctgtgtcaaacagctcggacaacgcatcgcgagagtcgcgcgcgtcgcttgcgcccgttttgtcgtgtggcgccgcggcacggctcctgcctgcgtggctgcgcgcgcgcctggatcgatcgggttgagcacgtgtgcgtcggctgcgttgcgtgcggcggggactctgctttattcgatgggtttggcgcgagcgccgagcgagcgagcgatcgcgacggcgggacgccgacgcgcgtgtgccgggcgacggcgttttttcgttgtgaagtgtgaacacggtgctggtgctacgttttcaccggttcaccacgatttcggtgtggaaactgcgagcggtgcaacgttttcaccacgtgcgatcgatcacttcgctttccaggtttcgctgcccctgaatatgtgaattcatgaaccaaattctattgagaacgaagggtttcctaacgtgcctcaaagacaacatgtaactcccaattcgtctcagcctggtctaaatttgttaaaatttgaatcaaacttcgttcgaaacttttcaaactcatatattttggcgggttcttattatttttttcctttttccttttgcaatcggatcccagaaccctagccacacggtcagcacactgacagtggttcaattttttttttcattttacaatcgttcaattttatctgcttaaaggaaaaagaaagctcgattggtggtttaccaatccattaaactgtgaagctctccttgaattgtcaagcaattttgctaaaaatatgcaatcacattttcaatattattttcttgccttttcctaatgtgattgttcttgtacgattgtctggtttaatctaatttaggtggggatttcccccgtgttccttaaaaaaaatgtgattgctatatctcacctatatcctcttatatctcagctatttttggtgggtccgacgtttttaggtgtgaattgtgaacagtgctctcgttttcaccacgattttctgtgtgagtgtgagcagtgcttcgttttcaccacgtgctctgaaaatttgaatactccacttcactttgcaagtttcgctgctctgaaaatttgaattaatgaatcaaattcttttgaaaaggaccgaaagggttttcctaacatgcctcaaaagttttatctattggtgcacaagtcacaaacgcggtcaggcagacagtcgttcaagatttacgaacgttcaaagattttgtgctacctaaaagggacaaagaaaactccattagcctacgattgtacagattgagctctccttgtcgttcagttatactaaacactttaccaccggcataaattgccaagacatgcaacggtcatatagcttttcgtcaatttcggttggagattcatatatgggattcaataattaaggggtctttattttgtgtgagcgattattagcttgcgtttgcttcaattatttgggtgtgtttttttagacttgatgatgtgcgctggttttgcacgaatttatgtaataattggttgtagctcgttgagtaaagattggagttctattctactccctctattccataatataaggcatggtcaaatttgacacggttttcaaaactaatgtttatcttataatttcttatatattataaggtttgtagtagcaaaattataatcatatgaaaggaaattcaaatgtcaatccaatgatataatttttagcaagtaaaattaaatttatattgtactaaatgttggtcaaaatgttttgaaggtggaatcttgaaatacgtgaacgcattatatttgggatggagagagtattatcttaagaaaaatgccaagacatgaggaccaagcaaaagaatatgacattcccacttacttccttcgtttcacaatgtaagtcattctaatatttcttatatttatattggtgttaataaatctagatagatatatatgtcttgatacattaacaccaatataaatgtaggatatgctagagtaacttacattgtgaaatgaagagtgtacaacctaactatgctatcaacatgtttgataactttaccagttggcatatacttgcttggctacttcgacgaaatacaaggtggcctaaaagttgaagtgcagaaagcacgatcgcctctgttgttcttatttgtgggaagccactttctacccgtatatatatttgctaaagaaatgtgaaagtaaaactcgtacggagactgaacagaggcatgtgagaaacactctggaatggaaagtgtcaacgtgttaacggagtgcatcaagctgtcgtgtaatctgtacatttctgtcagaaaaaaaaaacttcacattgtttttcaaaagaattatgatctgtacattcctgtgatccgtttgacccggtcgtaaaagaatcatgcattttttttctcgacatgtgggcatgaagcatgcaggttatattaggtcattcccaacccaaaacactagacatagtttccataaactccatatcataaaaaaaaactagtactagacactactctttcaatgcaaacaccattatttcatacttgaatttaatgctacttatctcatatgatatcttatctcatatgatatcttgaatattgtgtagaaatcatgtctcatgcaagacatggtttccttctctttcctcatttattcacttgccgcatcatttttcattctagatggcagcttatttaatgctatggacactatcctaattattgggttgagaatagccttactacaccagatgcaataaactaccgagtcacattttaaatagaacagatagaacagtgaaaaaaccccaagatatacgaaccataattctcttaccccacgacactacgtggtgcctattccactgctcatccagccactcatgtgaaaggatcatcgatgttagatttgagaaccgacattgatggctttccacgagtaaaaaaaaaaagcactgagtcagatccatgaatcaagttaatatgattgtattaactaaattaatggaactgttaaaaaactaaatgaatggaagaatgacaaatcattcacataatatcccagaatatgtgcatgcttcgagccaaaagaaaacctaaatcacactataaattcaacatcattgtctagagccaagtggaggggaacacaatgaggtatctatgggtgaagtggagacaacgtcgctcatccatcgagctagagttgagcttgtagatttgctcctagcctctgtcaccccgccgcccacaccctatgcgtctcccttccccagctatcaaaaaaggttatcacttctctatctttgcttcgttgtttcatcgagctatgtagatggtaggatctggcctcttcgagcgtagcgaggatgaaggggaggcgatcaggatggatctagtcttgttgtcactacctctccccataccttgacgatgacaaaggcggatctgaccgctccccaagttcgagataactggatttggtggccacccgtcgaggagaggtggatttgttggccccattgctcgttggccaggattaggtggttgggagaaaatggagagagtagagagagagagagagagcaagagaggaggagagacgtatgcgctcggagtctcgagtggttgcaaatgaaactgatcggtttgatatatttttctagctcactaaaaactaggcactattttttttgttgtgttttaatagaaaaccaacatatataactattatcagtgccaaatttttttacagaatcagcatttataattatcattcgtgtcacggtgccagtttttatcagtcaggaaaacccttagcgccggcttttttttttcttcttcaactaaccggggtacgtttgggcgtttggctgcctggctgggtcatggaacggaacggaacgtgtcaacgagttggcatcaagttttgtcatgtactgtaatctgtacttttcggtcagaaaaaaaactgaacattgtttttcataaagaattgtgatctgtacagtacattcctgtgatccatttgacccggtcgtggaagaatccgtgcgttttttttttcgacttgtgcgcatgaagcatgcagaactgaacaagtatgcaagatgcaataaacggcggcgtcacattttgaatagaactgtaaaaaaaaaacccaacatattggaacaataattccattatgaataagattttatttacacagcttcagatctaaagtttttaaactgggtatttctaaccttataatttcatagatttagatctatgatcacgttaataacattttgacaaatcattttgtttctattttgatgaaatttaaagttttaaagcactataatttaatatacaaacttcaaatcaaacgtgaaccgaagtctataataacatgcctaaacttattacaagtatgaatggagtattcaaagtaccctatgtttacagtttgggagttcaatgcgttactcccctgggtaaaaaaaaaaaagaaaaaaaatcatgtttgaaccttttaacggttctttcagttgtggttttgaccacaatattttttataaaataaagttaaagattatcaaagtacttttcaacacaaatttacacaagacatttttatgttcgttaaactatgtatttcaaacttcattgatagtccaaagttaaaaatttggtcaaatctaatctaaaacatcatataaccaaagggaatatttgaaaagccgaacatactttttaccacccatactagaatttatttgggaaaaaaaatagccatgtttaaaaaatagttgccactaattttttttcctttattacaaagacttcagtcccggaggaaaaaaaaacaaaacggagtacgaaaaattggtgaggcctgtaacaattctaaacacccagccagccaatcatgttcgtctcctgttggaacttgtaacatcagtagatcacctaatatgatcttattatccatgtatattaagttgaagggccaggatcactcacctaaaacacagcaatcaactcccctaaaaattgataagaacaaaccactcctcttgttcctttccaccaaggaagtttcagtgggtgttagtgtgtcaccatccatggcaagccatccatccatggatgcaactcacatacatcacccatcaccaaagccattggtcccatattatgctttccaagtagctttcacccactaactaactgggaggaaaattcaagtacagcatcgccaatgattcaatgataaacacggttaaaaaaatgaaagcatagtcgattaattaattgtaagcccatcgaattacaccacctgctggaattaactttgagtaatcaggtcaaatgaagaggacatcccatctctttcctgacgagttattattaacccacccacccggaagccactgattcacgcagccacaagctgattagagtagcatctgatccaatccaaagccacccacttcttctttatatacctcccgcgccatctctccttctcccagctcgaatcggaggaccagctccgccgccgacgattcttgacttgccttcttctccggcggcgacgattcttggcttctttggttgattggtcgggcggagcagcggtcgaacagcttgcgggcatcaacaggcgaggcatggcgagggggctgtttgcgtgctttgggaggggaggggaggaggcggaggaggaagcagggaagaggccggcgctgcggcggcggaggacggtgaacctcaggtcgctgtcgctggaggacctgtcgcggacgctggcgaagacgaacctgcacgccttcaccctggacgagctcaaggcggcgaccaagaacttctccaccagcaacttcctcggcgagggcgggttcgggccggtgtacaagggcttcgtcgacggcgagctccgccccggcgccctcgagtcgcagcacgtcgccgtcaagtacctcgacagcgacggcgtccagggccaccgcgagtggctggtgagtttgccgctgtctcttctgctgccgaatcatacatccagctcgtctgatgtgatgatgaactgataataatgattttctcgttaatttttgtgatcaggctgaggtggtgtatctggggatgctgagccatcctcatctggtgaagctggtaggattctgcaaccaagatgatcacaggatgctggtctacgagtacatgccaagaggcagcctcgagaaccacctgttcaagagtaagtagttactaattaccacatgatttggggttaattaccgtgtgttagctgttgcagcttttgctaatcgagtgtgtgattcattgggtgtgcagatcttcttgcttcgttgccatggtcgacgcggctgaagatcgccgtcggcgcggcgaaggggctcgccttcctgcacgaggccgagacgccggtgatctaccgcgacttcaaggcctccaacattcttctcgacaaggtaaatcacacagcaagcttaatttacagcaaaattcgttggtgttgaccacatgatttgtgttgcaatttggggggattacaatttgagagcacagtttaaaaattgaatcattgttaagctgcagagtgtagggcaagtaggatgaattgagaatgtagtagtggttgtttattttgtatacgcgacacgcccaatcaggcgaatggatcgcacgttgtcaactgtttccagccgggtcaaaaatcgtagcttccaacagtaggattaattaaaataatgcgacaaataatgcgacaaattagcagcaaaacctttgattgtttattacacaagccggtcgttgggcgtagaactgattggctttgtctggttcgttaggaacccacggtttttttaagttcaacgatccaaactgccatactggctttgtcgtgtcagtacggtacatgccaaccactaccacaacgccacagcaacatcaatgaaatcaaaatgcacaacaaaatcacaagttctttttagttttgaacgaagttgcaagaatatttatgatcttaggtcccatttggcataactacagctttcaactctaacttacgtagagttagagctgtcaaacggtacagattcttcaattttagagcggagttagcggagctgctccataaatttatactatagaggtgtagctgggtttttgtcgctccacaactccactccatcttaatagacccattaaaataggcacactttgatgccaaatttgctgacttgtcaaatgggaaaaatttgcaggattacacggcgaagctgtcggactttgggctggcgaaggaggggccgcagggggacgcgacgcacgtgacgacgcgggtgatgggcacgcacgggtacgcggcgccggagtacatcctgacgggccacctgacggcgaggagcgacgtgtacagcttcggcgtcgttctgctggagctgctcaccggccgccgctccgtcgacaagcggcggcgcggccgggagcagaacctcgtggactgggcgcgcccctacctccgccgcgccgaccggctgcaccgcatcatggaccccagcctcgagctgcagtactcggcgcgcgccgcgcacgccgccgcgaaggtggcgcaccagtgcctgcagagcgtgcccaagtcgcgcccctgcatgcgcgacgtcgtcgacgcgctcgagccgctgctcgccgtcgacgacgacgtgcccatgggcccgttcgtgttcacggtcggcggcgaggaggcggcggcggcggcggccgggagtagcgccgccggcgacgccggcgacgacgagccggcgagggggagccggcggggaaagaagcacgtcacgtcggccgtgcacgcggagagcccgctgcgcgacggccggtacgcgagcagggtgaaacgaccggagagcccaccgagtgtgatctgatgagtacatagaacaaacaaactgaatttgtacatagcaaaactacatggtccttgattcatttgtattatactacctttgttcgtgatgttttttgtctaaagaatttgctaagggaaacgttgattaatagagttgtttaactccctttgtaacttgtaagaaagaaaaggggagtatttttctagattttaggcgcatatgcaatgtgcaacttttgttcattttaactacgatttatctaactttaaagacttttaatgtttatgcctgtaattttgtaaatgttatgaacggtaagtttattacatgtaattagttttttttgctacaataatttaatgctcaactttttttatctacaaaaactttgtttaaataagtaacaagggactttcctaaaagaaatccacatatatctagcaattctttgggaacttactagtattttatatttgaaaaactctaacccttggtttcaatccaaagggccaaatgttcctatcaggtttacatcgtacagaattcctccccaagtttttttttaaaaaaagctgaatgctcgttctttgttgcggataaaatatatattataattttaataggtaccagaaataacatgtgttttgccataaaatgtgttacctatcatttttcaatagatcaaatctattgatagatttgattgatttttagtaaatagaagtttacgggggtaatttacaaaactacaatgagagcagatggtggtgtcagccagacaaccaccaccgctacttcttttaaagtacttccttcatttcatattacaagtcgtttgacttttttcttagtcaagcttatttaggtttgactaactttatagaaaaatataggaacatttttaatacaaaacaaatatattatcaaaatatattcaatggtaactccccgtcaagatggcgacaatgacgtcgagcgcggcagcaacggcggagggacgatgagccatcttctggagacccgattagagcaccgcccgccgccaccgccgccgccaccaccaccgattccccagtatggcatagtcacggtacagagtgcacaggatgtcgacgcagccataccttcaacccttgttggtgaggttgttcggatttgggtgccgttcgatatgcccagcttcaacccttgttggtgaggttgttcggattcgggtgccgttcaatatatcattgggcacagtgttggatataggtgaaattctcaaggacaatgttcttgggcagtccctggtggaggacccagctctgctggctgcgaagctaagccaagcgaattggcttagcaatgagctccgtttagtgcgatttcgtgtcgagcagctgcagcatgcagatactgcatctgtctgcctgactccctcctcatcagggaatctgaaactttggatagtttacctttttttgttgttcctgtaaagaggagagcttcatatgtctggcccccattttgctgtgtggcccccattttcctattgggaggagtagttcatttctatatagatagttgaagagaaatatcaatgtctcccttagttaaggatttggcaaatatactcattttaaattgaatttccattccttttagctccagatactagtatccctcttattcatctcacctctgttttggaataaaggaggtacaatcgatgtaataattagctaaagcctacctcttattcatctcacctctgttttgaaataaaggaggtataatcgatgtaataattagctaaagcctaaggcaacaaaggttcaggttgtcaacatgttcatattcacaccggcattatgaagttatcattaaatcgatgacttttacaatgggacctttaatatagatagactgaaccatatggtaataactcaagtgcaaagatgccattcagatacataaatttatacttatttgttttttaaatgtcactcatctcctttatggggtagcgatgctttataaggttctgaattatctatattttagaaagagaaaatgaattctttttaaagtagattttaaaaaagcatctgacaaaattaaattgcctttcatctatcagatgatggaatcaaaaagatttcctaacaaaaactagtgatccgatatttcccttgctatctagctatagaaaaaagagttatagaaaggagatacggaagatagggtagctattatgcaatatgcatatgcctctgaggagtcagcaaaaaacataaaattcatactttgcctcttttgaaaatatgtctggcttaaaaatcaactttgataagaatgagctgattattgttggacttgaaaaagaaaaggaactaaattctgttctatattgacttgtaaaatgtagtgccccgttcaatctcccgtttgggagggtggatttttgttgcatgcaaaacgagaaacatcattagcacataatcaattaagtattaattattataaatttgaaaaatggatttatttgcttttttaaacaacttctatatttttttaaaaaaatacaccatttaaccgtttgaaaagcatgctaaaggaaaacgagtaagttgaagtttgcagtggaagttgaagtttggagttgaatatatagggctaagtagtatacctctatacatgttgtctttttatagactaccaaaaggtgtatacctctatacattatagaactagatttttatggtagaaatatcaaggcataaggaaatatcacttagtccagtggccaatgatttgtaggccaaaagatcagggtggcctggggattcttgatttatttagatactatgaaagtagcattattggggaagtggctttgaaagctggagaatgatgagggtcttcggcagagtatgttgtatgacaagtacttgaagaacaaaactttgtgtttagataaacacaaaacaggagactcacaattttggtctgggctacttgagagatgagatacaagattttttttttctgaaatattgtagaaaggaagtaaggaatggcactatgactttgatttgcgaagacatatggataggagacaggactttggctgaacaattccgagagttatttaaggaggggactacgcatcggtcacccgatccggagtggccaaaatcggccgctgacgtcagcatgatccgattgcatcattaaattcgttacaattaaatcttcaaaacaagaccacacatggatatattctgacgaacatttttttagcttattattgaattatttttaaatattgcacgatgttccaccaagtatatcggaattgtttcactgagtagatcgaaaatgtttcaatcgtttaaatcgggcgttgtttcaccttatataaaaaaatattttagcaaatagagaaagaatatttcagttcactgcaacattagatctatacatagtgaaacattgtaagtacactaggtgaaacatttttggtggaacaaaaaataaaacgaattccctcgaattcccttaatagagggtttgcaaaatatgtgggtgatttgttgcaaaagaatgtttcgttcactgcaacattagatctatcaatagtgaaacattatgagtacactaggtgaaacatatttggtggaacaaaaaatgaaacgaattcccttaatagagggtttccaaaatatatgggtgatttattgcaaaagaatgtttcgttcactacaacattagatttatacatagtgaaacattgtaagtacactaggtgaaacattttttgtggaacaaaaaatgaaacgaatttccttaatagagggtttccaaaatactatgtgggtgatttgttgcaatggagtatatagtggagacacatgacaggtgggggcagaaaacatggtggggcccaggcgcctgcatgcacccgtgtgggggacggggcgcgcggggggagcgcccgatctgctccacccccgtcgggcgcccggcctgcagcattttcggttatataatataactttcactaaaatagtaacaatagcaaaggtctttgagatgggttgggatgcctttgaattcagaaggacactaggtggggatatggctgtgaaatgagaacattaataaaagctttgtaatgggaaaattttgcaaaatgggaaagacaagctcatttggacacttacaaaaagtggggtttttactgtcaaatctttttactatgcaatgaagggacacaggtcgtgcaatactgcaggctgacatgtgggccctgtcagcctacagtactgcacatgcagtactgcaggggatctcaattggcaatgaagttgcaagatagtggttatccctttaagaaaatctggagattcaagattcctattaaaattaaagtgctcatttggttagctctaaaaaatagtattttgacaaaagacaatcttataaaaagaggatggaggaagggtactgcaaaatgtcagttctgcaacaaacatgaaagcataaatcacttgttttttttagtgcagtttagcacgttttgtgtggcataccatgcattgtgtttttgcatgttctatacctggggggttaaaagaagtaatgggtggatggttaagcaagttctctaaaaagaataggagcctgctttcaataggaatagctgctattttgtggagtatctggaaaatcagaaacagggcttgcttggataatataattccaaatgatctgtggaagtgatttttcagattgcacataatatatcaaatcgggctattttggagaacaaggaggaagaggcaagaagcttgctggagggggccagggtgttaaagcaggtagccgctgaattctacagtgctcggcatggctggagcttcagagctggaaggatccaaggatgacagaaggaagacgacgtctctcaagcatggagggtttggaatatgagcaaaaatggctgagtttttttgggtgctattaggaaagtatggactgttaagttcttagatgtagaatggctgaaatggcgttttgaatgtgtgttgagcaggttaagggactatgtataaggggatggcacctagattaggtgggaggaggttgtggtcgtctcctgttatgctcttttttcgcttttgtaatgaaaaaaaaatcttgcagattatgttcagtggcatgtctcgcgacaccaagaatcgcagtggctcggtcgctggctggcgccaaggatgatgccaatatcctccggcccgctgatagtcacaactctgaacggcggcggcggaggcggcaacaaggcagcgaggacttcaagaatggattatgtgaccaacatgttctttgccgcctgaacgccatcttcaacagcagtcgcggccgcactcgtggactcgacgatcagatcgccatggcaggcgggaccgcccactgcgacgcgttcttgctcaccgccagcctcctcggcggattcttgcggcttgtcatggaagcccccggtgcgcgcccggcatgtcgttgacgctcgcgtcctggcccgccatgtgctggacgcccgcgtccgcttccacgcccacggcggcgacgccttcttgcgagttgccggcactttcttgcggcgcctgcgcctgcgcctgaagactccatggttcttgaggaacgtcacggaagcccgcggccatgcacagcaggtgttcgacgcctgctcccgcgggcatgtcccggccggccacgccttgttgagcctgagacacgtcgtcgaaggcgctcgcctcatcttgcatgttgccccgtatgcccgcgccctgtcgcgccatcttccctccgcacaacatcttgttgtggtcgcctcccacgtggccgaccccgacgccgacggcgctgctgctggtcgctgcctccgctccaagaaaggaagcaactccctccggaaacaatggaacggggagagcctccaacgccttggaggcgagaggaccgtacgccgcccccgacctcgatcttgtgagtcttgtcgtcctctgctccccggcggctgcctccactgctttcttgaagacccgaggaatccgcacccggggcgttctgttcttaggtgcgggatcgaggggattctttcggagaggagccattgaggcggggaggaagggggcggaccggaggcggggagccggggaacggggaaggagtggaggcgccggagttggggaagaagagttcaggtgagcgaagcgggtgggggaagacgacgccgagaagattgaaaatcgactctttcagtggtttggaaagtggttctctgatgttggcaggttgattgtggttgacccgttgaggatcagaaaagatgctgtacacacagaaaaaaagcatttccgcataagcgaggttttttttctatggcaggtatgacttttggagtcaaatggccgctaatgaaaataaaaaccggggtgaagctcgccacccgcttgcaaaaattaatttttccacctttatttttgcagctctcctccctctcctctctctcagctctactctccctccgcggccggtcgcgatgacgctgacgccgactgcgccaacaatgctgacgatgacaccgcctggatctaggaggagaggggaggcggcggcgacgaggagctgaggctgcggtgcggccggagggggtgcggcggtggtggagcggctccccttcctcttctctccctccgcggccagccgcgacgacgccgacgccgacgatgacgctgccttgatctagggaggggaggggagcggaggcggcggtgtggccgaagacggcgtcggcggtaatgcggccggaggggaggtgtggctcccctccctctcctatccctccgtggccggccacgacgacgccgacgccgactgcaacaacaacaccgacgatgacaccacctggatccggggaggggaggggaggcggcggcgcggctgaaggagaggtgcggctcccctccctctgctctctggcagctctactcctccgcgcccggcagtgacaacgacgaccaccgcgactgcaacgaccgcctggatccggggaggggagggtaggcagccatcggctagagggggaggccggcagagccgctggcaggttgggggtggtggcggcggattttattttattcgctaaaaatattttcgcaagcgggtggttctaccgtctatgaaaatagatgccgcctggaaaaatgagtttcacaggcggaccgctgagccgcctgcaaaaatcatctatttttcgtaggcctttgcgtgccggtggtcctttccccgtatgaaaaagctatttttggccgtctggaaaaacgatttttctagtagtgacacatttcgcccagggtttacgattccgacaagcccttccgtttcgggcgctggcggaattcggaatttcgcgaaatccggtggaaaactgttaaattctgaacaaatttaataaatcaaaatttgaatacaaattccctgaatttgccgacaagttctcgaaaaccggtcggttttggtaaaattccgatcaaattcatcgaaatttcgaccagtaagtatttttctttttttcttaattccggtcggttttggcccatgtaagtgtttccttttttttttgccagtaataataaaatccccaccgtcaatcgggcaagaaaagaaattacagcccgagtcgtgcatgttgaaaatgatcgcgagttaattttctttcgatgaaaagataaaaaaaaaaaaacaagaagggagcccacccagctaccctgagcgctccgtcctccggctcgtcgcgccaagtgaagtacacactgtacactcttccgccgccacttaagaaagaggggggcgagcgccccccccccccccccccccccgcgccgccggttcatacccctgccaccttggtccgtccggagattcgcgcgtcatcagcctccttctcaggtactatctctcggctcattctccctctcagttatttgcaccagggaaagacccggaaggagaggaacatctctgtggttgctctcgttttcgggtgaaatttttttgtctttccgattatactgggagtaacgatgaggattcgattatctctgtagaataggatccgattccggctaggtttcggggtgaaccaatccttgtttccggacactgcttgcctactatatatgttggattgcagcagattgattgctttatttatctgcagagttcagaggagtccggttgccagctcggagagcagctagaggatcgcaggtaatctctctctgccagccacaattatgctctgatttctcccccaaacctatctgcatatcagtatatggaacaatctttttttttttgttgttgttttgctagaaattgttttatttgattagggggaaattgaaaagaaaatgctaaggttgaaacacatcagtgagttatgatctttttacaatagtcaataggtactaggcaggatattaatgattacaataggtactaggcaggaagtttgagtaggatttctcttaatcttgatttttctctctcctcccttccagtctgcgcccttactaaatctggccatctatgttgttgcagaacaggaatggagaacaatctgattcgtagaacaaaaaggctgaagcgatgccatcagcagcccttcaaacaaagcagggcaaaagttcagtttgcagatcttcctgaggtgtgtttagaaacgagaaaccttcttcaggtttctgttttcaaaaaatagcttatcgaaaataacttctaccatgtccctcttgtgcaggatttgctgtgcacaattttctcaaaaattgccactgaaggatgttgtgaggaccagtgttttgtcaagaaattggaggcacatgtggacttgttgcacaaaactaagattcgatggtgttatggtatccagggataatattaatgcaatcttgcagcagcactctggcaagattgttgaagagtttgaggtgaagtttgaattcgacagcaagctagttgatcacctcaatggtttggttgattttgttgtatcatcacagacaaaaaaaatggcttttgatttagtgccaaccaatcctgttggtcttcttgatcgatacagatttccctttgagcgtttcgacaatggaagcatctcccgtctacagcatattcagcttagctttgcatctttggaactacctccccatttcagtggttttctaaacctaaggaatcttgaccttcacttaatacgatctactcagaaggatcttcaagatttgttatcacaatgctttaatattgaatggttgagtttagttagatgccatattggtggtgaaataaaggtgacacatccattgccgcgccttctatacttacgagtcacatactgtgatataaccaagttataacttaatgccatcaacctcaaagcttttatgtatgatgggatgcgacatcctattgatcttgggcatgctctggtactgaaggaagcaagccttcatttttttggctctgtacatcttgaggatgctcttactacactcccaagtatgcttccatgtgttcagtccctcagtttggatgcctatgtacctctgactactctcccaagtgtgcctccttgtgttcagccgctctgtttggatgtctatgttcctctcgaggtttgttgctacacctttgaagtcatatgcaattctttgctcaattctttcttactatcaccttttcaggtgtcctcgctgctgaagaacacgtgcaagttttctcatctgaaatatttacaactaaaattacgtctatattatcatgattcgggcaacatcctctctttggcctcttttctcagggccagtccttgcatagagaagttagaaatacatgtgagtactatatgttttcctatttgcaggaaatgcgtttattccatatttcttctttaatcattctggctgttagcaatgcagtactaagattttgatgatctgtcaattaattatccatgcaatacaagtcttcttatcaattcccattttcactcattgcagttcaattcgtatgctttgtcacacttgtattatcagcctatcaggaggcttccacaaggtgaatacggctatctaaagaacatgcatattactggatttgttgcatcgacaggcgagcttgaatctctgctacatgtcgtggaaagtgcctctatacttgaagttttgactattgaggcggctggcatgttagggaaagatatagattatgaaggaagattaaaagttgaggaattgacaagaagataccttgatgggataatgttacgaaatacaaagctctatatggcataagttattgtagtatagaagaggtgtgcttgagatgtatttgaggattcctgtgtgcaaggatctgttgttagctgtgtgcatgtattccatggatcattagtaattttcgcaggccatatccttgataactctatcagctgatggatcatttttgatagctaattgtctaattgattagaaatatatagccataattggaaatgatgcgatatttgttttttttaatattaaatgatgtgttgtttgtaaaatgctatattttgacctacttaattatgttaatggcgtaagaaaattaactcaatgcatgaatttgaagggattggtgagaagatcaatgaacatatttggagggatcgatgattatagatttaagatccttcaaaatttacttggtgcagttcaaatcatttggcctcagtaattttgttgaccccatagttcgttgatgtcttgcttatcacttgttctgcttcatcttttgcttataagaaatgtctttgtgcctgtcggtggatggcgagcgaaaaaagaagttatgtttttcaactgagaaaaatctttgtgcatcttttgctgtccttttggatttaggatctgagttgtgctaaactctaaaacccaagaaatccatttgataaagctggttattttatctttctggaaactgtcaaagaactgactatcttgtgcaggttacttgcctttagtttggtgaaggatcgatacttgcactttggtttaaaatgttctatatattgttgtctcacttgatttattgtgtaaccatagctgctttcagtttttgtaagtgctaatctgtaaccttgctttgcagttcctgaagttgtgagtcatggctgccaagctggcttgcctccatagtctccatgaacgccttggtaccaccttctcatctcatcctaataagttgattgcagtcttttctaggtgaagatctcctttgaatctgctcctggaaatggttgagttcttattgatctttatccgcataattggttagttcttagtaaattgagtagtgaaatgagagcatgttactgactcttagctgacaaggtgatccattcctttgggtttatatagtttttcctgagattgttatgatggtgtatgtaatgatctttgatgagatgtaacatattgattatgagtcatggatcttggatgatgttaaaaatattgtttttagctagaatcagtaagaatctggtctatatggtaatgccatcaacacagttcagccacaggaaggatgtgagatcgaagcattcgttctatttctcaaatatcactctatgcaggtatgttaacaagggaaagggagtgctgtagcatcaccagttgcttgctgagtttgatgaattgatgccttgatcgaagctgacaaagagaaatgtgcttcatttgaagacgttctgcgtgctgcccaagtatatttggcaatgtgcctactccagcatggcgacgatagtcaaatcgaagtcatctaccagcttttctaatttaatttccttgactgcatgtaggaagccattgtgctgcccccatgtgttgcactggccatcaggcggccaaggtctggtgtctgggactacatttgggtgaatgtgagtgagttggctgtggaggagctgagtgttcctgagtacttggaattcatggaacagcttgttgatggacagtaagttccagaaagacgatatgcacattataactgaagcaacataacagtctgaattcaacctctccttttcttaaacagcaccaacagttgttctcgagcttgattttgagcccttcaatgcctccttcccgtgcctgttcatgtccaagtccatcggagatgggtgcagttccttaaccgtcacttgtcgtccaagttgttccaggacaaagagagcctctaccccttgctgaacttcctggaagaccatgaccactgtgggcacggtcagaacctaccaaatgcttttctactgcatattttttcttgtttgaattgcctgttgttagtcctttagaaagctgacattctctgaagttggcgccggacaaaggtggcgccggagccagagcggcagcgtttcccgcgttggcgcgggtctagatggtagtgcaaagggagctggcggcggtgggtcgtcttcctcgttgccggtcggcaccctcgcccttcctggagctcctccccttctttgtggggagtttctaggctggattgaggcggcaacttgtcagcgggggaagcctaggttgctgaagcaatgccacccagtcccgggttctccttcagctagatttggcgaggagactggcgggtggtggatcggaggggtcctgggccagctctcagggatggaggttcgttgaagtcagccgatggcggggcgtcggtgcggtgtggtggtagtcctgtcgttggcaggactggaagctggccggcggaggggcgtcggtcgggtgtggcggaagccatgtgccgccgatgtttagatggtggattcggattgggcgatggaccacggcggtaggggattccgagcgaaagcttagcccaattttttttgggccaacagtgacttcgctttcgggcgtggtaaccctcctgagggcactgttgaggtacccctcctccctcggcaaggagctctgggtgaaaaccttgtccaaggatgacgacggcgtctttcggcgtcgcaaccctcgtgagggcgttgttttagagtcttcgtgtcgtggtggtgttgttggcccggtggcgatcggtctcgcatagcgatggccggttcggtgcttggcttccctctctgtagcatgtgtttgggcggttggcacatggttcggggcgtgtgctctggtgcatatccttcctcgacagccagctgtcgatgtaaaacttttcttgtaaccttttcttcctatcttaattacattgaatgacctccttcggtcattccggcaaaaacattctctgaagttccactaaacgataggatctgaatttcctcaatcataatatattgttttctgttacagaccatgatgctgaatgacagaattcagagtgtacatatgaattatagagtaatgtgcagacatgattttacttgatgcaggtaaccaggttgttgcctgatgttattgggactacatgcagccagtggctggagaaggttattggaactgagcacactgacattcttcgtgttccattcagaattcatctttctttttttctttctttttttgctgcaggatgttgcaaacgaaattatgagggaaatgcaggccaaatataccatttttcgtgccaattaactgctgatcatgccatgacacacagacttcacatcatgaccagcacattccaagaaattgctagaaggtaaaattttactattgagcagtagaatatcgctgcattgtggcaacaactgaaggagtatatgatgtttgattcctctgtttcttcagcaaggacactgttcggcagtatgaatcacacattgcattcacccttcctgctcttgcaataagacagtcagactcggaccatcgcatattacgctggaagttcacaagagaatgcaaacaatccgatgaaaatggctttcataaagcatatcatatttcaattggcatcaacttgcaaacccattgtaggcttccatcggatggcctaatcagccaaagaaaaagccaaattttgaattttcaaacttaattttgagatatttttaacgtagtttcttttacaacattggcttttaagtcaccaagaacacatttataaaagtttcacgtacaaattcatttttatttcctaataagccgttttggcttattatggggaccgcagtaaccatgtctagagcattttgtaacactagaacaaatttgattggtactaggatatggtgaagaacaatggatcgagtagcttctgaccaatgacattttctatgcagtctcaaaaaaataaaaaagggtctcttcggagacatccgataaaaaaatgaaaaggaaaaaaaaatgaaggaatcgaaaacgacacttgattttggattgatgatctggacttaaatggcagcacccatttcagtggatctgatcaaccaactcttcacagacgcctggattgatgactgatttctctctttccaaatttcttagacgatgagtaggattagggtcagcataatgccattcaagaatcatcctaagccattgtgtgaagagcggaattcattgacagcttcatgtagtttgatccacctcaaatcatctctgcgaatgcaccaactgaatttggcagtgggaaatctaaagagaatatgtactgcatcatcatgcgaagcacatacagcacaaagatcttacccaatccaattctcaacaacgtagactgaattctttctctccaacctctaaccacaaaaaatgcttaatttccataggaatgagtgctttccagacatcagacgagatataagatgaaaacgctaatgctctgtacattgatttagatgaaaaacatgtattactctctaaagccccataagatctggtaactattcttacagaaagaaactgatggagtaaaaacgatcaagtaatcaacctaataatttcattctaatagatcatgagagccaaaagatcttcagaaagacagattctctgctcgcctttctaacatctcagagtaagaacatcaaatgttcaagattctgcaaacctgaagcattactggttgcctctcacatggtaagaacatcaagcggtcaagattctgcaaacctgaagcattatttttccgtggtggctagtatgaagaacccaagattgggggaaaaaagagtctaaactgctagcaatgcacatgctcattttcctaaaggctactccctccgtttcataatataagtcattttagcatttttcacattcatattaatgttaataaatctagacatatatatctatctagattcattaacatcaatatgaatgtgggaaatgctagaatgacttacattataaaacggagggagtaacattttttgtggccaacagagaaattagtgacatcagactgtcaaagcacatcgtttggagaagtgaaaccagttttcacgaaatgttcaatgatctcagtctgagtctcaggtgatcaaacattcaaacctatatcttaatcgtacgcaagggataaatggaattacatacataggcacgtagctaagcatcctgaacttacacccatggcacaaatcctgaactaacacatgccataaatccttatatattggctgtgtttagatccaaagtttggtgtcaaactttagtccttttccatcacatcaatctgtcgtacacacacaatttttcagtcacatcatctccaatttcaaccaaaatccaaactttacgctgaactaaacacagccattgtttccttcagattaaaaaaaaatgtaagatgcctgcatacatggctgcatctaccatttggataacatctgaaaataatattttttttaaaaaaaagcaaatacattctacatagaggagatggattttcatgacctatcttctttctatataaaaaaaatataaccatttgggtgggccaaatgcaaaaataaagggatagtgtgttcttaattaagggatgaaaatactttcccctacatatagaacacattgtacacatccattgaccacaaatcttaactagtacacacgaaaagtacgaaagaaagatacccacatcaccatcaaaaattaagcaaacggagcgacgaaccagacacgatataatgctactgcaacatagtgtgcgctataccacaacacgagtccatcaaatccacaagccattaataagtatcgaagagttgcagctggtcacatacaaaatgaccagaaaagcacacttgcagcacatataatccgatcttgttacagcacaggatgaacactaactctcggacaagtctgaacattgtcgatcccataaccagcacagatgactcaagaaaaatggctcaaatcgcttaccagcagtaggaagaaactcagctcgtcgatcagtcggcgtaggaggcagcaaggacggtggaagtgagggtaagaacgaccgtgacaagcgcagcggcgaggaccagcttggcgaggagctccacggtggtcgtcgcgatcggcacgttcccggcggcggtggcggcggcgccggctcccccttcaccgcggccaacagcacggacatgggtgtagatgagcgtcatggagaggaagaacgtcgtcgctgcagcagctggacggagcacgtggacaaccgcgacggcgaggggtagcaaatcttggccgccgtcgatggcgcctggctgaggagccaagaagacgtgaagcacgccggaagacaagaacaggatgaggtaaacgacctgcgggcggatcatcctgtccacggcaccgccgcctccgccgccgatacgggcgtagatgagtgcgacggatgtgtggaaggcaaccatcgccgccgccgccgccagcagcatcgtgtggaccgcggcgtcaagcggcggagctcgaacgaagcaactctcgccacccgactgcaggtcgacgtaggggaagaatccggtggcgtacatggacaccagcagcccgaagaaggcggtgaccgagggggcgctcgccatgggggatgagcacttgagcagcttgggaggatcaagattctagagaggtgcggggttgcacgagtggagaacggtttggatcggggtaaggttcgcggaggaaggaagaagaaatttaaagtgaagggtctcccacaaaaagcacaagaagaaatcgcgagcggcaataaggcatccgcggcctggaggcaaatattgcggcaaaaatcctctctcaagttaaagccagaggaattgaaagggacgggttgttccgtcgttgggtggggtgccgtgcaacattgcactgcagccagcaggtcggctgcattttcaggcagtggctttatttttctaatttttttatggaatactactattattgcatggcaaccatgataaggttatgctatctttgaccaacacttttgtagtatccatccacttattagatttaagcaaaatttgacagtaacagttaattttggagatttaattgagtctttttctactgtagaacataagcttattactcagatgtacacccttcgttaaaaaaaaaaaacaaatcctgagagtacacagaggcagagtcctagaagatggaatgtgctctttttacacatatatatatatataggcacacctgttttttttttatatatatagagtatacaggctctttttactttggttgtggcttgtttttttctccacgtgtggaaaaatcaattgatgctccgagaaatgactccacagcaatacaacagtacataaagttgttatttcttcccaatacattgacgctcccctttatatgttgggtaattggcctcactacatttaggggttcgtttcgagaagcttttatctttcatccatattaactgagataatactacccgtatgaccactagagatgggtgtaaataactaacttaaagtgattgtgatccactaatatcaacttgtcaattttggctttgttctgacggatttttactccatgaaccggtcactgttctttcgcagaaaggcgcatgacacggtacaccgtacacatcaattgcatctacatgattcgcgtgagaaaggagcgcctggattgagagattcttccatttcactgccgcagaagacatacggcagcaacaaattcctcgttttaaatcagggctatgcaccatgtacgagtacttgacgtttttatcagagcaattggccggatctaaaaggcaactactctccatttccccagctgaatcgtgtcgcatggcagaaagccaggaaggcaaggcaaatcttaacacaggtagaaccgtagaagtactagaaaacgagcaggagatgcagagcgaaaggagcactgaaatccagagaccagagaaagggcactgcactgacctgaaatgtctgcacacgtaacggctgcagggcacgcacggtcagctcagctatagctccggccatggaaaccggctccaaatctgcaaccgagctcgcagattggcgaccccggaacatggagaggcgagagctaggggaaagctcgattgagcagcagccagtggttgacctgaagaagtggtctctcctcctagattaaggtatttagtaaagcaaatggtcaggacgagagcggcagccatctttccccaccacaagcacaccccactgcaccatggcaccacctaggacgcagacagctcagaagacatatagtatgacaaagcatgtgtattttttcagagatccaagtagtagcatcgtactagttcactttagcttacagacaggcagctaaagttcgtttgttaagtttggaacctagaacaaactcatctgggtgaaacacacggagtttcactggagttttacaggcagacatgtcacatgtcatcgcactaggagcagttcttggcaagggacaatcaagcatcagggggacgttcaaacggaagaaggtttcgccaaaaactcattttgctctgctcatctcactttctcacttgacaaaaaacggtggtggtgtccaatcaccatgtgagcatacgaacccaaacgaaaaggagaatctgcaacttttgaagggcctactccgtacatcaatggggggaaaaagaacaaaactaacacgaaagaggcggcgtcgcggcgatggacgctgtcaaagtcgtcctcactcctcagcgcgaagagctctctgaccggatcagggcggcgcggccgtgcagtggtcaatttgcgacacggtctccgcatcaaatcatcttgtgagtgaggactactgtaaccaaccagatgaactttaggattccttcgggggaaaaaatacagaaatttcaaaggatttaaaatcctatagaaaaaaattcctacaagataaagaattgagttcctaaaattcctttaaaaattcctatatatagattggcatgtatcatgaaaattttggagaattcttagcatgtgctgtaacctcttgggattttttgtctacctctcttccaaattccgtgattttcttgtgcttcactcaaactgttttctatgtacgtagttctcctatggttttcattcttttagaatccaaggaccataatattttaaatcaggtgttttatttattctcgtgttttgagaattgagaatcttacgtttttcaagaagtttgtaaaagctagtactccttccgtgtttatttgtatgatgttgtttttcttttaagcaaaggggcaaagccctccatttctattatagaaatggtgcagctattacagagagtcatcccattaaacactagtgaagaaaccatatttggtgggtcgaccagatttcacaaatagtcccggttgtattaaaaacagggactaaaaacacctggtttaaaagctacagggtacttttcaaactttagtaccggttggtgttaccaaccgggactaaagatatatttgtagtcccggttgataacaccaatcggaaaaaaagatcgccatacgctctactcaccaaccgggactaaagatctatttatagtcccggttggtaataccaaccgggaaaaagatcgacgcggagatcggagaggcgtgcgcgatcggatcgaggtatctcctcctctcctttaactcgtctctcgtcctctcctcaaccttatctcctcctctcctttttaactcctctcctcaaccttatctattattctccttatctctattcctctccttctctctactgccaggccggcgtgagggtggcggggcgcggagggccggccggcgcgggcagcggggcgcggtgggccggccggccggcgcgcggtgcggcggcgcgctgcgaggcagcggctttctttttttcttttttcttttttgaagaatctgagattgttgtgtgatgtatttgattggatatgagattgttgtgtgatgtatttgacttatgtgtgatgtgaatatgtgatgaattttgtagaagttgtgatgtaattttttttaagattttgtgatgtacttgagtatttgagatgatcgatttgtggatttggaggcaatttgaggatgtttgatttgggattttggggacaggatggggtgaaatcaatatatttaaaaacaatgaagaaaagaaaagaataaagagcaaccggatctagcctctttagttccgattgataacactaaccgggactaaaaatgctttatctttagtccaggttagtgttaccaaccgggactaaaaatggatttcactttcggttttttcacccgagactaaaaataacgatctttagttctggatttgtagtcccggt

SEQ ID NO: 83398 - DNA, 693 bp, Oryza sativa
gatcatccaaagtattgatccagtagaagattttcgatttaattcgaccagggtaattgctaatggatatatcacaggaaataccatattggttgctcacatactgaaggactggaactcttgcattaggaatgaactccatatgtctagcaatacctaaataaggaatgaaaacagataagaatatcctgtaaattcaacaaaaagggttgcattgaatgaagtacggaacaaaaagaagatcgtgaatagcttgatcaaaacttattcattacagtgacttcacctctcacaagatatattgctttcctttttttttttagataatggataacctggccgctgcatcaaagacgcgcaaagcccacttattgctttccttggtgcatgtatatgcatatagtgactatttgtttgatcacaaagaacacacaaccaaaacttctatcatttcggttaaagctgttttcattaatcgaaaagaaagtttacctcgcttttgcaaagctctccttacttctctcagggtatcttgcttctttctcttacttatagggagattcaaggcattgaacagctcaactgacacatccaaatcacctgattttgcataaagttgtgatacgaaggatccaaaaggttttacagaagcacctataaaggaaagttaagaactcagaaaaagaaacacta

SEQ ID NO: 83399 - DNA, 680 bp, Oryza sativa
gccgatccctcctctccccatctcctcctcctcttcctccgcgagcttggggtgggattggattggattggatttgcagggagggagaaggaatgcggcaacaagtggcgtggaacttagaccagaaacgcgagagatacggggaggggcggaggcttacacaccgccagggtgcgacggctttaaaagggggagaggaagggaggtggtggtggtggtggggatgggtggtggtagcccgtagccgcgtcccgtcccgtcgcgcgggcgtcggattacgtgtgtggcgagatcccgcccgccgccgcgatcgtctgcggcgagcggaccccgtgatggcccgtaaccatcgccgaaccgccaacgggcgctttccacatgggctcccggatctgtggaatcagcggtttgctcccaaaaatatcgccatcttctgtgttgcggtctctccctctctctagtcagcccagctcacgcaggcccagccacagtaaccacttattttaattgtggataaactgtgaactgaaatactgaccaaattcctaaaaactagtacatcactgtttcgaaataagattatttttattcgctcctgtttattctaaaataagtttatttttaaacaatcgttgtattagagtttataaaagcatggggcaaagcatgggctgcaggaa

SEQ ID NO: 83400 - DNA, 887 bp, Oryza sativa
cagaataaaaaataaaataatattcaaaattagaaaaactaaaagagagttcaagtaggaatacaattttgaaacaactgaaattgaaaataaaaaataaaatactaaaataacacaatacgatattaattaaaatttgaaaaaaaataaattctgaaattagaaaaagaaaaataagatttcaattaggaatacaatttataaataactaaaatttgtgataaaaataaagactatttaaagaaagaccatctaaaacacatgacgagataaattaagtaagaggcctataaaggagtagagtggtggcggttgatacgacatataaaaactgttaataaaacaccaaatagaatcctaataacgattaaaaggagggacgataggcaggccgtgaagcaaacgagcaatgtgattgccgggactactagaaagtaaaaaaaaaaccccattgataatcatattcaatttttaaaatctcaatgacaataaaaagaagcagtgggcggggtgtatagtagtatagttttagagccggtgatgtttgacgtgacttctagaaaataaaaaatgaattgcaacgatagttgtgcttaatttttagaatcacaatgataataaagaaagagtaggcggcggacgggccataaaggagcatagtggcattgtttgacgagacttctaaaaattataaaaaataaaacccaacaagacaataaactctaaaaactacaaggttcaatttttaaaggttccgaacttcgaaaaggtaaaaaaaaacaatgataatcatgttcgattttaaaatctcaatgacaataaagaagggactcagcgggcgagccgtagagaagtacaatggaaaagccgctgatggtttggcggga

SEQ ID NO: 83401 - DNA, 515 bp, Oryza sativa
aaacataattaaacaaatgagctaatccctcctttttgtggggctacttaattactttgctccattaaactatattttatccccattaaaataatgctactgtcactgaaagcatatttaagatttagatgccatgcacatttttcattcgttactttttgtaactcatgagatacgagctttaccagtaatcttacattgattgcagttttcctctatcggcaccctttcgggtgatgtgatatccacttacacgggccagttcaaacgaatagaggagaacccaagttggatggccagatcatacagcttatttgtaaggatttccttttatggttgcattcagcagtcttattgaaatttggactatttactaacacaatctcgttcgttcattatctccttttcaggtcaaagatccaattgagagacctgataatgccgctacagcggttgatttgaaaggccttgagcggattgctggggccttcaccgctgctaatcgtaagtttgcg

SEQ ID NO: 83402 - DNA, 933 bp, Oryza sativa
gattctcgccatgtttgtagagcatacggacatccatatcatggctcaaaagataaggaaatagcacaatcatactatgcctgtggcacgcctttggtgctatggaaaaaaatagtattcctgaacaaagctagaattgacctgtttctcacagagaaaaaatgttgcaagaaatctttcgtgaataaggtgcaaatcaaagcaaaaggcatggctgaatacctactaccaacaataattcagggtgactatcaaatgtctgttagcctgctaagtaatttgactaatttcagtgaggaacatgagtatcaaactaacgcctcggtacaagaaaaaatgatgatgccaaaggacaaatagacaaacaagtagcatgggataaatgatgccagaggcgaagcatacaaatgacatgatccagtattattcagaggagcgctaatacgaattctaagggaacatgatgctgctgatcaagcaggttcattacattgaataggagctcaagagactcaaacaccatacattagataagcgtaaattcgtgaaaaaataatgttcagtgagagtgactggcactaacgtaagctgactgcatctaaatttcgccgtcccagagctcctcatgggtcttataaacgctgtggggataaacaatgacgtcgcccctgagaagcctaacctgaacatcatagaacacgagcatgagaaattactggtgcactgctatgagttagtagaaggggttcaagataatgagatacttgattgatgccttgatggcaaataaaatagctcatggcataagatgtacaaaattgtcctgtaaggccagtggttgcgacataaaaaccaaacaagatcacgtgacaatagatgaatataattatagcacatgtaatgagaaatgagacaggcaacataataaccaga

SEQ ID NO: 83403 - DNA, 14741 bp, Oryza sativa
gaacatgaagtcatctaggcatgttaaaagaagactgaagtctgttagaaagcagaaaaactttggagtgatagcattggactatgtccagacggctaaaaatctggcagatcagtttaccaaggggctaccacgtaatgtgatagacggtgcatcgagggagatgggcttgagacccacttagagttgcacaatggtggaaacctgtccattgtgatcggagatcccgtgaatttggatggcgaaacaaactattgggtaactgagagaagagaccctaaaatgagcttatcttcatgatgcacttctcttctattctgtatggtaggatggtatacaccttaatgtgatccgagtggcttttcataaagcagagatgttatcctacagaacatcttagaaggaacacacctatatgagtccgactgctagtcacagtctatgagatctgggtgatctctagatactcatgaaaaggccaggagtatgacttatatgctccaaacagaggggatgcaaacaacagcctagtaccagttaagggtatgagtgaaacctgaatcgcacaagactgacaattcaaggcatagtccattgttcagttgtgatctggtgtagctcttttcctaggtggaagttcaacttaacagtctccaccgaaacactggtataacaaacaggatcagaatcgagagcatttcctatgagccacgaaatttggtggggattgttagattaatgggctaggtctaattaaatcctaataaattccattggcccacattaagtgctatgggtaataataccaccttggaaatctaagtgaagaggtctcaacttaaatatggaactagtggagagtctctgttgaccggttgagatggtgcatggacaaccaggcggggcgaggcgaggcaaggcaaacagctgctgctgcgctctctcgttttgtaacagacggtaataaacacggagaattgatttcgtatcaatgaacgcgtcggttaccgaattaaacgtcgtgaattgattccctcggctaccgaattaaatgccctgaattgattccgtattaacgagcgcctcggttccaaaattaaacaccgcggctgatgactccgaacgttactctcgcgcttgcatatatatactccgcagcgaccagaaggacttatgaagttcttgctgactcttgcactttgagttcctcctcctctattcttgagctgcagaatccttccccggttctgttcacctgcgcgcacaggtgtacgggacgagcaggtgcctccggaactccgtccgcttgagaacttgcacgggtaggcgagcgatcaagtttttgggtagcgcttcaagcgtgactgctcctgttcttcgttcttcgacgacaacgttgcatcttcctctacttctgcttcaccatggcttctactggagagaacggaggagacaatatcaatggaggcaatacgaatgcctcaacatcttctgcaccatgtactttatttgattttcttcttgttatttacatgttcacaatgttatccataggatttcaatcctatgtgaatgtcaacgatgtctatgcttattttaccttaagcatgcttatgtttatgtttagccttatcactagatcgcttctcattgtgtatgtcatgtttattgtcttaatattttggattaaaatatgccgaattatgaccaaatttccaacagccaccacttctcgtcaccgctgctatgcttcagccgccgtcggatggcgctgacgcagggggacggagctgatgagggggaggcacaccagtcgcgtcgctgctgagctcccgccatcgctggatagcgctaatgcatgaggaaccgcctcagtcaccactcctcatctccgctgttgtgctcgtacaggttccagatggcgctggggagccaccactcctcgtcatcgctgttgcacttcctctccgttgaaattgggagaaaacatgggggagagagagggggtgcatgttgtcaatcttgccgtctatggcattgtttttttaggtgtttttgtttttctgttttcactgttcctcgtcaggtagtgtgtcgttcatttctttgtgttgcttgtgggccggctagctatagcagctacgtcgtgtgtaagacttgaggcgtgcgagttcacgtcgaagtcgtggagtctgagtctcgcgcggcacgatctgacgtgtgggatggcgcacgtcggtgcggatcgtgtcgtgcgcatgatggtccactactgccgatttactagcgttgtttccaaataaaaggagatgaatataacccagaaaagctgctgaaggtgttgcagcgccaattcatgtgtgttcaagttcagaggcattgttgagtgttttagtttgagagttgcagagagatcgaggacgccgggattccgttcaccggctaacagtgcatgagatagagaaggaaggagagagagagggaggaagaataaagagagaggatgatatgtgggcctcataattttttagatgacaaatgggtctcacatatatgttgttaattctaatgccacctaagtgtcatgttaactctacagactaggtcaacactaacacatagatgccgcgtcagcgaaaccgctctccaaaaccattgagggagttaattgtacaggttttaataaataggggtcgagatatccggtgttatggtttagggatacgaattatatttgtttatatttgttcactggttaagggagttaaagctagcgggtgtgctagcagctgattggttcatttgctgtcccttcgttttactgacacatgtccatgcagcattcggggtagggcgctcctaacgtgactcttctcctatcgcgagcgtctgctgttcctgtatttagatatctcgcgtacatgtatacgggtccaacgggagtagcccctcagctagcaacttgggcctatggtcatgagccatgccaatgcttgcactatgcaggtcgagccagcttccacatacattcatgtcctgaaccgattgactgcgtgcctccgtgcatttgagagtattgttggactacagcgtaaaaagaacagcgacagatttaagcgtattagtctcatacaccatttttagtgtaaaatacacattagttcattattcaattaaatcaaagttcaatatcaatgtgttaacggtaaaatctggcagtggggttcagatagaagggaataaatcggtacagtattttatgaccaagcatgaaggatttgagatcaaattgcgcgtcggatggaaactgtatcggctgaaagcaaaagccaagagtcggattgaccaggacagtcaacggccgattcagccgatacagcacagtttgggtttagcataagcccagtttggaataattgatattgccaaatagagataaggctcattgaagccaattgtatccattaattaggttagttacgacagttttgttagttttgtcaagagacggccgtgaaaggtcttgttcgtatggtttgagtcgtgtccataatgaacttattttgtactcggggtataaatataaactgttagggttacgggtaaggtataccctttacctttcggtatacgtcacatatcgatatggtatacctgcgtgtatacggacattttctgcatacattaaggaaattcatcacggagttcacagatggaaggagtcctactcggacaggactgggtcgtcactgtatcatgcagggtccgatatcttcgagttctacttggaaaccgcctgacctgcgatataaaagggaccccctaggaaggacctaaggcatcgaatctcatagccaacacatccaccacagcctatgaagtcggagtctacaggagccaagtcgccaggagatttagttgaaccagctcgattacgatctcgccggtatcatcgagttccattgttccctttgtaacttgtgatttccattatataatcccatatcaactggattagggctaatacctatcaaggggcctgaaccagtataatctgtgctctttgtgtgcttgatgtcgtattacgtagatcctcgtaccagcgtaccccaataccctctatatccggtctacgggtatcccccgtcaacagtggcgcgccaggtagggggacttggtgctcaaggatctactaatatgtcatccagtttcgtcgacaacagcgctaacaccaacctcaaccaaggagttcctacttcgacaatgctggtgtggactcaagtcagcgaaatcgtcttcccggtttacaccacggtgccgatctcagctggtccatcaatgaccggaagcgagaacacggtggctacaacccaagacgactccatgtcgaaggatcctcccgccgaagcggagaacggaacgtcgacgacatccgagcctgagaaggatcttagtgcggccaaaccttgtcttttcgacaagaatcatgagccgacgaggataacttccgaggcgacaaggtcctggtgtcctatccacaaaaccagaaaacacaccttgcaagcttgctgggtttttctcaacgtacacaccgaaattcgtgcctgcaaagagcgtggaattcaacgtatttctccaactcgtgatatctattgtcctattcacaagacaaagaatcacgaactctaaagctacaaggtctttctcaacgccatgaagatgccgcttcctaaggtccatcagtcacgtatctctcttagggatgcggacaaggaacaaggagcgacactgatctcggatcgattcgttggggtaatctacatcgaccctcacgagccatcagttctacatttgctcgaagactatggctcatcgtcaacaagtacgccacgcgaggtgttggctatcgacgggatcggcacgtcagcgcgcgctaatgcagaagcagaaattcaagtgaaaggcaacgctgggtgtagagctttcagtcgttctgtcccgcacaacacatcagcacatcagggccgttctggttgtagagctgatggcgctatcactggacaacccaccgccctgacagtactgcacatcagcacatcagccctgatggcgctaatgctggaccgtcagtgatactgagggaaaccccctatgaccccgttctgaatgacaatctcgcacgctggacagaacggctacgggaatcagtgaccaacctcagcaacgcgttcgaagaggccgccgctgcagcgcacctggaacagccacaatttggcggtgctaatggcgaaaaccctgaacagcaggaatcgcctcatcgagccacccctccacctcacggcaccggtgatctccgcgatcacctgaatggctgccgagaggcgcgacgcgcacgacacaatgggaaccgttcccaacatcgcgtctcttcgtgacgtcaagataacgaagaacaaggaagccacacgagcgaagaccgagaccgcgataaccgccgcaaccaccacgatcacgacgatcacgaacggcgggtgccggacgatacttgtcaaggacgccgccataatgacgacgacgatggagatcggcgccgggacaacaacggggggcgacgacgggattctcgagaacccggccgatgtcctcagaatcgtacaccggaactaagtgacccatcatcatcgtcatcatcttcctcatcctcatcatcagatagacatccgcgaaggacgtatgatcgccgacaacccaccgcccccaacgcttggtgtagagctttcagtcgttcgctacgtgatgtccgatggcctgaaagattccgaccaggagcaatagagaagtacgatgggagtaccgacccggaagaattcctacaggtctactccacggtactctacgctgccggagtagatgacaacgtgttggcgaattatttgccaactgcattgaaaggctctgcgcattcatggctgatgcatctcccgccctacttgttttcttcgtgggcagacctgtggcagcagttcgtcgccaacttccaaggaacttacaagcgccacgcgatcgaagacgacctacatgtgttgacacagaacccgggtgaatccttgagggattatgttcggcgctttaatgagtgcagaaatacaatccctgaaatcaccgacgcttctgtaatccgcgctttcaagtccagtgtcagagatcgctatactacccaagagttggcaacgaggcgcatcacgactactcggagattattcgagattgtcgatcgatgcgcccacgcggacgacgtactgagacgcaagaacgacaagccgaagaccggaggagagaagaaaccagcgaaggacgcacctgagtcaagcaaaaagaaaaattgtaagagtgggaaaaggaaagctcaagcgtaagttctcgcagcagaatacgccgaccctgccaaacgcccagacccacaaggtagcgacgcgaagaatgcatggtgccttatacacaagtcggacagacattctttggaagattgcctcgtcttcaaaaagtcgctcgcaaagcacatggcatcggaaaaaggcaagcgagtacgtgtggttgagaaggacgctgaggcggctactcaggaatcggactcaacatacctagactccgatctccatgtctcgcacatcttcggaggttccacggcatactcctcaaagcgagaatacaagaaagtggaacgtgaagtctgttcgacgtggcagggggctgcacccaagatgaagtggtccgaacagaagatagaattctcggaagaagaccaccccaagactgccgttatcccaggacgatatccgatcttggtcgaacccagtattcggaatatcaaagttgcgcgagttctgatcgacggtggcagctcaatcaaccttctcttcgccagcactttggatgcgatggggatcccacgaagcgagttgacacccaccgatcaacccttccatggaatcactccccagtcatcgtccaaaccattgggcaaaattacgttgcctgtgactttcggccaagcaaataacttccgaacggagcaaatcaccttccggggtttctgattccgattccgaaaaaaatatgaaaatgaaaacgataaagatgatttccatccgtttccataccgttttcacctatagtgctcaagatgccaggaccgaagggaacaatcactattcaaggaaacacaaagctggcagtacaatgcgacaagcggagcctcgacatggtcgagcacacgcccagcctacccgccacagctgagccacccaagaaagtgagcaaaacaaacaagacaccaaaaccggacggcgcaatcaagatcgttccactcttcagtgccaaccccgacaagaccgtcaagatcggggcatcactaggcgagaaataagaactcgcgctcatcaccttcctccgcgacaatgcggatgtgttcgcttggcagctgtccgacataccgggggtccccagggaggtgattgagcacaaactcatggtgcgacccgacgccaagccagtaaagcaaaaactgtggagatttgcaccagatcgaaaacaagccatacgagaagagctcgacaaacttctcaaagctggtttcatcagagaggtactccatccagagtggctagccaatccagtcatggtgcggaaggccaacgggaaatggagaacgtgcgtcgatttcaccgacctcaacaaggcgtgtcccaaggatcacttccctcttcctcgaatagaccaattggtggactcaacagccgggtgtgagttgttgagctttctcgacgcttactccggctaccaccaaatcagcaaggcgaaagaggacgaggagaagacaacattcatcacgccgttcggggtattctgctacgttaagatgccgtttggacagataaccgcaggaaacactttccagtgcacagtccaaggtgcacttagcgaccaacttggaaacaatgtcgaggcctacgtcgatgacattgttgtcaagaccaagacaagcgactcattgattgacgatctgcaggaaacgttcgacaacctccgacgatatcgcctaatgctcaacccagagaagtgcacgttcggagtaccatcgggcaagctgctcggtttcctcgtatctggaagaggaataaaagcaaatcccgagaagatcaaggcaatcgagaacatgaagtcgcccacaagactcatgcaagtacagaagctaactggatgcatggcggcactaagcaggttcgttgctaggatgggagagcgaggacaacctttcttcgctctgctgaagaagcaagacaaatttgtatggacataggaagccgaagaggcattcattgcactcaagcgctacctatcgaatccccctgtacttgtcgctccccaacctaatgaagaattatttctttatatcgccgccacaccatattccgttagcactgtcatcgttgtcgagagagagaaggtgcaacagccagtctactacgtcaacgaagctctccacgacgcaaagacaatatatccacagatccaaaaactgctctacgtggtaatcatgacatcacgaaagttacgccactacatccaagcccacagggtcacagttgtctcctccttccctctcggtgaagtcgtgagaaacaaagacgtggtcggccgcattgcaaaatgggtagtcgagctaagccagtttgatgtccactttgtgccacgaacaatcatcaagtcccaggtactcgccgacttcgtagccgattggactatacctgataacaggttagacaaccaaatcgacaacgaaacgtggacaatggcgttcgacagcgcactcaacagccaaggagcaagggcaggattcgtcttgacatctccttcgggagatcaattcaagcatgcaattcacctcaacttcagggcaaccaataacacagccgagtacgaaggactactcgccgagataagagccgcagctgcactcggagttaagcgactggtcgtgaaaggggattccgaactagtcgcgaaccaggtgcacaaagattacaattgctctaatcccgagttatccaagtatcttgcagaggtcaggaaggtggaaaaaaggttcgatgggatcgaggtccgacacgtataccacaaggacaacatcgagccagatgatatagcacggcgtgcgtccagacgagaactacttgaacccggaacttttctggacgtccagacaatgccatcagtcaaagaggcaagcagcgaagatagcccagtcgcccccgacatcagctcgggggctacagaggcagagcgcgccattgttgatatcgagaccatagacgactggcgcaccccactgattaaattcataggtagcgaagagttgcccgaggacgacgcagaagccgagaaaataacccgtaaagcaaaattctactgtatgatcggcaacgatctatacaagaaagtgccaaatggggtacttctcaaatgcatctcatccaatgacggtagacatctcctcctcgacatacatgaagggatctgtgggtcacacgcagccggtcgcacattggtcggaaaagcctttcgacaagggtttttatggtcaaccaccctcaaaggcgcttgcgacatggttcagcgatgtgaagcctgtcaatttcacagtaaacacacaaagctaccagcgcaagtgctccagactatccctcttacttggccgttctcgtgttgggggctcgacatactcggaccattcccatgaggacagggcggctacaggttcctattcgtggcgatcgataaattcactaagtggatcgaagcgacacccacgggggaaatcaaggccgacaacgccatcaaattcatcaaagggatattctgcagatatggactgccgcatcgcatcataaccgacaacggctcccagttcattagcaccgacttccaggattactgtatcgggctgggagtcaagatctgcttcgcctcggtttctcactctcagagcaacggacaggtcgagagggcaaacggcatagtactacaaggaatcaagacccgcgtctatgataggctcttgtcacatgacaagaagtgggtcgaagaacttccattagtactatgggcagtgcgtaccacaccgacaacgtctaacaaggaaatacccttcttcctcgtgtacggctcagaggccatgctccccaccgagctacgacatcaaagtacacgagtacagaattagtattccgatgagggtcaggaggagcagcggaacgacgatgtgaatctactcgaggaacatcgcgaatgagttgccgtccgagtagccagctaccaacaggcccttcgccgttaccatgagaagcgcatccgagcacgcacgctttcgatcggtgattacgtcctctgacgggttcaaagccaagcagggcgaaacaagctctcacccaaataggaaggaccatacacgatcacacaagtcttgcggccaggcgcattcaaaattgcagacagcgatggtcgcgagttggcaaattcctggaacattgatcaattacgtaaattctatgtataagtcaatcgtatccatacttgtaagacatctcatagcttcaataaagcctattttcaggtacggattacaaccaaagtgttccttcccgatgatcccttacccagatgacatttagcattgaaacctatcctcttgtccctttacgccgtcttgacaaggcctccgaaaaacctaagggatcttcggctggggacgcctagagccgataaggccttgtcggatcctgtagagacgaaagaccatgtaagatctggtcgtgtaagagttcttgccgtgcgtattaaccaagccgtgtaatcggaaattaactttccaacttcacggctgggggctaggatcagtgcttgtaaaaccaaggcaggtcaaaggtccaagagccttatcttccgagaagtattctccgatgacaaggctgggggctagggagagtgtatgacttaaaagactgatcgacgtcgtgaagtgagaagacactcttacacactacatctagagtaaggaagcttagttagatagatcccttttctatttcacaagtactgcttacaatcccgtaaacatccaaaactatattacacttttccctaagatatttgtcacagggtacagagactaccaggaaggccaacgccagtccatagactagaagaccttctctgccagcggcgccatcgacttcgccaggtgatctatctccaccggagttctctgagaacgagaaaacccttcgtggaggaactcgaggtgcagttgcgggcgatgatctcgtatgcaagccaatacatgccctccggcatatcggctcgatcgacggcactcctgcttcagagcctcgtcaatacgcttgtcgatgccttcgagctgggtgcaggccccattcaaccacgagatgtatccggccgccgactcctcgggatccccacggggtactcggagctccctacagactcttgtcatggacgtgcagcaactcttcagatacgagttgaacctcacctcacgacctcggagtgtttccacagccagctccttctttacttccagcacagtcctctcgagttccgctacctcaaatttcgtcttccaatattggatgcgatgatcttggtcagcaggtgcactctcgagatctgctcagcgtgaaaacgactaaatcaagccgctcttctcttccgagaacacagcaaatcaagtcaatccaaacggaagggtaaaggagatggaaacagagatgaccaacctaaggaagtcgtcaccatacccgtgtccgcgggcaaattttgatctacatcgtcctgcgacacacgtggttcaaacgcaagcgtcggaacgatcaccggcaactcaagctgcccgcgctgctggacatcctcgacatcgacatctctacaaacgacaacaaagtacttgggattaaaatgctaaagaaaatgaaggtgatgattgcgcacgcaaaggcagttgaagccaacaaaagttttacaaagcatgactgattaaagagtacaagggaactaaagtcttactcttcaaaaagtgggagaacagactctcccagatcaccgacttcctccatcacgcccttacgtgcgtcgttagtcgctccctgatccaagatccactgaagatcaagttcagggtgcgctaacctcacacacgcgaggacgtgacatgccccggtgtaaatcccgttggacgtctcctccccgatcatggccgcatgcttggagggtatcgcctccatcgccgtggccagttctgcgagtgaagtcatcagcgagaacttgtcggggttcaccgggatggtggtcgtaacaccacatttcccagcgagctggtgtaggctggtgtaggtgacccgtaacgagccacggatctccgacaggttgttctctgtcacgactggaaataacccaacgggcgttccttacgtgcgtgtattattccttgtcccaggaggcaaggtacaccaaaagttgatacaattcagagtttaacaagcggaagcgtatatagataatttattacatgggcagcgaaggcccagcacacaagaagacaaacgaaaaacagcggaagactagggcgacgaccacaggcgcttgacggcaggcacgagttagacaccaaagccttcatcttctaggaactcctcttctgggtttgcgaaaaattgagcaagactgagtacaaccaccgtactcaacaagacacacccacaagtgtagaataaatgcaagggagtacaagggagttataacataggggttaagttttgcagtaaacagcatttaaaagtcacttagttgccaaaagctattttatgaagatgatcctagagctatacaagattattaatcaaggccgtgaacccacacgaacctgccttaacccaaggcctacgatgattcagaccgaactagcaacccgaccctgggtcccagctcgtcccaagccaacccaggccaaccattccacattttagttgttaagcaggttttaagaattaaaacactaacttgggtacattgctaggcttgcccataaccgagggcgcgactattcgaataggttttactctgatcagaggtgtacatctttacccacaagacatgtcttcctcacgtgtaaccacatgccacataccaccacggcatacagacggaagacatgacatagtttccaacccatcctagccatagacaagagtaccgacccaaccccacctacggccggaacctccgggacaggtaggcaggactgagcccctagcagcaggacaccagccccgtgccatgacatctcgactaccgggccgcagctcgtgtagccttcatttgccctagagatgtccatcgacccccgacttcgtccatctgcatccgtgtacttttgtttataaccagactgagccacaaactaagccttacccactagacatgtggaagtacggtagtgctttgcaacagaggcccgaagaccggtccttatgtggccgaggtgctactatcaaaaccatgcaccccgagcccagcctaaaaccattttgagggttttgaatagagggggaggtgtgaatccaattccacaataatccaaccattccaatgtccatgtgatatgaatattcccaaagtctagagttgtaaaaccacctaatgttgcctaattaaccagcgaagcatctacctaaattcatactagtggtaccatgcatagggtacccactagttggggttttgtttattctagggtgaacaaggtaataataacaatagcaataataataaggtcataacaatgataaataggtatggctaaataaaacagtgataacgcgggaatttaaataaagcgataatgcattaatttaaatcaaaataattttataaactgggattcaatatgttcaaggatgatgtgacttgccttgctcgctttcccaaacgtcggcttcaacctccacgaagagcggatcttccgaagctgcagcgtctacacgactaacggaaaggaaaaaggcttttactctaataaactccatataacaagcaggaacaaagcacaaaaatgggttcttgacttcttgaggaaaaattagagacttgaacggtccaattccgagttcaaatggccaagttatggccatttgaagtttatatgctctttaagtgaatatttgcgaatttctttatttaaattttaattttaaaaaaaggatttattgcgtcagccgacgggggagggcgcgcggaccgggtccacgggagtggggcccacccagcagcctcacggtccacggtggacagggtgcacccgggctcactccggccggcaccgtgggccccacgcgtcagccgcacccgagggcgcgggcagctgacggccgggccccacgcggcagccactcggcgcgcccgaaggcagccacgtcggcgcggccggtgggaggcggcgcgcccgcgcccctatggtcgccggcggcggccataggcacggcggagcggcggccgagagaagggaagggaagggggaaaagaggcagcggttcacggctcaccctaggtcgacagcgacgacgaaaaggcgaccggagcggaggaaggcggcgacgtggctcgggtcg

SEQ ID NO: 83404 - DNA, 20521 bp, Oryza sativa
gggttgggtcggtactcttgtctatggctaggatgggttggaaactatgtcatgtcttccgtctgtatgccgtggtggtatgtggcatgtggttacacgtgaggaagacatgtcttgtgggtaaagatgtacacctctgatcagagtaaaacctattcaaatagccgcgccctcggttatgggcaagcctagcaatgtacccaagttagtgttttaattcttaaaacctgcttaacaactaaaatgtggaatggttggcctgggttggcttgggacgagctaggacccagggtcgggttgccagttcggtttgaatcatcgtaggccttgggttaaggcaggtttgtgtgggttcacggccttgattaataatcttgtatagctctaggatcgtcttcataaaataggttttggcaactaagtgacttttaaatgctgtttactgcaaaacttaacccctatgttataactcccttgtactcccttgcatttattctgcacttgtgggtgtgtcttgttgagtacggtggttgtactcagtcttgctcaatttttcccaaacccagaagaggagttcccggaagatgaaggctttggtgtctagctggtgcctgccgtcaagcgcctgtggtcgtcgccctagtcttctgctgtttttcgtttgtcttcttgtgtgctgggccttcgccgcccatgtaataaattatctatatacgcttccgcttgttaaactctgaattgtatcaacttttggtgtaccttgcctcctgggacaaggaataatacacacacgtaaggaacgcccgttgggttatttccggacgtgacattctcgagttccgacatccggttctcgagtccccaccgttgtcactcgttgccggccactagttccctcattttctggaggtcctcacgaacctccgccaggtcacgcgccagcttatcggcacgctcatttgccgacgacgctgctgccgtcctcgcctccgcaatctcgcgacttatgccatgagcaccaacctcaaggatgtgccccatctcgacttggagctccccccaggtgaggacgtcagcaggcaggcctcgagcaggcacgagatcactggctgggccgttgggcgtcacctcacggctcctgggcacgaccacgacatcggtcgaggccatcgcaggagacgtgctggagttccctccggacccgtcttgcaccgccttcgcccgcgccgacctacagaagattaacatgtctggccctcaagacaagtcgccagaattcaaccaagggaaggacctcaaattttgtccacttacttctcgccaagtgtcaccagattctgccgtcgtggaggtggcggagacgcatccaaggcctaagtaaaccgagtacgacgtgagggggacatcttccgactacgtagttaacaactcaagagacttaccgatgggaggacgctttccggcggctgccgagcacggaggtgaatttcctccccttcctcgggacacggctgccactagtcgtggcagcagcagcaatggccgcgtcggacgcctcttgggcgacgccctccttcaacgaggccgccgcctggtggtccaagagcggtccaatgacgtcggtcagagggagagcctgcaccgcgtgaagtcattatgcgatctaggagcaaaaataaagggggtcgtcaaatacactcacgttaattgcggcttcatgctcagccttccccttctcgcaaagggggatggggacgttactcaccgttgtcgggccactgatcatcaattgtccgacgcaacgctccatggtctcgctgttcaaacctgtagacagaaccagaattcggtaagtcaggaggaacatgcacataaggaagtcaaattaaacacaaagaaaaatacccgaggagaaactcgggtcgcgtcctccggcccagaatagtcaaaggctgggtgggctcgagcctggagcggctggatccgcctaccaatgaagtcggcagcgacttcatacctcgacaaacctcgtactcggaggtcatcgatgggattgatgaagaactgaagagaaggggtcaaggcgggtttggcagtccaagacggaatcttgtctggttgttcctcaggaacaacaaagattggatctgaatcctctacctgaagatagaaccacctcgcctgccacttgctgcgagaagaagggcattggaaggggatatagcgcgactttaggccatcccggagtcggaaaccgacgcatccagataccctggtggattccatccaacgcagcttgtagtagaagcgaaaaaggtcgagaaatggctctaccccaatgtaggcctcacaaagatgcgaaaagatattgaggaaggtgatggaattggggttcaaatggaggaaagaaagactgtagaaactcagaaggcggggggagaaaaccacagagaatataatcctccaccgcaaccatgtgacctaggacaggttcaggttcagtacctcctggttccctctccatggtcccgcgaccggggagagcgcccttgtcgcgtcccaaaacgactctaaaatacatccccgaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattaagaagaaataaacaaagttaaaaaggttttataaaaagaaaaaccctaaaaagtccttttccccccctccccctcttgggccggctcggcccatctctctccctctctctcctctcccccgcggcaaattcggcctcctccccgcgcgcgtgccgctgacgggcgggcccgcccgccaccctcactgacgggtggggcccacccgtcatccccttcctcccgccgctcccgccgcctcgcccgtgccctagcgccgccgccaccgcgaatcccgccgcctcccgccgtccacgcgcgcaataaagtggggggaaatattccccgtgattccctccctctttccccccatttttccctccctctctccctcgcattcgtttggaaacctctcccctaacctcgccggcgccatcaatggcgaccggatcttccgcgcccgtttccccctcgtccggcagctccctccccctcccaatcctatataaaccttccccgtgccaccctccaccgtttccgccactcgccgccctctctccccgtcggaatcgagctcgcgccgtcgctctctctctccgccgtcaccgccgagctccggtccgccgctgtcgtcgccccggaccacctcccgcctcggcgtcgccaccttcggcttcaccgcatccccgacgacctcgtccacccctccgtttcgctcgccgaccgccggagcaccgtcgaccccgtccacccgagccgcgccgccgccttcctccgctccggtcgccgtttccgtcgtcgccgtcgacccggggtgagccgtggaccgccgcttcttttcccccttcccttcccctctctcggccgccgctccgccgtgcctatggccgccgccggcgaccataggggcgcgggcgcgccgcctcccgccgctgcgccggcgtggccgccttcgggcgcaccgtgcggctgccgcgtggggcccggcatcccgtatatatgtatatacatagacacagtttgattattggtcttactatttaaaaagtaaagtgcacgggcggtctctaaacttgtatgggtgtatcaactagatcactaaactaggtcactaaactctcaaaatgaactttttagccctttaacttgtctcgtgtgtcatatagatccaaacgggttccaacccgccccgtgtgctgacgtggcagccatgttggcacctacgtgtcaatagaactcatatatatgtccgccacatattaaaaaaaaaggaaatatttttcccctttcttttttcatttattttttcaaaattgaaaacattattttctcatctccttttaaattttatttttttctacatgactagcatgcatgtggatcccactgacacgaaagtatcaccgtggtataccacgtcatctcacggagcgggttggagtccatttagatctatatgacacatgacgagtttggggacccaaaaatgcatttttgagatgttagaaatctagtcatctagatgacacatctgtacaagtttaagaaccgcccgtgcacttcattctatttgaaaagttatataataattcaacattgtcaaataaaaaacggaattagtattttgaacgtatttaatttcagtaggtatatatactcttcattaattgaagttgggactttaataatcttgtaatatatttacccctcaacttgctgacaaagtatatggaatattatatgaacaacaaggatatatatcttgctgatgacagtgttaaactaggatgaactactattgaacgtgaatcaaaattcatgaactacatggaaaaagttgaaatcggccggcctatgttgtcagtaaatagaagaaatctttagatattacaactttccaacaacattgcatcaaggctcaagcagatcgaacaaggtttttttgctctttcttttgtttgaacaaggacatgttacgctttcccgtataacatcctttatttaatttcgtgaagagagcatatcttttacacttgtatcaggaatatcctttgcaattcttagtattattacaaaatatatatgttgcaattccataagtaaacagaattaaaaagtttgatcttggaaattcttcaatgtacaacctaattttatatttagcatcgggatcttatgtatagccctgggaccatgcatgatgcatgtatgcatatgaacagtgaagacaagataacttgacagatacatttttgtctgcatgctatatatatcatatcgaaaatttaatcctagacaagtatggagctatggacgcactgcacgctcatatgctataaattctttttactaatgattaagtttgtacagtttccagcaaacttgcaactttatttattcgtgaattcggtcctgtaccatgagttcgacagttccattgaaagcttctgttttattcgaataattaactttgccttgcatgcaacgatgcatacgtttatgcatatgaagaaattaattaattataattatctttactaatcccttggcagagctacgccgtacaacgacacgagctttcgtgagtatgtggcagaggggagcgcgccggcgctgccggagacgaggcgcctgtaccggcggctgctggagctcggtgtcaagccagtgttcctgacaggccgcaccgaggaccagagggccatcaccgtcgcgaacctccgccggcagggctacactggatgggagaagctgctgttgaagccggcagctcatgtcgccggcgggctccagttatcggctgtggcgtacaagtccggcgagcgtcagaagctgcaggacgccggcttcatcatcgtcggtaacatcggagaccagtggagtgacatcttgggtgcaccggagggcgctcgcaccttcaagctgcctgaccccatgtactacatcggctaggtcgccggcgtcggtgccggtggccgttgctaacaagctgcgatgaatatagtcacacgttgttgagtttgttagttcagctgtggctcctacgtgttccagaagttagcagttgcaaaggttgaaggaataagtctgctggagtttgttagcagatgcagatgatgcggcgatcaagtccttaagcagactgtgtcagtagggttcgcgtgcgtgagtttagcgcggatgtgtgagtcattgaattcgaaaagtggtatcgtgggatggcgcgatttgagccttggattctagtcatgttatttgagttgtatgttactctattcagttgaataaaaaccacagaaaatcaaccccacaatttccagtacatcgattgttctctgaaacttcactgttcttcctctgaagatctcctttctgcattctatgttctcgtctgttgccgtgtcggattgctgcagtgtgcacacaaagtgtttgatccgaggtttgtcgccaacaagtggtatcagagcactcgggctgagggctgatctgacaccatgtccatagttccggcggcagcagatccggttttattgacggtcgttagcgatcagttttgaccgtcaatattactaaaataaatgagaactagttatacttgcaatgcatatttatgtttaataataaatagtcctctagcactaggattactaacctcttgcatagaatgaccaaaaaatggacgagaatcaacatcaaaacaagcgatcgttcaatcggacgatgtcaagaatcagacttatcaacgaatgggccaaaaatgcagaaatgacatgaccaattgggccaaaattcacaagtctgcacatgggagcaaaagaggaggccaccagccaaaacctgggctggttgggccgacccatggttcggtcgaaccctcctcagcgccgctcgatccagggttggtgatggatggtgtggatggcttccctatagcgattgaagggtattaccaacctttccaaccgccataaccatcactacctgtctgtaaaaggctcactctctctccatttcaagacacacctcaaacaagaagatcatttcatctctcaaatttagtatagtccctggagtatagcggaatagaaatataatagaatcttcagtcctcggagtcttcggaagaatttgggtatgcctctagtagcttttttttttgcggggactctagtagctttttcttcttttgtaagacttatattttatttagaatattcttctttatactactttggtattgtattacttttcgagtatatgaatatctactttactatatgttcaagttatattcattatgatgctagcttatctgggagatacaatggtgtgagtataatgatcatatttacgatgactctatgtcatgacgatgatattagaatagtatttggtaatttaagcatggtgtttagattactggatatcattatttggggttatatgttgtagaagcgaggtgggccgctgatggtgacagctcagtacatgtattcctccgcgcgtgtatatagtcctaagttaatttcctggggagggtagtcctccgtatttagccctgattggatggtcatgacggattgtcgtaaggaacttggcaatcagggttggcttctcgaagcaccagtaggttatcagaaagaggttattagctaagtaataatatggctaggatgtatgtataatatgtatgtatactagaagtataggaatatgatctttctatgttctttccacttagcttagataattatgagtaagagtatgaatgcttgtgcttagtgtcactctaccctttggattatattaactcatgcttagactttgattattacaattaatatataaattattagtatggtatctctattataatcttcccacgggattaaacaaatacgatacccttggaatactctcgggtgaaatgctacaatggtatatccgtgcgcttgcggatgaactctgtaaccataatataccagaagtatttctgcgctattgctgggaattatatttctagtaacgtcgttaagaaataccaacaacatttctggcgccgttgccggggaggatttataacagagattaccatgactaatactttatatttacctctatataatcactgtcatttgcaggctaaccttggttgttttcacttttcttatggaaacagggtagtacatgactggtttcaacttgccggaaaatttcaagaaaaatccagaagttttcttttggagcgttaagccgcgagtcgttgctccacctatgcgggtggatctcaccggcgagaatgcgagtcgttgctccacctatgcgggtggatctcaccggcgagaatgactggtaaccgatactttgttttgattgttgatgactttacatggtggatgtgggtgtttgtgattaaatccaagggccaagctttggaaaccttcaccaagttcaaacccctggctgagaacgtggttgggcggcgcataaagacgctgagatcggatcacggtggcgagttcctgtccggcgagtttgcacaacagtgtgaatcggctggtatccagcggcatttgacagtgccgtactcgccgcagcagaacggggtggcgagcgccgcaacaggtcaatgatggtgatggcgcgctcactgttgaaggggaggagcgtgtcaggctggctttggggggaggcagtgcgccacacagtgtaccttcaattctcaactggccgccaaccaaggcgatgggaaatcgcactccgtatgaagcgtggatggttaagaagccgcacttggcgcatttgcgggcgcatttgcgtgtgttcgggtgtactgcacacgcgaagaacacagtaccacacctcgagaagctggacgaccgaagtgcaccgtatgtgtacttgggcgtggaagaagggagcaaggtgcatcgactatttgatcctcgtcgaggtcgcatccatgtaagtcatggtgtcatatttgaagaaaatgttgtttgaccatggtatagagctacaggcgagtaggtctctgctgaatttgatgtggaggagaccgtcgagcaaccagctggctcgacgacatctgtggtaggcttcgtaccgcggtaccaagcaccatcacccggcagatgtccatgcaaggaaccggtggtggtggaaaggggaaattcttccctggcaagctcactggaggcgtcaccatcactaccgagcacacctgctcattcctcgccccccggatcaccgtcggctactcctaccagatctttcggggaacagatcacgccgcagtctggcggcgacactgacatcaatgatggccctgtccggtacaggcatattgatggcattatgaattaattgtgaactgctttctcaataatccgcaatgcatatccttaattcccatgtcaacttaccgttggtagatggatgagatttttgttgacgacgttggcggccatggatagcactgttgctttcaatcggtagtttcttaagtatcgtcacctaatcaacttcctagttttgaaaatacgatagagatagaggtaaggtgagaagaaaatttagagttaagtttttcttcctaatctgggttgccatgtgacttctcttccttccaattgaccccatactctccaccctcagcttggcaagatggcttgtttttctggttatcgtatctccttcgtccagattccaaatcagacaaaccatatatctgttctatcgtcgtgttgacttcaatgtggtatactcaaatatgtgatttggtttcatatcttataggtagttttggtgctccttcaaaattcaattgggaataagcccaaatatcccgacatgtttacattttatgacctaaacttgcaaaacctgttagaccaacaaaactcatagaatcccattagtgtaaagaaacaacgataaggtaacatgttatctccatttattttattaaaatttttgtactcgaattggagtttttagtggccaccaataggcgtcaactgagaatgaacactcacggctgaatcgaagcacgaactcaagagttcacggccggaatggacacaaaggaaacgcacctgcacacacgcacaggatttttcagcaacaaatgtctttcatattttccctgcaattcacccggtaagtaaacaaatgactaggtccatcaatcttaagatatatcggtccaatcttttgaaggtgctcatagggtaaggtatatgtgtgcgcattatgaatacttgctttggtgctgacttcaccaattttaagatatgctgatctaatctttccgaggtgattataagaatacgatatgtggttgcgcatacatagggaggtaagtgggttggcattatgagcacatgcgtttgtatagtattttaaaaaataaaaacttaagtattattgataaattaacaccataaataaattacgtctacgctattctgcaaaacaactcataacattaaaaaaatattgtcatcatcttcgttttctctttgttcttttctaaagggcctcgagcatggataacagagcttactatatttttataagtatggtaagaacatacatatagttaaatcgattggcgataaaactcaacttcctacttaacgatgcaattatgtatgaggatgccgatagtgaattagacaatatgaaattatggttcatgctggttttaaggagtagatctacatcaatgggagatccatgtttagaggcagcatgaaagaaagccttggtgccattcataatcaagacaaagtaatatttactatatttaagtctacgtatattttacaacatagatattttttctatttatttaaataatttgtactgagatatgatttcttttagcattttttcataaataataagtgaggtgcccgtgcatccgcacaggtttccttccaagtttcttttaactaatatcattataaagtaattaacaagtaatcatggtatttaacggtgtcattagccattagccagccagttcgatgggcagtcaagcgaacttgctgctgcgcccagcccgttcactgagcagccaagcgaactcgtagagcagttaactgcaacgatggtatatttttggcacttctctctataaacacatatattctgtaaaaacgattagaaaaatgtatattttcgaatttttccggttacatgacacatgtaggcccccaatttacctcccttggttcttttcccacttgtctcttgaatacttcaaatctcaattcctaaaattcattctccttcggcaaatttgacaacaccaatcgagagcctaccatgcacgcatggatatatatatacacacacattaaaaaaaaaaacccttcatccagctaccacatctcaatataaaacccttccccaccaccctgcctcttgctgcttctgtaacttccctctccccttcaatctgaaaccataatgaacttaatttcgcttttgtcaggttttagctaggtttaggaggcatcatgaatcgattacatcctgcgtttgttgctagaactagcccaataaagagaacctagggtactggcacatatatatacagttgctgtcgagaacatttaacacacagagaccgggctagaactgctctctggcctgtccctaatcctgtaacgctcaatgcatcaaaaacatcaattttgattggatgccacctctcgatcagttctgtttcttgtttggcacttagagaaaaaccccacctgatcttaccaagccacctcccctacttatggatggaagtgtgcaatctggttacccaagtaaaaaccggccggcttagtagtttagatgtgttagtataaagcccaatgtgaaatttgtataattgccatcccactgtgcctgatgtgcctatttgtatgactgcttcttttggaaccctctaataatccattgtgtttttatggtaaaaagtggacgatatgatcttatattgtggacatgtaaaatattatgagaagttatacagtacttgagaaaatatcttgaggtacataagttttacattaaaattaataccaaaatttacattagaaaatatggtaactctcagtaccttcttaacaatggtaaaattactcaaatattattctgtgcatacacagatatgaataaataaagcaatcaggcagaagtactccctctatccctacataaatcaaaccttagcttcccaaggagcttttaaggagagaaataaaagaccacaatactcttaattaacgtgaatgttgtattgaataatggataggtgaggggtattgaagtaataaaatttctcgttttgcggattggtggcaggtaagaaggtagaagttgtttattttgggacaaatttgaaatctagaagttgatttattttaggacggaaggagtaataagaagaaagggatctacgtgtaaatcgattttgaggcaagtatttctccttgtctatttgaatgagcaccacgaattgaatccatgtttgaaaatgctctccgaattgtccgatgatggtgtagagttttctaaaaccaagttcttataaacttttacatgcttcatcctaaaaagcacagattcttttgtaagaaattaatcttgtttgcgtttcattctcgtgtgtgtgctcgcgtgagaggagctgagtcatcggttagccaacatctttttcctggtatcagttaggcatgggatgcatacaggattcatccaaaaaggacttgatggttggctgtactgtagtttgctgttcgtctggagctagcagttatgccagcaatttgtgatacatatgtttggcttataggttgagtttttgtcacaaactgaatgaccgcaaaacagctagctaacatggatattttaaatttcagttaagtaatgaattgtacatttactttcaatctttaatttggagttcctttagtatcattggaaaaaaaaagtgtgtttcattgacacatgtacgaaataattaatttaacccctcctctcccaaaaacaaaaaaagaccccagatgatgcctgcattataggctttgcttattcccaaatccaccaaatcccaatccttaaaagtcattctcacttgacaattctgacaacaatcttcgaggtgttagtatgcgagcgttcatactcatacacacacatacaaaccagcatccgattacctttgtctcaattttaggttttggaggcattgggaattgattttatccagtgtctactgatagagcaattttacaacgaactagtaagttgagctggtaaagtacagaaagtggcttgaaaatgtataaacgaaatttttgtattttttattatactattacatattgcttactagctagttcttaaactgaatcaaagaagaaaaaaagtaccattttgtctttattacaactgctgaattgaacttctctttatagcccataactttcattcaatccagaggatagttctgacttaaaagtttaagagtacgttcagaacttcagatcgtctatcctataattgatatcccgttgtttctatttgcctgtttgtatcattgcttcctctgtaacatcaattcctagagagcgcgtcttaaagtgatttctcatgtcccctgtaacatacaaagcttgcggagtatattgtggataccagcaaaccaaagcaccacagattcctcttcctatccatcaattaggcatgggagccatactggattcatctgcctctccgatgacaacgccaagttttatagtttgttcctcattgtgagtagcaactgcagcccatagtggtccattgtgatgtggacgagggttaccgatcttccgaaaggttctaataggcagtcaatttgagcggagtcgcgacacagcccgatccggcttctgaacgaacacgctcttgagccccgcaatcgtagcaccacgtctcctctggttatcacccgtatcgaaacgcggaagacctcgccgaaaaggctaatccctgtttgcgaatcgaagaacacaaacaagaacaaggaagaatacaactaaaattgtagatgaatgattaagctcacaagttggtgtcttacaaaccgatctagtggcgaaagtgttcttaacagaataatctaagaaaaacctaaaccctaaaggtgacggctggtactgatatatagagtttacggtcgtgcaaacaacccttgatgcaaccctaatgggttccaatacgatacacggcccaaatgcccaaatacggtgacgcagcaccgggacagattcttgacgtcaaattgttcggtcgattcctgttgacttggaaagaatttggacgtgggactagaaccattggaaatattatcttcttagctttccagccatataaagaacgccataatccgagcatgtatgcgatctgggtgcccgttttagtgcagagggtcctggactccgaatcgtactcgaagtcgacttggtttgggcctccatcttgacttggacgtccttgatgatcctccgcgcctctaagtccctctctaagggtgtgttcgctggttcatgttcccatccggaacaatagacacggaaaacagagcggtccattagcgcgtgattaattaaatattagctattttttttaaaaatggattaatttgatttttttaaagcaactttcgtatagaaactttttgtaaaaaacgcaccgtttaacagtttgaaaagcgtgcgcgcgaaaaacgagggagatgggttgagaaaaaggggttgcaaacacaccctaagtgtctctttgtcctctccatgattcctataattattaggtagcaatatattctcaaaatcatacaaagaagaataggaacgagcttacctctaaattcaattgtctcgcgcgagctcttgttattggtccttgaatgaccggtggaggattgttgtgtgtatccgaaggagtgatgtccttatcatcctccctctcttgaattagagtcgtcctcgactcaagtacatcttcttctctcaagtatggttttaaatctaaatgttaaaagtgggactaaccccaaactcaggaagcaattcaagtttatatgcattatcattaacctcctcaataattttgaaaggaccatcagctctaggcattaacttagacattctaaaatctgaaaattgatcctttcgcaagtgtaaccaaactaaatcacccggttcaaacttcacttcttgcttacctttactaccagcaattaattctatactttttagtcatcttttcaatgatctcatgtattttcaaaataaattcagcatgtgccttagtttcagtgtgaaccctctcactagtaggtaaagactaaactgctccatggcctgtccctaatcctgttacgttcaacgcatcaaaaacatcaattttgatttgatgccacctctcgatcagttctgtttcttgttttggtatttaaagaaaaacaccgcctgatcttaccaagcctcctccctctacttatggatggaagtgtgcaatctggttacccaagtaaaaaccagcttagtagtttagacgtgttagtataaagcccaatgtgaaatttgtataattgacatcccactgtgcctgatgtgcctatttgtatcattgcttcctttggaatcctctaataatccattatgtttttttatggtaaagagtggacgatatggtcttatattgtggacacgtaaaatattatgagaaattatacagtatttgagaaagtatctcaaggtatctaaattttatattaaattttttggtacttcattcgaggatatcaaaattaatttatatatattagaaactatggtatctcctggtatcttttgaaatatgttaaaattaccaaaatagtatactgtgcatacacatataagaataaataaaacaatcaaacagaactagtcagaagaaagggatctacgtgtaaattgattttgaggcaaaatatttatccttggctatttgaacgagcaccacgaatcgaatccatgtctgaaaatgctcttcgaattgtccgatgatggtgtagagttttctaaaaccaagttcttataaacttttacctgcttcatcctaaaaagcatagattatgtttcctggtatcagttaggcatgggatgcatacaggattcatccaaaaaggaattgatggttcgcagtgttttgtagtttgcacttccttgtcagctggagctagcagtgatgcccagcaatttgcgatacatatgtttcgctttgatattatgcgaagagctagctatcgcttataggttcgagtttttgtcacaaactgatcaaagaccgcaaaacagctaacatgtatattttagctttcagatctgttatatctgaaaaggaataactctccccccgcgtcgccgccgcgcctccgtcgccgctccccctcccccctccccctacctcgccgccgccggagctctcctttgccggctggcgagctaggatggcggcggcggggccttcttcgcggcggcgtcccttctaaggcgcggtggaggagacgttcgccggcgtcggggagtggtggcggcgaggcctctgggctaggcagtggcagatccggcgccgccgtcgccggatctggccagcctctccggttttcggccggagtactggcggcggcgccgtggggcggcgtgtgcggaggcggcaaggttggcggcggccggtgcgcgcgtggcggcgcgaggcggcgaagtccagcgcgcgcgtgggtggtccggtgcgcgcgtggtggcgcggaggacggcgcttgcgaggcggcatggcgacatctgctggctcccgatcggcgaggcgcgtcgctgggggcgtcggctacactggctcgccagccgccccccatcgccacacctacccctccggtgtcgacagtagccacaaccaccctcccctctcttggcttcttcctctttgcaagcagaagggggtgtccgccacccttgtctcccttcttctcgcttcctccctggcagctctgctgcctagttgtttagttgctttgcttcttacaccagtgctcctctctctgtgctagtggtgaagttggaggtggtttgtcgcagctgtaaggggtgtcctgcgaaggccggggtcctcgccggaaacatggatgacaccgatgccttcgatgccttctctcctccttgatgctcctccctttttttggccgtctgcttccagtctcggccgtggagtctttcggtggttgaggagaagtgttcgtctatgaaggtggttcagtctgtctgtagtcagggctcttgggcctcgcaagtgcttctagtgtcctgcgactaagtgaacctatcgtagtgccgagttggagcggtgtgcttatcttcagtgccagagttttgtgtttggcggagtcggagctgctgcatcgggcttagccgatgagctgggcaacgataacacaacacttttgctctggcccattgtagatcctcctttggagggagtctcgggtgaaagccctgtcttgtcttccagaatcggcaacatcgacgcttgtgggtgtcgtatccttcttggaggtgctgctttgtggactctctccccctttgggtgaaaactcagtccaatttttgggcaggcgtcggcagcggcttctgtcgttgttcccctccttggaggcttcgccttgaaggtcttgctcttccctcggtcacttttgtggttcggtcgtttgtcccaggcttttttctctgtcttctgtgtaaggtttcgtcagtttccctttagcaaactatgcagttgtaaggtttttgagcccggtttttcttattaacaaggtcaactctcttcttataatattccggtagatctcctaccgtcggtttcttcaaaaaaaaaatattttacctttcagtttataattaatgcattgtacatttcctctcaatactttggagttcctttagtaaaactggataaaaagtttgtttcattgacacatgtatacgaaataattaatttaacccctcctcccaaaaacaaacaaaaaaaaaccagatgattccttcactacatatataggctttgtttattccaaatccacaaaatcccaatccctaaaagtcactctcacagtcacacttgacaaattagacaacatccttcgaggtgttagtacgcacgcgtaacacacatacaaaccctcatctaactagcgaccgtctcaaaaaaaaagaagggaaataccatgtgtcaattttaggtttaggaggcattgggaattgatttcatccggtttctggtgatagaactagcgctgtggagattatgggtaccccatacccacacgacatggttatccgactggttataggggataacttatatctatgaaatatataacggatcatgacttgggtattacgtttccctgtatattatggaacggcctaaagtcctggtttgataagattgtaaagtagatttaggaaaccgataccgtattggttaagatttctatcttgtaatcctgccccccatcctatataaggtgggcaggaggccctctagggggcatgagacaactagatcgtcagatctataatacacatggtggattcaaatccccaaacaggagtagggtattacctctcatcgagggggcctgaacctatctaaatccttgtctccgcatccatccacttttaggtctcgtgcgctacccttttattattgctgaattcatgtttcgacagttggcgcgccaggtaggggtgcgtcaagttttccgtcaagaagtgtgatggaatcaagatcaggagtggccggattttccttcaccccgaaggctggctttcggttttgacggattcgtcttctttgatggtgactccaacaatctctccctcttcgacttgggttttaaccagtcgagagaacggcgatcaaagatttacgtcatcaagttggaggcttcaatcgtcggggtcaccgatatctcctgtgcatctccacaaagatctctgcttcaggagctacactttgtggttacaagaataaccaggttcgtcgttccaatctactaatcgttattagattggtctctgatataactactaattaaattaatctatgccttgcatgtactgttgctggttctgacctccgagtctttcgatcattgtcacgggagatcaagacatcagctcactgagcacacatctctatatgggtagatcgtattgatcttataccaggcgtacaatagaagtccagactcggatttagctgattggatcattctcggactcggctgactactggatgatcaggtcaaaacaaaaatacactcggcatgcaaggaaagcactgggaatgtggtcggcacgagccccaacacttaccagtaccccagctctgggaaaagcaacgaacgctatgcatttgatcaattccagagctattggttttgcatctacatcccagaagaattgccaggcatacacatcgttaattggttgtcatgagctatcctcaataagggacaccaattaatatttccatccagctcatacgcatgtgagcatatatggctaccttgccaactaatcagatcaggagtcctagcaccatactcctacgtgaggatatatgatatattggctgacatcatcaggagatattatctcggactccatcaaaacatgctccggttttcccttcaagcactcctctgacatcatgagcttgagttataaaccactaccggatcagtacaacatggcgttgagtctggaagggcctatgtcttcgttattaccgctggcttgcctccgtcgtcgccgactagtgttctcgcctatacggttggttgatcacaccaccgttgatgggcatcttcgtcttcaccgactggtcaccttcgtcgccgccgattgatgtctttgccttcatgactggcttatttcatcgccattgacggatgacttcgttcctatatcggtcatctctccgtcaccaaggagaatattacaaagctaagtcatcattaattttcttctttatatgatatttttcttttcctctaactcactacatcaattggttcgccattgactagtgagtcgggggctagagatgctatgtcatattttttcaacaattttcataatatttatcttgattgcttgcgacataatctgagtacaaaagtgactatcgagttatggagttctatcttcctatgctttccgtttggtttgtcgatggatagttgcctttgggccgattcctagcacccgggggctcgttggatggaccgagtaacgcaagatgctaagtattatattcggaataaatcaaaagcatagagataagataaatttatttattttcttctcttaacaattgcaaaaatacccgagtagtaaattttgattcgtgaaactttgttccattaatgacgaactcatgtcactcatatgcatgtttgggaagtgcctaggccgactcccggtgcttggtggctatgactagtcaggcagagtgtttaaacgtaatgagtcatctgctcggggaaatcaaaattgacgagaggagaaatacatatttataaacacttttaatacttgaatctttctcaagtactgtatttacatcagatactactcatcctatatatttgttctgcaggatccagatccagatatgcatcaaagggattcatggcttt

SEQ ID NO: 83405 - DNA, 32669 bp, Oryza sativa
ttccttgtctctttgcatgatgcagcttggacaagcattgagcacacgccctgatatattgccgaatgcatattgtaagagctctctaagctacaggtagtgctttgttgtgcattttataattttgcttaactgatgggaaacaagtagcatttaccttcaacatacttcatctaattgtttgcaccaactttctgtaagtattgagggatcagggcagagctaggtcccaaaattgaggcataaaaagtgctaaactaagtctaggttccaaaatagacagtactcaaagtctgtttatatgggatttccgcagttagtaatgctctactcaatggaattgaaggcaatcatgttgaagctttaagccgctgtcaaaatttgaattttaaaacttgattttgatgtttttctttgaagtttattttccagcactggcttttaaatcactaaggacacacataaaagttttacccacaaatattttttttgcggcttataatcagcattaggctaggtcaatcaatggcagccgtatggcttataagcacccttaagccgtacattccttttgctttatttatttctttttagaggtgtatgttgacaaatcacaactatctcatcaggaccagataccaccatttcctactcgtatcgcaatcaggactattgagtctcaactgggttctcgaatttctgatctatttgctgatatcagcccagagccagttgctgcagcatcgctggggcaagtatataaaggttagccatgcctgacaagacattttatctaatgagttggtggctatcttccttaagaccttaagcatctatttcagacctgagttctccaagttgaaatgcattctttgatatttcaagtcatgcagctcatctacactctggagagcttgtcgcagtcaaagttcagaggcctggaatgactcccttgctgactctagatgcacttttgttccatatgatcggaggacagttgaaacggtttgcaaaggctcgcaaagatttactggtagcagtcaatgagattgtgagcatttaacttctgtttcaattggatataatgatctattcatgctaatccgatactattagattataaccttatgtcctgcttacattttctatggttccatgttaatttaatatgtgttgttctaatgtgtgttctaatgaaagtgaaatactttcctaatactgtatttttctaggttttgttgatgcatgaaaatgtatttttgtggtcaaaataatgtcatagaaaccatgtcaatatctcaatccaaaatttaagttttgtattgtaggactaataatagatggtctcattaagacaactgtaatataatttgtttcagacaatttagttgcaactgccatatactatgtttttccattctagaccacgtttcccatattttggccgttaatatatattgcaatatagtttgcttatagcttttgacccttctgttcaacaggtcaggcacatgtttgatgagattattatgttttagagggaaggaatgctgaaagatttgcgagactttattctcatggtgagttcttaatttttattcaatttttgatttttgctacctgctagtgtgggttcctctaaatctatctgacaagcttgctctcctgtttcccatttatctcgaccatcatatccaaaccttttacattcacatttcctagtgctctttcagctcagattgatctctggctctctgctatttattatacaaagcacactgtagggccatcattgtgttttttttcctggcagatttaggtgggaatagctccggagatgggacaagtatcaaagtcccaaaggtctactggaattttacacgtaaatctatattaactctagaatggattgatgggatcaagctcactgatgctgagcgcattggcaaagccaatctgaacaggaaaaggatgatcgatgaggtatcgcagaaatgttatacttactgtatattgtgactaacacaatactatgaagaattcagatttatattaaatcactactttcctctctccacatattttcataacatgagcttgtctgaccatatacattgtacatagacttgcaaattgtgcttgcatttgtttgtaccgtgcaactgttttgttgggcttgtttctgcgtgtttttcagtgtattgtccaggtgtttttcaccattttagcacattttcgtacctcttctgtttttcatggaaggtgtttggtagtcttgcatgtatagtcgtgttcttatttaggcatgctaatatttcaaaacaaattttacagggtctctattgttcattgaggcagcttcttgaagaaggctttttccatgcagacccccatccaggtaatctggttgcaactgaaggtggatcactcgcgtattttgattttggtatgatgggggatattccaaggcactatcgtgtagggcttatacaaatggtaatcattgctcccttttctcatgtgtaaccatatggttctgttgggttttcttcctgatttggtttttgtcgggtgctaagaactgtttttgaccggttgcagtgcagtctggtgcatttctgcacagttttgcatcttcaaattttgaattgaaaattcgaaatgactggtaacaaacttcgaacgatttggttaccatcatattgtagagtggaaataggttatatcatggtacaaaataaatattaagaaatgattttcataatgcaaaccatatacaacctggcccatcttctgaacctggccctgttcgtatcttctaaaggtagaggataaagttttggatactcgtggcacgcttttcaaactgctaaatggtgcgtttcgtgcgaaaactttctatatgaaaattgctctaaaatatcagattaatcaatttttcatgtttgtaataattaaaactcaattaatcgcacgttattaccacctcgttttgtgtgaaacacttaatctttatcttcatcttcatcttcaggagattcaaacaccacctcaggctaccttgggtcacggttaaatcacaaataaattgaatagcatgtacagaaacaagtatatatatacataattgcttcctacatgtaccaaatttgaaatttaaattatgtttaaaactactcttctaatttatctcctggtcagaactccttatagtcaaagtttaccggcctgttcctcagagtaaaccaaatcctgtgtatgcacatcgttagattgaagcattttgcatagattatcgacttttcagtctatggttagtaaaattcaaaacattcaaacctacaaggtaatttgagttttgcagagctttaggctttatttgtaagttataagatccactaagtgcatcaaatttatcatagcaatttcagagtagagttgaactattagtaattcagaaattggtctaacacttatttgaagcttcaccaatatatagtttgctgaagatattagattttgtacttctcccagtttactttatatggattttaacttctgcgaaatatggactagcaagatatatactgtatctatcgatgtcagtataagttaaaaatggcggtaatactcttaagaaacaatataattgtacttctgcattcaaaacattttttttggatgtatgaatactagtctgaacatgtgttcgagtagtcatgcgcattactatacaagcagaaaggggcttctgccttttaaaaaatagcgcacttgatctgtgaatattttacattttatgttgacttcatttgtgttgatttcttgaattcacttgttccagcttgtgcactatgttaaccgtgactccttgggcttggcaaatgacttccattcacttgggtttgtccctgagggaacagacctacatggggttgctgatgcattacgtgtttcctttggtgatggaaggaggcaatcaaatgattttcaggtttgttaatattttttttgggtatatgtagtggactagcctttactggatttccatctgattcacctctgaaaatgcaatgcattttttcttaaatcatactactacttgggtctttatcacttgtctcgtactaaattctcattatgggtcatttcttttttcaattgtatatgcttgcagcttcatctgccacctttactttagtttaatgtgggtgagttggtgtccttgttaatcaatttttttttgccttatatagggggtgatgagccatctgtatgatgtcatgtatgagtttaatttctctcttcctccggattacgcactggtgataagagcactgggttctttagaagggactgcaaaagcattggatcctgacttcaaagttattgaaagtgcatacccatttgtcattgggaggctacttgaagaccccagccctgatatgaggaaaatattgaggcagctcttgatatgcgatgatggatccatcagatggaatcgactggagcggctggtaaggcgatccttaattatttctgttttgcttgctgtttcattttgtcttgtagaaagaattttgcaatacattcttcataaaaatatataaagattacatatctgtcatgtttatgatgaacaacaattaattttctttcctttagttagttccattaggatgattaagaacttgtgtcacccctatagtcctgtacacttggaatactatcactaggggtgctaaaggtccgaaatccagatcaaatccaccctgctccattcatctgtatgcatacttcccgatccactccaaatcgattcctcattcacagaatccaaagttccaaaccaaccctccccaaagtataaaagcaatccaaaccgatccaatccaaaggtaaaaaaatgggtggaacccattcggagaccattcccaaaccaaaagaaatccaaaaggggggcatcgctgcggacgctgatgaggcaacgagaagatcgttgtccccctccatgctccggcgcggccggcttctagaacacaccactggcggacggaaattcggtatcatctatgctggcagcaactttaacttgtggagtcttgagtcaatggtgatggacagattaaaatttagtctttgcagatcgattagtgaaatgaaaaccaatgcaggagtgagatgtatgcatgtgtgcccaggagatgatcacctggctgcaaccatggaggaagtgagtgcggcggcggactgctgctgcttgtacttgttgctgacgaagatctctgacggatgcaccaccgccttgctccctaagctcgtagcctcaaggtcctcgaactacctcatggtcgcaaggtgctcaaagttgatgcacatggtgtccaagcccagatcggcagcggcgggcatgtctcgggcatcaatgtgctcatgaggaagatcagtgtgtccatctggccagcatagaggatttggggacgatccagtgaaaatccatgggttgaacccattttggacccaaaagtatacagccaaaatccagatcgatccaatccactttcagcgaagtccaaaccgccccagccctacagcttcgtcagatcatttctacccaaccaaatacaatccaaaatgaaaaccaaaccattataccgattcccacccaacccattagtaggcctaacgataacatgcaaggtccaaagttatggacacactgaaatgcttatgatttacaacaattaatttatttccttgatttcattggagtgattaagaatctgtcatacccctcttgttacttgtgcacttggaataactatcaaacacttatatatgcatgaacgtattacataagcataattttctagtgctgaccatcattcatgtgggaccagtattgtaactgcgaacatggcactaagagatagaacttatcatgataattttgtttttgcatcaatatcatgcaattatttggcaaatatccgtcatgtcttgctgtaatggtcactaaaaatccttgaaatgttcagattgcagctatatccgaacagtcagaatcttcaaataagtctgaagatagatctggtgaaaatgctgccaacaaacctgggtggagatcattcgacatgcattctgtggttgcagctacagaagacctttttcatttcattttatcaaggaaaggctggagggttcgtgtttttcttgttcaggacattgtaaaagcttcagatgcattcctacaagaagcaacatttccaggtatattcgatgaagaggggactacaggggagctacatccagaggttaggacatcttatttcttagattgaaaatgtattcatttcagttttgcatgtagatagactaatttaaccaatttaccactggtgcttaaccacttcacatatttttggacatacgcagcttatatttcttttctgctacatgtttagagtcataaacaaccctcattgctctatttcacaatctttttttggttgactgctgtttgtaaccttgcactatttgtggtgaactactgcatgtatttgtcaattgccttgggatgtgttgtttcaccgtgttgtgcttaacctcatttgcttgtatcagaaagttgccctcatcacatacttgttcactgctgcataagcattatagctttcgatttttggatcgatttattattttcacccctaagaatgttcattcatttttatgagaaaagatatgattctctaagctacatctgtactgtaaacgtgtggatcatcgcacatgctaatacttcgtagtgcctaagcgagtatatatactaaatgtttcttttggaatgcagagaagtaaaatgataagaagggtggtacatggtgttcaatcattccgtcaagctatcagtttggccccagatgcctggactgctatgctattccgtaccttgttgaaacctgaatcccagaaatttattcttgatgtctttctagccttggcaatgcattcctgttacaagattccagaaacaagctggatttgtatgtcgagattcctgaattacttggacaggcagggtaggtaacacagataatggaaatgcagtctaattatcttttgatctgaatttactcttcagaggccaatatgctcatttttgtgagagctgctaccgatcttctaatgccactgcccactagtttcatttctgttcgtaagtattgttgagggtgttgaaaaagctaccgtatgctttgtgtagttttgatgattcattctgttctacacttgtactattttgccccattattacctatggtcccttctgcatccattgccttgccttcattcactcatcagcctgtagagatctccattgaacttggacactgaagcgaccaagccgacgccttcctttcgtagttgtcgagcaccttgatgatatcgccggacagctaccatcgcctgtgccgtcggccctgccttgctcctgtcgacgagcgagggaaatgaggcgaggatcctcttcccagtggtatagccggcggtcaggtccggcaaggcggcaacagcgagctcttcttcatccagtcccattttggcctattagaaaggcaagtaacaagtcatcttagtttcattttgtgctagcatagaagagtaacctgctggcaatccaaaatgtccatctggtgcaaggccaatgtcgtcaggagtcaggacagccggggaggttgtcaaccaaaatctccgacttctcgtcctcgtctgccttcagccgcagcttcatgcatcgaaaaccattgattccgcagaagtaatcacagatctgccacacgacaaatctcacaagagcgatatgggcgaacctagaacaaaacttgctagggatcctattatatacttcctccgttacaattcccaaattgtatagcttatattttttttagagcaaattgcattggtggtacacaaacttgttaggtgggtgcaatttagtacataaacttgaaatatgctcgtttcagtacacgaatttgtctggttcatgcgaatgaggaccaaaataacttgacaatgttaattatgttgattaggatgtgacgtgcatatgtgtgatgagtatgcataggacattcaatatttataaatttgctctctactttatttttcaccatggaaatgatgaatttcatatatttctaaccttcataccattgctcgttttctaatctttttctactatcactgtatcctattctattttttattgaagagatgtatgtctaatagcaaccttctcagatatatgccctaaatcaataagattagcaatgtagtgtcctttttgccttcctccgcacacaccagataagtttatgcatcaaaacgagcattttacaagttcgtgcattagattgcactcacctgataagtttgtgtaccggcgatgcaatttactcctttttttacacgatctgacatactttgatcattaatgtaattcatgttatgttcccaacgaatataaaattagcatcacgtgaaaatactttaaaatatgaatatagtgatataacatgtataatatttaacatagatatagttaatatgattattagctaaaaatatttttcttaaaaaatagacatcctactgattatctatttatggaccgatatgctaattaatacaacataaattaaaattagttagaattagataatcaacctgtggtcttgtgaccctgggagcgagagcacgagactttttgttgttctcatgccgtgccatgatgccatagcgtgtctcagtcgcagaggagcatggatgccgccgtcagtggatgggaagatccccggcaggggtggagctaagtattgaggacggtggtcaaaaacccggtcaagaaaatttatagctatatttgatctattttcataatatatataccctttcaatataaatttagatacccacatataaaacagagtaaattaaacaggtgacaccctctccatatcattctagctccgctcctgatcctcggcaggccgttgccgccgatgaagcgccaccgttcccacgaccctttggggtgcatccctttgtcccttgtcgccgccacggccatgtgcacgtcgtccggccaggcgaccagcccttccccgagcttctccagcctctgcatccaaccagctgaaaaacgatgcaaaattcgaacgaacatgacaccgcgagccggcgaggcgacgctctaatgtgggtgtgcgtgtgacaaaagagaaacagaagtgtcgacttcaagcgagtagaactgtacaagtgatactaatctgaattaaaacgaggaataatttatttctacggaattaatcggcttgcctaataaagttatagtaagacattttgtttctttttttttttggtcaaagatgaagattattcaattcaattcgtctggtacttgtaactccctctattcaaaatgtttgacttattacttgtggcaccaaaaccaaagagaaattaattcattctgcacataatgaataccactgagtatatgcatgcatataacccaagagtattaaaatgactgtttggattctgatcaatcatttaaatttatggacgtgactagagagctaccggtttgtcaagtgatcactccatccagtataaatccccattcaacataaaaaatacaatagtgtgtgtctttttttaacctcttcaataacttatatcttttaaatcacatattcttgttttggcaaaatttgctacaggacgtcagaaaaacatgtaattagctaggggatatcccggcaggattattttattatttttagaggaatatgagagagaaacaatcattaaagaccaggttgcccttggctcaaattagttagtcttcactaatcacgggcttaaacacatcttacattctcatcgccaagcaaagagcaagagaggagaagagacgatggtggatgtgaagcacatggccgaccacgccggcgcacggagagtcaagctgttccgggtgccatggcggccagccagggtggcggaggaggttggggcgccgctggtaccagctagcgagaggaagaacatgaacatgaagcaaaagcacatatatttacatacaatgaatcaaaagcacagatatagccaaatccaaccgatattcatatccaacatcaagtttgtcgaacaccttgtgacaactgacaacacacacaagcaagtctttcctggtagcagcagtcaaaagagaggtgggggtggatgtcaggcttggatgctggacgagcaagctacgtcgatggtggtctcctagggcagcagaagcagagccgcgccgtttcctccgagggcagcagcagccgccgctgccaacgccactccctcgagtgcagtcgccgctgctaccttcgcgctgccgttaccacgcgcgctccctccctcagtgcccatcccgtcgccgctccctccctccgcaagtttctgctgcgtcgtcgcgccgccgtgtgaccgtgcgaggctcggcggcggcgccggcgggcgaagccggctgttcggtgcattccggtggctgcgggtgcggtggttggcggcgctgtaccgcaggaggagaggcggcgggcgagcgcagcgagcggagcggcgacggcgggtgagcgccacaacgttgggcgaagtggcgcctgcggcggttgagagcagagaggaagagaaagaatgagagagggagagaaggataaggaagaaaaaagaaaaagaaaaaaaaaatcaaagggtagaaccgtatttacacaactatttctctctccaattcttccggatataataaaataattccacgggtatccagcagctaattaccaattttttgcggtgtcctacagcagaaacacgtttttgcagtgtctcctagataattacacattttttggttgtcctgtagcaaattttaccttgtttttaagatctatttgcatcattgtaccccactgaaaatatatgacaaaacgagatccatattaaatatattcaaacattttattaatttaaaagtaatctattactccatcaatgttaggaagttatcgggaagtaacttttacatcttatacatgattaattctcattagttactccatcaatgttatttacaatccatcaaagattttatcttcttttctcatactacatgaaaaacaaaaacaaaagtgaaaggaaaaaaaaactatcaatgcttaaaacagatttatagaaagttacttctgaaccatgcaaaagttacttccaattaacattgaagttacttttaaaaattgttaaacttacatgtgttgattaaatttaatttctagatagagtcatatttttatccctacaacgaatttacttctaatgtcgtgacaaagttactttctttttattttaagttacttttataatatatgtaaattacttttagactttattgaatttacttttatatgtctaagaagtaatttaatgaaatctaaaagtaatttaaatatatttaaaagtaatttatagtttttcatcaaaatataatataatcatgtgagatcttgttataaagatttaattgttacgatcacaacgatgtaaccggatcgtagatcggatgagtagtttaattgaattttatttgaagcatatgtggttcctatttgcttgatggactagtattatattttcagtagagtaatggcttcagtggtgtctaactgtaagactaaaccaagaggcttctcagtttagattttgcgttctaaaatccctaactacgaaatgacgctgtccaatggcgacaaagccattatagcaaaacatatgatattttgtgctgcgcgtgtgcccttccaatttatgcttcatattagggctgccaaaaaagctcgaggctcgcgagctactcgaacttggctcgttccagactcgatttgagctcagctcgtatagactcgagcccgaactcgagcttgtttctaagctcgcgagctctgtcgaacgagctcgagctattcgtcgaccctatcaattcttaggaagctgcccacatgtgcctttatctttccttgcccatttcaaatctgccagtacttagctttacttgcttttggaactagtactagtatgcggtcgttcgcggtggaaggctaaagctagtgaagcaaatgtcaacagctaatggccctgtttggatccaagggttagagttagtttgagctagttggggctcaaatagccctaaaggatccaaacatgaggggttagattggggctagttgcatctaacccaccaaaaaaactagcccctccaagaggtgcttattggagctagtttgagtggggcctaccatagaagccacttttctctctctcgctgcccgcaccggatccccatctcgcacgggatcctctcgctggacgccgccgcctccctgatccacaccgccaccaccactaatccgcgcctccgtccccgatccgcgtggcgcggcctcccccattacccgcaccgcggcctccgtccaattgcgccgccggccaacctcagtgccgccgccagccccgagccgcgccgccttcgtccaaccgcgccgccgcctccactattccgcgctgccggccaatctcagcgccaccgccacaccccgagccgcgctgcctccgaccatccgcgtcgccgcctccaccaatctgtgctgccgaccacgcatggacagagatggcttcgacaacctcagcgcgtgggcttcgcagccgtcggcgagcggccctaccactgcttcctctgtcggcgccggcttcgacctcaactcgcaagcgccggcggcggaggggttcccggggcttgggatgtacggagccttcctccagggcgacgacgacgagctcctcactggccgcggtaggggctccagcctccctccctatcgcccaccgcgtgccggagtcggagacggaagggcgactccaaatctgactcggcaactgaactttggcaactcctcctcggcaggagctggtcgcggaggaggaaatggtggagctttcccagcgggttgtcttcggggagaggcgtttgcagcactcgagttcggccgccacggcacttggccgccggagccagcacagcaacacggcggtacgtgccggtggcaggggccagcgcctaccgcgtccccgggcaccgaggagtgccgtccgtgggcaagcatccagctccgacgctcccttcaccaatgaagatgaagaattggaggatgacgtggaggagtttgcgagctccggcggacccccggtgagccaagctagtcgagcctaatggaatgaagttaataatgcttgcttgttagaattgtgcattgagcagcgtagagtaggaacgtataatggtgcacaaatgagtggtgaaggataccaagccatcgtcgacggcttacttgatagaagggggtatagaagggggttggtgtatacccgttgccaggtgaagaaccaaatactcgtactgaaaaccacccactctttctggcgatacttgcaagcgcacacagggttggggaggttaccagatggaaccattgatgctgagtctttgttctggaaaacacatacagaggtataagcagccaatctgtgtattctatttttcagtttcctagttacaaattgtttcaaattgtgtacagtgcttgcccaatttcagtgttgctagctccagtgggcgaaaaattgtccaatgaactgatctctcataggactgacttactgttgtagttactaactttctgctattaagtaggcaaaaatttgacgaggaaccttattataaaaacatttgcttagtaaacacaacacgaattgtgatagttatttgtgtgatagtacagtgcgctgtataaactatactcttcctttatgatagtacagtactctgtaatttaggttatatgagcatgtaattcagttatctgtgcactagtatagtacatatgtgctcatccattttatttatcgctgcagaagaaaccataactaaagaggctgcaatggggtcctccagaaaacgaggagttgcttgatcaactattcagagggtacactgtggatggaagcacaacccttgtgcctggagatgattatggtcaggaccaggggcaagaggaagaggaagaggacgaggagtttcaaccaacacctagtagtacaagcagccagaggagcaagagccaaaagggcaagaggccattaagtagcactacaagcactttgtccagtccaatgaagaagagcaagagcccaatggtgaagattgtgaaagacatagccagtaccttcaaagaagctgtcatagtcaacactaagcaaatgcagaaacgtgcaagtgacaaggctgcattttcagtcaagaggtgtcaggagctggcatttgagtgtggcgtagagcaaaccattgaatctgtctatgctatgtccaagatgttcgaaacagagtatcaaagagagttcttctgtggccaattaactcctgagcttaggttgggttacttcaagaaatggtgcagggacaacaatttggagtagttgatgtcttgctttcatatgtctgttgaactatttatttgtgtgttgaacctatcatctgtgtgtcagttgttgaactatttatctgtgtgttgagactattatctgtgtattgaaactattatcggtgtgtgttgaacctattatctgtatattattttcgagtgttgacaattttttacatgtgttgaagcaggaagaagatcatggccctatggttgaggaagcaaaagatgatggaggcagcacaagtgaggatgagattatatcgatgtgccgcaacaatctggtgcatgcagagaattcgatcgtgcaattggttcctatcttgggtatgtactctgataactattttgtgaaactacctaagagggtcaatggagattttggtatggattgggtcatggatacactagcccgagatacccaatgctacaacatgtttagggtagagagacctttatttaacaggctacataatactttggtccagtcatatgggttgaagtccactacaaaaatgacatctatagaggctcttgctatgtttttatggattgttggttcaccacagtcagttagacaggctgagaaccgtttaaggaggtctttggagacaataagcaggacatttaatagagttttgacatgcctccttaggttagctcatgacataattgtacccaaggacccaactttttcagaggtgcacccaaacttggaaaatccagcattttggccacacttcaacgactgcataggagctatagatgggacacatgtgaatgttgtggtgcctaagagtaagagggttccgtacttgaacaggcataatgaaaccagtcagaatgtgcttgttgtttgtgatttcgacatgagatttacctttgtattgttgggatggcctggttcggcacatgacatgagagttttcaaaggtttgctacttgaactatcttgcaacaatctttaattgcacttgttcatctaagtctcattgtgtgcctcactttcacaatatgttgggaagtattatgtggttgatgcggggtacccaaaccggccgggctacctttcaccatacacacgtacaaggtaccatgtcgcgcaatggaacgatggaccgccgccacaaggtatgaaagaaaccttcaaccatgcacatgccaaagttaggaatgtcatagagcgatcttttggagtgttgaagatgaaatttaggatcttgttgaacatgccaagttttccagaagcaaagcaaactagaattattgttgcttgtatggctcttcataatttcattcgagagagcagaattgcggatagggaatttgatgcctgtgatgaggataaaaattataacccaatgctcaagctttattttatggagtgtaattttttcttgtctagcttaatttgtatggactaaactacctatcgtgtatgttgagtgtgatatctcatttgtacagacaaataaaatttatcgtgtttcggatgcttggtttgaaatatgatttgtttgtgtcatttgtgagagggaggaggccacacatgagtctgccacatcaaatccggttggaaaggagccaaatgattggaaaagtatatttattgtcaatctagccctttcatccaaacacctctagggctagagttagttcagggttagttgagagctagaaactaactctaacctcaaactctaacccttggatccaaacagggccaataaatgagtagtacctgctctacttttctcaaacccaagtccccataaaagctattcctactactagtatgcatgtagcatgtgtgctgtaacagagcagtatgcatgccggctgttgattttttaaacttcttttgacaagctcgacaagaggctcgaagctcagaacgagctgagcccgagctcaactctaaactcgaaggctaaggaggctcggctcgagtctgtaccgaactcgagcctagagaggccagctcgcttgagctcggctcgttgacagccctacttcatattgagctagtcatcaaaaagttcagtcctaaaaatatcgaacattttttttttggctattcatccagaagttcagtcctatgattctacgaggaactttaaacactgagctagtgaaattactaagctaagtcacagatttgacaatttcaggcttttggtctaacaatcaggggcatccaagaattctattagatgtaccagaagtttttcatgttggcaaataaaagcagaaaactaaagcaggtatcacaaggtaagggccggaagcagataaccaaacaaataataaaaactcgaatttatcaatcttttgatatgcgaacaagtaaaccagtgggtgtttgaactgtttttatgtgcccagatccaattaagtcgcgaatgtgaaagcgcacatcaagaggtgaaaaccgtaatcttgtcttctccagtgaagagagtagcatctccttgtacttcttgcggttcaataatgaaagaatttccttccttccctgctctccatgagaaactcaaatagtcaaaatttctaattatttttattactacaagcaactttgacaattctgttgaggtcctatatagaacacaggaatttctcaagagttcagttaccacagtttgggaaagatatccgtgtttgcaaacagagatttagaaataaataaaaattatgaacatttatttattgacatctagaaacacacaaaaaagagctggactgcatactgaagggatccatcgacttcaacttgtgtagttatgaataaagtatttgaattaactttggatcataatcatgtgtatcaaagctacgttgaatgcaaatgcgcctgtatattacttggtagatgtaacaaaggtcaatattgcccaatggaattgcaaataacgtgatgccttagtaggtatatattacaaaggtcaatgcctgatcctgatattcgatatgcaaaacccaggatgtcgaaaatggctcaagcctaaccccatttttccataggacagaaaacagaaacatatggaacaacttgtgtgtatttttccttgcttagtgcaaaaggtttaacaattaatatgatcagcatatatgatacatggtcctataaattggtctgcaccaagctaatctagaaagatgtaattaagtgctacctcaccgatacacatgcatgaatgaatgcatgccacaagctacgctagcaagcattaagatcaacaaacaccattgaacaaagaaaaagaaaacacaaacctgggttaggcctttcaagacgggaccaatacttggtatagaaaaccagtacatgtttggatcaattaattggcgagtctgaaaatagatagtataaacagtaagcatgcttgatcaagaaaattaattatgtttaaatttatgtgtagttaatatttgactaacaaacatgaaaataattatcctagtgaagacatcacatgtattcttctcatgtatagagttttcaatatcatttccttattgtcgtttctattctgacataacatcatcaatgacaatacttactaagagaccagcattcatcagtaatgtgatatgtttgtcagttacatcacctccaagtgataacagagaaaactgcaacacaaaaccaaagatgttagatatctttaacagatttttagtgtaagatatcttttgatgtgaaaagtgttaatcgtgttcctttacttgagaaacatgtcatgggctttgggccgggagtcctaggcccaatgggaacgatatcccaacctcacaataagtacgtatctcagttggatagagtcggggtctgttaggattaggttaaggagtcctccatctatataaggagggatcctatctcaggtcagtgaggcattagattaagatttatcttagtgcccatcggccctgccttctcggttcgacggagagcatcgcgccgtttaggtccagggccattctctgttctttcctctattataatccaatttatttcctttcaccctgtttcatcccaaataatcctagcacatgacaaaacaataggctaagtcaaaatgtcaggtcaagaatagaaaaaaaaatccaaatattctgtggcagattatagcgaagttctatatatattaaaacttggatttaggtttgacactataaacagtaatgttgatggccagaaagaaacaaaaaggttaacacaaaaattgtctatatgaagtaactagcaattctccttgtgtgatggcagaaattaccagatcgcgctgatcaatgctaacttcaagcttcaaatgaataacatatctctcaaaccacccaaaaacttcagtaccatcttggtccttaccccttgacctcttgactgccaacgccatctgcatatgtttagtgtacagagaaacaaattaaccaaaaaattaagtaaaaatgtatgaagttaatgtgataaattatgtatgaagttaatgtggtaaattatctgtttcctcctggatagttagaattgaacagataaaactgaaattttattatgagtgaataaagctataacatattaacaagcaattttcttaacaaatgatgcaactaaaaatctaagctaaattcccaaggacatggccacaacaccaagtaaaatttttcaagattcagaagcgtacagaaattttgtgtgtaactactgttcgatatcagttctacttatactgtattgcaacagccatcactgtttatgtgtgcagttgctcaccagaatatcgttagtttgtcttagatataaagattcttagtgtttatgcaggagttgaaattttctacaagggagacaaaatgggatgacattaacctactctagaagtgcactcttgaatgtgaaagtttggcacacaggcacaatatcttggttggctaaaaaacacgttcctgagtaccgttttaccatagcaaatggtgggatgatgccatgtaacaccatgatgtcgatttcgatgcatggtgtttcaccaaactagattggtgttagtgtgcgctagtaacaaatccgtgcattgcaacaggccaataacactgggaatgtgccggcctttttgttttttttatctctagcgtgtgctctgtgcgtgcactgggaggagggacggaaggaggactactccgcctttacagtaatagcagcaggtggtgagcataaaacagaatgttagatacatgtttaatgccaaaccagtactaagagatacctgtttcagataatcatccatgaacatgattgcatgatcatcctgcccagtattgagtttgaatacacgcaatactttgtctttcttcaaggactacagccaaaaaaaggtttaaattctcaatgaacctcttgtgcagtatgaggatgactgatcatctattatttatgctgaatttaagatgaaagacattcaaaatttcaaataagaactgctagaaaacaatagaaaggcaagacagattccactgcatctacaataggcatgctagaatgctacactaaaggtatgataacattaattcaagacaaacctcaaggtctctatcaacttgtgtcctgtccttcacactactatacaactgtgactgcaaaatgaatggttctgtcacaacctgcaagtgaatataaaacaggatgtaatgtttacacacaaatggcaatcaatgactcttaagaaaaaaatgttagtccagagagagataaaagctcaatataaagcccaattggacactgattatcctagcaatacaaagctagagagagatattaataataaaaattgaaagaaaatgcaaaaatctgtaatctctgactgtcttagttatttgtagtaacaaagagtataacaacccaactttcattttggttccattaaatcttgtatatagctcataacaacttttgtttcttttgcgcctgatatctcttgggaaggtgcttttttacacctgacctacagcatattggcacaactgagggatctagagtctcaactctcaagtgactcacttgagccaacttaacttggttgtttctcaaatctatcattcatatatgtgcattgagaggtataaataaactgtgtttagttgcttaccagtacctcaattagatatcaagttcagaacatatgaaacaagagatgatattcacttggtgaaaaatgacaaatcatacagcagttatgtggatactggatgcaattcgggtgaattacagaaaacaactatctaggcaatcaaaacatattgaaccaaatagtttaaactggacagattaatcaagttttgacaagaactgaatatgaaatttaaccttcaaagtgcgtgcaaaccttctctagctttgggaattgtgtgcgcatcagttgaagagcaatcatggtatcactgaacgtaagggtgtcctctgcatcatcaaacagataataaatctttatggtaactgaaatataaagcaataatcatcaccgaacataaaacaattcaattgttcgattaaatttggacgaggagagtaacgaaccaaggctgcttgtgtatatttgggttgtgtgcactggacgctcatcgctgtgaccaggagagcgtggtcgcttctttttcccaccagaggaagatggatatgatgatgatgatgatgatgatggttcgtccatctcgctttattgattattcatgggcggatccaacttgggaacttttcggggaacaaacaaactgttactaaggttaaggctctctctgaaattaagagaagagcttcttccagatctggaagagaagctagggttaacgaacgaacgaacgcaagcaaaattaaagtagtcccggtgggggagagagagatgaatcagaaagaggatgtggatgctcaccaggatcacctcctctcccctcgccagatgagatggagatcagcgcccctcccctccccttccctcccctgttcagcagcgagatgagcggagcagacgagacggcagattttctttcttttacgctaccaacgtattaacacacgagggttagcaaatactccctccgtttcacaatgtaagtcattctagtgtttcccacattcatactaatgttaataaatctagacatatatatgaatctagacatatatctatctagattcattaacatcaatatgaatgtgggaaatgatagaatgacttacattgtgaaacggagaaagtatttagcctgtgtctttccagggccgggaaccccaacccttcacacggaaaacggagcgatatattatcatatgattaattaagtattaactataaaaagcttaaaaatagattaatatgattttttatagcaactttcctatataaactttttacaaaacgtgtatctttagtagtttgaaaagcgtatacgcggaaaattggtagttaccatgattgcctctaccatactcggtgagtatccttaggcggtcgccgcccgattttctgcatgccttcctccaacaggaccaggacgtcgaccaccaccagtccctgttgcgtggagtcagaagaaaataaaaaccagagttcgatttgccgccggtgtgttcccttggatttccgtgctctgcctctgagccggagccagaggcgaaccacaccacattctcctgcgaactggagaaccggatgggggacaccatcgggttccaatgtgatggagattatctctacttcttggtgggtagtggccagatagagcatccgtcgcctctacaacgaccaagacctgggccacgtaacaaggtgagataggttgggaacccacaggaacgaacaccgcctaaatgtcctgagttacatggatgaaactgttagtaaacagaaaagaatacatatttttttttcagaaacaaaaatgaatatgataatgctactatctgtcggaaacgaagtaggaaacttttcggaaacacattcagtttttttcttctcaaaattggaaacgaagtatttctcatatgcagctgtttagctttagacttttcaactctaaataattagatttatactatgtgccatagtacttataactgcagttatggatgaatataatttatttttccaagaaaataaagtgtacaactagttgtattattattaattgataaaaaatagaaatattgatttattgttttagaaaagatattgaactatatctcttcattgatttgagaagctcatctgcattgatttgagaagttcagcttaagtttttatagtccgataaatacccgttaccatatttgctccattttcgtattcgataatattcgattctgttttcgtatccgttgtttccggttctgatttcaaaagaaataaggaaacggaaatgataaaagtggttttcatccgttttcgaaccgtttcgtccctactcgagtactccacctttatctcaatttttttattatttttaaactagctatttctttacgatgactgcggcccacacatcagcaatacttagagaaaaaaatgcaacaaactcggttgagaattttgtcgacagcaaactcctcagacctccggtaaccactagttgccgctccacgcaccgccaccaccgctctttctccatgagccaccatctttcctcacatcctcctctccgcctttgcatgtgcagccgcatcctctagtcaccgacatgtcttttctcctcccctgttttcatgcacgctatttttatggtcgccgttgaggtcggaggtgttgggcttgcaaggacccgggaaggtaggagctgacccgatgaagagcatagacgctagatccggtctcctccttgctagatctgacgatttcccaactgtcgaaggggaaaaaaaaggagagagagttagtatgcgatatggttacagagtaaccggacttggagatggatagaatgcggtggtctaaattgaaatgtaaagttagattttgtgtaaatgagaagaattattaaaggatgatataatttgaaaacttttaagaatacatagtacaaaatgtaatttacttttttctacagcacaattaatgataagttgtccattacccaatagtctcgtgatatgccaatcccatttatcgtctctgcacagtatggttgggtcggtgtacttagctattactaataatctcatgatatattgatacaggacgatacaaaattctactaacacggattgcttaattatggttagatagatctggctaaaaaaagataaaaataataccatcaattttgctcaataataaagcattcgatcatggtctccttttctcactgcatgatatatgatgatcagtatgtatataactatattgctattttcctaattctttcatttttttttattttttaaatatatgttaatttggactaattttttttctcataattaagtaataaatttgtttttccatatttctcctataaaatgcgaatagtgcattgtataatttgaaatttgtattataagcgtatgtaatttgatgtgtaagatatggatttatagtataagatttgatttttttttaaaaaaaatgttgcaccatagtagataagtagttaagtgaacaaccgtaaaagagagaatccattgtgccactgattttgtccctattttataacatgtcactggatttgtcaagttctaatatgccatcgcattttgcttaacttctataatataccatctccgtccagttagcctccgtctacaaatttgtcctagtgaccaaaatacccctggacgaaaacttctaaattttggtcaaaaattccgaaatatcatattgtaaaacttctaaaatttgagatgggcaactttgagcgctgctacagcctttgcatgggatggggataatcgaaggcgaagcgacgacggaagctgtcgctccggtggcggcgcggggccgatgcgagtagatgagttttcagggctctcggctggtttattggagatatttacctgattgccactattagatttgacagttaactatatgaacccacatgtaatagaaaatgagaaaccatgaaatcatatgttacatatgagtagcaaatagttaaatgtccaagtttattgagagtctggtttacaataaataataaacgaacagagagaaagagagtggagaaagaacaaatttcaaaaataaattcaagaaaaaagttttttttgtggctatatagttgcagccctaggggtgaaaatggtcggaatcggtagcatctcttcggaaacgacgctcgatcgatcgataattatcatttaaactactcagtgtcgatattaatacgatacagaaagaaatagaaaaacaaaatttatacattgccaatcccttatacgaaaatgacgctcgcttggtcaggaattttcatgaccattttcaccccttgaacaaagaacctaattttatttggaaagaagaattttacagttcgcagttgatattttattcttttttcttcaaaaaatttgaccaatactatttattcaattacttagttaagtaaaataaaagaaatcactagatctgtcataaaaaaatcttttaagtatgtctacgatgattttctatgatagtcaaacaaactattaaaaaatcaaccatgtcatatctctactattataaaaattgaagatgtttttgctggtattttggtacgtcatctgtgtatgagtcagtttttaaattcgtttgtttttagaaataaatattcgtatttgagtcggtttttaagatcgttcacttttggtaatacataaggaatcatataagaaatctgttaaaaaaactcgcatgctaacttgagacgatcggactcctaactctagcttatgattttctaaaaaatatatatctaagcgaactcccacagtgaatttcatattaactaaaccatataacaataataagattaaaataaacttcaaaaaactcgcatgctaacttgagacgatcggactcctcactccagcttatgattttctagaaaaacatatatctaagcgaactcccacagtgaatttcacattaactaaaccatataacaataataagattaaaataaacttcacccgttgccatgcacgggcattttatctagtacttcaaaaaaagagagatgataggtttcaaagaaaaccttgatctagactaacatgatatctactcctctattccaaaataataaaatattctttgctatctctggctacgaatttggataagcatataaggatccaaagttttctttcacaaactaagcagcacgcctctacttcctccaacatgattctctgctgaacagattatttgtggatggattatggttaaaaaaaatatccaagcttggaatgctagtttgctacagaacaattcttttattctcagtaataattatcaggccgtgcggttagtcagttaccaccgttggtaaaaaatagatgaaggaaagttactacctttggtacaaaatagatggatacatgcatgccgtatgagggagaatttactagtatttgccactctaccaaaatactactagtgctcaaataccactctcctaaattttcattcccaaatagtaacttctcccgggaagtttacatctatggacggaatacataacatcgcgtagtcttacattggtgacacgcccacagtacagcaatcctttataaagaaaaaaaaaacaaactagtaattcgaagccatctgcacaagatgttacaagctttagctccgaggggaaaattgtgagacgaccaacatcatcagcgataccttcttcataaaaagtaagcattcggtgagatgatcagatgaaaaaaatgagtggttctcaaggcacttgttgacgtaaggtaaacaggaacagcatcttaggctctcttcttccgagcagaaggtccgagtgatgaaccagcagtaccacgcggagcagacgagcaaagtccacgcaaaattgcgatgacagcgaaaacggcaaaaggaacatacatctgaagcaattttagtgtcgctttcttcgagcccacaatctctccaagtattgctgactgaaatgattataaacaaacattatgaaacatgtcaaaacaatgatctagtacaagtagatgacattacatcattcattacgagctagaaaaatatctgatgcttcccactaggatgcactcacatgcacccaattcaaaataggacataaatagtaatgaaaaaaaaacccataataaagaataaaaaataaaaaataaaatttacagaacaaagaaccatgttaaaaagaatcaaatataaattatataattcattctacatgtggagaaattttttagataatgaaagctgaaaattagaagaatgcctattcattaaaatatctttttgtttcttccaaaacagaattgattttctaataattttttataggatatgcttgattactgcatgacctatgtaaccaatattgtcctgttttttgtatccatttgcagtttgcattgaagaagaggcatcaatgagcattcagggcactcagactgaattctggaatgacattgactgaggttacttagcatgcatggcgattgaacgttcatgtaacaaatgtcttctggcgtttctacagtttgctccttaacgataaacaaggatatagaagctcggtgggctaaaaaatgtaaagtgaattgattgtacataaatgttcgggcaagcattaactgttctgttcctaatcttctttccttctgcactgtgaatctatgaccagttatgtaaacttgaaactaagacaaatttgtaataagaagtcacaaattgtatgtatatttgaaagggaaaaactgaccaaagaaaatgtgttggcctgttgggtatttaatcaaacagactgtaaatcctcaactatgagtgcagaaagtgaaattgacatgtaaagtgaacacaccatggaagccagtaaataaaacaattaattaacgcaacagaaaaaagtaattatgtttcagataatacatccatagtacatgaaatatattgagtggatagttgggatggtaataaactggcttaacacaaagtggatctgggcagagctgctaggtggatggtgataagtgctgggctacatgcttctctattttataggccagactctccggtatcttgggatgggataaaaacaagagagaactttgtgttctgcttaagctaccatgccatggcatgcttctagatagattgcgtgccccacattggcatggtaagttcttttatcatcagaatttttttaaaaagaaaaactcaaacaccttttatatgttttcttacattagagatgcgctaaatctaatcaaaatattaccttacaagcaaaaggaacatttaaattataaaaacaatgacaaatcgtctgttttccagcgttatcaaaatatatgtaacaatgcaataaatgaacgttgtagttctcttaattatttcttccaacattatggctcatcactgtagggattcagcaagtgccgactgcagttaagattttatgatggggatttggatattgctttgtcaaaagtcaaaactatgcccaataacaaggtgtcatgactactatattagaaccatgcccaactcccaaaagaacaaacaaagaaattgtatccttggatggaaagattaaggctcaaatcagtcgagcttttaatcatttccactctgaatgactcaatgcttcagagcagggcattaataaaacagaagaatatctacattcttgtttggagcgcactatgagcatttacaaacacaaacaatagtaccaactaaaatgggatcaaaaagcaattcgcgcggcattgagttggacttaagaaatttcattggtccacccagatcaacaaacaatatagagcaatttcatcgaaccctctaaacaagtgagcttaggcaatccatgaggacgacaattactttgttctaaaataaaattatcaatctgagattaggtctgtgtgttcccataaaaatgaaaaataaaatcaaccctctgcgcgttgcagatccgatgcagaagcaacccatttactcccaaccaacatgaactcgaacgctgaagcagagagacagcgggggagggagcgaaggggggcgtgagttaccatggaggtgagggtggagacgccggcgatgagggaggtggtggcggcccagcggcggcgggcgaggatgccgtagagggtggcgagggcgagcggccagaggaaggcgagctcgagccagacgagcccccggaggaagcccggggggcgggccacgaggtagtcgccgaactcgcgggcgtaccaccgcttgagggagacgagcggcgccgggaaaaggtggcgcgggagcacggactgcgcgtcgatcagcggcgccgccaccgccaccgtgagcgagaagagcaccaccgccgcgtccgccgccgccgagaccacccccattgccgcgacgcccggtggagcagagcagagagagagatagagagatctcgacgaggagaaatggtcgacgcgtccgtcaaaggaggaggtactaacttacagatgtccaaaattcgagcaaatttaataagggaaaggattaattggatcatcccattataaatttaatttgatggtttttataattcacccatttgaaatcatcatgccattataatttgataggtatttaaaatcatcatgccattataatttgataggtatttgaaacgtgtcactacttaccactttaatacgctgaaattattttttggactagattaccctttttttcttcctctactaattgggtgtcctacaacgagagaaaaaaatatatttatgaattcaaaaacactaaggaaaatgattttaaataggcatcgagtgtttgtttgttgtatcgaaaaccttaatacacaataattacatcacatctttatagtgctccttattaaataacaagaacaaacaaaataattgaatagaacatcatagtaaaaaataaaataataccgctctaatgctaataccaatatttgacttagttaaacacaaaattaactcacggcatacagagacatgagtaacattatgatcatgcaaaagaaggtgagttatggtgaagcaatgcaagcacaagaatggttaataaaatccgattcagtcctcactgtgcagataactataatagcaccttggtcgtcacaagcttggacagaagcattgtttgataaattaaatttcagctgctccacaagcttcaatcttcattgtacaaaactacaaatgacagaaccacattattagctacttgaatgctataaatggagaatggtgcaatgattagtcatctacaaggtcccagtgaatttgaaaaagcttgatcagtaacattacgtgttaaacatcaaagttccagaaaatctaagccaattcctacaaacattgaagcaatacattaaagtccagaatcatagtcattgaaaattcaataatcaaagcaacataatatgtacatgacatgacaaaccacaaagtcatcgactcttagtctaagcaacaaccactcaaaagcacaaactatagcatcagctaagaagtcctagcacaactatgctaataaccaggagctcttctagccatcacactaatacccttcagagcacggttgcgaggtatgccgatctgttgtcaatatatccttggacaaatgcaagatccaaatatcttgttatcacacgttgtcgcaattatgcattacaattcaatatagatatcttgggttattttctgaatgagtaatttacatattgttggaactacttagcaaagcaagcattgcaggatgaattggattgaacttgaaagtagaatgatctgaactctctaagcatcctattgttaaatacgaaattaatatttattgcagttcaacaatgtaacattatgttagttatgctttaaggataccagttctacactaatttttgttgggtctatgagtgggaggaaatcaatgatatgatgtagttatcgggactttactttattcattggtggttatttgatgttgaaagactgaaggtacgagaggtaatctgaatatatttattagttaattaagttgatattaaaaaaaatgtaattagctagaaaaaaagggtacatgccccttttacttaacatgggggcacaagtcccctcttaacgggcttgtaaaaaggtgaaataatcattagcaaagtccactagttttttatcataattttctatggtagtagcatgaaataatatttttgttgaacatgtagcacgaaataatattgctattaagtttgtactataatgttactttatgcttgacttttgatatcatcaactttttaaatttccatttatagagtgaaaatccaatctcctctggccaaagaacgagtttgcgcctatgagtagctaggtaaggttcaaaattttaatatatacaaacaacaacatgtgtaatttgatatgaatgcataatatgaaagtctttactacaaaatagactttaaagtttgtagacaagactattggaaaactcgagggagaaacatttgaggataacaatctaatcattaccgcaaataatgcttctgttaattgcaacaatttaagtttggaagttggttgaaggagtagttatggtatattaaaatatttttttgtcttgtagtgactcatagaaagttggcatgaagacttaatttgtactatttaagttataacttctaattcatttccaaacatgtttctcatcgcttttgtactaagatttagagcttgactcataatcaattgggacaatggaaaagcaacgaaatatcttctaaagtcatttaagtttctccctatttatattggagatgaccagatagacaaacatgcatttaaggttcaattatttcttaaacataaataaatcccgagaactccttttagtgttagttatataatatctcatatgtatatgttactttgttaggtgtttcatgagcgtaacaacgagtacaatattcttatgttacaagctatgtcacccactacatacgatgatattgttatatagaatctcacacgtatatgctactacattagacttcatgactcatgagttccacaacaaggaacaatgagacagtttcatgcagaattgccagccgggggatacatccccatcccagcccacccctattggttggaaaattccccatccccaaactgaggaaacatgattcccatccctgccctctgggggaattatttatcactcctcgtacccgcttaaaaatgcatgtacatctcatatcataaatgtaatataacacatatcaatatatcggcatataatcactaattcacatgataggaacaaaagattgtcattcatctagtaatcatagcccagctagacttcaaacacgcaaatgtacatcaaatttggacccccaatgctagttaagcgggtctccgtggagaatggagatggaggataattctgcccggctgcccgccagactctatgggtcggtgtgttttctcctgttcaatttccttttgaagaactaattgcaaccatctatgctcctaacaaaagaataccccatagccacgaggaaacaagtccaataataaatctcgaccgtttggtctgaattttacttgtgcagatggtgtccatacaggaacatatatgtggtggttgagtaccatccacaggccacagctgatcttaatatcgtgtgggtggtacacgatatttaagtcacaaaattcagtgacttgtcataacatcaataagatatttgtggtaagtttttaggaatagagcttataatgctgaaaatgttgatatgctggctgacaatttt

SEQ ID NO: 83406 - DNA, 710 bp, Oryza sativa
ttcctgcagcccttttttccactttactaagtcattgtacttagtatcttgctaaatacttatattttaaggattaggcggcatcggaggcttaggcgtcgggcagtaggagaaagcaacagccggtgctgtgatttcgatcgggcctaacaggtgcgagctgcgcggacagggccaacgccataatgaggaggatgacgacgtcaatgcagctgttcttggcagcggtgcccatggcgccgatgagtgaggagctatcgccacctcccttaccagcggtgaagggagataggaaaataaggacatgttcagattgtagccaaaataaatcttaccaaattttggcattgtcaattttagcaggatttcttatggacaaagtatttgttaaatttagcagcaaactaaatgtagacattttttaagtaactttgacaaaaaaaaatggtatggttgaaaatgacatcaatctaaacagaccccaagaaaagaggggagaaagaagattaatctaacgggtgggtcccacttataggaaagaaaaaaaagatgaaaaatgtgacggtagtggcacggttctaattttataaaatttcaatgacatgactacgatttgaataaacgaattgtaatgacatttatctgaaataacatatttgtaagggaaaagtctgaattacccttgaactattgtgtgcgtatgaattact

SEQ ID NO: 83407 - DNA, 17180 bp, Oryza sativa
aattggtcctgagtcaacagtactgccggaacgtaggtctccaatggctccagcttcttcctaagcattacaaatttaagaagcaacaaggctttcagtggaaatcaaaagctgcaacctgcggaaatgcaatgtactagtaggagtactaaatttatgaagggagagcaaggtacggataagtacttcttgacgtatttgtcaaacgggctcgcgtctgcccctgcaacatcaaaagttgggaagcagatcagaaacaaatttactcgcacacccgaaacactgagctccgatcccgacacgaacacgcgcgcgcgagagagagagacgaacagcatgctgcatgcagctggacttacggccggcagcagtggcggtgagccaggaggcgacgccggcgagggagacggcgcggcggccgattccacccgccgcggcggcgacctggcagaatcgtcggcggcgagacggaggcggtgaggggcagaggtgcccgccgccggaggtggtggggaggagcgaggtgggcattctggctgcctgctgcgacgcgacggcgggcgaggcggcctccggctacggttagttgagtgtagagggctgggccccttttgcacgacagccactcgtgtccaagttgtttttttctttcctcgcaacacggcgaaagctatgcgcgcgctcggtgcagatgcacgctacgtgggctcggggttgccaggagaaacactctacggagtacgtgggagaggatagcaaacgtagcatctcagtttcaggtgcaaccgtgcaacggtgcaagcctgcaaggcatgtgtaaagtttgtcacatgggcttgtttaggttgcgtttggttcgtggtgtccatccatccatgtgtttgagggtgcgctcttttcagcttataggattagattctcctcgctttttcgttagcacgcttttcaaactgctaaacggtatatttcgtgcgaaaacttcctataaagaagttgttaaaaaaatccaacaaatttattcataaaaaaatatatattaatatttaattaatcatatgctaatcgtatttctcgtttgcgtgcggctaaacagtccaccgccactgctaaacgatcacaccctgagtttgtcatatggtgattctgttttcttttagcaaggtggatatggtcatccaattcttatttgattggatgaatgagaagggatgggatgaaaccaataagatattaatatgttaattatcgttaatatagcataatctatactaattaacaataaatagactaattatgtctaattaacattaattctgacaagataattgctaattaacaacaaaaatatattaattattgctaatcaatcactaatgatcaacgaagttggatatcctcatctggccaatttggctggatacggtcatccagcatctttgtggaatattctctttctggttgtcctatccaccctcacctaccaaccaaacatactaacaaactggataggcatatccctcaaactaaacacacccttggttgcttgccaaatttttacagtaggattgttcgactcaattgaatgaattggctttccagagagctattagcgtgtattacaatttaaaaagatgggggtttttttttggaaagaaactatgtaaagaatttattttaaaaattgaaaatttagcattttggaaaatatgtttacagaaaacaagtaataatcaactcaagaagctgattcaaactcagacaagtttaaatttttagtgtgagggtttgagtgaagctaaagatatggcatatgatacactttcctactcttatggtccatatgttatgcactcgttagtataaaagcttgtcacaagtatgggcgtatggctcttttttggttgccaagaaactatggtgtaccacatgcaaataagtatggcaaagtgggtaagctatccaaacagccccatacttacgccacgtggggcctgtgtagtgtgttaccactatccagtttatggttcgtgagagttgtttttctcttcttcgctataaatcttcgaaacgccgtgggaatcagcaaccgtcgtcattcttggttgcactggcacagtttgcacgaggctgaaaagatgaaagaaaacaaaatacccaaataatcagtaatgttttcattgcaaataaagtagagttttcttttttctaatacctgcctatggctctaaggacaacattgattttgctcctgatggcttcagcatgtgctgacggataactggttgactcttgtaatacctgattcaggtcttccgaagctctaagagatagaaagacattgccactcacaagctgagctaaagttctttcaagaaaaaagacaaaaagatgtgcatttggaatatttttcatgtatataccgtaagcaaatattcacagctttggaggccgctttctcaatatcattagaagcataatatccagcaacctgcgtcacgaattttgtagggtcagctaagttcaggtgtggataattcggaatcaagaaatccaattatggaatgaaagtatgctagcaattgccagtttgacaaggcaaataagatcttgaagcttgtggaaacaaatacacttgcatggtttgaagaaacatataggaacacaaagcttgaaagcagattagcaaaacaagggtgtgtttagttcatgccaagattggaagtttggttgaaattgaaacgatgtgacggaaaagttggaagtttgtgtgtgtaggaaagttttgatgtgatggaaaagttggaagtttgaagaaaaagtttggatctaaactcggcccaataagacatataatcagaacagaacttacattctgaatattggaatgcagagatgatactggactggactgaacgagtgacctgtactcctcgaagtttgacctctcaaattctgagcaatcgtctgcatcgaaccatatatatagaaacctcaggtaggctatatcacacaaaatgtatatgcaaaatatagccacaagttcaagatgtttagtacagatgtttgcggaggcaaacaaatacttgggaaaaggggtgaacttaaacttaaaatgaacgcttccatcaaaaggtaagacaacacacaaatgaaaaatggggagactgcaattttccgaacatactcctcgtcacaaaataatgtcttttttttaagaatccgttactagaaaagctttcatagtattacacttgtctaactattttacaatttatgcaaaagaattaggtgatcagagttatgtcttatattggctttgacgagtccaaaacgacattattttgtgactagagggagtactatattttacttgaatgtgcatttagtactgtagagcaatttatgtattctttttgtatatggcaaggaaattagaggtagacatgtgacaaccattggtatatgttggatgcacatcaacacatatggggttgcagtgctatacaataataaaatcaaattcaaaggaaaaacggtgttttagttaaaggacttctcattaccaagttcattcaacgagtcttgagtccgtagcgcttccagaacacggtcctgaagatgatttctgaccatgcattcagtagcagcagagggagaaatcaatcggacatcatgcaaaatgaaaaactaaagctggcagcaagtatggtgtcaactgcaaatgttctatacttgtcacaacatattggattacctcttggtgtactcgcccacaggattgggaatgacaacccctacaaaaaattggatacaacataacagttacacaccatatatgggaaaagaacatcatataacttctcacttatcagcaaaacaatcttcggcttcaatccgaggtcccatctcacaagctcaggattgtaatccaagtcacaaagtgttttgggctagtatcatatagtcactgcaaggttatacaagttgtcttcgtcgaatttctttatcataccataaacagtatgtacaaacgcacaattaacatttacagcagtgagccacagggtcctgctggagatgaaggttgcacaagatgccaacggccaagccaatccatggtgataatatggttgctggggattgacagtgccaccagacctcatcaaggaaagtggaggtgtcaaaaagtggggaaaggccacaacctctagctggctactgtgacacaaggcctagacctctagctatgtggattttgatcgcacgttgttttgagcatgaggtacagcttcacgcatgtttgtaagacatcaaaatgtatggatcaatgcatgagtaacctagttgagtgcaaggaaacagccgaaaacaactaaaactactgaaatgaacagtctcaacgacaattctgccagtgcagagacattctgagacaaacccattacgcaaccaagatttaagttcctggggaacataagcttctgaaaacaaaaaatttggcggtcacctgaggtaatcttgaggtacttggagaatgcacagggacgacaatctgaacagagaacggagaacctttcagcagaaattggggccacagcttgcagagtgttctgtttcatgtcaacagagatgatccaggcatttttgtcttcttcagtcatcgtggacatcatgtaaacaaaatcgtcgtcatacatgctcagagtggggatagtacaaatcagtttcttcaattgcatcattttggtattatcgtcccatagatcgggcaaaacagtggagtaactgggatcaaccaagatgtcaaatttgtcaactgagaaacgcttgcgccaatctttccaagaaagcatcctattccatatcgtggctttccaaccattaccattgacgtcgtcactgtagcagtattctatgtccacaaacttgatcaaaccatcgcagcaggcgacatcccgagcacactctggggctatttcaccgcatacagttgcaccgtacgcatctatggtgtacaccactggcttagggaatgtcatatatctcataaccgggtagtcgtcgaacagcttttcgagcagaataataccacgccagagatcgaccaaacccaacgaatcgtgtccaatggtgatcagcttgtcggtctcatgctcgatcgctaccttgtgaatctcagacggggacaagtccagcaagactggtttgctgctccaccttccggtcttggatgagaaggtgcatagctcgaactggcaagcctcatcagaggccacccattcagaattgaggaaggccacatcatagtgctcactgacgccgctgcggcaagggaagaggccaaattgctgggagttgaagggcatggcattggggtcaggaagcaggtcgagccatggacgcccggggccagcggtgtagacgaagtagttgcacgggctcatgtaggtgccagacctcctgggacgcggggacaaattgacgcggaagagaacgagggatccttccgcggcgagaacggagggctcgtcggagaagccgtcccccccttcagtcccgggcaatggacggtgaagtaggaataacccggcggatcgacgagtcagaaggacacctggacgatctggccctcgctcgtctgggattcagccgtggacgcgttccggcggtcggagatgtacgctgttttatccagcatgacccagtcgggagagccagagcgtcgggaggcggcgccggggccagcggcgtatggattcaccagcgtgggtgtacggtacgaaacggggcaaatcgtcatgagatgatgaaggcgggttgggggatgggcggtgccggaggcaaaggcggaggcggaagaggcgcaccgggttagatgaggagcggcgcccggtcgtgcagggcagaggaggcagccgctcgggtcaggtggaggaagcaccgggatggagattggactttggaggagggcgtcgggtcgggtggcggcccagatctgaagaatgtcacggtggaccgagcaggattgccatcaacgtacgtccggcctatcgatggagtccggaagggaggggagagggggcctgcgggcctgttacggtaactgggctctgcctttctgctgcgtaagtgcgagcccgccacgatgacccgctatggagctcggcccggctgttgggtcctttcggttttgcacaaccacttacgtaggggcattgctaggctacattagcgttgctaaattacgttgaccaacctgttgtgctacattaaatcatgacacgtagctaaatatgtaatttacaagataatggatggttcaagtttaagggcatgctcggtatttcacacatcttgaaacttaggggcgcgtagatattgctctatcggtagaagggtggtccgacatgtagttcactcaacatcttgaccactacttcatccatttcacaatataagtcattctagcattttccacattcgtattgatgttgacgaatctacatagatatatgtctagattcattaacatcaatatgaatgtgaaaaatgctaaaatgacttacattatgaaacggatggagtactttgtttaagtgcttgtggaaaattagcggagaaaacgtccataatatggcaatagacacgaataaaggttcgctaaaaaaatgtaaacaagtctatattgtatggttgttacttcgtactccctccgtccaacagatataagattggacgtgacacattattgtatggttgttttcttatgaaacaaagggagtagttgttaccccatgttgtgagccgtgatgtacgtttgcgttgggacgtgtctttaaattgatgtacgagattgaggttattggggcacgggccttgacttataatggattattacgagcgcttatataagcaccgggtaagggatttatagagtatttattctctaatatcttaaaagcagaatcgtcctcctttcatcttctcctcccacttcacctagtgtgtccgtacaccgaaagtaattactacattcaatattttattctcaatcaccttcctaacttctctatttacatggacctggaactggttgattgcttcatgtaatcacctcgtttcttcaatggaaacaggagaagatcttacctctatttctaaaaaaacgctatttatatgagtttagtctgttataaagtacaagtatgctaatatgttattaatggaagaaattaagaacaaaacccaaatcgaatactgctcctctgcttttcttcctgttgttcttcccctgctcggcaagcaaaatctacccaaactcctatgttttggcgagacgccaacgatttgtcaccaatcgtgatagagaaccgcacaagccaacatacaaaatggcaacggtagcacaaagagctcagttgcgcagattacgggaaaagcttgaactggacctaaaaaatttataggcgtagcgtattactataagtcttaagttttaacaggtgatcgacagcccaaactgccagtatatcaaggtaaaccagtcagagacaatagctgcttccacatttccacatgagatcctcacttcccagcacatagaggcattgtttggataatgtgatagggaaatgatttcccacccatcaaaaggtatctttaaatcctagccatttattctctctcttccatttaatccaatcccttcgttcattttccaatcccaatcccaccctctttcccattatccaaacacacccagaggtgtggctagctctagctctagagagacgccttacacttgagcacgaagccgagcagcagcagcgtggccatgaggccgcaggatgagcccccgacgcggtgtatccagtaggggtcgaacctgaccaccctccggtccacgaagcacgtaacgttgatggccaggatcagcacgatcagcagcgccggcagcagcagcgccgacacgccgccgccctcctcgtcgtcgtcgctgtcccacgccgccggccgccgccggtcgatgtacagcggcgagagcacggcgagcaccgccaggacgacgcacaccagcctctccgtcgacgacggcctccccatggcggcagctctcctctctaccgctctctgaaagtctgaagaggctagctatgcgagaatgctgccttggctgttcagaatataacttgtttatgctgtctcaaccaatcttcagaaactaggagagaacctaacgacattttcttatcgccaaggcttttgactattgatgattgattcctatcatgcaaaaggaacatattcagactgtccatgattatccacggatctgtggcgagaattggactgcgatgtaaaggcgagattcttcctagctagtgagctcggaatcggattccgggacaggcagctcaagatttggggtatcctagaacagcgtggctgatggacgtaggatcaaaattgacggtcctgatcgttttgatgggaggaagagtaaagctgagctcttccccctgatcatactgaactttgttcgtgaagcaccagcctgatgtcattgcctgttcgatactagtacgaatgattttagaatcggtacggcacgattactctgcttacacctgttcttggaacgagaaaaatagcatgaatcctgcactttatttgcctgtgtattgtactaatatattgtgagacagagcatctttctatctgtttattattagctgttaggcaagtaagcagaagtgtgagcatcaaggttggcatcaggttgaagcggtttggtctgaaacggtaggccaaagcagatgagaaaaggcgagatgaatgtatccaaacaaggtccttcaagctagagtttcagtcttccaaagagaaaggctaagctatagcatttcgtagatgatgccattggaaggttcatgatatgaaaacaaagtgacttgaaggaatgttaggctggtggatttccccaaacaagtgtccacaactcataaatactccttgtatctgaacaatttatttccgaataaagtaaaagttctccgggaaacaagtaaattatgaataaaaaatacacacactaaactaaccttcacgatactattagtccccgccattatctagcccatgcgaatcttgcttatattctcttaaacaggtatacccactgttttgagtttttggcttaacctcaaaccaatgtgccatcatgtcctgtttagatgtagtgacaattcaatagcctatgcatccaaaaaataaacagattcgcgaatgcccatcaaccaatcatagattgatatccatccataaacagcaacacatagagccccatcgattggtcacacaagtcaaagcaaaagagaaaatttgaattttcgaacttgataaaatattttcaacataatttttttagtgttgacttttaaattaataaactgttttggtttattagagaatatgatcaactaacgaggctgttatactactcctatcaccaccctggagctttcctgaaatccatgtgtacagccatcaggatagcaaagcaccatgaacacgaacgcgacgcttcttctgtcacgtacgcccgtccctcatatggccaatcgcgtcgtcaaatggtccagagttcagacagccatgggccatggaaccatggaagggagccgaccggaccacctcaccaccgcgtgactggacgcggctgtaaaagtgggtcccaccccacccacccggacccactctccaggcccacagaaacaagcgaaacggatagcggaaaaaagagagaagaaaagagaagggaggggaaggcaaggcataggtagacctcaccggacgccgacgcggaggagctcatcactggccagctgccgccgccgccgccaccactgctccgcctccgattgctgccgtctctcctcgcggggtgggtggggggggggtgtatggcgaccggctccgtcgtggcgccgccgccgtcgctggccggcggggggcgagggctccgtcggcggggagtcctccaccggcgtctcgcggcctcgcctatgtgagcgctctggttcgatttttttgccttgttttgcgtcgggttcgtctggtgctatgcccccccggtcccgggtcctagttctttacaaagaattgcgttcatttcttgctgattgtgaagtaggggaaactggggaaatgaggaaattacttgagtggtgaaaaaagaaattaaggaggtttaggggtgttattgattagtgacttgctggatttccttttgcaagttatattgatggcaagaaaggctgatcaattagttcaatgtaggatcacgctcttgctatgtcggattggtgggtgtatttatatggttactgattgtattacagttttacaccacacaaatattttttttgtgctacaaatttagacatgaactgcaataaactcctctctttgtaagacgtagcagcgagcagtgatgactcctagtactttgtattttgtgatagttatgagttgctgtgtggaaatttggaaagtttggtccaagtagacaccttcatagatgcacaatttggagctagtactttgtattttgtgatggttatgacttgctgtgtggaaatttggaaagtttggtccaagtagacaccttcattgatgcacaatttggagcatttggtttgataggcaagaattgagatagcattgggcactcagaaaagtgcggagtaactcttacacagcatttatgcactgtcgatgcatcttgccgtcttcctcattattttcatacaaaatcagcattttttcccaggaaagatgaacctgtggcttcgacgaatggcggcaaagatgaaatggtcaccgacagcctcagtgttgctagaagagcctctcaccctgggctttcatcaagcttatctaatccaatgtcagaagtcaccacacctttccatccagctgcgccatctgatcttcgtttcaatcgtcttcgaccctcagttgaggaaagtgattgcaaatacaaaagattttttggctgctatgttgctcgggaggctataattgatgaggaatactgggtatatttcttgtcacctgtagaaaacattagattgttaactctgggaaatacactactacaattttcgctgacatagcctgtacaggtattttggagtattctgatgtttactgttatatgctaataccgttgtcgtcaacacgcctttcgttttgcatgctaatattgctcctaagatgagaccactagctaacacttatgttcctagtcttttaagctcaccttttagtttgtattatgaaattgtaatattcactttaacataaatgtgtaactttccttgtaccatcatcttgatagattgctgcatggttgagagcagagaatcgatatgaagatcagtcaagcgatcggttagtgtttgatttgcaagcaaattttatgcagcctcctctgttgtttgtactgcttttaacatatgatcagtgctatcctcatggttgacatttatttaccatcatttttactgcagctatgttgaaagcttcaaaaggaagtttgcatcgcaggtacacgggtaatcaattggttactagtttatgtctgtttgaaggcaattgggatgcctcctgctcaaatagctctgcttaaattgacaatgtgtcaaaacgttccattaatttgccgcctaatgtcattcaatacttcatgttgcggtttgtgtgtatcattgttggctatctttctgcaggaatttcatgcattaaagaggcgatgtagcaagctgcaaggagagaagtatatctgttttgttgcggtatgagacaaaagctccacgtatttggtctatcaaatttggtattaaatcttggatccagcatgttagttcataggaaatacttgcaagggatgaacacatggcaaaatgactaccacaaatcaccgtgggggcttcctccactgtttcccggtcaaaaaagtaaaaaggctaccacaaccaacaagtgaaaagttgacagtttttttgtctaatactacaatacttgctatatattctggtttatagagttgaactgacttgcagttgctttaccgacattttgcttatatttcacaattgaaaaatgtctgtctctggtgtaatatttcaggtaaaaaatgatgatctcaagcgaactgttttgaatagcgtcgttggcaccctggatgtttgtataaggcatcctctgcatggggagacatttcctgcggtatggaaaaatagcagtatagcacccatgttttttatataacttctacaatttttttatggtggaaaattacatctcaaagttcttcccaggagcctggaaagtcatcatttcattgtagaatataccagccagatcagccaaagtttgggtatctgacaaatgtttgtgttgctaaatatgcacggcgtcaagggatcgccagcaatatgttgttactggccatagatgctgcaagactcaatggtaaagcaagaagttgtttttaattaaaaaatgaaacaatgttattgtgtactagttagtacatataccagataatactgatccatctactgttatcttcaaccctgctttaggtgctgaagaagtttatattcatgtgcataaggataatctaccagctcggaggctctatgatcagataggattcagggtatatatactatcttgttttgctatagttctaaaaaaaatcatttggttatataggcctaaatataaattacacttcttctatgcgtttgtagatggttgacttcgatggtgctcgtcagtcgtcagatctatgcttactctccttcagttcctaggacttggatttttaatacgatggagttttgatcccatctccctgtgcagatgaaatgccactggtccttgtgatttggaaagcaggacggtgtcacgaatacatttacaatcttgtacatcaggatagtgtgaaatgtttgtaactttggaattgacgatgggttaacctatcttgttctgatgccctggaatgctgtggcatctgaatgcttaccaggtttcttttacagttttattgtacagtttgtgaagactgctaaaagttgttggtccgttctgtcgttctgtaaggagataaccaatgcaaaacaccaaagcttgtgttgcattgtcgtgtgaagtttaccacatacgagtaccatactcacactgccaaacacaaaaccatactcacactgccacacacaaaaaatgtgcaaatacctttcatataattgactataactattcacgaactcgttccaaacaatgtaagttcatcaccagttaaccactcagcagtttcagcttcagtactaaaagcaccattgtttggcatatttttattacatatgccgtatcagcgataaattacaatttaatccttaacaatttatgagtaaaccacgatgaaaaaaaaaaaaccaaaaccagcttcgaaattaagttttaaattttaagatttggtaaagaaactatgggatacaaaatagccatctgcaaccaataacaacgggtgaaaattgaaacacagccctatgatacagggtctccgagaattggaaaacaatcgcaaggtccgtgcttggaccctcctccgagcacgatacttgtagagtgacctttgggtccaatcaaagatgatcaaataaggttatttttcatatgaatatatctactatagcacaataaaacttaagtcttcgaagatactcataggatagtgtttgcgtgcgttcatgtaggatagggtttacgtgcgtgcgttcatatgggtgagtgtgcgttcatgtaggatagggtttacgtgcgtgcgttcatatgggtgagtgtgcgtgtgttgtgaatgtctaccgttgtactatataactttttttaaaaaaaacttataaaccacttcgtattctatctaccactagtaatatgcccgtgctaaacgctacggtactactttatttgtctttaataatttttaaaattttcatgttagcaaaaaaaaaaactattatatgaactgtgcatttgagttttaattcaatttatgtcatagatcaaatatatttcatgtaaagtataataatatgatataccaattcatgcagatatataatgcatatatctgtgtttaagtcatatgatattaaagatatatgataatgcgtatatttatgccttaagtcataataatgcataataatatgatatattaaggcataaatccgtgacacacaaaaaaattaggaatatcaagttaatcaggaatggagtatgtgcgccgtcaaaaaaatgatatcattacaaaggaacaactaaatctttgatgtggtagtagtacaggtcttagaccctgtttagatgggactaaaactttaaaagtccctattacatcgtatgtttggacactaattataaatattaaacgtagactattaataaaatccatccataatcttggactaattcgcgaggcgaatctattgagcttaattaattcatgattagcctatatgatgctagagtaaacattctctaattatggattaattaggcttaaaaattttgtctcgcaaattagttttcatttatgtaattagttttgtaagtagtctatatgtaatactctaaattagtgtctaaatacagagactaaatttaagtccctggatccaaacaccaccttactttgaatatttccaaggctcaaatgaacaaaaacttctgcaatgtattgattattttgcctcagattgggcgactaaggatagcagatctgttgacaaacaatatggttctgatttcaggagaccataccaccaatatattgcccaaaattggatatttttgcaattatacggttttcagatagcaaatagtgcatgtggcattaatcacaacctatgcatgtgctgataatttcccttttcttgagagggagagaaattctgttacatgcttggtgatttgataatataaaactgttttttgttatataaatttcagtatatacccctataggaaataaagcagcatatatcctctctatagaaaaatgcagtatatatgctcgtaatggtgaaaaaaaatggcacataggagacattgcagtatatacttttgtatataaaaaaaatcagtatatgcatttacaggaaacattcagcatatgcatctacaggaaaatttagcatacaaatctgaaagcatgcaaggactgaagtacacaatatccatctatttctataaagatattcaatctaattgtctcctaatcaaccactggcaataatttttggggcatacttttgactatggtgataaaatgattatcctcacctgcaaacgagtagaaaattttagacactgaatgatcttgcagtagaaaaatacatgtactaacctgctgctttgccacatgtacgtgaatactctgctgctctccttcagatgtgttcatcacatcagggcaaaagaaaccagatggcggccaggctgatgtggcgacgatggcggtattcaacaagtcaatatatcctgcaacgaggagaacaatggtgtcaactgtacatcattgagcagacagacaaacaaatcaacatgttgttgatgaatgaattatcaattgagcatcatccatgtcttgtttcaaaatccatctctttcttctttggttgtagtggttccactccggttatgtttcaaggttcgttttctctttctcgttgccacgacaatatgaggcttcttctaccagtaccagcaaaccaatgcccacataagcaacacctagctagtaacaaaattcatggcttgaatcttaggaactattaggcttgtttgccggcagtcagatctaaccttcatcttgcatctaaaaatatagttctattcctaataagcactaaagaattaaaagatctgccatcacaaaagagtaacccatctgaactacatggagctatttactcaaagatcaagattcacaattattagctagtcctctgtactataatgcatcagaacagagcagtatccatcacttaatctgatcgagcttgacaatgtaattagccatgtacaaatgaataagtgcgatttagattgcacagaaacatgtatcttcaatgacacggccaggccgatgacatactattcctttagcaaacaaggacatgccgatgaccatataaaaacaatatatttgtacaattaattggaaatggagaaaaaaattcataaacccctaacatcagttgttatgcatatggatatatataactaattatgggatgaaataggatggtttccttcaggacacatccccagtacttttgagtctttcaccgcttagtactatcatataatccaatatgctgttatactatactccaccgttttgtgtcgacctactaatactatatccatcctatagctagttaatgagaatcaattaagcttcagaaggaggtgtcaatttaaaagcaatcgaaataataagcacttggttaactacagtcacaggttcacagtgcacttggatgccttctcaaatgccgagatatcactaataggtaagaaattattataaataccaactgagaataacatattccagcggtacaaaatggttttttccaagtacatgtaataccgtgttaattggtaatttgattacagttcacaggaaccccattataaaaacattgaaaattggcaacacacagtaaaggaaattaagcgaattaattggatataccttcaatgcagggaaggaggttatgtgggtgggaagctactgttcgaactgatctggtaacacatgatctcatatatatgtcagtacattcatttatacgcctaccgaaatcatccgtcaaaagtatataccaataatatatacacaagaatgattgcaacgctgcccttctccaatcatcatgtcattagcaaaatagtgcggtgggttggagaaaaaaaaggaagttctgcatttgtaaactaatgatttttgagccttcatatctttcatctaaaaatattgttctattcctaagcactcaagcatgctactcttgacatcagttgatactaagcactca

SEQ ID NO: 83408 - DNA, 10421 bp, Oryza sativa
  unsure (1)..(10421): unsure at all n locations
ccccacttttatcctacgtggcggctgagtcagcatgggacccacgtggccatgtcatcaccctctctctttccctctctctttctctctctctgttctctgggaggccggccggcgagcggggtcgtggggaggagacggcggccggcgacgcggcggcggtgacgcgggagaagggaaaacagcggtagcagaggccacagccgccgtcgagtgaggaggtggggccagcgagggggcggggagaccggcggcgagcgacagagagggaggaggcaggtcttgcgagggggtcggggaggccagtgagctcgccctcacccctcctccaatgccgcgacgctcgcctccgcgccaaccaccacggagcaccgtgccggcgtgcccatcgtctgcgtcggcaccgcggggacagagcaaagaggacggggggagcacggtggcgccagcatccgagggcgtcgcggcactggtcctcaatagctgggggaggagctaggtgcgggcggcagtcgccgagggcgtcgcggcatcggtcctcaagcaccctcatggcgtcactgttgtcgccgcgttcctcccgcctcgccgccgccgccgatgctgtcgccaccgccaagccgacgccgacgctctcttcctctcatgatgccgccaccaccgccaagccgacactgacattagcggcgaccgtgggaaggcgctggcagagctggaggaggacgagatggcgctcccagtgactgcgccgcccaccccagcagcatcctctccccctctctcgccggattggatcgaatcactggcgcggatcgaatcaccggattggatcgaatcaccgacgccgacgctctcttcctcttgcgatgctgccgccaccggcaagccgacgccgacgccggcagcgactgcggggacggggaaggacggccgtcgtcccgcgctgtccgcgtcatctacatcagctcatgggagctcgcctcttcgcgcgtcgtcgtctcccgccttaccggcttcactcgatacagagaagagagggggtgagagaggagaggagagaggaagcaagttggagaggagggaagaagaggctgacatgggggcctacgtgggtcccacgttgactcagccgtcacgtaggacaaaatcggggtcaaaaccaccgaaggacctatgtggccggttttgattagttaagggacggccgatatctagttttgcgattgggggaaaattttgtaactcgataaaagttgagggaccttcggtgtactttttcctaatgaagcttacactggctctgctaatcgtcgcgcggcccaacagcccgtgagggataacgtgcgccaacgatcttgctggttggagcaggaggcccaggcccagctgctagtgatcgggagtagcagtaggaatgtactaggataaaggcattggctgctcgttgaaaggtttacgcagcaatggtcatatagttctatgtagttctataaaacaactatagcgaacagagcgtacacgatacagcatgagaatgtattatttattattgtgtttctaccttctaccaatactgccttgactcttcatctgacctgtagtgtaggccgtgtcctgtcctctacgacatcatctttatttccgtagaagctgtcaccgagcttttacacacaaaaatgtccgagaagtgacgagtccatttcaaaactaaacaaaatcaatccgaatttaaaacaaacaaactcctgcaagccgggagaaaactttgcgtgcgcgagtcaaagcccaacgtgcggcccggcccgcaaaacaaaccacccgccgtggcactggcaaggaagaaagagaaagaggagagagagagagagagagagagagagagagagagagagggggatccccgcgccgcaaccaagtggggcccgtgatccgaaacgaagcttccgcgaagcagcaacggttatgcgtgtcctcctcaaaaaccgccatctctctcactcccaccaccaccaccaccaccaccgaactcgatccgccatgtgcccgcctcctccagatccgatctcgtcgccgccgccgccggcgatggactccgcgctgccgtccgccgtcctcgccaccatcctctcccgcctagacgtccgctccctcgtcgccgcctccgccgcctgccgctgcctccgctcctgcgcttcccacgccctctccttcctcccctccttccacctctccgtcagtaaccacccaccccccctgcctctgctctctcgcatcgccatcgccatcgccaccggctacggatttgacggggtttcgtttcctcttgtgtctttgtctgtgattgaaggaggtggcgctgacgcacgagctgctccgcccgctgatgccgctgaacccgagcctgcggagcatccgcctcgactgcgctaggctcgaggacgccgccatcgactgccttgcccgccccgacctccatgagctgatgctcctcaactgcgataacattagcggccgcctgctctgcgagcttggagccacctgccaagaactcaggtactcttctactgctctgttaactctgcagggtgacatcgctaacagaaaatactgcagtttatgatcccaataaaacaaaatgcagtgaaccagcgttactgtttgcttagagtcgcttctgttctgaactaaagtttgattcagttgtcaaatatggtattgagaagtacatttctttcccgcttggatgtagagtgctttccctgaatgcccttgctgagcgtaggggactaccgataagcttctctgatctgcagcaattgcttaatggctgttctcaattggaggtattgtttcgctctcaattactattgcaacaactaatttgtgcaatcatgttttccattagttgaaaacaccgtagatatatataattctagtttttattaccgaatcagttatgtgaaaccaaaggtgtttatattgtgattgtttagttttctattactcttccctattggatcataagtcactatgaacataaatctttgtgaaatttctactactttgaagtatgattatcttttgctttgaaatccaattaccttttactgttctggactggcaacttatgtccctcttattttcagtctctcaggttggcccttgatttctcaatgttnnnnnnnnnnnnnnnnnnnnnnntgtgggcatctgcttcagaagccctgacctccctagaaatcggatatattccaatgacaatgttgcttgaacttcttactgtggctatggaatcgcaacgatgcatgcatcatgtaaaggaacctgttttctttcctagcctccaaaagttatgcctcaccgtggacttcatcactgaccatttgattggttcactatcaactgcgcttccatcattgacacatctggacctgcaggatgcacctataatagaacctacaacatcatcagatctcaccaatgctggtcttcagcagattaatccaaatggtaagttgaagcatatttctctcatgagaagtcaggagttcttattcacctctttccgccgagtaaatgatcttggaatcctgctaatggctgaaaagtgctcaagtcttgagagtgtctgtcttggtggtttctcccgcgtgacagacacaggttttagggctatcatccactcttgttctggccttcataagcttagggtgtcccatggaagccagttcacagatcttgttttccatgacataattgccacttccctttgcctgacacatgtgagcctgaggtggtgtaatctccttactgacgttggaattgagaggttgtcattcaacaaggatctcaacgtattggatctcagggactgcaggagtctgggtgatgaagctgttagatctctaagctgccttcccaaattgcagatattattcttggatggaagtgatatcagtgatcaggcattgaagtatctgggccttggaacatgtccactagcttccttatctctgaggggttgccgaaagttaacaaatgattgcataccactcttgtttgctggttctgttaaacagagcttacaggtgttggatctctctagaataccaggtattactgatgatggtatcatgttattagcaaggagtcgaactcctattattgaactccgaatgagagagaacccgaaaataggagatgctgctgtgatggctcttgcgtctatgctagttgatggtggaacccatggcagtagcttgcagctgctggatctttatgattgtggtgcgattacaccacttgcaatccggtggttcaagaaaccatatttcccaagattgcgatggctaggagtaacgggcagcttgaacagggttatggtggatgcccttgttcgaagccgtccattcttacatatggcttgccgtggtgaagaattggggactttcaattgggatagatcctccgattggtatcgacatgatgatgatgatcttgatgagcttgaacagtggattttgaatggtgaacctgtatctgacactgaaaccatcactgaagaataaggcatcactctttaaggtttcttgacccacaataatctccctgttctagcctgctagtgttcatctcctgttgtacctccaccatttcatttttctttcttataaagctactgtgttatctgtcttaaccagttgaggtattttcttgcggtgtatgcatatgcaaacctatccgttgctgtatacttgtatcacgcaacacgcatacacgatatgcatgttgcattcagattccctgggcttatgtatgtacattgtttgctttcctgacctgatgttgtactggtatctttttccaggtttcagcttttctcatagttaagttatttatcgaccttatgccatataagatgtttacgattgctggctcttatacgatatcttaagtgggcacctttattgtggatacgctctaattgtttgttatgcgacatgtgcttcatcatatgttagtatcaaaagatcactttggtaaagcgccaggtccactacctctagttagtttcagtttccttgccgtagttagcataaacaagcttgtaagctatacatccgcttgtttgtttctcactatcctcgtttgtggctgtagagccaccgaaaccaggttgagccgcaccactctccggagcaaaaccaaaaaaaaaaaagtgcgtagtatgttttgatccagtactgaaagacgaacatacaatagattttttttttcagttaatggtgtctctatacagtatggtttgtagtaaaaatgtactactactgagcaggaatttttttaccggtgttaggccctgtcatccgaaatttcgatacaaattagaaagtattaaatgtagactaatgataaaactaattccataattttagactaatttgcgagacgaatctattgagcctaattaatttatgattagcatatgtgatgctaaagtaacatgtgctaattataggttaattagacttaaaaaatttatctagttttattagtagtagtctatagagtatttaatacttatatatttagtgtccaaacatccaatatccaacgtgacaagaaaactttagtcacgggatccaaacgcttagcacaacttgatatcctaggtagaatgtctaattaaaagcttttctgtgagtttttaccgtggataaggccactcgagcccatctgtcagtgtgtcagactgtcagtgtgccgctcactcgcgtccctccgtctccggccagctagtggagtggagtacattcactagtggtttgcttccagttcctatccaatctctggtcttccggcaggtccccgaagaaggagcggcggcgatggcggcgcctgtgacggtgtacggtccgatgatctcgccggcggtggcgcgcgtggcggcctgcctcctggagaaggacgtgccgttccaggtcgagccggtcgacatgtccaagggcgagcacaagtccccttccttcctcaagctccagcccttcggccaggtccccgcattcaaagacagcctcaccaccgtcttcggtaaaaccctaatccccccccgtttcctccgctaatttcgttgctcctccagtttccttttattctccctttctcttttgttcgaaatacgtactgattcatcacatcaatatattggaaaaaggagatgcaaataacatgtagccgcgtctaattagtaattacctagaaatttccccaatcactagtgccctttgtgaaaaaaatgatatagtttccatgttctaaaatggtccttgaatgcaaaagatgaggagatctacatatggtttaactgattgtatcatatcatgtttggcagagtcgagggctatttgccgttacatctgtgaccagtacgccgacagcggtaacaagaccctcatgggcaggaaagaagatggggcggttggccgcgctgccattgagaaatggatagaagctgaaggccagagcttcaacccaccgagcttggcaatggcattccagctcgcatttgcgccgttcatgggtagggccactgacatggccgtggttgaacaaaatgaagcgaaacttgtgaaggtgctcgatgtttacgagcagtggctgggggagaaccagtattttgcaggtgatgagttctcgctggcggacctggtgcacatgcccaacacagatcttcttgtgcgcaagaccaacaaggcagggttgttcacggagagaaagaatctggcgaggtggtgggatgaggtatcagctcgtccttcatggaagaaggttgttgagttgcagaatgtaccacggccctcatgaggcttcttgttttttcccctctgagcgtcttgtgttagttgcgttaaagattcggtcttgttcagttgtttgtatcatttgacaaaatgtgcaagctcttcctatgggtccctaatattgtgctaccatctgtaccttttagtttggataaggttgaatctattttcaggttctcaagtttacttacctaacagttcccttaacaaggtaacaatggtatagacaaatagttgcaaatgccatactgtcggcactgaattcttgacagacatggtatcctaccacacattcataatatgcaactattagatttacatattcttgatatgtctgctagcaaaaagaactgcattgtcctgttccttttagtagattgttctagttcactattgaaatttaagttgcatatagcttctttttttaacgactcatataactttcaggctacagctgatcttggagttggttttttggtatgagattggaaaactggaaatgttttggctcctttgtttatccatacgttctctaattactagtgttgagattgagggtaaatgctttagagatttcaacgttagtaggctgtcagcaaaacagcactgctgagatacaaccattgagaactattctgagtttattgtgattattgggcattgcctcaggaattgtacagtgaaaaggccctaagcattccccgatattttgtgctgctagcaatccaagatgaggtggaaaacgaattgtcatgaatcatgattcccttgctcagaatgtcaataatattgtagatttccaattcatttttttttgctacatcatggtgcaattattacaagtaatatgcagagtcattttaagttcatcttgtagtattgcaggcgtaactcctgacagcccgctaatgttattctaagttaacaactagtagtccttgtttaaagttgaagaacatacaggtatgtcttttgctcaacattaaagattaagcacatgcagatgtatcgttggttaatcttctataggttaaacagctggattatatccaactctgtactagggacgttgcttttgttgaaaagcttattcttataccctggcggaagtcacaacatcttctttgtatgtctagtacttgattccaatcttcttcttactgtcctatataaattctcataaacaatataaaagaatcttgtagtactgtgtagcaagctccttctatgctatatttttcactctagtgctgaaggacttcatagatactaataaagaaggctgttttgtaggatttgtttttgttctagacaatatgattgttgcaagcaagaatccagatcttcctctttttctttacacttttccttttccatttttgtggtgcctggtagcaaggcaagcatagaacttctccttttgtttctataaatacctgattaagaatcctgctgtcatcatccctcgttgtcgttttaaacaacttgatcaggtgatcaatcaaatcaatagaaacgatggctgcaggcttgcaagtgtttggccagccagcatctactgatgttgccagggtcctgacatgcctctttgagaaggatctggaatttgaacttgtctgcattgatacattcaagagagagcacaagcttcctgagttcattaagctgcgggtacgatactatttatttatttttatttagattcattctctcgaatactaagttaagctgtgctctttttgaccttttcaggatcctaatgggcaagtgacatttaaacatggtgacaaaaccatcgtcggtaaggccaccatggatccacattacaatggctactttacgttattagttttactttctttttttgaggatttgaggacaacgtgaaccctatgtgcagattcaagggctatatgccggtacgtttgtactcagtttccagagggaaataagaccctttatggaacgggatctctagaacgggcatcaatagaacagtggcttcaagcagaagctcaaaatttcagccctcccagctcggccctcgtcttccatctcgcatttgctccccatctgaacattccccaggaccatgctgttattgcagaaaatgagaagaaacttcagcaagtcctcaatgtttatgatgagatactctcaaagaatgagtacctggctggtgatgagttcaccctggctgacctttctcaccttccaaactcacattacattgtgagttctgagagaggaaggaagctcttcactggcaggaagaatgtggcaaggtggtacgaccaaatctcaaagcgcgagacatggaagcaggtggtcaagatgcagagggagcatccgggtgcattcgagtaatggcctgatatattgcccaagttcatcgtgtccgttgtcgatcgatctggcttctgctgtcctgtgttgtcatcgtcgctagtttgcctgttccctgcttatattgtcgtgtgaccaaataatatgaagcctcttcttgttgtgacgtagtttcataccatgtacctcgttgctttacaggtcatttgttttctcccttgtttagtgattaaataaaattgttaatcgacctggcagttctaaatctgttgttttcttcgcctgaataatagtattcttttgtgcttggattgagcttttgagtggcacataaaacgagaagagtcattagactaattgaatactattataaactaaaataatgtattttttaaaaagaaacttatgcgtagacagatttttaaaacacacatcgtttagtagtgaagcgtgttcactaaaaataggaagcgtgttcactgaatatgggaaagcagttaaacccttaagcggaactgaaaacaaccttaatgaaatggaatgctgaataggtgaatgattgatgataattatttgaggctacaaacaaacgatgaaatgaattaccattatagataaatagatttacacacacacacacacacacaaaaaaaaaaaatcacatcgtttaggagctctagaagcgaaccatcattccatgcctaaggatcctaaggatcttggatgtaagaatgccacaacacaaatttgtaaggaattcattggtgaacgagtagatttgaatttagatagtgaagtactgctatgagttgagttgtgagcatatgactctatatctattagaatttaaattgttcataaatattacacagatgcatgtttttataggaatctagtaaagttagagatttgtgttggtcgtccgttttttagtgtgttaagagaccacttgcggatgtgtgtatagtattagtatggtcttgtatatcctgcaacggaaaaaaaattaaatggtatgcacaattaaggggagaaaggcagacagagtagaatcgtttaaagtcttgaaaccgctggcaactagacagggtcttgctgccgatttgccgaccattcgccaccagatcaaccgatcatctatagggtttgatgtgttgggccgaacggtcaggctcaggttatcccgaaaatgctctgggtcgtgcgaccggcgcg

SEQ ID NO: 83409 - DNA, 8920 bp, Oryza sativa
  unsure (1)..(8920): unsure at all n locations
cacctaatttatctataatgtttcactatttatagatctaatgttgcagtgaattaaaatactcatttgcaacaaaaatcccacatattttggaaactctctattaagagaatttggtttattttttgttccataaaaaaatgtttcacatagtatactcataatgttttactatgtatagatctaatgttgcagtaaacgaaatattccagtgcaacaaaaaacccacatattttggaaacctcctattaagggaattcgttttattttttttccaccgaaaaatgtttcacctagtgtacttataatgtttcactatgtatggattaaatgttacaatgaactgaaacaattttttgctatttacttaaatattatttttatataaggtgaaacagcaccagatttaaacaagtgaaacattttcgatcaacttagtgaaacaattccaatatacctggtggaacatcgcaacatttaaaaataattcaataataagctaattttttttgtcggaatatatccatgtgtggtcttgttttgaagatttaattataacgaatttaatggtgcaattggatcatgatttggattagtaatttaagagaaaaatcagtttaaaatagttttgcacgtaaatcgggcgctgacgtcccgattttttcccacccacgatcgggcgcccgatttgtaggggtccaggttatccaggccaacccgttttaggaccggcctcatctttacttatgcttatacttgttagtcaaaatttgaatttttaacattaaatttagtattgattttgaaagttttttcatcatagtttatttttcagtttttgcttttagatcgctgagaacacgtatataaaaattttattcataaatttttttttgtttgtaaatataccgtttgtcttttttctgtgaataagccaaacaatgaccctgatttcgtgtcgtggttttatatctgacaaattttgatgagaaatttgatcaaaaaatgcatagcaaaatcgctcatatgatctgatgtatgtgagccacaactttgcaagtggtggacgagccgattgaagtcattgaactcgttccctcttctacggttctaccccaacactgtccttgcaactttatcggttagaatgctaagctaaatctgtgattgccgttgcatctagccacgtcgtcatacacgggtagcagtagcaccaaaaggcactctcgtacttcaagatatacttgttttctcggacggatcaaattccattgttctagaatgtcctgtttaacatcacactcgattggacattaccttttttctctctcaaaaacaatcggaatgaaacagctctaaagaacgtgctaagtgtacctactgaatccaaccttaaatccgtagcgtacgtaacccctgctccgttcatcatcccctgccagtatgccttgtgtaccttgttcgtttctttgcaatattcattccgacaaatgcacgcagcctcttttgtatcggttaccctattgataaaagatcacgccgagacacatgggggatcgtctcttttccttgccggagatgatagttgctccaagcaagaatcaggggctagctcttctttatctttgagctttctcttttcctcgccgtcctgtaatcctctgcagcaaggcaagcacctaatccatccctataaatacccatcggcgtctctgcctcctcacagcgagccacacaggttaagtcactttcacctgcaaatccacaagcacattgctcgatcaccgaggaagaaaactagctagcttaatcaccgggaagagttgagcaatggcggcaggattgcaggtgttcggccagccggcgtccaccgacgtcgcgagggtcctgacctgtctcttcgagaagaacctcgagttcgagctcatccgcatagacaccttcaagaaggagcacaagctccccgagttcatcaagctacgggtataaataaaatcatcatgccatttcaatccattcggttaattttaggctcttggaaatgaaacaatcacgcacgtacattggcttcattctgtcccctcccatgttcttttgcaggatccgaccgggcaggtgactttcaagcatggcgacaagactcttgttggtaattactgctttctaaattttcttaatcacctgaattattaacaaatggattcttgtttcttaatcttcttgttgttttgtggcatagattcaagagcgatatgccgatacctgagcactcagttcccagacgacgggaacaggacgatctacgggacggggtcgctggagcgggcgtcgatcgagcagtggctgcaggcggaggcgcagagcttcgacgcgccgagctcggagctggtgttccacctggcgttcgcgccgcagctcaacataccggccgacgaggcccgcatcgcggagaacgagcggaagctgcagcagatgctgaacgtgtacgacgagatcctggcgaagaacaagtacctcgccggcgacgagttcaccctggccgacctgtcccacctcccgaactcccactacatcgtcaacgcgcggtcgccgaggggcaagaagctcttcacctccaagaagcacgtcgcgaggtggtacgaggagatctccaaccgcgcctcctggaagcaggtggtcaagatgcagagcgagcaccctggcgcgttcgagtgatatgcgcacgcgcagctcaaaaactctcttgcattctgcggcgagctctgctttgtctcgtccacggctttaattcgtcgggcttcatgcagtgatgtggttgtcgtctacgttaattgtcgtttcggctaagaataatatgaagccttcttgaggtctcctctcagtgtattccttttgcaacgccatgtctttcgattcaataaatataaatgtgtcccagccttttttgctcatgtgcaggcagtatatgtagccctccgaaaaaactaattttactgcaagtctagctagcatgggccaacaattgagtacgtagtttgacctagctaacgcctaggtcaatacacaataatactttgggggatccattgtactgctgtctacttcctccatcccataaaaataaacatagtacatgatatggtatttccagtaatacaaatctggacaataatctattcagattcatagtactaaatatgtcatatttcatattagtttttgttttatatgggacgaaagaagtatgcaataagaaccacgcgcatgtggatagtcttggaaatgatagcatcaaaatccaacccatcatactacattgagtttatttttgtcatcatgttcttaaaaaaaactttttttttctaaagagtaaaatgcatgaagggttatttaacttgtttaggtgtatcatgtatatatcactttactttcaaaatacacattgagtcactaatataagttaagtgagccatgtgctcatctaattatccacgtgagtatatcatacatttggcattccacctaaaattaaaaaaaatacttctgaaaatgcgtagacctaacaatgaaagctgctagagtttgatgccaagtgagagaggactgggaactagaactcgtcaaaataggtacaagtgaaatgatttgattacactagtttcgtgtattgttaattggtagctgtcgatttctaagactggtaataaaatttatagagtacgctagatgctagaaagaaatggtgacatagtgatttatactagtttagactctcgggatgaggtaatactctagtccagttgtttggtggattacctatgtatgagtgttgaatgaagatagtgcgtaacccccaaggggtgctgtcgattccctttatatagcagcagggtgatcggcgacaaggaggatgcgatatcccttaaattctgggtacctgccatctgtcaagattggtgggataggtttttatctccctattcgccgccatttatagtaacagattacatgggcctgggcttgtatcacgctagagatctatacttcgagtactgtgatgggctaccccggtacgataactctcatagtaatgctatgtgaatcgaaaaatatatgttttctgcatatttctatatgcattttttttcaaggcagcgtatcgtatgcacacagctaggtagatgcactcatgcacacacccatcctgagcctttggatcaacatcctgcggccaagacctcgagtgtggtatttttgcaattagccgcccgcctcctccacttacttttacgaaagacccctccacaactctcttcttcactcatgcagttcattttgcaaaaaaaaaaaaagaagaagaagaagaagaagaagaagaaaagaaaaaaaatcgcccatttcattctggatcttgcacaagcactcccaccatcggcggagacagaaatctctagcaacggcttgtattcgtaggcagcgaaaataacatgctggccatcgatgacgacctcaatcgacggttcgccggcggagacagcaatctggagcaacgccgcatccggagaggctgccgcagtgctgctactcttgagtatcgctgtggcagagattctgttcaagtttagtggaaaaaaactttctcaactagttggcatgtagctaatggctaaatatcttctcacctatcagttgaggatgaactgatgattgatgagcagcacaacttactggttctgaaactctaccaaatacaactaaaagaacaaatttctctgcgaaaaaagtggactggcaattcagacttcatttcagacaagcacacaggtagccgaacccaaaagatgataaatctcaagctaaaaaaaccaatagaaccccataaaaggatacgatccaatcttgacaaaaaaaaacattgtagcgcccgttccgtcgtggcgcctagcaggaaaatttaaattctaaaaaaaaaccctaattgcgaaatctgtttctttgcttgttgtaagtctccatgccaatccctgatctcgaatccccgatctatcgtcaaattcaaatcccgaatccaaatccttcccaaatcaaattcctccgcaaaagtctattttccctccctcaggttcggtgggctgatttcctctctctctccctcagctctcccctcgctctgcccgcgcgccgcgtgcgcgtgcgcatgcgcgtgagccgatgccgagccgagctctccctctctctctcgttctcccgctctccctccccgctccatccccggaaaactctccgcgcgtcgttacctcgcgcgcgcgcccgcgcggtcgccgccgtcgtcagccgcctgctgcctgtgcctgcgccgtccggccacgcgccctgcggcactgcgccgcctgtgccgcgccctaccccacgagccagcgcgcgtgccctgccgcgcctgaacccgcgcctgccgccctgtagccgcgcccttccaaaccgcccccgccgtcatcgccgtcgtcactacccggccccgccaccaccgcgcatgcttccaagggttggaggcagagctcctcctcccactgcctcgtcgccctctccctccttccttcttttcccaaagtggcaagaggcaagtctcctttccctctgtcttttcttctcccccttccccccctccgccggcgtcatcctccctgtcgccgttttggccgctagccggagagccagctcgctggcttgaccgcccaatgtcagttcctccctcccaaaccgacattgctgccctataaacccgagcccctccccaaaccaatcttccccattttcgccctcgccattgccgcaccctgccctgttcgccgtcgccgttcgtcgtcgcgcgtgtcggaggagccggcacgagcgaggacgcgtgacgtggactccgggcgcaccctctccttcctcttccccggcccgaggccagagcgatcacgccccgcgccgtcggccatcgtcactgcgccccttcaccccgcactgtagtgcctcctccccgttctccctcctcgttcctcctcttccccttagctttcggtagaagctcgtatagcctccccgtagctagctggtgccgcctcgaccgctgccgccgctcgctgtgtgctcgccgccgtcgccgcccgtgctccgtagcgcccgcacgtcgtcggcctctctcgtagtgtctccgtctaatccgatgctagaaacggacttccggtggccgcgtagatgctctagtccggaggaatcgaaccctagtcgcgtcgttgccgtttccctcttttctcgccgccggttgccgccgccgcaatccgccgccttcgaactccctccggcgaatccgagccgttggctcgtctcccctcgtctcgtgcaaccacccggtgtgctcgctntcgcctgtatcgctgtggttcgccccgccgttcgcagctgccgtcagctgtccgttccggccgtcgccttcttcaacctcccgccggcccgcgtggcagccacgtaggcgccacgtcggcgcctgctcggccaagatcgggtcaagccgaccccggtccgccgctcccttttgccccgctcgcgcgcgcagtccaccgcgagccgtgaggctgcgtgtggggccgccgcatccgcacccaccacgagccgcgcgcgtgcaccgcgccccgctccaaaccctagcgccgcgttgcgtgctcctcgctcacggtgagccgagccgccgacaagcgggtcccactcgggaccacgcgagatggacccggcccaccggctacctctctcctctcctcctgcgcgtgccttgggccgccttctcaggccggccggcccattaagctcggccgaccgcccctttctctcgggtcgtgccctagccacccgagggaagtctgtttcccctccctctttcttttcttttcaaaagggtttaattaaatcctttttcctttagaccaaaaatccaataatcttagaaattcaatatcttctcaaccgtatgtccgtttgactccgttcaacttgcaaaattcctcaaatctcgagatctatttaatggcacgtttagaggtcaacaatagggctttattttcgccgtttgttgagttgtcccgtttcgcgtgtagtttcgaagcccgaagacccgcagtgcgaggatttcgaggatcaagctcaagatctcgagcaaggcaagtcacctttgatcatcttgcacctataatttaaaactaagtatttcttttctgcaaatattgcatgaataggattaacacaagtaaatcggccgcggcttgcgagatagcctgccggtcgcaatcctaattgctgcaattaccctccttgaattattgaacacctaaacctcctttgtcaactgttgtgcttcgatgcacgggcctttgggcacgggcatcggaacacctcccctcaaatttaaaatatccaatgatgggtaaaacttggggttttacaaaagacttggaaaacccgacacctgggtcggtgcttgcgaactaaaatgaatttccaaaatcgcggaccgggggacgtaccgggagtacggtttcctgctcttgcacttaaggaccgtttccttggaatttcatccgaacataaggcaagtgcgaccacatgggtggaatgggacacccctggctgagtaactagctaatcgggggaaccatgatgccaagagacatgtcgattcaacggggtggtgttggggagaacccccgggcttcctggcacagtatggtctgggacctaacctgttgttggtctgggacccctctcgttggcatatggtaaccctgtgtcggctttcgaaatgccttgacgtgaaagccccaaagtcaccagacgtggctattctgcacaggctgggtgaccaaggctagtaatgtcatgtgggtaaagtgtaccccctctgcagaggttattaaactgttcgaacagccgtgcccacggtcatgggcggatgtgaggtgattcctagcgtagttttgtttgactactgcttgtgaaattactgttgtggaatgggttcgatgtttgaaaaatctgcggctgatgggatcagccaggcccgggtggccgtttgaaagctgttggccaggtgctaaccttgaatcaattcaaagactgatacgttgcacatactccgaccggacgagacacactgtctcatccgtgtcgtttgagaagcactcacttagttgtttcaaaaaggagtttaaataaaaccagttgcaaaaacaacagcctttcctttgaagcctgcattaaacacttaattcccatggcttgctgagtactcctgtactcacccttgctctatataaataatcccccccagttgctgaagaagatgaagtggatcccgctgacgaggagttcttccaggagcaagtcggctacgatgagttttagggtttcggtctagttcccaagtcgcgcctgtgatgattggtccaagtcttggcttccgctttccctttgtaatgcagttgtgagctcgagatctgtccgcagcccaacatgactgtactcctactctgtaataaagagacctctgttgctgtgatattctgtcttcctatgatactagcactgtttcctaggactggtatcgattaacaggttaatttggagcgtcacgggctagttccgtttggggctagttcggggcgtgacaaacatccagctccaatcttcaccaggcaccaaccgagctcagtttccactctcctcacaaactttacgacgatgagagcagcgacagcctctgaagatgagccgtcgctccaaatctctggctccaaaggctcaccgtcactgttccgtcggccacgctgattgaggtcgtcgtctccgccgatgcgttgtagtcgtcgccttcgaagtccgaatacgg

SEQ ID NO: 83410 - DNA, 5571 bp, Oryza sativa
attatgcccatctattgcattggctgcaggcatgtgtccattccacattccattgagagcagtagaatctatactaatgtatggcctacagccctctaagaatccatctatgcaagctttgaaagcacaaagaatctgttaaagtgaaccttatctccaactctaactatgtcaatctcaactacactaccaggggatctcatttctatctcagccttgaacctatacaaccaatcaaatgaatcatcaaactttccaaataacttatctttagccctctgcaaaccataccacgttgtctgatagcctatggtggtcttgtatgtctcctgtagcttaccttgaagttcctttgcacccatgtctttcttcttcttcaaaaatggaatagccctttcagccacccaagcttgagatgccatcttcccaagaactctgcttcttgaagcacaatgatgatcctcctcatttatttggatctgcacaagtaaaccatattagcaacttattaggtaaacaaaatcaatgcatacagcataatgtacaatttaacaacaattaaatagttagtataataccctgacacttttatcagcctgtgtctttgctctgattttccatgggcaaccatttgcagaacactttcctcgaaatctatctggatcagatttttcagtctcaagctcaaactcactaacaattgcatgctgtttcactgccattctgaactcattcattgatggatactttgtccctacttccattggtggatcatccctatcccaaacaagttctgggtcagcaggtacctcatcactaactacaatggctgcatctatcatatcttgttgaatctcaattggaataacagggagtgcagcttcttcttgtattgctgttgctgctgctctctcatctgtttttttgaaacccatagcatcaaatagttcatcctcatccaacaatgcatgagcatcaccatctaagccatccaaaatgattgccaacttactccagtccacaagagcagctgagtcttctacatttggtgcatggttacaagtgtcaccagtatcttcttcattggtcatttgaactggagagcaaatatcaattgaatctgaatttatcacaccacatctagcaattgactgaccagttggttttgcacttatcacactaccttcagcaattgatggaaccccaagatctacacttaaaacactagtgacaacttgagttgttgactcaactcgatctacatagctttcagcaggcttgtatccctttttagtaaccacttctaccccaagatataccactttctctttccacccagactgaaaccacttctcaaactgttcattgttggttaccttccattcagtcccactatcaaagtctaatccccacactacaatttcttggctaggcccccatattaccttgctagtcatatcatcacagaatttatctaaactataacctttgcatttatcaacccaccaatcatgctcttgctctgacattgatagcaatccatactctaagtttgctacatatgaagcacatttaacaacaactctaacagcattgccaggatcaatcctgacaaaaaaaatggagccaggatcaattctaacagcatgctgcacacctcacacaaagtcaagagaaggggaatacagagaaggggaatgaatttaccaaggaggacactccgagggcttcatcacgatcagatccacttcacctccgccagctatacgtcccggatgaccggccgatgcgttggcgtcgcgtgcaggcgcggtggaggggaggagctagcggggggactcgccctgccgctgccggctgggtcgtgagagccggccgcgacgcagtggcgtcagggccggcagcggggcggccgcgtgaggctcccgccggccgcgacgggactcgctctgcgtcacgcagtagcggcctcgccggccggccggcgcgtgtgggttccaggcggcggcggcagtagggttcaggcggcggcgccaatagggatccaggcggcggcggaggcggcgggggtttcaggcgcagcggcggcggcggtagagtttcagggcggcgacggtagggtttgagcagctgtggtcgagagaaagagatggatgccgatgcgtttctgtttccccctgttttctcgtttctgcacaagggcacaaaggtaatttcgccaggccagtccacattggcatgatgatgtggcgctccaactcagcgaaagtggcaaaaaattaggatgtaatctctctctagtggcaaatatgttaggccaaatctaatagtggcatatggagagttggcactcataagagtggcaaatagttaaatttcccggtgtggaccgtgtggtgtggatactctcgtcagtcatggcaagttttcccttcggatgcgactggtcaattggtcatgccacgcatgaaattcgcgcaccagtgtcaatcctgttcctgaggtcagcaatcaaaaattattgaccaaagaagatcctacttcctagggtagtttattttcggattggttattcaagtttatctttaacagcatatacaatagcagagtataaaccagctgcaaacatattttaagaagataaatgtggagagagaagtgaatcgggctacagatttgtagccagctgtagcacggactccaaaacgtagtgtgtgtataacaggtaggatcagatattaataagctattagattagctatatatgaattggagctagtacttggctataatattaaacttgctctaagggtcactttcaaaccgcaaatgaaaatggctacaccgtagcttcctataataacgtttcccaaactgtaggtccgtttgatataactctaacatttaaaactaactccaaaagtcaaatcgtacatgaagcagcctaaacttagcttcactcctagttaattttacgaaagcgcttcagtcaactctattcccattttagttggagctgaaatgttttaccgggcttcatctccagaaaagatggagctctagctggaaccgtgcccaacagatcatacttaacagcatattccgtaaaattttttatataatattttttaaaacaaataaataagttagtttttaaatttataatagctaatacttaattaataatcactccgtttctaaatatttgacgttatcgacttttttaaatatgtttaccgttcgtcttattaaaaaattaagtaattattagttttttcctatcatttgatttattgttaaatatacttttatatatacatatagttgtatatatttcacaaaagttttagttattataaaattaaacaatatatttatttgatattttaaaccacgtagaaaattttcacatgaaacataagtttaaaaacgtgctaatcaaaatcgtgatgaaatcggtatgataacaagaaaagaacaatattactactccttccatccctaagggcgttcacagtgtgtcgtcgtggcttctgcctcgactcactacatcggagattccatgccacgcatgcatttggcgtagccaagtgaagaccgcggagccaactttgggcacgcgttctgtaacggcccgcctctctcaggccggacccacttacatctagctgctcttatatgttcaccacatcggagattccatgccacgcatgcatttggcgtagccaagtgaagaccgcggagccaactttgggcacgcgttctgtaacagcccgcctctctcaggccggacccacttacatctagctgctcttatatgtgtcgtcgtggcttctgcctcaactcaccacatcggagattccatgccacgcatgcatttggcgtagccaagtgaagaccgcggagccaactttgggcacgcgttctgtaacggcccgcctctcccaggccggacccacttacatctagctgctcttatatgtcatagactattgaagaccacggagctaactttgggcacgcgttctgtaacggcccgcctctcccaggccggacccacttacatctaactgctcttatatgtcatagaccgcctctcccaggccggacccacttacatctagctgctcttatatgtcatagactgccctcacagatcaacacaagtcttttctgcacactttgtcctcactcgtgtgcactcaggaagaatttcctgattggttacccatcccgaaattgctccaggccaagtatgcttaacctcagagttctttcgagatcggcttctggaaaataagttgcaacttgttgatatgagtattctattaatcctattaagccctggctcgggatatcatacgttcttcctaggcttggcaggcatgcgtcagagcgagaggtgaggaaagacgaggaacgggatgcacgacgtgttgggagagggcatggccccgtgcttcatcgcccccaaagattgcgctagacagatcaagcgaggtcgacggtgcagcgtcgacgtcctggagagaagagaaggcagcggcggtggaagaggaggcggcgaaggaaaaggcggcagtgaatttggcgcctaacctcgtcgtcgtcctcgttccgcgccgtcggtggggtgggtggaggtcgacggccgcagtgggaggagaggagggggcaggcccgcggggaatcgtcgtgcgccgccatccctctccccgtggcggtcctcggctccgcgacgccgccaccagatcgggcgagctcggcaacgacatcgatggcggcttccggccccggagacggtggcttcctgcccgccaccgtcgccgcttggcctcctcgacccttccgccgttcgtcgcccgccttgttgagtagaggggagaaagagaggggggaaaggcacgtctcttgaggagagaggaaggaaaagcttggggagagagaggaaaagttgtttcacatcgaccctactcaaggctacttacactggagtatgaggtttgtaaggttctttgtctatgtggcatacgaggaacattaaaaatcgatgacatacagtaaacgtcctagatgatactagtaatctgcccgtgctaacgctacggaaatatttaataatacaaatcaaacaaccaaaataagatatatgttttgccaagcatataatgagatagaatttatagtaacgtgcatgcgtacaacacattatttacaatatgtataagaaaaataattacattcaagatgtaaaaataagatataggacaaagcgaattcatactttaattacatttctgagttcaattgtaaacaacatacatcaaattttgaaaatgtttcctacttaaggaaaacaaacttcacaaaaagatttaccatgatacatcttgatttgtcatgtaaatcatcactttttgccatatccatgcacatgggccaaattaattaaactaaggttttccttgccatggagcttgtgaagcgcataagcacaattagatcacaaggaactacttcacaatgcggctcaatagacaataacatactccctccgtttcacaatgtaag

SEQ ID NO: 83411 - DNA, 36166 bp, Oryza sativa
agaatgacttacattgtgaaacggagaaagtatatgacaaacgccggtgcccagggtattccggctagctccacagggtggtgggctagaagcctcaccacttctaagtatttgatattaggtcctaccctaatatccgcatctttttgacaataagatatcaaagccataatattcgcgtcttttgacaataacatatcaaaggcagctttgccggtgcttcatcgctatgctctcccatcaactccattcatcgcagacataacttcgttatccatgagctttacagtatacaataaataggatatagattccaaaatactaagcatgagaaccccatcatataaatgacaccaaaatcttagtatatcaaataagtgtcaactgtgccaattcgaacagcttctccatggtctcaccagtcgcacactgcattgagtaatccagagatatgccttaatactttctgtcaaccaacaagtacgttagcaatgaaagtagaaactcacacaagcaacagcaggaatttaaacccttacattgtcatttcctagcagcgctcgacatcatccatcagatcatgcatgttttttttttctctaaatcggaccaatgtaagcctgctcctcccatgtgttgcaaaatgccaaaccatagtgagcctgaagtccatattatccatttactttgatatctgaaatcaccatgccagggttttgaatcaaattaacatattagaatcatgtgaattaagccagggactccatgcaagaggtaatggttaaaccggcaagagttaaaatattttgattaacagatgactttagctaattgtgacaaagaatgacataaaacaaatatcaatttttgatttctttcatgatattgaagtatattaattgaagggatgatatatatttacaggacacttagggcttgatcggcaagcatagatttctcaggggagattccctcccaccacccaattgccctccactgtgggattgtgattgtttggataacagggagaggcggggatattgtctcacatcaaattcagaatttacataggactcatgcattatagaagtctggccaaagtttcattatcctcaaattacagaaataatttgcaacggaaaataaaatgcatggtattaagtaatcatggtggctagacccttccaataatcgttgactgttgttggtcacaattgagctgccgctagccccaagcattatgcccattcgaaccattttcatgttattatggttagactaatgtatatgctgccatagatgccattgcgtgcagctatgaaaaagctctgtaaccaaatatcaactaaataatcaatgcagcaaattaaactgtggaagagattaatcatcacctagaaccaaacctgttagagattaattgatcgggagggaggcgaggagccgttggattgtcgtcatcagaaactctatactctatagaagcactccaaaaatattcaaatcttatcggaaagcactccaaaacttccgtgttcatatccctatgtaaggaccacagaaaagtgcagttgttgactctgctctcctaaaaatcccactttacttcaacttcctttttcaaagtggctagaaggttaaatccaggcacctcaaaagaaattaaccaatacatgagttctaataaaaggattaggttgtggtcacagtagtaatctgactgtgagaaatgagtcatgcaaaaaaggatgaaggattagtgctaaaacatggcaataataaggcagcactaacctgagaaatatcaagagcctttcttccacttcatcagaaaaaggattggtgtaacaattttatggggaatattgtcgataggaaacaacttactaaaattctgcatgaaaaaaatttagttcctttccatcaatttgtttagaagaagcatatatatattagtcaaagtagggcaatacctttcagaaaatacgaaaagttcaaaccttttttttttcgccaatgccaaaaggttcaaacctgtaggaaaggcaaaaacatgagaaggattcacatagtattgtggtaaaaattgtgctcatcctgcatcagggcgtccaccatcgtatagagagtatagtagctggaacaactattaccttaaatacatatgcagcaagccaccacgaacaagtttgattattttgtttgaagtcattccacaaacacttccgaagcacttcttggtactgttgcagatgcagtgatgcaaacaatcatctcggacttatttgggctagggaaagagtccaagctgtgcactgatttttatctcgtgttctaatcaaaacaaatgaaaaactgagccatgctcgggccaagacaatgaagatataccaatcaatcagggagcagcaaatcgaaatgctcacatgtgttacttgcctccatgtgttttggccgccgtaggtggacacctcccattcttggatggctgcaagctcgtccgttccggttgtcacgtcggcgctgggagtcttgccggcgaccgtggtggcaggagactgagcgagtgggcggccatctggctgcgtacaaccaaagggttcagggacagccgtcggtcgaggtgaatctgggatggccgccggtgaaggcgatccgatctggagggaggcgcgatagaaagaggagggagggcgcggtgattttactgggggaggggaggggaggcgaggtcggatcgggagggaggtggggagccgttggatcgacgtcatcagatgattttcgatcgttggatgtgtcacacgattaataagtaaaaccatttatttaattatagggtagattttggttggagtaaaacatagccatccatatcctcccaccgtcgactccgcgagtgctcacagtccaccaaacagcaacccaccgaaaataaatcgcgaatatccgcagctgctttgcatctgtggcgcgccgcgctgcgtcagatttctcctcttcggttcccctcgccaacgtgtcccaccacccaccgtctattttgtcccctctaaaaccctccctttcccccgcatccacggccctccctctcgccgccgccacttccccctccctgacgcttcgccgcagcgaaaggcggagagagcggcgcgcgcgcgggagagagagagagagagagagagagagagagagccgagaggagcaagcgagaatgtcgccgatgctggcgacgctgccggacgtcacggccgtcctccactccccgtcggcctcgccgccgtccggcctccgcgcgccggcggctgtggggatggggatggcgaggacgcgctttctcgctccgcgggcggcggcttcggcggcctccgccgtctccgcgaagccggcggcggtggcgccgctgtacgcggaccgcacggtcgtccgtatcgggctccccagcaagggccgcatgtccgagcaaaccctaagcctccttaaggtctcgcacatcgtctccgttcctgcttccatctatcgaattctgtatttacgtggtgattttgttgactttgtgttgttattatgctgttcatgcctcgtggtgcagagttgccaattgtcagtcaggcacctcaacccgcggcagtacaccgcagatatcccgcaggtgaggtttccatctccattcattgtcttctatcagttcgtcatttctgtactggaaattggcctactatcgaattagtaggccacttaggctctctgattcattgataagtatacgtatgggctagtccattttcaaagcattgcagtttaccatttcctgtatatgcactattgttagtatgaatgcccttttgatggttgaataaatacgcaatagcaattccaaactaaggcccggtttagttccaaagtttgaaccccaaaaacgtcacattgaacttttctacacacacaaatttccaacttttccgtcacatcgttccaatttcaatcaaacctccaattttagcgtggaactatacacaccctaaagttactttatcccttcgacagtatgagtgaaatactgccatcttatacaatattatatttttagtttatttcttcccttcaacaattcgaattttgtctgaacttctggtgcactgatggatgaagcaacagaaaatttgtcccttaaaatgattcaagcatccttgtcaatttaataccccatcgatcacattgtgtgttcacaatacaaggagatgtccttttagaaacagtagtcatttttaatgaaacctagcatagttattgtaccttttccacacttgcatatggttttaaagtttggagagattttagttaatttatttcatttaatatgggtagcattagcagctttaccttcctatgactttgtccctgcatgatctgcagctatttgtggaaatgtggctgcctgtttagaaaattagtattggaatataacggtgtaggagatagctaaggtaaaaagtcgcagtgctatttaaatcacatgttttgatttttttctttcctttatgcaggtcccaaacttggaggtttggtttcagaggcccaaagatattgtccgcaaactacaatctggggatcttgaccttggcattgttggttttgacatagtcagtgaatatgggcaggtatattttgggaattaatgctcaatgttttagctcgggttgtgcatgttagaatttcaatggttactctcattgagaagaggatggcactcgagatggggcaattttctggttttcttcattcactaaacacaaaagccatatcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaaacaggaaaaaggcaccacaagaccaagaccaaccagccaagacttattcctacattctccccctaagtcttgtgcgctgtcttgtgggagagttgagccatcccgatccgggagcaaagctcaaggaacttgatcctcctaaggggtttggtgagcaaatccgcaagctggtccttggtgttgatgtagctcgccttgatgctcccttcctccaagtagcttcggatgaaatgatacctcactcggatgtgcttgctccgttcgtgaaaaacggggttttttgccagggccagagcggacttgctatccaccctgagctccaccgctccagtatctctgccgaggagatcactaagcagtcgagcaagccagagcgcctgggtcgaagcggcggatgccgccatgtactcggcctcgcagctggacagggccaccacctgctgcttgattgactgccagctaacgaggcactcgccgaggaagaagagaatcccgctcgtgctcttgctggtgtcgatgtcgccggcgtggtcgctgtcgctgtacccgacgaagtgtgccttgccaggacacctcgggtagtagagaccgtggtcgagagtccccgcaacgtagcggatgatcctcttcacagcctgctggtgctccgtcgtcggtcactgcatgaaccgactgacgtagccgacggagaaggccaagtccggccgtgtgtgggtgaggtagcgaaggctccccacaagacgtcggtactgtgtagcatccacctcctccgctgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccaccgggctgcgctcaacacgagctggcgtcggagtagacgtgcccggaggagtggctgttggtgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgccgttctgctgtgggctgtacggcgcggtgtagtggcgctgaatgccctcatcagcgcagtacgacgcgaattcagccgccgtgaattcgccgccgttgtcggtgcgcagcacgcgcagcttgcggccgcactccgcctctgctgcagcctgcgcatgcctgatggcgtccgcagcctctcccttgctgccgaggaccatcacccacatgtagcgggagaggtcgtcgacgagcagcaggaaataacgtcgtcctcctggtgtggccggtgtcactgggccacacaagtccccgtgcacgagcccgagccgctccttggctcggaagctcgtctgctggggaaaggggagccgccgctgctttgtcaccacgcagacgtcgcagagctgctccacgtggtcaaggcacggcatgcctcgcaccatctccttggcactgagctgcttcagggcctcaaagtggaggtgcccgaagcgctcgtgccactgccacgcctcgtcgtcccgacgagcggcgaggcaaactggatgtgcgacttgcgcgctgaggatgtagagtcgattagtgcctctggttaccttggcaagaaggcgacgacggcgatcccaaatcctcatgagtccgtcctcgaccaacacgcgtgagccgttctcatccagctgtcccacactgatgatagaattcctcaacgcggggatgtagtagactccggtgagcagcctgtgctcaccggacttggcggtgaaggtgacggagccaacacccttgatctccacgccggaggcgtccccgaacttgacggtgcctcggacgctggagtcgaactcggtgaagaactcccgtcggccggtcatgtgatgggtggcgccggtgtcgaggtaccacccatcagccttgtcgttgctggagccgtcgcagagggagacgagtaccttcggctcatcaaggtggaggaaagccgctgcggccggtgccgctggaggtagctcgatgcttgcgtgagctaggagcagagccggctcttcctcctccacccgtgcgacgtgggcctggccgcgtcgtggctgtcgacagtctttggcccaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttacggccgcctgtcggggaagatgactcccccttcctcccgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgtaggtgtcgtcgccgtactgcaccattttttgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcgcggtcccttgggccgccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatcttccgccgcctccgcctccgcctccgccctggctgctgccaactccgctgccgccagtctggccgccttcgctgctgctgcagcggtctgagccgttgctcgcctgcgctcttctgctgcggcgagcttggcgtcctgctgacgccgagtgctcgaggcgaccgaacgctgagaccgagcgtcggacatggcgcacctccggggggctgctgtgtggagagggggaagggaaaggggaaggaggagcaaccggtgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcaattttctggttttcttcattcactaaacacaaaagccatatcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaaacaggaaaaaggcaccacaagaccaagaccaaccagccaagacttattcctacagtgcataccgcatacctctagtttcatactaagtttcttctatacttatttatagcatacataatgttcttaatttaatatttatttgactttcttagcaaggctttaatagatttatacttgtacttatctgagatttcctgtggcagggtagtgatgatttagtagttgttcatgatgctctcgagtttggacattgtcgtttgtcccttgcggtatggtgttctagaattgcatccatgcgtactagttgttacttggttgaagtttgtatctgtctgaaactgtcaaattgcatgatcaggttcctaaggaaggcattttcgagaatataaatactctggaggatttggcaaatatgcctgaatggacacaagagagaccattgcgtgttgttacaggatttggatatgtatggtcgtgaataaactcaaagttgttcaagtgctccccccctcttggacattaatttgctgttcatttacctagttattttattgtattgcagctaggagaaaagtttatgagagaaaatggtttcaatcatgtttcgtttttagctggagatggagctcttgaatcatatcccgctgtgagattgcacttctctaataacttacttaggtttctttgtaacttaaacttcctttcttttttgtacttctttgtttatctagttgatatattgatggcacaattctgttcctccataatagttatatttagatcctagtaaaaccaaatttgcatatttctgtcccaatatttcagcttacaagattggtatttgcatggtattgtctgtaccgctgtagtattgtttgttatttctattttattatgatgttagtatgttacaaagctgcatggaatttaagtataccaataccatactttactgtaatttgaatttgaattgtaatagatctgaactgaaatttgtctttacttctttattctatattggcatgtttgtcttgattcttgatatgtgaacttgtgtgttcttacataatacacaattagcctatcaaggttaacaaatgctaagaattcttttttcctcctgtgaagatgggtatggctgatgttatcgtggatcttgtgagtagtggaacaaccttacgtgagaataatttgaaggaaattgatggtggagtagttttggaaagccaggtaagcctaacctctccctcccttcctctcacgcgtgcacacatgcatgtgggagagcagatgcctggtattttaattgacatttgcttcatcaaaagataaattgtgctcatttacaagatatgtaatatcacgcaggccacgcttgtcgcatgtaggagatcgctacacaaacgtaatggtgtcttggagattacgcatgagatgcttgaaagattagaggctcacctcacagcaactggggagataatggtaaaccaattttgtagcttaaattgggtgattactcaattaattgcttacttattatactttacattgccatataaggtcacagcaaacatgagggggaacagtgcggaagaagtggcggaaagagttctcagccaaacatcgttatgtggattacaggtatcactaaaagtatccaaagtagtattttacctttttatatactgaccatgaatatgtgcacttatgtggcagatgctaaaatatctctttaaaaataatattattttccacattcataaattagcactctataatcttgaactggaaatataattgtattgtagctgctctaatatctagacctgattaatcttcatcataatctgggcaatttaaagcttttaggtcctttgaaataaaactagttttgcatttcaaacttatagcaaaagctttgctcatgattatctgactggaaccactgtagtttgaaatactgatgtggaaaatcactaaagcttatgagttgattcactcattttgatttaaacagggcccaaccataagtccagtctaccgctcacgtgatgggaaggttgctgtggaatattatgcgattaatgtagtagttccacagaagtctctttacaagtccattcaacagctgagatctgtaagatattttacctcaatacttttaaacggaaatgtgtgcctatctccccttattctcccttttccttttctgtttcatgtgggcaattgtctcttatctttagaaattttctaatgttgtagtaaaaggtatatttatgtgcttatatgagtaattatcaaaagatgtttctgtgctattctcactgctgtcagcgcaaaagataaatctgatatgggagctcataatagaacttattgtcagaacatatatggcccttgctatatattttttgaacgtgtatggcttagttccattgataaatccaattgttttaatgtgtactcattaacttgtaactgcagattggtggcagtggagtcttggtgacaaagctgacctacatatttgatgaggaaactcctagatggcgcaaactactttcggagctggggttgtgacttggtgtgaagtctgccatacttctctgtcaatgacccttttagcatcggtttacttatgctcgctgaagtatactacaaccataatcagaaatgagctctcgtttgaagtgtctgcggtgcttatttgagaggaaattttggtctgtgccatcgtacattgtgctcgtctagttatacctttgacaagcatatgggttgaaataccctttatgtacctgttgatataattgtgagaccttattgccttgttggataggtgtgcgtatgaattgtaccttttcttgcgtgacgctgaataaattgggctttctgcaataaagatggatggtgtaattccaccccgtagcaaatctgtccgcctcctatgatgcaaggctcctgctatctttatccttttggggttgacccggggttactatggaagagtttgacaccaaatttgctcttggtgctggatctgggatgataagggaattccaaattaccaattctaatttttcttgtcaagttcctttcctcctttctttttacttgtcttgaatattgccagtatttacagacacatctgtacatttgctttgcacggcaattttcatggtcaaattgatagagcagagacagaacacctaccatatacatgatgatattgctttcagaatttaagttccatgaaaaagtaatccaatatgagatggcgaccctttgcacgtgcaggtatagtgtagacatgacaaacagtttacataatactgcacacatattatctttgatagatttttgcatatttttacacaattggaagccttatactcactcagtcactgatggcgcacacacaataaaaactgtttaaaaactgaaccaaattcagagcagagctggtgcacattttctcccagctgcttatttactatcggcaagcacgagggtcacggctacaaactacacgatcaagtcatggtgcatcacgcctttagctgcagacgtgcagagcctcacacatttcgccgtgcgcttacccggacctcgagcggcactgccatctcgcacgacaggcggagcacctccgacaagtcgacggcgccggacgccggcgtccactcgaactcgtgcagcagcgttgccatccaggcggtcacggtcgtcatggccagtgacttgccggggcagctcctcctgccggacccgaacggcacgaggcggccgtcggcgccgagcacggacacgccgtgcgccttgccgccggggaggaaccgctccggctggaactcgagcggcgcgtcccacacgtcggcgtcgcggctcatcgcccactggttcaccatggcggtggtgccggccgggacgaggtggccgtcgacgtaggtgtcggatatggccctgtggcgccacgagaggagcgggcccggcgggtgcatccggagagcctccttgagcagcgcctgcaggtaaggcagcgacggcacggcggactcggcgaccgtgttgctccgcccgaccaccgcgtcgagctcacggtgcacgttggcttggacgtcggggtggaggacgacgcgagctagtgtccactccatcagcacggccatggcgtcagttcctcgaaagatcatctcctgataatttaatgtaaccacggttttattatttactcatttggttatgtaatacgtacgtcagggagtaactgctaccatccgtttgtatgattctttctacatataaaatctgaaagaaatagggaaaaagttggtggaattttgcatgggggtagctttttctaaaaaaaggttttattttgtttttcagatttgatcacaacaaaagttagttttgcatgatgtgtttacacctcttttatagaactgtttgatgccatattaatccaagcacgccaaaatatcaaagcacacggatcgtacccaaagcacggcggcgatgtcggcgtcggcgagcccctcgctctcctgcagcgagagcaatatgtcgacgaagtcacgtgcctctcctccggcgatcgccttgccacggtgctcctggatgatgcctcgcacgaagcggttcacccgtggcatgagctcggcgcaccgtgctccgacgccctgcgggtcaacggcggcgagccccgggaagtagtcgcaccagttctccttcccgaggaggtcgtacccttcgtgcaccatctcgagcagctcctccacctcctccccggactccggcgcgccgcgcgacacgtcgtactccttgccgaacacgaaccgcatgatgtagtagagcgacgcgcgccggaggacgccgcgcacctgcaccgcggcctccccgcccgcgccgcgcagcgcggcgaccacgccccccgcgacgcgcgcgcggtacggggcgaacgcgtccacctgcctcgggccgaacaggtggcccgcggcgacgcgccggagcgcgcgccagtacgggccgtgctccgcgaagccgatggagcggtggaacatgaggccgtacgcggcgtggttgagcggccggtcggcgaacgccgggttgtcgaggatctccttggccacgtccgggtgcgacgtgacgaccgcgcgtaccgggccgagcgacagcgccatgagcctcttggcacccggccggcgcgccgcctcggcggccagcgagcagtgcgccagcccggacatgaggccgaggcttccgacgaccgggagccctttcggccctgggatcgaacacctcgggctctgccccctcgccctccggtacttgccccatgcagggccacccgggtgagcccagtagagcagagcagtgcctgcccatgcaaggcatgcaaagatcgcgaggtagacgaagctcgtggccatggctgacagtgtggcagcgctctcattttgccctgagatgggcgggaggaaggtcagtggcagcacccaccagttctcagctgctgagctctccatttgcaatattgcactgtgctgctgctgtgaagttctgtgtgctctgagctgcagctcggggagctgtatttataggagttttggagcgaacattccgtcattcctcctccggtgtctcctggcaaagatgattcagttacaatcattggcaataaagaagactttgcagtgcaccgttgagtatagtccagtacagtggtcctggttcctctgtttttccattcaggtgatcactgaccaggtagttcagtttagagaaaataatcaaaccagcctagctagtgtatgtaaactgcatggaaatcgaggagaaattggtctcagtatctgctaagtgaaaggttcaacgagcggtatacggtacaactcctgtgttgtactactacttggtctccaacttttattctgtcgcaatcctaactggccacacgtacgttcttcagattagtctagcttcaattcgcgacacctgtactcctgctaaccatacatttttggcaagtcctaaattatgagaagcctggggtaccaacaaaccatagcccaataagtctgcaattgcagcttacgtgttgctgatatatagatctcactatattgtgggtgtagagtcgttgagagagcgttgcggctgcttgttttctcgacagagtttgttttcacatgctttgtttagggcgtcatgaggacattcacgcaagacgcaacgactgcgcatgcaggtgctaactaaaattttatattgtgcatcagttggtgtggaacacaataggagttagttaggcccctttcatgttacacatgcatgcttgcttggtttttatgctttatgcatgaactgtcctacactaggatcagtcagcggtagcgcatgtacctgtcagagtagttaattatacactaactatagtaccattattggatggaccaaaagattaattacactgacttgcttagcctcgtcattagcagtacgtatgtgggagtaatttcgtcaccccgcaaaatcttctatgataatgtccccatccctgcaggcagggatatgtacaagtacaactggccaaactttatgtatgcacatgtacgtatagtatcacctgtgcaatgtgtgagcagttgcgcaggaacttatcaggaacacgagagcaaaaacaaatgaaattaatgcattctctccttatgaaaatataacaacttctcgcttttaaaatttgtcctaaaatataacaatttcttcaccaacattctctttttaatcaatcacaattccccaccattcaattttcccacctaacttcacttctcctccaaccgcaacactcgatctcctatttaatcctaccaactttcttaatatctgtatctaactctaaaagtacttatattctaagacggatggagttcaaattaagactgttttaaatcattcaacacaatcggaaggtaattcagctataagtttaccaaaacacaattgggcgggcggaatctaaagtggattgagtacgtggttagttccgcaaatcgtctgcgcccattgtttcatcgaaccaaataacttcgtttcgtgccgtttaggtgtttagctgctgcagttctacatgcataaacagcggatccacttaaaaaaaaaaatccaaaacaccgaactgaacctagtacaattaggattgaaatactctgactaaaatgtgaaccctctaccgagcagaaccacatatcaatgactttgtcttaaggaagtactcccttcatttttttaataaataaagccgctgacttttaaacatatctttaactattcgtcttatttaaaaatttatattagatataaatcaataaaagtgataaaacaatttacaacaaaaataacttataattacgtaaaatttttaaataagatgaatgattaaatgtgtgatatatataaaaaatcaacacgtcatctattaaaaacatgtagtaagtcagtacaccacatgtcctactgtcttgcattggatccgccactatatactggaacgcacgcgcacggcgcacaaccacctgagagcaaggatactagtatagctcacttactatctataggctctctccaagagatctatgtcaacatattttcctacttggaagagattaaatgaagagagagataaaagctatctattaacctggagatagtttatagagaaaaacgaggcaatggattagagagctatagatacccatgtatatataccatttaagtggtttcctattaatctagtctattgctgagatgtacatgttttatagatagcaccttattttactattgtgggtgctcttagcttatcttaaagctaacatatatataatagattagatataagtttggctataattttcttctcctctctctatctctcatacatttaatgcatttgtcttgagttttcatacatttaatgcatttgtcttgagattgtgttaagttagtctttgcatgagtgtcaatccccttgatttttttttgttacctctcttctccacataagtttaagtttataggtttatagtagatttatatctcactattatacttctctggaagctgaaagagctgacccgcgaggccgcgactgttgcctaactccttgggaagtacgcggggacaaccgcgcgcctaacataacgcccctggtgccaacaccatcgcgcgcatggacagcgctcccgccgccacaaacacatctatcgggcggcttccgcgcgtgatccgccaccgaaatgcacccgccgcgacgctctcattctgccggagcgccggtaccacgcgcccggcggaatgaaaatgcggccgctactacgtgacaggacgccactttccagcgaactcctcgtcaacatccgcgcgcatccccatttttttatctgagcaaaacaagaaataattttttttatctaagcagggcggtgtgaatttttatttataaacaggacggcgtgatttggtagcgtcccgttagcctaattagagcaagtttaatagtataactcactactagctctaatttatatatagcaaatctaatagtcaatttatataatagttacttcctatactattaatatatggtcccttgtcatatatgcattgtatcttacagtctgtgttgcagctggctatagatctgtagcccgctgtttttctctctcatcttttatctcactaaaatatatttatagctggctaatagtctgctattgtacctgctcttagacggagtcttttacccctatgccattaagaaagttggaggttacgcgtgtgccaaaaaaagttttgagttacatgtattaccatgacacaaactttcgtttacccgtgtgccattccatccaccatctgttagagaatgagctctgacatgtgggacccacgtatgaaaatgactaaattgcccttgaagcattttcatctctactactcctctcctccagtgcgcctcgaaccctagccgctgctgccgttcgtcgccgtcgccggcacggtgccgccgcctcgcctcgtttatccgccgccggttgtcgccggcacgccgccgtcaccacctcgtctatccgctgccgcctctctagcagccgccgccgacggtcgttgccgtcgccagcacgccgcctcgcctcgtctatccggcagcgcgcctcgtctatccaccgccgcctctctagctgccgccgccgccagtcgtcgcagtcgcccgcacgctgctgccggtcgtcgccgtcgcccgcacgctgctgccggtcgtcgccgttgccgccgccttgcctcgccggcacgccgccgccaccgccgcaaaagtggctgaaatagaacaatggcaaaatagatctttcaaacctccgttagtctccattagtgctgattccatccaaagtggcgcacagttaaacgaaagtttgtgtcatggcatacaggtgactcaaattttttttatggcacacacgtaacctccaacttttttaatgacataggggtaaaagattctcttagacgcggtttatctggagcgtccagtcttccagcggacgcgacgttgttatagcgtccaaggtttctaaaaacacattcatctgctcacagtaccccaaatcagaaagggaaaattgaaaccatgccattataattttgcaaaatttaagatatgccatcctgacccacatgtcattgactcatgtgggtcctatatgtcattgagatatcgatggcatatctcaaactttgtaaaattataatggcatggttctaaattacccaattagaaacccaccattgaagcaccgatcatgagcctcggcggccgcggcggtggcggctaccagtggcgctagttcatcacgatcgagccttggagtgtgtgcccgtggccgttctgggtgcgcatccacgagactgagtctctcggcctcacgcgcggcgtccggccatctggttaattagtcatcctcttacacggccatgtactggttgtatgattacctcttttcgatttttgcattcaagagtaaatgagtaaatcccgtgtggtattcttttctttattcatacattgcactgatactgcctcaggcgatagctgtttcgtgcttatgttttagaggacaatgaccgaaatatgagcaacagccatcgtagcaagtgcttgtaagctaatttgtctgtccattctggcctgttttctcaacatagcaagatgattaaggagacaatagacaatagtgtgcacataatctggaaaaatgatttagttttactgtaggaccaatcaccatacaatcctaatttttgagttgcagaaaaaaatataccaattgtaaattgtttgacacgctctattaatttttttaaggtaactagtaagatgagggctactcaagatgggctaagtcggtcagctgcaagaagtgatggagtgcaagaagtgatggagagctaggcttattagatggagatcaaactttagttcagcaaactgaacaaagtgtttcagaacgtttcagtagcactgctgtggatgccccattgccagctcaaaatctcaaaagtttagaaaaatgtaagttatagcttgtttcgtatacttgtttccaaaaaataaaataaaatgattgactaatttttaccctatgtatgcaggctaatgatggtgtgtaagagtgtcaggtttcaccgtacgtgttggtagcattctataccatttatttatgtgagccgctattgaagaggcttggattttatcaagttgcttagatgggtggaatgggtatatatgtgcagtctataagtataagcgatgtatactcaatgcaaaggactactgtgcatattacaaaggagtacatctgcatctagcagcatcggtgatgatgatagttatttgatcgatgcactaaagtttttaatcataatctccatctagcgctgcaaccattgcaggatataaatagaataaatctaaaaatccgctacttgattagtactgatgtctaatcaattcgaaacaaccaaaagaaataccttagagcaaataatctgcgatccccacttgaattctgatcatctaatgtaagatttgggcattattagttctccagtaagagaaaattaggagagaagattagggatatgaactgtaggataatgaagaaagacagcaataggccaggtaccagaactcagcagcgtgcaattccgatccgtttcgttatctttgttgcgtgtgtgcagttgctcgggcaaggccgctattatgtttccgcgtccaggttcccgttcaaggacacggtaaacaccaggcgtccaagttaggcgctggcaaagggtagcatccccatgaaaacaacaggacgctacatgaccacaacgtcctgcttattaatctaatttaatttctatgatgctaaaacaaaaaaaatatatttctcatcctgctcagagtaaaaaaaatcgggcgcgcatccgtgtgtgcgggaaacgcgcgcacacgtaggttacgcagccaagcggcccgaatcgatcgcaggttgggtgaggtggccgtgatggtacgtactacgtactaccgcaactccatcacgatacgaaagtgggatcgtccaagagcatctctaccagcctctccaaatcaaactctccaaacactcatatagccaactctccatctgatttagagcatctccaacagtctccttattcaactctttaagttaaattttagcaattttaaagcaaaatcgtgctccaacagactagctaactggatggccaagccatccggctagccaaactactcctcccgccggccaaatttggccagccaaaatagcctagccaaatcgtgggtcccaccgctttcccccctctctctctcgtcagatgaacgccggcgccgcatcttcgccgcttcgcgccaccgcccatccacgctggcgccgcccgtccgccagctccgcccctccgcgccgtcgcctctcctcgccgcccctacgccgccgccgcccctccgcgccgctgcccctccgcgccgcccctccacaacgccgcccctccacggcgctgccctctgctttgccgacgccgccggggccgcccctcctccattgtcatcctttgccggcgccgcgccctccgtgcgacgatgagaaggaaggaaagagaaaaagaaaacgaaggaaggagaagagagagagatgggaagaagaggagtggagactgaaatgggggtgccgtgtagtttggaagagtattaatagagagttcggttggctaagccaaattagatagagagttggctatatgagtgttggagaggctgttggagatgctcttagctagtcaaactacatgcttactccaacaaactctctattaatactctccaaaataaaatcggacccacatgtcagcctctctccccccttcttctttctttttccttcttttcccctttccttccttcctatcgaggtgtcgaccacgctgttgccgacggcggccgacgcatggcgtgcggtggtgcgatgacgcgaggaggcgggaggcggtgcggggaggctgccggatctagaggccgccgctggctttgcggtgacgaggcgacggcggcagacgaggtgggaggcggtaagcgatggcgcccgacgacctcgacgacgacctcaacgatgacgacggcgcccccaacgacctcgacgacgaccccgacgacgacgacgacgccgcccctgacgacctcgacgacgccctcggttgtagatgacggtggcttcggcagtggggcggaggggcagtgccggcagagggagggcgccggcgcggcggaggctagaggggcgccgaatctaggggatgggtagagaagttgcgtgatgaggaggaagtcgtgatctggggagggggagagtgtacgggatggggggggtggggaaaacgcgtggggcctacaattggagaggcgattttggctggccaaagttggccagcgcgagaagaagtttggccagtcggatggcttggctagccagttagctaggctattggagtgtgtttttatccaaaattaccaaaatttaacttgaagagtgggataagaagtctgttggagatgctcttacgccagatttggctttacagcgaccccaattctctgcaagcggacttccgtttgtctgaatccttcttatggttttgtacttcagttcagtgcactgagcctagctaaccacggatccttaataagatgggtagtttggcctctgaatacagatcgtacgcttgcaatttgtgagcgtgatacacatggttcggcacatcgcaatgattcaatggatcatcatcattgcacgcatgcaatcagaaaaaaagatcaagtacgatatattactcctagttgttatcagtagttgttgcagggtatattgactggctatacatagtgctgcacgcagggaaataggggcatcttccctgcagatggtgagacactgtgcctaacctaatttgctgagctaagctccagtgcagactagctcccctgattctagctacttcagaatacatataaacaattctccgctctatacgttttaggggtcaaaattcggatagaattggattcgatcaaagatttaagcgagcaaagtaaatctgatcgaggcaagccagtgcacgcacgggcttcgcaaaagcgacatttatggttaaatttgattcctgctccttggccaatgcgatgatccattgctttgacttgtcaatatcaggaccagatgcgcaactaactgatgattttgtcctcagcaatgcaaggagatatccatttgtcagtggagaaccctaactgccaaaaagtcgaaagtgaaaagacgggcatgcgattctgatatacgcagctttttcgatgataaatcgaaagcaaatcctttcttagggccaatttgtctgtataaatatttttgaattgaatagaattgattcgatctggcactcattttatatttggcagaatcgaactttcctgtttctgcacacttgcggagcaattttctgttgctgctgcatgtatagcccacttcctctctcctgttacgtttgatctactctatgatccatacaataagttaatgaaccactttgtatacaatacaaatggaataatcttcctgaacttttttcacagttattatagctcaacgacccaatccaaattatccatcaatcaggccatgtattcttaggtcttcgtgttgttgcctacaaatccactctagtgaaaacaaaggacgccgacgttttataaaaacaaagaggtgctcttacacatagcaccacttactaatctttagctgttctcctcaaaagttgccttgctacaataatctttcaagctagttaatgatcacacagaatgtggcttttgattgatccaaatacaactagtaccaaagccttataatcagttatatgtgctcaataagatatagcaatgccaacactacacctacttgaaaagtgtttatttcactatgctcctgtcactggcccataggctcttagcatatattatacatagaagcatatgcaagatcagtagatcacactaaagtttgcatggttcagattgagcctcaagatatttcaggatccagtgtgaaagcctccttttctgttgccaatcatctccattgaatgcaatctgtagtaaattaaggtggtgtttggatccagggacttaactttaatccctgtctctagacactaatttagagtattaaatatagactatttacaaaaactaattacataaatgaaagctaattcgcgagacaaattttttaagcctaattaatccataattagagaatgtttactgtagcatcatataggctaatcatgtattaattaggctcaatagattcgtctcgcgaattagtctaagattatggatggattttattaatagtctacgtttaacatttataattagtatccaaacatctgatgtgataggtacttaaaagttttagtcccatctaaacagggtctaataaccgatcgaacagtatgattgtttgaactcatggatatgattatgaagcgctatggacacgccaagccacacgcccacacttgatttgattttgcttatcaccgtggcattgattcgaacaatgtatctggagagatcacatttttcaaaacaaaaaaaaaatctggggagttcagttcagacgtagcacacgcatatgcccctaaacggctttaggggctgtttggatggactaatttttaattcttatcacattggatgtttggacactaattattagaagtattaaatgtagattattgataaaacctaatccataaccctggactaattcgcgagacgaatctattgagcataattaattcacaattaacctatgtgatgctacagtaaacatgtgctaattatggattaatgaggcttaaaaaaattgtcacgtgaattagctcttatttatgtaattagttaaaataatgtccaaacatccgatgtgagattagaatttagtccctgaattcaagcatcacctgaattccttttcagctagcagaaggttatccattgtttttggttgcatcctttatggctaaacatacagaaaatttcagaggcaattacctctgttaatctacatctcacacgttgctaaaaaaaaatccgggctagaagaaccagttgtagtgttgtaccagtaataatttacatgtaactcaaatatattctagtgaaaaattcatccatgatcagtatgctgctaaaaaaaaatcattcatgcatatttgtgagttttcaactgtggcagtaaacttcttaagaacttccatactataatctataatatctcacataatctgcagcaaagaatttgttcctccagtgcatgggcaacgaccgaaaaaggcaaatcaccatgaaattcgcgggctaaaaagaaaaaggcaaaacaatctggctggaatggaggggaaatggagcgaattcttgctgttgctgccgtgtagttgtgcacttgtgcgtgggaatcatctcgcgcggccggggagaagaccgcatctgaatcctcacagcgacgtcgtggtcagtcagccgagccgttgtctggcggtggtagtggactcgtgcaaggtccaactgatcgatcatcgcgtgacttgactagacttcacttttgagagggagacttgcctggcaatggtagctattgacttagacttcatatttcgtcaactgagatgcaaaagcgctctgtagaattgaattgcagatggagcagttaagcaggtccatctctgtctctgatttggagccctgctttgtataagtttaagggtttattccacgtaaattgttcaatagatctaatagctagttttaatgttagatttgttgattctttggtcttctcattctctttggtgatcggtggctatcgcatttgtaaggtctttgatgtcgggttgcccattattcaattggcagcatcggctttatcgttcagatcaccggtgtgtttgatgacgttgtttgaggatttataagatggtgatcgatttcgtttgtatacttctatatttttgtttgtacaggagttgatcaaaactgtggctacgctcatcagctcgtatctcttatgttattctagcaagcagactatctttatttcgttttggtagttgttcttatttgactattacgtgtaaaaacactaataatctctatacaaatgtaatgtacattgtttcaatgagaaaaaaaaaagatccaaagtagtaccaaagcgcaatgctaagctggttaggtagcaggttacaagttagctataaacacgtggatgagatcagagaagagagaaaaggaaattgggctacagatttataaccaacttcggcacgaacttcaaaatgttatgtgtgtacgagatgtggcactatgtattaatgatgcagtatatatttatagataactattgcatgaatagattattaaattggctatagataatttgaagctaccagttgactatactattaaacttgctcttagtttgtgttcgttgcttgaagttcctaactcattccttctcgttttacgtgtgtacactccccaaactattaacgatgcgttttttcaaaaaaaaatctataggaaagttgtttgaaaaactcatattaatctttttttaaaaaaactattaattaattatgcattaattagtcgctccgttttacatgcaccgcaaattagttcccaaccaccaggaaaaaaaccccgccttatgattgaatctgagccatccagtttaagttctagacacatgcatttatatttgcggctaattattatttcagtggtagcttggtaggtgacatatgcatcgacagcgacacgcttgtatcaacttcatcaatatgaagatatatcgtacaacgagatgcttatgctaactttgttaatttcaagatatacatattgttaattttaagatatgctagataataaaacgtcggtctacgatgatttcgtcaatattaaaatatgctgaataataagacgtcggtctatgatgatttcgtcaatattaaaatatatttatatgctggcttaatttttagaggtgctaatagagataagggtgtgcgtgtgtacgtttataaatgcaagtatgcgtgtgtataataacatccgcgtctgtaccgtatttcgggggaaaaaagtagtgccaaagctgaaattagttgacctcagcatcaattaccttcagtctgtaccgaagttcagcttcattcgcacccccattcgcatcaggcagagaagatcataacgcgcggtactcataactcagggaatctgttgttattattctccacaaggaagatgggccgaaatcccagaggccggcctattctagaatcagtaatacgggcttcccgtcgaggcccactacatcaccgtcgaggcgaccatcaccgacacgccaacgcggcacaaaccaaatcgatcgaaaacgaagcagtccccagatctaatcccttctatcaataaagttaacctcgtgcttccacgccatcattaaattgtaaccgttggatgaatgtattagatcgcttcttagacgttggatgaaatgtaacatatagcccaacccattagtcaccgggtgagtctcttcgcctcctcagtaccaaatgtagcccacataaacacattggcccatctccacacacatctacatgtatccagcccgttaatccgtataaaagagctttatggctgaacaccccttcagttgacatgtgctatctaaattatctacaaattttgaatagggctgttaaaaagaatttctccaaaaaatctatttgtttcttcttgagattgtacctcctatctaacaaattgttgttaaccaagtcccgcagcaacgtgcggggcatcctctagttatccaatacgccctagtcctcaccgacgcttccaccacgcgtcgacgccccggcggcacttccgctccagatactcctcgcgcgccgcgccacgcccttcactcagcaagcccgccttgcgccggagctcgggtacgtgaccgactgctgggagataagagatcgcccgagcccgggattaaggcagaaaataggggagaggaggaaggagtctctgctactttggcggcgtttttttttctctattgctcatgaaagccggcgtgatctagggttttgggcattggactcggtgagtcgttccaggtgtggttgcaagatgttgtagtcagacccagagttttggccgtggcaccatgtcaaagagtgggggattgtgcgcaagcctgacgccaatcctcttggaaggagcaaggggacatggctgttccgctgatttcgtaccttcgtgagttttccggttcccctccatcatcgttatgtgcttttgttatcttaggtcctgttcagtttaatattattttcaaccattttttcgtaaagttaccaaaattttggctatgtttagtttgttgccaaattttaataaatacatatgaaatcttgctaaaatttttgacaaccttaccaaaatttggcaatgtcaaaacttggtaagattgaaaatgatagcaaagtaaacaagcccttatttcccttggatggatattgtcaaattactctaagctccatgcctcatgtactatctgtcttttaggacaaacaaatggttgcaattatatgcagtgtgcttgcgctaattgccaaacatcagttcaactatattataagttcatctatcacgattatttactcttatttttctgtactagtgatcaaccgcccttcatttcagaaataatgcatcaaagcaaatatgcggataagtagaactagtacaacttatgctgtaccacccatccatggctcacatgttacatcctcccacgttgcttatacaaacaatgaatgaataaactacagtctgttcgatctcacgcgcaaacctcaaataaaacgaccataccgacgggcgacggcccgacgccactacgccagctttagagttagaggcgcgcacatcgcttggatttgctctgcactgactcccatatataccacttcgccggctaggcgacccagccatcctctaactcgcaacacgtaagcctgcaccaagaacgactcttgcttgaccatgccgagagcgcgaggtctttcctgcctcatgtcgccgctcagcggcaagcgccacgccggtgacgcacgccgcagcagcgccgcgtgcatatgctgcatcggcccacaccacaagccgtcgtccgccgtcggcggtggcggcggctgcgtgccctgcctcgctccccacgccgaccacagcgtgagagcgcctctcaccagctgctgcggcagcggcggcggcggcggtgacaacaacctccgcggccgcagcagcaccaccaccagcgcgcgcacgccgcgcacacccaagacgccgtgcacgcccacggccaggcgactctgcggcgtccgctcccgcaccccgcgccgcgggcaggtcggctgcttccagtcgtcggcgcctgccgccgcaaggacgccgcggactcccacgacgcagcgcgcgtgctacgtccgtggcacgggcacggctcagggcaacgcgaagctgggcaggcggcgccgctggctccggtccacgggccagacgccacgccgcacggcgcgcgcgggtggcgacgtcggcaacggcggcgacgtcaaggtttacaacactggcctcgtggaggccgccgccgaggagtcggtaacaaaggaagaggagaccagctcgaacgacgagtacgcgctgctgtgcaggcagggcttcccacgcgaggacgtggccgcggtcaccatccaagcctacttccgaggccacctggtgcgcgcgtagaaaaacaaaaaaacttatatctaaccgagacctgtttgtttcggccattggtaagaggattttgcttgtgttttgcaggcgaggcgagcgttcaaggcgctgaagagcctggtgcggctgcaggcggtggcgcggggggcgtacgtgcggcggcaggcggaggtggcgatccactgcatgcaggcgatggtgcggctgcagatgcgcgtgcgcgccaggcagatgctcaccaagcccaaggaagggcagctcttgccgagctgatcatcaaagccgtacgtgtgcagtgcacgaccacgttaccgtgggaaataaacgtcgcctgaataattctggaaatctatcaagttaagatgtttggcatttgttgctgccgagaacatcgacatgggctgttggcctgttgctgtgatgaacttcccgtggatttgtaattctaaatatctgtaattcatatgttgtccttggttttttttacccgtggaaaatgcttaactgtttcgtttgggaataacccattttattttgttttcttttgattaacttgatcctgtgacccgaagaattatttgacctatatggaagtagtttagttgtacaatctttaagatttgttttcatttatcacccaggctatgtcgtgcccctcatgttgcacaagttaattagagcatcaacaacaagctacctatatgatttccaaaactaattttgagggattttaatccaaaaatcagctccaacagatcctctactctcctacccgagttttggagttcccttcccccggttgctcgctccgtttatatgcgggcgcgaaagtcgctcccaatcacgcaatcctgcctctctccttcgttcccgcgcgtgggagatagcgatctttctgcgcgtgaaagaaaaaaaatagaattttctcttggtagtttaacagaagggcccacttttaagttttagggattgaatttaggctatctattggacggaggtgttttttcacttcctattttcagtttaggaaaccaaaaacgaatttttaaaagaaaattatagataatctgttggtgatgctcttagtcaacttgtatcatgaaatcctctgtttcgtaaccggttttccttattgtcatgcattaattagtgcattaccacatgatctaaaaggaaaacggcttatggataaaacagtcaaactaaactcatggaaaggacacaatcaaaacttcactttcatatgaaaggggctggccaacattttattacaaggacgataggtaaactgcgactgttacaacggtagaaaaaccacgatgccgaacaaaacacgtagtgacgacgtactggaggccgggccagacaatctgcgacaaattaatcgacacggcgcgcaaatggcaaaggcgcaagtaaagtaacagtaggaagcatacgtgacaaccccttggaactcatgcagctcgatcgtcgatatgcccatgtttagttgttgtagttctcgacttgctcgttgcggtagtgctgctggccctggccctggccctgctggtgctggtagttgttgccggcggacggcgattgctgctgctgctgctgctgggcgttgccggcgtgcgcggcggacggcgggcgctgcaggctcttgacgtactcccacgactcgcggctggagatgttgttccaccacctgctcacgttcttgcgcgcctcgaacatgcggcgggagcgcgggtcggaggcgaggcggtcggcgttggggaggtgggacaggtcggcgatggtgaacttgtcgccggccaggtacgccgcctcctccagccgctgctcgtagatgtccagcagcttctccaggtccttcttgctcttctcgaacaccttccgcatctcctcctccttctgctgctgcttgttgccgttggcgccgctcgccgccgtcttcccgtccgtcgcgccggccaccacgcgcttgctcgacgcgttcgccacctggacctccctgccattgctgttgccgtagccgttgccgttcccgttcccgttgtcgttctgcttgggcatgttgggcggcaggaaggcgaggctgtagaccatctcggcgctgggcacgtcgaagctctgcgcctccgtctgcagccactgctcgatggacgcgcgctccagcgcgcccgtgccgatcaggtccgggtttccctgcctcgcgtacttgtgcgctatgtggcgaaggatccccctcgactctgcacgcatgtacgcattccacaccattatttacagtcgttcaagtgtcaatccgtactacaaatctcaatgctaattaccggacagggtgaggttgtcatcttcgaacgtgagcgcctcgccgagcggctgcacaattttccccagacgtgtcagtccgagaattgcacaacgacaatgtggtatgcagagcatgagtatacctgaagcttgagatattggggcatgcgctgcgtgccgcggtacgcgtcgacacggacgagctggaactcgacgtccttctcgaagaggcacatgagcacgcgggcaacctccgccgaggtgggtgacccgaaaaccttcacgctcgccggcgccatttcagttgcagtgggcggctagtgactctactgcaactgttggttgggatttgagaaggaagtattatgcagatggtggtgtgttcctgccgtttggaggatagcttgggtgtgcttatatacatgccaaagtggggagcataacacgctttgcttgccaagaggtaaatctaaagacaaaaatcaaaggggggaaaagagctaaagagcaaagcgctggatgccaaagggaaagacaaggctcatctctgctgccaaggttgtcttgtgcatcatatcatcatcacacccgcaagcaaccaggcgatgatgttcattagaaaacatcataatttgtgtgctttaacaagatctagtcgaaaatagcaaggtctgagaagatttcagggtgaaaaaaaggaaagggaaagattctgtttcgccttgatttgttcaagatctgcttaccaaaggaagtttcagattattctactactatatgtcaagtgcaaatatcttcagaaagaaagtatagtgcaaaataactcctagtaattctactactcatgtgctaaggtaattaagttgttgcaaatatcttgagagagtgaacatactacagcagacgaaatatatcagattaaaagagtctccagatcattttttaaagaaaagaagaatctccagaacaaaaacataacatgacaacgtgacaccctgatacatcaaacaaatctcgtttaataaagaagtaggagggaaaagagttcaacaaaacatggaacattcccctcaatctcaaataattatacactaagctgatatcatcaagctttaataaagggtatccttttcttctttttttttattctctgttcttctgaaaagaaatacagggattcatgaatttaactcttcaactcttgttactgtcatatgctaagggttgcaataccgcctcgcaacaagtttaatagtatagccaactactagctctaaattatctatagttaatctaatagctagttcatacaatagttacctgtaaacacaattaatatatgattccacctattatatacacatatatcttggagttcgtgctgcagctggctacaaatctatagcccgttggtgctctctcacatcctttatctcctcgaaatgtatttatagttgacttatagtctgctattgtacttgttctcagtttttttaacacctaatgtatagtgttaaactcaaataataaactcatctcaaaatataaaaacatgggagcattcgtagtattaggataagtctactaggttactgtattctacgataatggaggtagcaaaaaaagaatctttacatgtttttgaggttggtgacaatctcaataattgtgaggcgatttacaacaacacccttcccaacaggccaacacacgaatatttggccccactacatcgtctaagctttaatcattagcatatctgttgtcttaaattagagaccaccttatatacacatatacacatagacacgttaagaatgtgctgtcttttgcctttaaccgtattacacattaaaaaaggtattgaggcgctaggctcaaaacgtaaatatcagggttgtttggttgacaccctcaatttaccacaaaagttttgacaaaatatggcaaaccacatattatgtggtaattttgtgaaaaaaatatatgataagtgggcctaatttcttaaaaaagtgaagtgtaacatagttgtagcaacaatcaaatactaggctaacttatcaaaagtggataacacaaatgtggtaaagtgtggctatcaactaaacaatccctaatttatcgcatttaatttgaaattttagtgtaaacattttatttgacctaaaaagtaacacccgatttacagcgtagtttgttcatgttaaggagtactactcctttttaacttacgagccgatgcgagggtagagtttcagttcatcatattaacaatgcctttttctagttgacatgcagattaattaattcacatgaaaatgtccatgaactcgggactgagtccagttttcacgccataacgaaaaatcggttatcttttcacccgcctctgtctaactacacacaacaagacacggtgaaactatttggttgtcataagcactttatgaaagtttttacaatgtgaacggttcgcacttaaatgggttttaacattgttgaaacttacttttcaagtccgtcaaaaaccacccatccaaagtgtagttatttattttggaggatcttaatttaaaaacgagtaaaatgaatggaatatcatccaacttattaggtgtgtcggagtcatacagatcactctactttaaaaatacacatttgagtcactaatctaactatccatacaagcatatgtgcatatgttgtaggtatgtcacgtagggttgaaaaaaggcagtgtatcgtatgcacgcacacagcaaggtagatgcactcatgcacacacccatccggagcctttggatcaacatcctgcggccaagaccccgagtgtggtatttttgcaattagccgcccgcctcctccacttatttttacgaaagacccctccacaactctcttcttcactcacgcaatccattttgcaaaaaaaaaagaaaaaaaaagaagagaaaactcatcccattctggatctggca

SEQ ID NO: 83412 - DNA, 1998 bp, Oryza sativa
tttcaattgaattcccaccctgaagtcgcaaatccttgttgttggtggctcgcctccagggactgcagtgtggatgtggttcggctgtcctcgctgtggatcggcggtcggcagcgaccgcggaggagatagtcggcgtggagtagatcggcgatgcgggcggcggaggctgtcggcagcgcccgcagaggaggttgtcgctggcttccttggctgtcctcgatgtggatgtggatcggcggtcagcagcgcccgcggaggagaaagccggcggtcgtagatgtggatcgacgattggcgtgagggacgaggcagcgtagccggttggcgtggggtcggggcgtcggcgtgagtcgcggcggcgtccgggatcgggcgaggcgaggcgacggcggcggcgtccgggagcggcggcgtcgatctggaggcggtcggcggggaggggcgccggcggcaaaggcagggcgtcggaatcgacggcgccggtggctgcgctgcagttggcgtgagagggacggagcgaggaggttgggcgaggggaggcggagcgatctgggcgagcggcgtgattttcggctgaggtgcggtggtttctgctcgcggaggttgagggggtacgtgggatgataggagccattggattggatgattctggaccgtcggatttgatgaatgaggtttgtataggagtgtagttggtgaattatatggtagatagatgatcggacggctcacggctgggaggaggagtagcgcaaccaatctcgaaggttcgtataggtccacgagggcgggaccagctgtaaccgtgaaatacccaggctgtccacggctcggccccaaatcggcaaaatcgccaccgcacacaggagaggacacagcgacgaaagcagcgaagtcggcggcgcgtcgcgcccccaccgcatcgatcgcctcgccccggtgagccatgtcggcgcgcgacagggagacggccgtggcgctggcccgcctcgccgccgcgctggacggggcggtgctcggcctcggcacggcggcgctcgccgtcgcctcgtgggtcaagtacctcgccgcgtccgggcagctgcggcgcatcgcctccgcgccggcggccgccatacccgacctccgctcgctcctcgcggagtacggcggcggcggcggcgacggcgaccagccgatcctcgcggtggtgcggggccacgtccgcgccgccccccgaggcaagtacctcgtccccccaggctccggcgagcactgcgtcgtcgcaaagcatacccagctggtgagtcgctcgctgagaagtatcttgcgcccggcgcttagagctagggtttacgcttaggtggtacggatgcttagcaagggtgtggtttccaaatccaatcataaattctcaagggttctgtgcgtgcttaatgactgttctcgtgatgatgagattatatgggaacgctgaagattccgattaaactgtagagataagcatgtttaggcattggagtacgaagtagtcgtggagcttttgtttggtttcatgtgctgtattgcaaatctagatagaggccttaaattgtagaaatctttgagaatttcagtgcataaggctataatgtctgtttgttttcattactctctgtgtgtagcttctaggagtagtcgagtaggaaggtacgtggttggtattcccttgtgcataataattagatagtttggggaaagggtagatgcttgtggtttccttgtcaggctattcttgtgctcaattctgaggtttgacaactaattcggaaagtttggcaatattgattattaatatgcaaaatagcatttggcttctgttgcattgggaatcagatggttagtaccgtatatgagttatctggttgcaagatgcctactagctgcaaaatcaatctcctgtaaccctgttatgcttccatggatttgggtcttaggagagtgttgttgttaaagcccggaagtaatggtaaaatg

SEQ ID NO: 83413 - DNA, 653 bp, Oryza sativa
tggacatgtgctcaaaggatgtaataaatatgatttttttttaaaaaaaaaagatgaattcccagtaactttttttagggggggtaaaaaaaaaattttcttgccttaaaaagacatggtttgagagagagctctggccatgcagcaaggacgagccaatcagccaatggtatatgctgcaaaaaagcaaacgcatgcatgggccccagttgtcagtggcatatgcatgacctctaatttatatggtttattttttccctcgtaatatttcccaacattttctgtgtcacgtaggggaagctgcttagccctgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccg

SEQ ID NO: 83414 - DNA, 73079 bp, Oryza sativa
ttaataagttgaacaaagaattctcacatgagcctgtgtactttatgagagagaggggcagggagttaaaattaaacaagcgtaaaatggacaatctaataatttcactgaaacatgtttagttcttttgctttgtactaaaagcagggccttgtgcctcttatctaactgaagcatgtttagttaaaaatagcttcgtcaatcaatcaaagcatggaaaagagagtgaatagcctattatttttttggtcaactcacaatagcttttgcattggcaacatgaccatggatgaaaaatatacatatgacaaagagatcagcattttaactaagaatacagtttttgaaatgaaagtaaagcttaagagctgacacaagctaatggaattatagaatgtggagtaagaattccaggcagaaaagtatgcacatacccagtttacagttccagcaaatacaggaaaccctttttccttggggactggcaacgattccccagtaagcattgattcgtcaacaaaacttgatcctccaaggacatttccctaacagaagatatgtcaaataattacgtgcaagaacaaactgatgtagtaagaaaatgcaacagaagaaagacaagtgtgtccaaccatcagtgaactagagcagccttctagcattttcacctctacaaataaatcatgatatgaaccttaaagggtatagtactataaaaatacatgatcaaaaccatgagtggacatacaaattttacaaataacagaggatatccaagtttgagaaagagagagagagtaagcaatctatggtgcattcattgaagacagataggcattgctgataaattgtctaaaaataactaataaagaagagggaaaaggagatatattcaaatgatctgagcacacgcaattcatttgtaagattacttcactatatgaaattaatagtaacaaaaaaggggtcagtcaaacttaggatttatgcatattcaaagaaagtactataacataaaaccagtgtggctccttacatctacagggattgtttctcctggaaggaccaatatgaagtctccaacacgaacatcatcaacaggaacctcaacagtgattgcatctgaattcaaaacaccatctgaggatggatcgtcacttgaggaagtaacgaccaatcttgactgaggtgataagagtgactgcaacagaataaggcataagtagttgccacttgccaacaaattcagtcttataatgaagaacatgcagaactgcagataaattacttcactaccatcaactaccactgcaaagtttctccaatagtgtttgagggaatacatatttacttacttttattctacaaatgaaaaataagtgtctctgtaaaggaataaggtgtatacttacaacgagctcattcatatcgctagaagccttaagcctggcactttcttcaagagatcgtccaagaagcacaaatccgagaagcatgacctgcatgctacaagaaaagtttcttcaacattattatgcaaaacatattcaactgttaattcatcaatcaccaaatcagttcaagtaatgcggtaggaagtaattaggtttatatttgaacaattcaacaacacaacgggatgccatattaacaatacaccacaacatagacaaaaggcagacaacattgacaaacgacaggagtgtcaacaagaagatgaaacgtgcgtgcatggaagatcactcaccggttcatcaaaaaaggttgaattccattccagttcagggttcagcaaggacacctgcataaaagaaaagctgcatcagtattcttgtatgactgacagacgatttgggcactgcaaatgcacttactgaactgatagcaaatgccgctgcagatccaaaccctacaagagagttcatgttgggggatccttgcttgaatgctcgaagaccatcaaaaagtatatctggtgttacattgaacacattttgagaaaaggataaaaagcctgaagatacacattgcacggtcatgctgaaaatgttccagagtaatgtacaacacatctagttcttcatatcatctgccattctgttgtttcttaggaggctttaagaatatgtctcctttactacccacccaggcacccaccaacccaaacaaaagcccgtgaatcgaagtgatgaagtatttttcagggcaaacaataaggaaatccttgttgtgtacatacattagaaatatataaaaaaacaaaggagtgtttaccagagaaggaatgtgcaatctcccccatcaagtaaggctaccaaattttatctagccatgactgccatctcagagaattcaatgatcatatcaaggatgactacatgtaatggtatgagttttcagcatctcgtgtcagacaacctagtgacctgcttgctgctattgagttgtctatttttcattgtttagagaattatattgttcttaggaactaagttaatttggtcaagttattgctagtccctatctggtttgatacccaaaaaactgtgtagaagcctatacaaaaaaaaaacagtacattactatactatacctcttccaggcccaaacaatgccgctattgcaatgccacatttcacatacgaattatgcaacagatccaaaaacgttcctgcaccatgcataaaccgatcagatagtgatcctagtggaaaaacagttcaatatagcatgtgcatcagtggccaatttagactttcactaaacttcattcatgtccattcatctattgcacaaacgccacacaacctgtgatcacgctcccgtggtttgaactcaccatggccgacgtggatgccgagcgagtgtaggaaatgggttgcgtgcgagccgcagcagagcgcaacgagcgtccacgcgaaggcgacgcgcccacggctccgcgtgaggagctccgccttcctggccgccatctccctccacttccgagcgctgtcgctagcccccgaggccgcgccccctcgccgcgccaccgaggggaacccgcactccgtcagcctcgccgccagctccttcccggcggccggctccggcgacctcagccgcacggccgccgactccgcgaggaggttgaccgccgcggtctccacccgctcgtccgcggccaggatggtccgcacccgcgccgcgcagccaccgcacatcatgccgctcacgtcgagcagcacggtggcagcatcactggccccctctccttctcccgccgccgcggccgcgtcgaccgcgctcgaggccgaggcggagggatcggccgtggagcggggggtggccaccgctgggccgcgggggaggacgacgaggcagaatcgctgcgcagtcgaggccttaccacaaccgccacctcgacccaaccggagacgccggagcaacagggggttaacgccgcgaaccggagcggtgacatggaggggggaacggctagcggtggcggccatggaggcggtcgcccgcgagcgcggtggggaagcagctagcggagaaggattaagcttaggtgcggaggagggaggaggcggccatggaacgcgccggacgaggagtggtgggtggtggactggtggtggtgggaaatgcagtgcaggggaggagaggggaaaatgtggtggtggtggaggaggaaaacgggggagatggcgacgtgtgcgagggatgaggaggaaaacgggagtaatctttgcgagtcggatggatttggatagcaatctgtcgagacgtttggaggttttcgtggttgaaaacgtggtgggcgtgacgcacgatgcagatccacaaagtttcaaactcccatgtggctttgcaccgtatcgctcgcaatgtgccggtgaaactcccgtttattttgatgtaaaagtaagtttgcggcttacccaagtaccggtgtgtccgtgcgtaggagcatcgtgcgtcggtgcgtgtcatgttgctcgatcgcgataagcaacggaagctgcattctcggggtagacaatatattgtcacgaatcacatactccgtatgctcgtatttcatcgataactcagtaactcacaatatagccttgtcagtgtctaactgaccataagcattgtcagttgtcaccttgatcattcaactggattttcgtatgagatgtttgcgttgtaataacacctctttaaagaacatgtagcttattttttaaaaaaatcgtacatcgttttgatctatttacgagcgcatatcatatctactttttttttatttgagacacaactaaatggtcgtggactcgtgggcttgtggctcatcagatacctcctttctttaataaataacaccattgactttttatcacacgtttgactatttgacttattaaaaaaattatctaattttaacttattttgttgtgagttgttttatcactcaaaatacttccaacatgatttatatcttacacattttgtataattgttttaaataagatgaatgattaaacatatttttaaaagtcaacggcgtcatctatttaaaaaataaagggagtaattggtgcccactaataattattacaaactacttctccgtcaaaaaaatcctaaatatgtatatggacaacatttatatccagatacatctcaattggactttttttttaactgtgggagtaaaacttaagatacaaatacgacgcattatcatccactaacaattactcatgcaagcataactaatcatctaaaatatgatattgtaaagctcaatatacaagtatatcaaatcatattcctcacattgttttcataaatactccaacattcattatttctatagtatgcaacatatatcatatcttactataaagttatcccccactaatttattaagcttaacatgcaaagatgctacatcatcatccactaaacaagatgtcacatcatcatccactaattaacaatatgtcacatcatcatccactaacaattatcacatttaaacatcatgcaaacatgctatatatttatagtttttataatttaagagctttttaaatacaaacatgttaaattatcatccaacataattcatataatgtttcaatgtatatatttattatgttttatgatatcctatatatttatatagttcatcctcacttagttagtgcttaaatgattaaactatggtccaaattatctttctccttttttcctctaattaatttatatcacatcaattgtttttagcatttagattattaatctacggtccaaactatctcccttcttttcttcttctataaagtcataccaccttactttttacgtttgaatcaccattctacatactatttaaatttaaattatcataaaccacattaatttacttaatctgttgttatccagctatcttacacgttattttttatttctatcataataaattcccacagcaatacgtggggtttcacctagtttactcatacaatttgtaacaaaacgtgggtatcacctagtaatgctcgttggctaaaactccaatattagagggtgtggatagtgattgagtgggatttaggtcctctcactaccgcaataaatgctagtgcaatctttcgtagctacaacactcgctattggattttgaggcaaatttcacttggtgctcttgccatatcaattgatatgatgcatacatcacaaatcctaggtgtatagtgtctctaatggtgttacggcagaggatctcatttcacttcgatagatctccgcctcctattaagtagttcttctattaatgtcatcgctaatataatgttctaagtggctcctttgacaagcaatgtcgttttatcctttacatataaccgatggtaaaataatttcaaatttaatcaaatttttacagcagaaatagacaattaggaagtcatttgagcttgtctttaagtcaaacttctctaaacttaactaagtaaatagacgcaacaacatctacaatatatgttctacaatatacttattttgttttgaaaatgttactaagtttttatttaatttaatcaaattaaaaaaatgacttggagtaacaaaatgagcatttccaacacaaaagtagtactagttcagaaatactagaacgtaccaggggcaaactccaaaacctcccatccgatcacctccgtcccgaacgttatctctaaccccttcgtttcccacccaccacctctctccggcgtgctcgctcgcacacagtccccaatggcctcccggaacgccgacccgccgcgtcaccacccctcgacgccgcctctcctcctcgccatgcgccacctccccttcccgggcgtccaccggccgcgcgcgctccccgccccggacctcgcgcccctcgccgcccgcctcgaagagctcgctgccgccgcggccgcgcacccgctcctgaagccgctcttcgccttccactcccacctcgccgccttctcccaggtaggtcgacgcccgcggcctccttgagctcgatcacacgaacagacgtgtatgtgcgagggttgctcacgacgcgcggttgttggtggaatgagcagagcaggaggcgggcgatggcgacgatgcgccggcggcggacgacgggcgagtgcccgctgtccggcgagcactgcttcgcggcggtgctgggtgactccgtggccggtgtggtggtgtccagcggcatcaacaacttcctcagcctgtacaacaccgtcctcgtcgtcaggctcgtgctcacctggttccccaacacgccgcccgccatcgtcgcgcccctcaggtacatagtactcgtatgtatgtatacagtagctacgcacacggcgcaacgtagcactttagtgacagtgtttatggagccaacaattagcctggtctaattcagaaaagaaactcaaaaacattctccctccgttcataatatagacatatagtgcatattttcgtagtctaattttaagcttagacaaatcattcaatccaataaaaatgataattctgaattcatatcgaaggtactttcttattttgtaactgcaatcaaaatagtgcaaaaaaaaaagtgcattgacacatctgactttgtgcagcacgatatgtgatccgtatctgaacattttccggggaatcatcccgccgctggggggaacgctcgacctgtcgcccatcctcgcgttcctggtcctcaacgccttgtccagcaccgccgccgcgctcccggccgagctcccggacccagcaccgccgacgtctcgcggcgcaacctcgtcaagctccgtgctcaccgcaaaccggaggaaatggatgcggagaatccgcccggtaaaatcgcaggaaggagaggaggaaatgtgatgctctatctaggtgggacttcgtttgaaccagtttggacagatggaatcgctgtctcactgacatggtggccatcagactaagagtctgggcatgttcagacgcgaacgatcatcaattaagcaggcggaattgttttggttgtgttgcttcagaagatttttgcttgtacgctgtagaatccatcccattgaggcttcgtgttttctgcatgtatgcagaggaacaacctgcttgactagtttgacatgttccagtcttttggatgagtttgttactttgttgatgaatcgcatgctcactgtttatactacatcacagcagtacacgaagcatttttattctgtatgcatccagtgaatttgattttggagttgttattaggctattaacatcgtacatcacacttcaagcgtgcccctcccccccaaaattcttttcttgtatttttaagggtcatgggttttctgcaaagctgaatcaaaccagtcgaccatatgtatctaatgctcgtttgaaggggaaccttgagatccaagcaagaagtccaacacgatcttgttgaaccgatccgggtcctccatttgaggcacgtggcctgtcttcttgatgatctccaatctaacatgatctcccaagcagctgcaaccgtcataagcacaaggaaaaaggttaatctgcagttgcaaattttgtattgctgtgaattattttacctcttgacagcaaatgccttatccaaggggaatatctgatcatggtctccccagataagcaatacatcctgagccaatggtgtaagctggaatgcatccgtgcccacagttgtagcattcataagctcgatcttctcttccctcttgtccgaaaaaagtttctgcaaattgctgaaatgcaacattagtgtgtttgctagcataacagtgcacccaagctatgaaagaaacttgtgctctgcacaatgttcaaaatataaacatgagaacacgaggaattcgctggaattttgagtgatttatatggatccttcgtcaccttcatgatgtctcggatcacgaagtccggtagcatggcgccggcctgcttccggtagaaggtcagctccatgagccggcgagctccgcgcgcgtccagcggcatgagcacgtcggccgggtgcgtccacccgctgccggcgcgctcgaggaacgcgccgtcgtcctccgccgtcttgagcaaatcggagttggatatcgccacggggccgaccctctcgggccccgccttgcgcgccatggcgtaggccacgaacccgccgtagctggtgccggccacggcgacgcgcgccgccgtccccacgagcgccgggagcgcgtcgagcagcgcggcggcctgcgccgactcggacggcggcggggaggaggaggaggaggaggcgccgaagcagaggaggtccgggacgatgatgtggaagcggcgggagaaggggcccacctggcgccgccactgccacgtcgccatggggccaaagccgtggatgaggaggagcggcgggaggcgcggctcccccggcggcgcccagtagtggatggtccgggcctcaccgtcgccggaggtggaggggagcgtgacggtgctggggcggaggccggcggcgaggaaggcgcggcgggcgatgtactccatcagcgggatgacgccgaagcccatggtgacttacgtggacgtgatcaagtgatcgagacggggctctagtagagaaattggatagtagcaggtagtactagcttggcatacgctgatacgcaacgccgccacggtgagatgcatacagaggagaaggaagagcggtggggtgtaaatgtaatgacgtataccaccctaaccagctctatagctgcttctatagagggctgtatacatagggagtggattttaatcctgggtgggacgtcccctcgtatatttttcttctaaatttgatacaaataattataaaaaaagcctataaaaattaaatgtagagtatagttatatctattggttcataaaaaattaagttcaaattcgatctacacaccaagaaactaaaaagacatattcaaatgtgaacaatatatggtactattcatatgttaaatttgtttttttaatctcgttgtgtgagttgagttttgatctaagattttgtggagttgaatagagtgttgtataagtattgttaaatttttctagattttttcataactatttggattttttttttgatttttttaagtaaacgagggatattccctcgagggttcccctatatatgcttatttgattgatgttcaccagaacttttggtgatgtgataaatttagtcattgtttggtttgctattagaatcttgagggtgccaatctatttgaagataggatttttggtaagcatgttgatatttaaaatcttcacatcaaacaataatcctacctactctttcaaagttttgatttaattcagcaacagatacaaacgagatgcaccaacattaccaaaacttcacagaatttagcttactgatattatggtaagctaaccaacatttgccctgactctccattgactccattcaatgctttagatggctaagaaaacaaatcaacaatccacccattttctttaattatttctcaatgtgcgttctcaaataattcgtagtacaaattttagctatgaatggacgaaggtggctaaccatcttatttcaatcaatcaaatattcgagtgggcatccgacttattgcgatgcgccatttgacgaaggatcaggcttgtgagtagccagcaagaagtctagcaggatcttgttgaaccgggttggatcctccagctgtggagcatggcctgttttgcttatgatttccactctagctttcccatccaaagaactggacagagcgaattttgtgcaggaaacgtcaatccgtgttcagttaaatactgaaatggaagcttcgtactagtatgttactatccattacctctgaactgcataagccttctcaaccgggaacaactgatcttgctctccccagacaatcaacacttcctacaatgccaatgaaacatgaaaggtttcagctacggtaagtgtcagtgaattcactggttgaaatactgtaataagtctgtcacttacctgagatattggagttactgggaacttgtctgtgccaactgtgatccccttgaagagttgaataagttgctctctgttctccgtgaaaagtttctgatatagtagaagataacaaaaccatctatttcagaggacagtggcgtttggctacttctgtgagtaatctgaagttctgaatgatatactaccaatctcaacaaacatgagctgtgtaaactgtagcacccgctaaaagtagttgggtattattgcagtgtgcatggctttgcctcttgcaaatggatgctagattcattacttagctgtgagttgtcgtcatttgtttagatgccagtgcaagttcaaaaccaacattttttttacgagaaccgaatatattactgtgacgatccagccaaatcgctggtcaccagacgttccaggcccaggcggaatatcggcccagctggaaatgttttggagattgcatcccatggctgccaattcatgcggcaccttgttacattcccgaggacagaaattaaccgaaaaagagagaaaacaactggaaattacatttttggcttactactgagaacagaaaaaaaaagcaactgcgtatttcgatcaacagttgcatattttgattcatgcatttcaaccgtcagatggaaatgacaggatatataatcttctactatgcttatttggtactccctccatctcataatataataagttttagagttgagcgtggttatattaagaaagtagatagaagtaagtggtggagggttgtgattggatgagtagtggaggtaggtgggaaaagtaaatggtggagggttgtgattggttaagaagagaatgttggtgtaaaagttattatattttgggacggagggagtactactaagagcaaggtcaatagtatagccaactattagctccaaaacatctatagccaatctaatagatcattcatacaatagttaaatataaaaatatactacaccattaatatctggtcccatctctcatacacacataacattttggagtctgtgttgcagccggctacaaatctgtagcccgctttcttctctctcttcacttttcttctcgatatatggttatagctggcttatagcctgctattgtacctgctctaagagcaagtttaatagtatagcccactactagctccatatcatttataactaatgtaatagccaattcatacaatagttgcttactatactattaatacctggtcccacctgtcatacacacattacgtcttggagtccgtgctgcagctggctacagatttgtagcccactgttcttctctctcttactttatctctttaaaatattattatagctggcttatagcctgctattgtacctgctctaaatggtaggagtaatttacatggttgttttcaacatgattttagtaagattatagatatattgttggtttatgtctctttgaatatgtgttggacgagtgtgattttgtgcgtgtaatgttatgcgttcttgttcatccggcgtttaattaaattaaaaaaaaaacatgtttgctctccactgtcagtcttcacagttcagagcgtatataaaaatgcgagcagcagttccacggatcgaacaggaacatgatgcccttcttatactttttttttaaaagaaatccaactttatgctacgtacgagcgattcgagacggcctagtttttgaattgtcagcgcgagaagtagtgggagtggtttcagttttgacctggatgaagtcgcggaggatgaagtccggcatcagcaccggcggcggcggccggcacgaggccatctccagcagcttccgcatcgcggcgggctcggccggcaggagcacctcctccacgccgctccacccgtcgccggccctcttcaggaacccccggtcgtccgccgccgtcttgagcaggtcggagctcgcgatcaccacggggccaaccctcccggcccccgccgtgcgcgccagccagtacgccacgaacccgccgtagctggtccccgccaccgccacccgcctccccttcatccccggcagcgcgtccagcagcgccgccagcgccgccgcctgcgtagcctccgacggcggcgaggcggcggagtcgccgccgaacgagctgccgccgaagccgatgaggtcgggcacgatgaggtggaaatgccgggacagtgggcccacctggcagcgccactgccaggtggcccgtgggccgaacccatgcacgagcagcagcggcggcagcagcggctcccccgtggaggcccagtagtggacggtgcaggtcgcctcgccgccgtcgcccgggtacggcagcgtgacggcgccggggctgaggccggcggcggcgaactcccggcgcgcgaagtagtcgaggagcggcacgaggctcaggctggcgcccatggtggtgatggtcttctccctccactgagctctcgcagtctcgctcacgcagcagcagcgcgcctcgtgtgataacgtctggtcgaggaaaaaacgtaaggctcacacttaacactggtggttgggcgtgtaccaaacttaatcgcgagttaaggaaaggaaaattccggttcgttagttggtggtgggcttctttgaatgggaggcgatgttattgacggggttaaggagagccgtccgtttggtgagggcgggctccatgatgctgacacgtgtatatcgccagtggtgcattgtactagtactccgctagtggaggtgagagagtagcggccaagggaagagattgccgcactggccttctcaacaaaaggagaaagatagtcgtcaagtgaaggacagcatgagattgccatctgagctgcactgtgctaaataataccaagtgggcagtagcaagcagcaacagattaattactttatcgacctgtcaagaacatatgcatctgacgatctcagaatgatcacaacaataaattagccactttagtggtactgccatctgcctgcagttccatagtcaagaggaaaaaacagagtccgtgagcatcacatttttttattgggagatttcatatttgacaattaatcaatagttcacggtatatattttttacatcccaaatagggtcattacactatcggcatctgaggatagagggcaaatccgggttacagttggattggtttgggcctttccgagagctcctgcttctagtacttcttagcagggctctagtactgggccactcccaacttccggcccatttcacgagtccaggaggaaagacttgatgaagcggttcacttggtcggctccctccaactgcaacgcgtgccctgcgtccttgatgatctctagccgtgacacgtctcccagatgcctgcagccacagccatgcgaaggcacagtgatcactgcttttttttgcaatcaagcgtccatcaattctgcattaatgcggtataccgaagtggtgaaattaggtacttgatgtccaattttacctttgcagtctgtggccgagatccaacgggaacacctggtccttgtcaccccacagaatcaacgttttctgtggtgcacaccaaaacttatttaggctgagtttgagtgggaggagattgagaagattgagaagatacgcaaaacgaggtgagctattagagcatgattagttgagtattaattattttaaattttaaaaatggattaatatgattttttaaagcaactttcgtatagaaactttttgcaaaaaacacaccgtttagtagttcgggaaacgtgagcgcgggaaacgagacaaactcactcacaatctcctcctgccgaaagctcccttagttgcttacaaacaataaaattaaataaagggtccaagggaagatatcgatcgggcaacagtacagaagaagagagagaaagtacagtgtagacacgcatatgacagaatgaagtaatgaacagcattacagcaacagtacgggatgatgacgctttctgtgtggactccgtttgagattgatgactagacaaacgatcatgggatatcgatcgatcagatcacctttttttttttggcccggcaatcagatcatttgcattagagtatttattttcttttgttgagtgctgtgaaagcatggcatatgagatgcacttaaagtacagtgataagatgggtgtgattttaaccctaaaatcctgtgttcaattttcaatgtggtgggacgtttctttctctaaatctcgtttttaaaaacatgatatatgtatgctattttttgaaaaaaaaattatccggcctctataaccatattggcgtatgtatgtatacacagcccatacactggaaatgtggatgtggcatacctgagtgagaacggggaggggatcgatgccagctccgttcttgagaagctcgtgtagcagctcggccctctccttcctctgaaccacgcacatcaactgtgcaaaaaaaaaaaaaacagagtcagtacaaaattacattctgacatactgaaatgccatatatctccccgtttagaatcgagtccagttcgaactgcatatgtcctgaactcctgatcaaatgctcatcgttaagggagggaagcacacgtgagtcccctatactttttttaatgcaatcagtacgagattgtactattttattaaatatagcggtagaaaaatacaacctctaaagaaagaaagaaaaaaaaaactatacagactatacgtgtggagaaagaaactcgctatttttttttgcttcagcgagaacccaagttcgtgcttcttccttcattttagccaacagcctaggaaccactctttatatttgaagatacgctgatttctctccttccaaatctcccaaacaacaaaaaggagtagagtacgcattgatctgctgattggcgaccaactcggaaaggggcacacggctgatagaggtgggtgcacatgcaattcattgctcgatccaagcggcgtatcccatgtaggatcgagttcatcgcgaagatcgtatccctccataccgagggacattctatcgtccgtgctagttgctgatatgtcccctgcatatgctctgctcttggagttactatgtgctactgtactttgccgttgtatacattcagtgcgtgcaccagctggcgtacgcgcgcggtcgagagctggtcgttcttcgcttcccccacccccgacgttattacgcacggcggcgcacggcatggcgtcttcatcttataccctttgacttggtcggatccacgtcaatggtgtccatacatggggttttgtttgttctgttttgcaaagttaaaatgaggcaaagctttttccctccattgaaaaatcaaagaaagttacgagaaatgtgagatcttgtgctacaagttcgtgtagtgcagattggtgctgtcgtgttgcaagcttgcaataagaaaaggttacgctttcaccgtcctagaccagctcgaatcacacgccaaagttcgaggccatactttaattggagtgcttgatcggtgttacatccaccaaaaaaaaaacaaaaaaaaacaaaatacgagtaagtggcagctagtggagcagcaacattattttggggctggccctcgcctaattttcgagtcgattttgctagatatttgtcatcaaatttctccccctaatatttgtcagatgtaattacagtacaatcgtagtgtaattacactgtaacttgcatgtaattacactgtaactataatgtaacttgtatgtaactttcaagaatctctcggtaacatgttatttcagtaaaatagaggtcgtgggaacaaattctttcatatatgtgtgtgatgtgatttttttcttcctccatagaacaaatcttgtaatagatctaacgattcaaaattacgtgaaacttacatacaagttacactgtagttacatgcaagttacagtgtaattacatacaagttatattgtaattacactacgattatactataattacatctgtcaaatttttagtagaaaatttgtcgacaaatgtataggtggtcccttttcgagtagtattcctgaagacgacacgtgggccacgtaagggcccagcgcccatgacagaatccacgagatttgacgtaacgtacggcatcaccgccacgtcagtccagatctaccggagcactttacctttacgtgcccgtgccactctcctccagcactacacgtgtaggagtactgaattgccgatctatattttactctagtatttttcaaatttgctactaaatgcaaatccaaattaatctctggtggtgccgtatggtgctgtacgatctgattctggaattgctcacatgcaaaggatagcgtgttctactctggcttaatttggatgtgtccacctgaccatgcaatttatatggcactgttatcaattgttctcgcttaattcctgctaccatgtttggcctaactttatattcaaactcgtggagatctcaattaggcttatacttaaaagtcaaacgcatatgtatatacagtacgatctaaacgaacactccagtctaagctggagtttcgtatataaactctactaacctcgctcgaccggcaagattgctcaaaaaccgatcaatgtacatgtttttcgtgagaaagaaacttagggggttctgcatcacaatccggcacgtgcacaacacatgcatatacgccaccgtacaaagagtgcaagttccccgtactgtttttgtaccaattaacgaggttttccttaagaggcttgttccattctatcagtaagtggaaatgttgcatgtgaatcttgcaggaacaattaaattgctccccaattttaaatatacgtcactggtgatttttaaaaacaagatgtttgcctgtttcggattattaaaatggatttagtacaaatataaaaatacaagtcagattttaagtatcttcatatcaatgcaacatactccctctgtcccataaaaacgaatctagaatcggatgtgacatattctagtactacgaatctaaacaaatgtatgtcccattcatagtaggggcatctgcaaatttgccaccggttttttcaattttgcaagaataccacccgaatgatagttttagtgatatttttgtaattttctagtgacagtcttacaataacaattatgttatatatggtactagattagttttttatgagacggagggagtaaataatacttgtataattttattaaataagataaatgatcggacaccatttctaaaagttaacttatatatttaaaacccgatgacgatactatatacaacatcacgaagttaaatttgtcccacatgatttttattcattttcttatcttgatgtttgagatagactaaaatataagataaaattagtgcatgcaaaatgaagcacatgtaagttttaattattacaaacataaaaataacttctatttgctaatatttaaaggcagcttctatatgaaaagttattttaagaaaatagcgtttgctagtttaaaaaaacgtgctaattatctgacgctaatttctagctaaaaaacgtgctaatgaaaaccttggtaaatacacatattaataaaaagaaaagaacggggcctgtaattaagacaaggctttagtagtgaaagttaatcgtgccagttaattatttgaaaacggcaagatgtactcttgccttgcacaggctagtcattattggatggattagcgagtgtggtagtaggtgctggaatgtgctgagctgaagcaaagcacgtgcatgctgagctagcgcgcatagcacagcatctgctcgatccatgggagtagcaaacaaaactgcgcctaaaaaaccaagcaaacacacaagacgacacgggccatcgatcggacagaggcaaggcactgaccttgatgaaatcgtcgagcacgaagtcgggcatccatggcggcgggcggtgcatggaccggcggacgaggcggcgcagcccgtcggcggtctccgggagcagcgactcctcgacggccctctcctcccgcgccgccatctccctcatctcccccggcgtcgccgccacgccgctggtcatcaccaccaccctcggcacccggtccctgccctccacggcggccagccggtacgccacgaacccgccgtagctgatcccgaccacgtcgtagcggtcgacgccgaggagccgcatggcctcggcggcgcaccgggcctggaacgcgacggtgcggagcggcgaggcggatcgggagtgcgcgccgaagaagaggaggtcgggcgcgtagacgtggaagtggcgcgacagcgccgggaggttgcgcgcccacgtccacttggagtcaccgccgaagccgtggaggaggagcagcggcggcttggcggacggcgccgcggggcaccagacgcggaccgtggtggcgtcggtgcccgggaggcggaggtggacggggcggatgcggaggcgggcgaggaagtggagggacagcgcggcgtcgcggaaggcggcgaggcggagccgcacgaggaggacgagcagccggaagagcagcagcgacagcgggagcagcgcgaagagcgccgaggcggtggcggtggcatgccgctgcttcatggcgcggacacgcggtgcactgtgcgtgcacacgacgagcagaggccgagaggggtgtgggtgtcgaggggcagagaggatgatggcctgccgttgctattaatagcgggctccttggcttcacagaaaaatggctatggatcgatggatcaattagctcgaccgcggagtatatacaattaaagaattggctttgattctgttggaacttggacagttggagtgttgggataattcaaaactcccttttgcagtagtttccagaaaataaaactctctgttgcagtagttccattaatcatgtactctcttgctccaaatgatctatgtggtgccttctctgtctcagctaactacatctggagggcgataacatattagcatacatggttaatttcatcgtgcgacatgcttcgtgcatgccttgagctgctatgtcaattacctcttcaaatctgtgtgtactctgcactggcatcagagccatcaagtgcaagggaccatgcaggtacagcggcgacacccagacagggactcaacgaacggtgaggagcactagatcattcgtttttgatccgataattggcaggaaactggtgacaggctgacagcgctctgcattctcaaaataatgatgtcaaattggtctcgatcgttttgatttgtttaccctgcttgttttgttagcgcttcatggcctgctttttctctaatatgtcaaaacgatttattagaaaataaaaatatatttataggtaaaacttttatatatgtattcttactgacttaaaaactaatgtaaaaaaactatgctgaaaaaaaaatctcaaaattaagtttaaaaattttaaatataactttttctttgggttaggccatcggatgggagcatccaatgctcttgcctccgtcagacaaagaccacggaatggtatggtcgtctgtgcgtacgccaaacagagtcactgtctattattcacgtttttttttaaatattgtctagtgtttggttctgacttctgagaggtgctcatgaaaagaatcaaggctgtaaacgattctagacttgaggtgtttataacaaaaaaaaaaaggcaatattatactccctctgtttcacaataaaagtcattctagcatttttcacatttatattgatgttaatgaatatatatatatatatatatatatatatatatatatgaatgtattcattagcatcaatataaatgtgagaaatgttagaatgatttacattgtgaaacggaggaagtagtaccgaagaaaatcaaggcactcgttcaacagaaaaaaaaacatcaaacgttggagggaagaagacattgagatataaaaaggttcagattagagctatggcatatgctgtccttgctggtggaaattcggctgagagccgcgcagccaaggcccatgggccatggacaacaggccacgatattggcccatctgtcacgcgcgaatcataatgggctttatccgcacgaatcctagagccttgtcgttggcagaacagcgcacattattcggcgggcatcgccatacaagtcttatactccatgtaaatttgatcctaaataaaccattctaatccatgaaattgatcgtatggagatttagaattcaagtttcctgtttcaatgaaccataaaaggttccattaacgatgaaatcactccacaatccaatacaatgcaactgtgcaagtgcttctaatgtcttcttttgaaggttaagagtcatcatccctgatctttcatggtccaaatctaacagtggacttcctgtgaagttgtgaaccacattgtcaccagcaatacttagtgtggggcaagcaatacttaaattcatcaacaccaagtttccagcactgccatttttttcgtggacgcgcaaaagtttccagcaccgccatcacccagtttactcaacaaatcataatgacttggatcatgaaccatgatttcgtcaaaactagccacgctgttagagtttgtgtcgaatgtgtacgtagttggttacagtttaggacttggagttgtaataggtatgagtcggactctatcctaggttcactcataaatagaggggcatgcctgttgcaaccgcatggcgacttagcatagcgagagggagcggctgccggcatcgaccggccgtgagtcgttgtaactctgatacgctgtatatgctggatcggggaggagcgcccgtaatcagtgccccggagatgtaggctacggctgaactccgttaccaaatatcgtgtctcggtgtcgtcattgttttggatctcctatggcgttttcttccgcgtttagctaccgatgtcgatttcggggttggtttttataacaagtggtatcagagcctgcgggaggtccatggtagaggcgcgatggaggtgctccacactgcgtagcctgctgtaatgcccagggaggggcattggcgcaaggtggagcacggcggcgatcaacggagtcttgatcggtggatcgaacacttctggcggtggccggaaccgtcgatggctgctttcaacagggagatgactagacgtggtgctcaggttgatggcggtggaagcgattggcgatccaatcgatgggtcggacacttcgggcgggtggctcggactttccggtgagctactctcgacagggaggcgtgcggccacacgctcgggttgattgaagctggaggcgatcggcgttctcgatcggtggatttgaacactctgggcagggtggcccgggcctttcgatgagttgcgttcgacggggagatggctagacgtaacgctcgggtcgttcggcggctgggaagacggcatgtgacttgtcggcttcggctcgcgactagattgatggcgtttcaatcggaagtcggagcgggtggatcctataggctgttttggaggtgttgacgaggtatttgcacgatggaattgcttcaaaggcggcgtattttgtggcatatggctgaacaaagcctagggcgaatagagcagcatctagtagcggttcaatcctggagaggttttggttcaacctgtttttccctctagcagacaagaagtaaaccacatgggctgtagatcaatgacaacagttgttggtggagtcgtcggtggtgcttggcattggtgctagatgttgtcagagatacgaagaagcccaggaggtcagggtcgcggcggtgtgcgcgtcttgcgtcgaagccgagcaggtgacggagatcagggcgatgccgagaaggagctggctagggttttagctaggtcgtgcagggttcggtcttgagggtttgtggtgtggaagacacggacatggagtcgtctccggttcagtcatggcacggacacaatcgaagacaagcagtggataccaagtttcaacatgaaggggaatcggatgaggactacgattcgttcatgaatcggactcgatttttcccaaataaaagcagcagaggaccacgggattgcaacaacgcaatcgaaacaaatcacctagcagagggcgagattcgtacccgattttcacagaggcggaggtggtttgggcggtgaggtcacgggcggctggaggcgcatccttgcaggcggtgcgtggcggcgtggtactcggcggcgtccgtcggagctcgagcaggagcttgcggcggcggctgcagcggttctcggcgaggaaccggtgcaggtcttcagcggcggcgctccaaggcggtgcggcagcctcttgcggggccagcggctccccaaggtccggcggcgcgacggctcctcgcaggtcggcgcaggcactggacggcggcgggaggcggtggtggtgtgcggcggcgcaaggcagcggtgtgcggcggctttggcaacgaggcggcggcgcatcggatagggcggcagcacgtgcggtttctgggaggagcgagaaaggccgaaggaggaaaggggatcggctcgatctgtttccctttaaccgcacgtttgactggtttttttactagaaaagaaaaccgaccggtttttttctggagaaaaaagaaaaaggggttggttttgtccggctggtgactgtgcaagtttagtcggtgggtcaattaatcagggcagatcaatttaatagggcaacagctgttgagttgattatcgtcgatggcggtgacagttgtttccaaatttgaggtggtgaagttcgatggcatcgggaattttgttctttggcagatgaggctgaaggatctgttggctcaacaggggatatccaaggctcttgaggagacgatgccggaaaagatggatgttggcaagtgggtggaaatgaaggcacaggcaactgcaataatacgcttgagtctctcggattttgtcatgtaccaggtcatggatgaaaaaacgccgaaggaaatttgggacaagttggcaagcctgtatatgtccaagtcgctgacgagtaagttgtatctcaaacaacagctgtatggtttgcagatgcaagaggagtcagatcttaggaagcacgtggacgtcttcaatcagttggttgtggatctaagtaagttagatgtgaaacttgatgatgaagacaaggccataattcttctgtgctcgcttccaccatcgtttgaacatgtggtgactaccttgacgcacggcaaggatactgtcaaaactgaggagataatttcgtcgttgcttgcacgagacttgagaagatcaaagaaaaacgaggcaatggaggcttctcaagctgagagtttgctggtcaaggcaaagcatgatcatgaagcaggggtgtcgaagagcaaggagaagggggcacgatgctataagtgtcatgagtttggacatataaggaggaattgcccgttactgaagaagaggaaaggtggcattgcaagtttagcagctcgtggtgataattcagatagcagcagtcatgagattctcacagtgtctaatgagaagtctggagaagcgtggatgttggactcagctagttcctatcacgtgacatcgaagtgggagtggttctcttcatacaaatctggtgattttggtgttgtttacttgggcaatgacacgagttatcgtgttattggagtgggcgatatcaagttcaagatgtatgatggaaacgaggtgctactttcagatgtgagacacgtgccaggactaaggaagagtttgatttctcttgggagcctacatgagacaggttggttgtatcaggtggattctgataggaagaccatgaatatcatgaaggacggcaagactgttatgactggtgagaggacaagctcatgtttgtacaagttacaaggaagtgctgttgcaggtggagtcatggaagatgggcatgctggtgttgctgtgcacgatcctgaaggcggcaagcctggcgtaggctcgtcgggcggctcggcatgagctgtggcagaaccaactcaagtcctggtacacggaggttcgagcaagtaacaaattcaggttggagtggcatattcgccaaggtagagtttgttagagtttgtgtcgaatatgtgtacgtagtcggttacagtttaggacttggagttgtaataggtattaaaactagagtatgagtcggactctatcctagattctctcataaatagaggggcgtgcctgttgtaaccgcatggcgacttagcatagcgagagggagcggctgccggcatcgaccggccgtgagtcgttgtaactctgatacgctgtatatgctggatcggggaggagcgcccgtaatcaatgccccggagatgtaggctacggctgaactacgttacaaaatatcgtgtctcgatgtcgtcatcgttttggatctcctatggcattttcttccgcgtttagctaccgatgtcgatttcggggctggttttataacacacgccttgttccaaaagtatccgtaaaccatcctatcctatatcacggcccggattaggagcagctagcgtctttgcagggtggttctaagtccgagtcatagagtatgtttgcttcttccccatggcgtcttctaccttgagtaagagatgacaaccgtaattagcacatgacaagcaagtctaagctctacacaacactactagttgctcggctagtaaggtgcagcccgtcgttgatgccggctgccaccaagatcagtgcgccagggccgcatgctaataggttgcggaacaggtttagaaatggcccgtggaagatcattcactttccaatcacgaaaagaacctgcaattacagtagtacaattagtaggaaacaagagcgatttgataatttaacacttctcaaaataggattcgattatttgatatactagtccactttcattcactcagatggaccaagcagtactccttcctttaaaagcttaatgattaattacctggacttatcttcaaatactttgacagcgtacaaggtctgtatgggtggcaggtctttctttcaggaccatatagtgcaagcgcttccactgtcttcctttgaaggttaagagccatcatcactgatcttccacggtccaatttgacaatggaactcatatgaaccacattatcaccaccaatacttaatgtgggggaatcagtactcaaattcatcaataccaggtttccagcactgccatctcctaattcacttaacatctcatagtgacttggatcaggaaccatgatctcatcataactagccttgcaaaccttattccaacaattcccataaaccatcctatcccatatcactgtcctccaaccaacaaagcttttaagccagatatcaggatcaggagcatcttctttgcagggtggttctaagtcccagtcatagagtatgtttgcttcttccccagggcgtcttctaccttgagtaggttcttgagtgggttcaacagtaggtatcaaaaagtgctccatctcaataaacttgatcactccacccatacaatgaacatctcgaatcatatgcggagaatcatggcaataattacccggcatgagctctggcagacggatgaaacgtaccacagggtgatcagcaagcacgtcgcagatcaaaatgcccttccaaagatctacccatcctagcaggcttcctccaagctggatcgtcttgtgtggtaaggctgggtaatacttactatcaaccctttcaagattgcaagaagggtccaatggcactgatttcatagtccactgatccgatgccgaggaataaaggtggagagtaaactcacgaatattgcaagaggtgaacaggagagcagccaggaagaattgtccatggtcaccacaccggatgataccaatgtcctcgccgcgattgtatcgtggatcgtgggttgggatccggcgaagagacggcgactcggtgccggatccggccttgtacacgaagtactccttgtcaaccctcccggagaacatccccgagaaggccatcggcatgagcagcaggagcaggtcctccgactagcaggcgacggagggcgcggcggtgaaatcggccgccgtcagggtggggctgtgcacgcacgagatggccggtgggttgtcgacgcagaaggagacctcgacgacgtcgccgtggctcgtcgtggccgtcgccgtcgtggcatttgtgcactgcgcgtggtgcaccttatcctcgaggagcatccacgcgggaggccggaaggcggtggcgaggcgggtttgaatcatcatcgtgtaatgatctaggaactagggttttggagtacctctctagggaagagatcgaagcagctattcgatttatgtacgggatttttttttttgggatatgtacgggaaaattaattttccgatcttgaattattgattgggatttgctacgggtggcgccacccttttctccctggacctatatctactgtgtgtggattttagtttaaaaaactcggcccattccttgtggataaggcccatccaacagcatgtctactaccacgcggcccaaaaagcgcttggttgctattgggcccatgggtcagggtgtgaggcggtttcaccagtcgctagctcaagcctctaaacccttcttctccccagctcaccccgttcgccgccgccgacgccgctcgccgggggctatcgccatgtcgccggccgccgcctcaccggatgatcgcatccggagctacgaggatttcgcgagggtgcacgcgtacctgctggccgcatccgggatcccgccgtcgctgcaccagcggctttaccgcaagctcgccgacgaggtgttcgacggcggggaggccttctcggtagagccctgcgagggagggaggcagcggaggctcgttctcgccgctgagtggactctagggagggagtccgatgtcttcctcgtcgaccacgcctggtccttccgcctctccgatgcgcttaagcaggtactaatactatccctgggaccgtggtttacttctgtggaatcagttgcgctagtttgttgggaagtgattagtgcgattttggcggcttttgtgctgcctagctgtattatggcccataacgtagtgtattactgatgaatgggagcgcaatgacgacattataacggacttgttgatttaatttgtttactcttgtgacttcaagtagggtttatgctgtactattatgccatttacttttatgttggatacatggaacgattttagcatggtccttgctgattgttaatgtgttattactgtgaattggagtattgactagttaagtgagcgcagctacagttcgaactaacttaagagtgtcatagtttttttttttgggtgctgttaacgtcttgtacttattagctttcttatgctggttaataagtggtcgacactgcaaaatcagggtccgttttattcttttcatgctatcatctgatagctatgtcgactgaccaacaaatacacattttgtgagtgttcatttacagagctttttacttccatgagtgctcttatgctcttattttggtgatatgcagttgagggaagtaccaggactggctgaaagaatggcagcattgatgtgtgtggatctggacgagagaactgaacttgaagaagcagatgaacaggacaatgggaatggagggagtttggagagtgccttggaggtagttgagaaagaaaggactagaatccaggagaagggaagtgactttgcagcatggctggaacttgaggagcttggaattgatgatgacatgctaatagctttggatctatcttcaaaatttccggtccgttccctttatatattatttattcatgtttttactttttagttgccgttgtctgcaacatacaccaaaaagttgtttatctgccttatctgataaaaaaaaaaccctgctgtgcatatctttgtagatgatccaatccaataattatggtttgaattattcttcaggaaaagaaactttccagtgttaaagatcgtttcagtaaaaaaaaaagtactaatgtttagtactggtcttgctccccaaaaacattatgactttgagatgtgtatttttaccataatttcatgtttctttgaattttgtgtatgttctgaagttttccttttattttctttgtatgccattagaatatggtagccctcaacctatggggaaacaagcttcaggatccagagaaaataatgaaaggaataggggaatgtagaaggctaaaggcactttggttgaatgagaaccctgcactgaaggaagggtcagaatcaagccttatttgtttttgttgaagttttaattttgttaattctgttgtgaatatttttcatttcaagtttttcactgttatagcctgataagtccaagtaggaaaataactctgggggtcctgatggaagttgaccagcaactagttattgtggaatcatgtagttatctcaacatgattgataggagaaaattgtaacttctgtgcttgaacagaaagcaagtgaacaacatcttaagataattgagatattattttgcttagttatagtatatgtcctctttaatttgaagaataaaaccatcttaggatgagttggttcatcatgaggtcttcccatggttttagtgggatgacttccttcttcatcatagtaataaacatgtactaacaaacataaacttataaaaaaaatgctgaggtgataaatggatcctcaaaccaaacaagtgaccagttttggttgggccattcgccatctcttcttttgtcatgtggcattctgatgtttttttccttaatgttgatagtgttgacaaagttattcttgacggtctacctgaattggaaatatacaattcacattttacgaggaaagctggagaatgggctttaggtttctgtggggatattattggagcagacaatccctgttcctcagcggaaagcataccattggagaatattgcgtctctcgatctctcagataggtgtatccacaaactaccagtggtaatagctataactggtcttctttattgacattattcactaattcattttcttgatcaaaattattcactaatccatttggcacattttgactttaagatgttattttccaaactgtacaatcttgaaatgtggaactcttttgctgataattcccttctctgcatatacaattcaacaggtgttctctcctagaaaactttcctccctgttgagcttgaacatccgtggtaatcctttggatcaaatgtccagtgacgatctcttgaagttaattagtggatttacccagttacaagagttggaggtattaccagcctaactgcatgtctgtctcataaataagatcaccttctttataaattaataagatgattgcaatcaaggttttcatggcaaatttctttccacaggttgatattcctggctctcttggaaacagtgctatttccattcttgagtgtcttcctaatctatctttgctaaatggtatcaatgtggcaagtataatagagagtggtaagcatataattgattctgcacttaaaccacgtctgcctgaatggtcaccacaagaatcccttcctgaaagagttattggtgcaatgtggttatatcttatgacataccggcttgctgatgaagaaaagatcgatgaaacacctgtttggtatgactacttgcaagttgcaaccttttctcatccctttatggagcattgtgcgtaattttaataacttcgaggtgaagttctgctaaaagtttgaacataaataattatgattgtgtcaactagcccctagccataggtaggtttgcctagtgtagatattcacctttagacgatctagaacattgctttgttttcacttttctgcagtcataaatattgaatcgaatggcatgaaaagaaaattttgtatctgattaacactgtgtctactattctgtgggtttgtgtctggttattcatgtaggtatgtcatggatgagctgggttcagctatgcgccacagtgacgatgcaaacttcagaatagcacctttcctgttcatgcccgatggtaaactagcttctgccataaggtattgtccttcgaacttcagcaacatgttagtaatatgtagcttgctaatacccaacattttcagttacacaattttgtggcctgttcatgatgttcatactggagaagagtgcactcgtgatttcttgtttggtgttggcgaggacaaacaacgctcggctaggcttacagcctggttccacacaccagagaattattttatccaggcaagaaacttagtctgtaaacttgtggtgctgggataaacggtcttatcttttgtccatatgtttatcttcctctcccttttcaaccttttaggaattcagaaagtacaaggaacaacttcaatcaagcagtatctgtccttcaagaaaagtaacaccggtgaccaaaagtatccgtccaagtgatggccatgcacttcgagtatttaccgacataccccaagtagaggagtttctaacacgtccagaatttgttctcagtaaggaaaattccaccctaccttatcgtttatctgtttttttttttggtaagggtcaactgtctttagatagaaataaactcttaacttctgtttatgtaaaacattaactttaagcttgtaatcaacttgtcctcctttcccttggaacttcgtttatgtaggaagcattgatgtagcttgctggtgatgcacattatagaacattcatttatctgggtagtttgaacccaatcgtagatgttcatttgagattaaaagcttttgtgtttgctagcactagtttacctaaggaatcagctaggtattatgttttctctgaccagtcccaaaaaaaatattgatagtgctcttccatcgtatggtttacttatatatggtcaccaaatgttcctcatttgtatctattttgtatgcctgcagcatctgatccaaaggaagctgacatcatttgggtaagcatgcaagtggattcggaattaaagaatgcactaggacttacagaccaacaatatacaaatcaatttcctttcgaagcttgcctggtcatgaaacatcacttggcagagactatccacaaggtgagctactgagctgtttagcttagatctgtttttcagggaaaacattgcgtgtaacttatgtcaaaaaaccatacaataaacaccatattctttcaatggcatctgaaaattagcatcaacttctacaggcatggggttcacctgaatggcttcaacctacgtataacctggagacacatttatctccactcattggagattactgtgtgagaaagagagatggtatggataacttatggattatgaagccttggaatatggcaagaacaattgacactactgttactggtgatttatctgctatcattagactcatggagacaggtcccaaaatatgccaaaaatatatcgaatgccctgcacttttccaaggaaggaagtttgatctgcggtatattgttttcgtccgcagtatatgccctttagagatatttctttctgatgtgttttgggtatgacctttaattcgaatgatacttttgatcgatctcattgttcactgtgatacttactaattattttgtgactctggtgcatataacttattattcgcaggttaggttagcaaacaatcagtacactctggagaaaacaagctttttgaatatgaaacccatttcaccgtgatggtatgttcaaatttgattgtaactatacatattatttgtgggaccatgaatgttagttgctgtcaggagtgtataagtagtgtgtgttcagatgttctttcctgttctttaagtgattttatgttctggctttatgcttatgttatgtttatagtttttttttttctaagaatgaaaatgtgctttagatgcctaactatatttcccttccagaattatattggaagggatgttggcatcaaatatcatgtgaaagtctagattctagaaatatgatatatttttttctcagaattaaaatgtgattaggatgcttaactatatttcccttccagaattatattggaaggatgaaccatatgaacacaccagagtttgtcaaggagtttgagaaggagcaccaaggtcagcttgcatttttctctttatattatgcgtgtctagttactgacttctgactaaaattttagttaaatggctggagatccatggacgcatacgggatatgatacgatgtgtctttgagtcagccacagctgttcatcctgagatgcagaacccgttctctagggctatctatggggttgatgtcatgcttgataataaattcaatccgaagattttggaggtatgccttacctactttcctatcctgcaaccgctgaaatttcgttgcctccccctattgttgacatgacatgctgaaacctgcatatctacacaacaattgtagtgccgcggcacatggttaaagttatatagtactgacgtgtgaaagccattgcccatatgcttcactgaactaatgaaagcccttgcgcattctcattttatgcccagctcagaattaatttcagaagatatgccagtatgttgatttagatattcttgttgtagcctcacatacatagtatgtcaggcaagatgtggtacaaaagtcaggaagtaacactcagttaatctctgtttgccacccaagcataagcttccaattgaaatttgactattacatttggaattttatagatgttcagctattgtattatataagcattaaaaccttcttcctagtaattcctctcactgttccgaaaatttataaaatgaaatgcaggtgacatattgtccggactgcacgagggcatgcaaatatgacactcaagctctcgtgggaagccagggtgtcatcaggggcactgaatttttcaatacagtgtttggctgcctctttctggacgagcttaaagatgtatcgccgctgtaatcaccacaacaaggttgctgtaacaccgaagttcaacacaatacacgcacatgtgagttgtgatcctgtcgttttatatgccatacatatcaaatttgctcagtacaattacaaagggggtgtgatgctgcctcctgcctgtaccatgcttcggatcagattgaaatgagcttgacgaatcctcctcctgctgttcaaggttttggttggtcaaaagccagaaagcacgtacctcatgctccaaggcaagctagcccttacctttccgctactcatacccacagtaacttgaaagcatcatcacatggcaacaacattctagacatatatacacaggtagtagcagctactgatatctcgacctaatcatctagagagtagaggcatatactcctttcccgcctaaactggagccaacctgatcgagacgcagccatgcgagcagccgtcgcccatcgaatcctcctctcgctcgccctcttcgccgtcctctgcagatgcgatcccgacctcctcttcgactactgcgtcgccgacacggcggcggcgaccgcggccggggcgttccacctgaacggcctcgcctgcatcgacccggcgctggcacgcgccgaccacttcgccacgtccgcgctctcccgcgccaccaacccggccgccacgctctacggcttcaacgcgacgctgacgagcccggccgcgtcgctgcccggcgccaacgcgcagggcctcgccatggcgcgcatcgacctcgcgccgggcggcatggcgccgccgcactcccacccgcgcgcgtcggaggcggcgctcgtcctcagcgggagcgtcctggtcgggttcgccgacacgtcgtaccggctgtacacccagctgctgcgcgccggcgaggcgttcgtgttcccgagggccatggtgcacttcctgtacaacatggacacggcagcgccggccgtcgtgctgtccgggctcaacagccagagccccggcgcgcagctcgtgcccttctcggcgttccggacggagccgcggctgccggacgaggtcctcaagaaggcgttcaagatcaccggccaggacgtgcagaggatccaaaaacacctcggtggactatgatcgattcgagattctacccatcagattttaggcacaaacatatgatatgagttggatccaatattgaaaccactggaggatattctttgatgctgaatttgttaacacatgctgaaagttttgtcaacgtgattcatgattgtataatatgtgaagtgcaatatcaaaatttgtactctgcgttcgtttatgctggttgggaccctatcccttcagcacggaaaacagaacaacttattatcgcataattaattaagtattagggatttaaaaactttcaactaaagattcgaagctttcaactcaaatttaaaaatttcatttaaaaatttcatttaaaaattaaaatcattcaacttgaattacaaaaccttcaaacttagagtttaaaacttttaattaaaattttaaaaacttttgactcaaaatataggaatcctctctagtctgaacctaccatttgttgtccttggttgaattatattcttaaattatacacacatgttctttgtgattcgatatctttgaaatactgctaccattagttgtcattggttgaattatgttcttaaattatacacacatgttctttatgattcgatacctttggaatactgtgattggataaggataaagatgaatggcgagccgaccacgtcagcttgttagaagagcactgggaacctgggaacgagttgttgtgcgagcagccagataccaacaggccctacgtcgatatcatgagaagcgcattcgggcccatacacttcatcaacgattatatcgtccaacaggtccagaatcaggcaagacgcaataagcttttagaattgttgagataattttatgtataagattgatatactatttgtaagttttgctcgtatatatcaatacaaatgagttcgtacaactattatgttatctcagtgcacaatgtttatccgtcgatcccctgtttccatatcgctattgtatgaagtcatttcctatcatcttattacgttagcatgactaatcaccaggtctcagaacctcaatcagggacgcccgatcaatgctaacaagttcccataaggtctcgtttttttttccaataagagttggatgaagattaagattttcgtagcatgtttttcaaactgctaaacgatgcgtttcgtacgaaaactttctatatgaaagttgctttaaaatatcatattaatatattttttaagtttgtaataattaaaacacaatcaatcatacgttaatactatctcgttttacgtaaaaaacttaatcttcatctttatctttaggagaaaagaataccacctactccatccgtcccataaaaaaccaacctagtactgaatgtgacacatcctagtattttattgtactagaatatatcagatttagttctatagttctagatttgtttttttagacggatggaataagtatcgataattttgaagattttcaaataaacaaaacaagtccgtatatacttcctgatacaccaactcgccaagcaggggcggagctaggtaggatagggggggtgcccagaaacccggttaagaaattgttttagctatagttcatctattttcaccatatatgcaccccctcaatctaaaattaagcacttatatcagtctaaagtagagtaaaacaagtgagtggcacctatctccatttcgttgtagctccgcccctgtcgccaagcggacggaacctcggagggttggaggtaggagtacatatagatggccatctaggccgcccggcccagcatggcccaagcctagtcgtgcctgggccaaggcttgtcaggccggcacggcccgaccgatgcaccgggccgtgccgtgccgtgccagcccacgggcggcatacacggcccaatactactcgggccgtgccgggccggcccgaaggcacgatgggctattgtgctgcctcacagaaaaagtctatatttggtccctcaactatgtgggctgtgttaaaatggctggaaataagtctatttttggtccctcaactctgtgggctgtgtttaaatggctggaaaataagtctattttgtatacatattgtcttgggccatgccttatacgattatataagtctatttttcgtccctacatttttttatttgatcgggccgtgccgggccggcccaccgtgccaagggtgcagcccaggcacggcccggctgtcgggccgggccgtgcttgggtcgggccaaaattgcgggcttcgtgccgggccgtgggccgccatctataggagtacatggatttctaggaattttttttatttatacttttttttattaaaatatttacaaaaataatttgttgtttcgaaaatttacaaatctaatcgcctgccgccctttgggagggcgatttttaaaaatcgcccttccacagggcggcaagggacctaaatgtaaattttccagcataacttgttagctctataattttacaatttaaaattatattatataaagtcagatgaaataaaactttatatcaaaattgtagagctcaaggagatctacaactttgtagttaataactttttcatttaagatgttttagatatccaaatattcgttacaaaatataaaacacattttaaaaaatctcagatctacatttcaaacgacattggatggagataaactttatataaagttgtagatcttgatgagatctataactttgtagtttatcacttttccatttaaaatcatttggagtatcgaataagcattattagtttttaagcaattaaaaccggtgggaagggtttgaacacaaataaaaattttgtatttaggtcccttgccgccctttgagagggcgatttttaaatatcgcccttcttaagggcggcaggcaattagatttgtaaattttcgaaacaaaaaattatttttgtaaatattttaataaaaaatgtataaataaaaaaaattcgatttctagcgtgtcgcagctaaccccaagcctccctggcgtctcgcaccccctccttcctgttgcagccgccccgattcgacgccaagcgccgcctccgcctcgatcagcgcctcgtctgcccagatctgccgcatactcctcgtccatcgccatccgtcgccgccaccagcctcccccgaaccctaattgccaaatcctgtgaccttaccgatccatggggatttcctccgcttcctatcatcccccaaccttgcagcttccgtcctccgccgtcggcgcctcccgacgctgcggctctcccgactgggtcatgctggatgaaacagcgtacatctccgaccgccggaacaaatccaccgctgagtcccagacgagcgagggccagatcatccaggtgtccttctggctcgtcgatccgccgggtctttcctacttcactgtccattgcccgggactggaggaggacggcctcgactgtgagccctccgttctcgccgcggaaggatccctcgttctcttccgcgtcaaattgtccccccgtcccatgagtgagcccatgcgattacttcgtctacagggctgccccctggagtccatggctcgacctgcttcctgaccccaatgtcatgtccttcaactccaagaaatttggcctcttcccttgtcgcagcggtgtcagtgagcactataatgtggccttcctcaatattgaatgggtgccctctgatgtagcttgccagtttgagctatacatcttctcatccaagaacagaaagtgggacgttaaaccagtcttgcaggacttgtcccgttctgagaatcacaaggtagccctcgagcatgagatcgacaagctgatcaatataggacacgattcgttgtgcttggttgatctctggcatggtattattctgctcgaaaagatgttcgacgactacccagttgtgagatatatgacattccctaagccagtggtgtacaccacggatgcctatggtgaaactgtatgcggcgaaacagccccagagtgtgtacgggatgttgcctgctgcaatggtttgatcaagtttgtggacgtagaatactgctacactgacgagaccaatggtaatggttggaaagccacaacatggaataggttgccttcttggaaagattggcgcaagcgtttcacagttgacaaaactgacatcttggttgatcccagttatgccgctgttttgcctgagctgtgggacaataataccaaaaacatggaactgaagagactgatttgttctatccccactctgagtatgcttgatgatgactttctttacatgataaccaagatgaacgaagaagacaaaaatgcctggatcatctctgttgacatgaaacataacacactgcaagatgtggccccaatttctgctgcaaggttctccattctcagttcaatttgccatccctgtgcaatctctaagtacctcaagattagctggataagtgctattgctgttggtgatgcaaatgggtatatctatgaagggcagtatgtgagtattagggcctgtttgggaaacagggacttattttaagtccctgtcacatcggatgtttatacactaatttagagtattaaacatacactaattataaaacctattctataaccttggactaattcgcgagacgaatcttttgagtctaattacaccatgatttgacaatgtgatgctacagtaaacttttcataattatggattaattaggcttaaaaaattcgtctcgcagattagctttcatttatgaaattagtttttttattagtctatgtttaatactccaaattagcgtcaaacattcgatgtgatacggactaaaaagttttagccccatctaaacacccccttactttatttgcttagctgataatcaagtgatgtctaactgtttactgttgccgaaaccattattatgcactctttagtaacttctgcctttaaatgcacaagattcattaatcaagtctttcttgccctgaactcaatacatttatcatctgtatgtgtattgctgtggcattccaacctgatcttggttgttactgcataaacattattaagtgaaaataacagataattaataagatccagttaaaaatgggcgtagatgtatgtactagtactatataaaggagaactaagggcaagtactatgagcatccaagcataagccccaagataccacatagggctaaatagtgaagtggatgagagaagaaggatgagagagaaatagtcacctctcatgcaagaggcagcccctacataaatttcaataaacatgtgagagtgttagagatattggggattgtgtagtagaggtaacctattatgcatatcacctcttaatttaattatatatgtcatacataaaattggatgtgttagtcatctctactataaaacttgccttaaggttcagcctctatgagtttcaccacctgcctaaataactatgtcattaattgtggcattagttaggattgcatggaatgatctttgaggtgataacatttgtcaaaacttatttgctggagcatcaggggtaaatatctgtcaattggaaactgggcaagacaaagttgtcttgcttttgtaaactgaaaagaaaggagttgcaaatatgatactcaagcgctcgtgggaagccaggtgtcatcaagggcagtgaatttttcaactttgtgttcggctgcctctttctggacgagcttaaagatgtatcgcagctgtaatcacatcagtgacacacatcaaatttgctcagtacaaagggggcgtgatgctgcctcctacctgtaccattgctttggatcaaattgaaatgagcttgacgaatcctcctcctgctgatcaagccacgcagggcttgggttttggtttggtcaaaagccagaaagcacgtacctcatgctccaattatgatgtgaacttaataggcctatcaattgaacaaaccggggctcgcgtcgatcacgttgcggcccattaaattttcggcctttcttcatttcttgcacgttcagggcccagtaagtccgttgaacagaatacataacatttttttttagcaaaatttgttacaggacaccaaaagattgcagtctttactgtgaaacacccgaagatcgtgtatttactcgtggacactgtaaaaaagtggtaattagctgctggacactcctcccattattttattatttccggtcaaaatgaagagagaaatagttgtgtaagtaccaaaatgcccttgtacagtgttcttcctctcacttcttttcttttccccttcttgttctttgcagtggagcagagggcgacggcggccggctcgagccgggacggctgggccatggcggggtggcggcggcggcggcgcatcgccgggacggcttggccacagctgggcggcggcggcggcgcatcgccgggacggcttggccacagcggggcggggacggctcggccacggcggggcggcggcggcgctcgacgaccacagtcggaaggctctccacgacggccttccccgccacgcgcacgccggctcgtgctccgcggcgagctgcccgaacagcacgtcgtcggcgtcatcgaggaagaacgtgtcgattccaccgtcgtagtcggcgtcgcaccgccgcacgctgctccacctcgagcagcaggtcgtcacccacggcgatgccctccgcgtcggcgcggtgcgcggcggcggcggcgggctcgacttcttcgcgtcgtgctcccacgccgcccgcctcgtcgacctcgtcacctcgccgtggcccgcccgcgtcgtcgcgtccaagcacgccgccgcctcgtcgtcctcgctagcacaccttcgccgtggagctctgcccggtgtgccgcgacagagaaagagaggaagagatgaacagagagaaagaaagcaagaagaacaagagagagagagattgacgagtggacccatgggcaaatttgtctttaaccaaagttttcctctccattttgatcagaaataataaaataatgggagaaatgtccaggagctaattaccacttttttacagtgtccacgagcaaatatacaatcttcagatgtctcgtagcaaagaccgcaatctttcggtgtcctgtaacaaattttgcctttttttcagttatatacgttgcaaatacgtcatacaaacacaacagctaagccatgtcacgctggtgtacgcagtaagcgaagttgattcttccatcatcatcttcttcttcttgatcagtttctctggaaacgtcggcacacaggcgcaatcttccgcccccttttcgtacgcacggcggtgttggaaaaaccgggggtagtacgtattttgaaactggaaagtgggaaaaaacaagtactccctactaggcatttgttcaagcaagagtgatttcttgtttcaaaaaggaagggagtgatttttcctgcctcctttgctactcttcttttaggagacttcacctctagtctctagaaagtaaaaaaaaaaaagggtgaataatccatggtaaaccgacgcgagtacacgaccgagcacactttctcacctgtgttgttgacacttccattgacaaggccacgcaaatttcttcccttttttcggctgtcatttaaccacgacgacaatttcagatgtacatgtacagtgtacacatcgtataagtctactcgtgacgtgaatcggtggcagttggtactttgatagggtagaattccttcgcccatctcgatcaattacatcagaaaattagcaaagcgtctcttctttttctacacaccggatgctgctaccttttcgatttcgacttttggggagcatcgacgagtctgagtccgtcacctctcttttgatctctgttcacatgcgtatgaattcatatgatcgttccgttcttgaggctaccaatctaccatcagtctgtaattctgtatgaaccgtcaaggaaggcaatcgagactggacatctgctaatccatttgcagccatcaatgaagtctgaagagcgtggttactctaaaatggacgtttctttcagcagctttccaaacatgtgtgagctcaagaaatcgatgttccctaacatgcgtgatattctgttcctcagcccaatccgtgttaaatcagatgacccatcaaagatgatactgaaaccgggcaagatttgggccacatgagagccagttagtagcttaatcagtttggcaggcaaagtcgaagagatatggtgcttaaatgtacaacctgcatgatattttacagcagcaagaaaggtgagaaagttgaaactgttgaatgatctgatttatgaaaacgtactatatatgtcagagatcacctggcacaagttttatacaactggaatcaaaaggagataaggatagaaaccttttattcatcaacaattgcagactcaagttaaataattctgacaagacatatttcaattttccaagtcagatgaagataactagtagataaatactcagctagtagccccttgaggcatataccacacaattcaatctctaatgcaagtcagttcaaggagatgtcgttttctgttgttataggtaaggaccaattcccccaaggcctacctccctgtaactcccaaatctgtcttcatctcaagtcatatagatttgaaatgatttttcgtgggtgatgtccagaaatatgatttctcccagaactattcagtaaacgtaatgtaattggataatatgaaagtgttcaattctgcacctaatccctgaaatggacgttgcttataaactgataggtgttctgatagagatagaaatcagacaaatcagagtgatcgaataagttgctatcactgaagcgaaaattttcccacagaaatttggaaaggtcataggcaatactacaattctacgatcgattctaatcgcagtgtgctttaccctgcttcttccattgatacgcctcgtttcctttagagccgcttcaactaaaatcattatatctgggggcggcttcggaaacatacctatttttcctttatttggttgttgacaaatacacgaaatcgttacgtttctattaggttagactctacaacattcatactggaagaaatttcatcataaaaggcaggaattttaaaaggtgcagacatcattcaatttgaattatgcaatgaaaacagaagtgcgaacttggagaaaataatggatctggagctagtgatattttcctgttatattttaaatgtcgacgcattaattcacaggtcggcatacttgagttgtgctaatcaagttggtcacaattgaagtcatgtctgaagatggagtaaacctgaagcatttgctgccgttgcatcctactttgagttaactggcaaactgctcacagccactctgcatggtggccttgtccatcttgatcaagatgtccttgtctcttctgtgagttttgtaaatttcgtcttgctcgttgacataattaatgcgtgaaaaatgctccgatgcttccaaatgatcggggtatgatccatgttctagaagcctggtgctgatattcttgcgatttctgacaccgttcgttgatcattttgtctgcataatctaagctgaggattgatgacacgttgaagctgaatgcagccgcttgggtgaattaggatagttacctgaatccaacaagttacggtgttgccatcattaaaatgttgaagggtttgatcaggacgtgtccttttgtctcttgcatacatcactgttgaaatgcaatactgatataataggattatctgcctgcacctttgccctaaggtcaaacgctcaaagagacacgaaaagaaaatgtcttgggctattccatgcatggataatatggtagcctcacaaaaatgttgttttgatgcccggacactataggagtttccatgacatgatcatatatggatattaacgtaacttgattattaaaacggctgagatggtagaatataatcccatatgttttttttcgtgaacacgtaaaagaattgcacgtcaatatattagaataatagagtttttgttacacgatgcacttagctagaccggcctatgccaaggaaggaagaaaaacaaagataaaaaaaacaaggaaggaaaggaaaaaacttgatacgacggtaactctactccaaacagcgggcgggggcagagccactctacgctcccaaaaattctccaaagaaagcgacggccgctaacgaccacagccagtcctccgaaagaatggactatagaagggaccacctatatatttgtcgacaaattttctattaaaaatttgacaaatgtaattatagtacaatcgtaatgtaattacactgtaacttatatgtaattacactgtaacttgcatgcaactacagtgtaacttgtatgtaagtttcacgtaattttgaatcgttatacctattacaagatttgttctggtgaggaagaaaaaaaatcacagcacacacatatgtgaaagaatttgttctcattacctctattttactaaaataacatgttaccgagagattcttgaaagttatatacaagttacattatagttacagtgtaattacatgcaagttacagtgtaattacactatgattgtactataattacatctgacaaatttttgaaggaaaatttgtcgacaaatatatagcaaattcgtttacgtaatcccatatgtaactcgtgcagttacatatgtaggcgatgatttatacggtgatcggcggcctctaattttgtgagaaggctgttcaatgcagagtatctagttcaacctttttttttgggaaattacccccaattgattggtagctgttgttaggtgaaacaagagataaaacgatcggggggaaacgacgtgcgccgtccaaatgcatggaattgacgattgggtgagttggcatttggcagcccaaccaacatttttcacatcgcctcctacatcttacccctcccttccaaagtccccgtagcgcaagtgcgcgacggttgctttcacagttcaaaccaatccaacgtactcggcagctccagtactggaagtcaactactcaagtaatcaatggatatatgacatctgctatacatccaatctggaataacacacaccgattgatcgggctgcaaatggtgatgtgtactgtggttagctaggggttagctcgcatcgcagccgtcgtacagtatgtgcctgacctgacctgacccaacgaatattgcggcaacgcacgctgttttcctcgccatctcgccgcaccgcgcccccgcgcgcgcgcgttgcaccgcatgtcacgctggcttccggatcgacccggtcgcgggcgcggacaagtcgagggaaatgccgcgtgggttaattgatccgggcgtgcgtgcgtgcgcgtgcgatcgaagagcccaatctgtggccaccggtccaaccgcgcgcgcggagccggcagatcagatccatccagcagttgacgcgcgcggctagctcgtccggcctcccgttgttctttcgcgttgatcgagccgaccgaccgattcgcctgatccaacagtgcgtgctaggccgcggggggcgcgcgcgattgcacatatgccttggcctacgcacgtactagcaacctcgcgtacgaatcgcgtgatcgaggcgagcccaaatgtaggcacggtttacgttgtacttcaccgcggcagtgaggcaaaggcatgaacctgatgcacctgcacctgcctgcttttacataccaacataaccagtgcacaactatgactgtaaatagtatgcaattaatattggcattcttaacttatataagtcgatcgaatttacgtgtttgtgaaatgatacgttaaatagtattaattattattattttgataactttacaatcaacattagaaacgtagaagttccttgagggtcaatgagactttcccaatgcaaacacttccactaaagaaaacaaagtcacaaagagatcaatgtgctattcgcgtccatgcggcgctcatggtttcgatcgtctctctctcctacctgcaccatattgaccgtacgtcgtacaactacagctgcaggtcagctttggtcaggtatatacgtacgttcctgttaccttctagaagcaagctagccacatccatatcaagttgcacccaacaccataggattaaatccattactactactaatttttttaatttgtttctagtgctcgatcatcattaagtaccatatctcctactcgtttttatttggcggcacctaacacccggcaattaaaattaaactgtagctgtctatctgaagagttcctttccctgctactagcagccaggctcgatcgatcgtctccatcagcttgtgtccagtgacatatatgatacgtggacgcccggcctgaagaaggttctgaaatttggtgctctgtccaatccttgagctcgacaacgatcagttggcaattattctagtacctctagctagatcataaacgtttctaattaacttcttctatagctagataatgccatgttgcggaatagttaaacaagtacgacatgtcacatgtgtgtatatcttgttgaacaagattgaaaaggggcataaagctccaaaccggtggatttaattaggacaagatcattttcagaaactgaagatcatctatgtatgtgtgtgtagagacgctaatgcttccaagtgatagaagaagttgaggtaaaacaaaagggagctagcacctttatgatcttgttgggcctactgctccattttcttaatacaggaggttgcatgggactgttcaatcatgtttaaactacaatttgtagttttgtactctgttaggaaacgatagacgaacaaacgataaaaaacaatagatcaatcacaaaagacacgagatttaacgtggaaaaccctcccaaaataggagagaaaaaaccacgggcgccagccagcaaaatatcttcactatatctgaggtgagattgcatcgccgcacggcggcttacaagaggtatatatatagtggaaccctaaaagggatgatgattcgctccgctacggcagaagctggcctttattaagtgcaaatgaatttggatcacaactcaacaaactccaccttgagacaaattccttcttgtagcatgaatcaatccttcactctgaacacaacaaagacaaaaaaacactttcggcgccaaatagcctctcgggctaaaccactataccaactaagcttgagcaaagctcaaccttagcaacaggaacagactttgtcatcatatcagcaggattatcatgagtacttattaaatggaaataagtttggatcacaactcaacatactctgcacttcgaagcaattgcaaatttgtagtttggacgattcatgtcggcacgaaaacagagttcagagccacggctccggtggcttgcattgcagatggtacggacacaacctttacctgctctcaagactcaaactatatcatctttgttttttttttttttcaaaaaaaaattgcaaggagtatcagcttttccttgcagggagcattgctagcgaaacagaagcaacgttccttgcaagtttgatcaatgcagtacagcttctggaaagggagctttgataatagtacagttgtacattaagtacaaaaggatgcgccaatagtcgactggagaacggagcagaggacacgtcattccagatagagccatctctagctgctcgtgtgtgtttgtcagcacatgatgctaactagtacgatctccgggcaattaacagctttattttttttatacttatacttatcaactaaaatagttctcaaccttaaattttgaagttgattttagagtttttcatcgaaacttatttttcagccttagcttttagatcgttaagaacacgtatataaaaattttattcataaattatttttcatttgcaaatatatttttggcttattccatttgcaaatatactatttagcttattccttaaataagccaaacgatagggcagtaagttatcatatgacattgataagaggttcatcgtttgttattcagtttatccagccaaaatttaaatttaaaactcaattttaaagttaatattaatgtttttgtcttaatttatttttcggtgttggtttttaagtcactactaatacatatataaaaattttaccttttctttttctaataagcgttgcaacctatgatcagcaataggtgaaatgaagggataattaattgagagaaaattaagcaagttaattaattaccttggtaaaaacacattgaggaaaaagttttttttttgcggggaggaaaaagataatttaaccatgtgtgaaaatacacttggagataacgcgatccacttgtgcctcttgtcggtccagtttgaaacggacgcaaactatggagtactaccttttttttttttttgacacgaactatggaggaccaggaggagtactagtactagtaaagggaagctttcagcataccaaagcatttgagccatgcctttgcctgcttttccatctgatccgtccagtcctcatccgacgcacgggaggcaccctcgccgcgtacctcccgttgcaactgacggcgcggatcggagcgtccgtcgaaacccccgtttccgccggcggaatttcacgcatttccccgtgtcaaaatggtccgccaagtcaaaagcccaagctagccccctctccatccacacacccccaaaccaaaattaaccaaacccccgcgccgttaaccctctgagcttgtgatgaattaacgatcgtgaccgatcaagtgagcgattaataataacccagcggcacacaattaagcaatgcaagaagccgtcgtcgttaacaccggcggccggtgggcaccaacccgtatttatatacacttctatccggccaaagcagcgggcgcggccgggtaacccaaccacacacgcacgacacgaagaacgccatggcgaagcaggcgtggagctcgctgttcgggtgcttcacctcgcaccacgacggcggcggcaagaggaagaaaggcggcggcggcgggaagaaggcgaagaagaaggtggcggcggcggcgagccagaagcagcggaagctgcagagccggctgtcgttctccgacctgtcgttcggagggatggtgtcgccggaggacctgtcgctgtcgctggccgggtcgaacctccacgtcttcaccatcgccgagctccgcgccgtcaccagggacttctccatgaccaacttcatcggcgagggcggcttcggccctgtctacaagggctacgtcgacgacaagctcaagcccggcctccgcgcgcagcccgtcgccgtcaagctcctcgacctcgagggcacacagggacacaacgagtggctggtaagtacgacacttaatcactagtagctgcttaattacgcctcgctaaaatttaattataaactactccactgcttgctagctccatcggctcagttcattacttgcacggttgcacctgtacgtgacctcacattattactagctggcatgccttgacactccaattaggcggttattgttggtaactaaattaatacagaacaccactttgcaaaaagtacgaaactgatcataatgatcagtttgatgaatagtgtggttctttacctgctatacgcatgacggcatgagattattgctgctatctagtacctctagttgatgagacttgcttacttgttcaaagttagttgagctgttctagtaataaggtttgagttaattagctgggaatttaaaccatgataggacttcagataaaattaattaattaacctatatgtacatgttacataagttcaggaaagtatatacccagcgtaattagcattattaacttggccttgctacggtgggtacaaattaaagtatatattctgaaatgtcaggggaaagaattcagaaaatgattacatattttctataagaaaagaaaacttggttttctgttgaaatataaaataaattgcttgtatttcctcactagcttaagtttcaacatggaaatagagccaaaggtctcgaattcaaatcttgccagctggtgcgtaattaaattaaaattgcatccacttttattctatcctataggcttgatgaggcccgcatgagaggatattagaatatgtaattacttgtttttctttattagcttaattaaacttttgggttaaattgatcggtgtatgcaaccgagctgaactttattttgcagtatctattgcttttttttgtttaaaatggttaattagtattccttaaaaaaggttaattagtattgtgatactgtatttgtttatgagtacgtacctgctctattctttctactatattttttctcaatattccaaaccactagtcttttcttatattaaaatggttaattggtattgtaatactgtattagtttatgaatacgtacctgctcgattatttttactattctttttctcaatattccaaatcactagtcttttcttagaagtagaagttttcttggttgacgtgttacacatactgaactccattcgagaaagtttcagaagtttgctgctagatagtagataccatggaacaataattcaatagaacagtgctgcttgcttagctgaaatgcttccttattttatttttctcccagttaaaagcaatcaaatgagaaaaaaaaatgtctggacttgactgacaagtctgcaaatgcatacatggcccgatgattatgcagactgaagtcatctttctggggcaactgaggcatcctcacctcgtcaaactgatcggctactgctacgaggatgaacacagacttctcgtttacgagttcatgacgaggggcagcttggagaagcatctcttcaaaagtaagcttgaaaaaaaatactaatattttgttattgtttcctatattatgctagctttctgctactctgaatatacaagaaatttggtgcaagcctcagttgttttctgacaaattagcagaagtaattaagaataaaagcgtaactgagattagagagaattgaaacgatttacatatatatcaacggtataagtatatattatagcagagtgacaatcttgcaggcaacaagaaagagatattcgtaaaacattgctatcactctgctttttcctcgctgcatcattaagctaaaaaggattcgacagaatctctaggctgaacatcggttgaaatggacggcgcgattttaccaactcgctggcataaacttttctgcaaattggtggcgcggctaagctcgattgatcgagtagcttttcttgctctacacccttcaatatgtttctccagtttttcctgatggttcaaactgcctttttagacctttgttgtgacgtccatttttgcgttacatcatatctcactctctgtatggagtcattttctcttaaccactttgatataattcacacctgcaacttgcttttgttctcctctttgtctgtctcttgtacagtcctactgtcatgtcttcattgtcaatttgcctctgcatagtgaagaggaaacagcgcagatttgatgtataatcatgagtatggtaggggtaggacaccttcaccactcgttgtctactatggttttttcacattagtacttgcgtcaaagtagtagacaacccctaatatgtgatttggatcaacctcacaagtcaaaattcgtggcttgtgttatcggtaaccacatgatctagtcacctcgatctatcaattactactggtttaagagacatagtagcacaatatgcttcatgttttattaatgaagcaaggtagccctgaaaactgaaaaatcacgtgtgagggagtacagtgattaaactgttgcaaattaattaagagatagcaacgtttcagcaaagttttttttaagtaaatccgatgtcattagtttcatgtagtcagtctactgtcatggacatgcagatgcatgctgaccaaaatgtacatttctcttcttaattcaagctccatatgtgcatactattattagttcaacttaatcgtcttatctgattacatatcgtacttacacaccaaatgtgcagagtacgcagcgtcgttgccatggtcaacacggttgaagatcgccataggtgccgcgaaagggttggcctttctccatgaagccgagaagccggtcatctaccgagacttcaagacctccaacatcttgctagactcggtacgtccttgaccttaattacgttaccatcgtggcatcgtatatgtgttcttcacctacttccccaaaagattgacctgcttgtcatttgatctctaataaggttattagtagtcagaaaagttatattcttttagataatagtcagaatacatgcatcatgcatgcatggtttggttgcttgtacgttcttaattagtttccagtatgaaactgtcgtgatgccaaatgccaagtactaaacaacaaatcttgactactactcgatcgcctatgtatactgaactaagaattggtcaggtttcagactttcagtttcaactatagcagcgctcccgttttgtcatcaatgcgttaacgtgacaaaggccgcgaatttagttctaaattttttcttcaaacttccaattttttattacatcaaaagttttctacacacacaaacttttaacttttccgtcatatcgttttaatttcaaccaaaggccgtgtttagttcctgaaaaaagttgaaagtttgaggaaagttgggaattaaaaaaaaaagttgaaaatttatgtgtgtaggaaaatttttgatataatgtgatgtgatggaaagttgaaggtttagggtagttgggggtaaactaaacacggtcaaacttctaattttagcgtgaactaaacacacccaaagaaagagcagggtggtatgactatttctccgtggagaaaaaaaactgaaaaaaaaaggtaaaacatggagtgattcatcagtttaaactaaattattacgcgcgtgataaacagagttgttggagttgggtgcatggtgatatttccctctgaacaataatccctagcaggctagcactactgctagtgcatttgctttggttacgctattatttctccatcaactgaatcctgcagttgcagcagaaaggttttcttacacaagtacaattctgtagcaatcttaattttgttttcgttgctgaattgtccgtaggacttcaaagccaagctctcagatttcgggctagcgaaggacgggccagaggatgacgagacgcatgtctcgacacgtgtcatgggcacacagggatacgctgcaccagagtacatcatgacaggtttgacagcagaaaaaactgcaaccttttaccccatcctaaataaacaatataatataaaatgtgatatatcctattcagatttgtaatactaaatctgtcacatttctctttttctaaaaaaaattttgaaatatatggagtaagggtgagtttgaggagagggggatagagaagattgggaagatacgtaaaacgaggtgagctattagcgtatgattaattgattattaattattttaaattttaaaaatggattaatatgattttttaaagcaactttcctataaaaaatttttacaaaaaatacaccgtttagtagtttaggaagcgtgcgcatagaatacgatgtccctttctcacccaatccatcccctagaacgaacgcaccctaagttttactccgacaatctgatcgatggtttgtcagtagattaaaagcaatataattatggtcttgttatcaaattatttttagggcatctgacggcgaagagcgacgtgtacggcttcggcgtggtgctgctggagctgctgtcggggaggaagtcggtggacaagagccggccggcgcgggagcagaacctggtggagtgggcccggccgtacctgaccgacgcgcggcggctgggccgcgtcatggaccgcaacctcgccggccagtacccggccaaggcggcgcagaaggccgccgcgctggcgcaccgctgcgtcagcctcaaccccaagtcccgcccccacatgtccgccgtcgtcgaggcgctcgagccgctcctcgccctcgacgacgactgcctcgtcggcaccttcgtctacgtcgcgccgcccgacgacgtcgccgccaacggcgacggcagcagcaagaggcgagccggccggaggaggtctgacggcgccgcggcggcggcggcggccgatggtgtgcagcgggaatgactcggttttgcttgcgtttgtctgtactcgtcgagctacgtgctgatcaagcgatgccggtaaattaatccggatcagtgagttggctcgtgggtaaaaaatgattgtggatttgaagcatgttattatttgtcttaggcttgaatagcagaataggattagagcgtgtaaatacgagcatgtcagacgtacatgagcaaattgagcatgtaaacagtttgacaaaatatggatggtttatcacttctcatgttgggaggtttctctagtatcttcccagcgccgtgaaatatctctgttgatagacactgtatgctgtacgcgagtatgttattactgtttgctgaaagactgtaggttttctccgtgtgcactgtatttaaattttgagaagctgcaaggatttagtaatggtaatgttggtggtgtacggtgtgggaatgcaatacaactgtaacaattggacagggagaacggaatgattccggattcaggatttctgatgtcaggcagctaccatatgggccaaatatatgttgggccaagagaggagatcacagagataggcccaaaacctctttgtagcccacaaggacacactcctggctagtcgccggcaattggaccaaccgcaccacgttccgatgtgccggtgtaacatgtaccgcgtacgtaataacagatgctaagcagcaaaggcgtaatcgagcccagagatttcccctaatctaccttaggttcatcgcctgtcattccagaagcaccagccgagcgccgccgcggcggccacgtccaccagccatacgcccaacgcggcgaacgccacctggccgcgccccatcagctgtaaatacgccaccgcggcggtgtgcaggagcacgggcgcggccaccaggcaagcgagcgtgcccctgtgcatgtcctcgacgaggcacggccgcagcatcaggcgcatgtacagcgagaacggcgcgaggaagaagagcaccccgacgccggcgctggacagcgccgtcgtcgtcgccgggacgaacatcgcctgcgccgccgccgcgcagagcccaattaccacggagacgcacagcaggacggtcaccgtggtcctcagcttccgtatctgctcgctgctggtgagctcctcccagcggagccagatcgcctcgtcatcccaccatggcgacggctgatccggtgacgaccgtctcgccgccgccgccgccaccgtgaggccagcttcgacgtcgtcgtcgttgtcgtctttattgttgcttaccatcttctcgccgtttttagtttctccctgcagactcccgcgattcgacgcgacgccgtacgtcgccgcgcgcgcgcgtatatatcgcgcatccgactatccgactacggcttgcactccgtaacatatccgactgcggcttgcactccgtaacgtgtcgcaccaggatacggacacactttcaagttgtaggcttgtagttgtagcgcacgtatacatatgtcatagccgaataatcgactgcgaggttgacccaaacaacggaaaaacgatggaacaacgctgggacgagcgcccgcggcggacgttggcggagatcgtccgcggccgcgccgcggggcgcaggtcggcgatccgcttcgccatggcggtctccgcggcgtgcgcggccgtcgccggcgcgacggtggcgtgcctgcccggcgcgcccgcgggcgccgcgttcgggctcggcctcgcggggctcctcttcctgctgccgttctcgtcgctctacgtccccatgctgcggccgccggtggacatgtccaggcccttcctgagcttcacgatcggcaccgcgctcgcgctcgccgcggcctacctcgccctgctgcttctcgccgcgaccgacaagatgctcggcgccgacgccgtcaccggcttcttgtggggggccgacctcaccggcgcggcgagccttggatggtttgtcttgaccacgaaagacactactaggtcttatatcattcgtgaggaaagactggaggtggtcaaaattggctaaccgtgcaactgatctattgcatttttcactccattggacattgttactagttaagcaaaagcaaatttgcctttcatgaagatttgtttgatgaagtatgtgttattactacttctttctgattacatcgaattatcatttttttccaattacattaaaatatacagaaaacctagacaacgatatcccgttggaacgagatacccttctataagacagtacctatacctgtttatagcaccagctgcatggtacccgatacctgtaatacttgttatccggtatctgtgatatctaggacctgatacttgtgtaagagaatagttaatatgcctatcccgttgcaattggatcccgttttgtagcagccctctaaaatataatatacgtgcacacaccattacacgcgtacacatccacgagtgtacacgcagcagcaaaaatatgggccggaatgctgggcctgagccttcaaaaactgggccggaccatactgtaaacctgcttggaacacaaatgaattctgcaaactaggaatggtctatttctagcagagtatggaaaactttgtgtttccacatggagaattcatacagatatttgttttacaaatagaagttttcatctatcagtaaggtctgcaaactaagttacatagatgttatttgtatttaattaagtaaacttctcaccaaaccaatttacaatatttacaacatattgtgtgctgctagtgtatcaacaaaaagttaaaataagttatctagcagcatgattaataacgaactaacgcaattgaaacaaatttgctagttaatacattcttatccaatgattgctattaacaccttgtcgattccccatggatgttgtcaagaatggcaattacaccaaccacaaacgcctggtcataacctggctgcaccaccacatggtagaagtccttaccagccagcatccctttcactccaatctagtgaaataaaatacaacaaatgcttgtaaacattttttaccatatgatataattccattcctgatcaagttcatttcaactccattgccatgaccgaagagtttcattacctgtgctacgacatggcctgctcggctcctgacagtgcaagctctctgagaaaatgacccgatcacctcataatcccagtgcctctttcttccctttggctcaacagcgaccctgacatcgccgttcatgcagagcaccggcttaggatcttgaaagctgaaaaccagcttgctgggttcaccatagtccatgagatatcccttccaccaattgttaatgctcaacacttgaacaactcctccctgaaaaatcaaaagttgatcaagcatgcagtgttctgaacatcatggcatctactcagattgaaaacatttcaggtgaagtctaatcttgagttggtttcaccttcttgtggatgaagaggatggcagtgccatcaccgtccctgacgatcagctggccgctagcaccgatgatcccgcagccgtcgacgctgaagacgaccctctgatcacggtcggtgacgacgaacccgccgccgttcaccgtgggagggcggcggcgcaccatcagcacggcttgcgagctgctgcagaagatcttgctaacaaccggcgtcagagctgcgtacgcacccatctgatacggtagctctttcagttcttggagctacgaatactagttgtgatcaacgatgaattgtttttacaatgtagcttctgctaatgcaggaaaggaataaatagggtcatttgagtgtacgtgtgtcgcatgactcatctgtgcacggatgatgcatctgcctaaccatggtctattgtgagtttgtgagccaagcgatttggatgaagttgcagagctgaagcaacgtatggcaaacgacctggtgatttggtcatggaaaagtatggcaagtgtacaggaggagctcataaagaatctttgaattcgattgctttgggccaccgaactgctttatcatcatcggattaagtgtttacattcaattcatgaaggtttatgcctgattaagagcacaattatgctccagtcaggtcgctttaattttgatgaacgacagatggcaacgctaagtaggaaacttggcaggttttggagataatcagataaaccgacctgagcttatccttgtcacaagtggtagctaatcatgtaatcgtgagagtatccagccagcttttaatcctgatttcctttttccggctctaaacatggtcatgaatcttcagcgctaagcaaaaactcacatgtcacagtcacctaagcaaactctcatagtttcattcacatactatgaatttttatttatatatttattttttataaaaatacaaaaaatatatatttgaaatttgtttttaaaaattatataaatacactcctagttctctttgcgagggtgtcttttaaaaatcgttgttctagaggatgagaaggggcctaaatgtatttttttatttgtatagacactttctgctggttttaattactataaaaactagtaacgcttattcgacactttaaataattttaaatgaaaaggtgataaagacatgaagtttatctctattggagatcgtttgaaatgtagatatgggattttatgaaagtagattttagatttttttttaacggatgtttggattcttaaacaatcttaaatgaaaaggttgtgaactacaatcctcgagctctataatttgatttcatccaacttcatatgacatagtaaattccatgtgtaccctttaaaactcactcaagctgtgttcggaatcatatgtacctagcatgcacagcgcgcacggacaacggagcagtccattagcgcgtaattaattaagtattaactatttttttttaaagatggatcaatatgatttttttaagcaactttcgtatagaaactttttacaaaaaatgcaccgtttagcagtttgaaaaacatgcgcgcggaatacgatggagaggggttggaactcatggttccaaacacagcctcaatccctttcatatccctgaaatttactcgatcatttctatacccctgaaatttcaacttgatctcttccatgccattgccgttacattttccttcatttgaattgtttggttgcaaatgttttttatgcccttgatgatttaggtttgaatataagcttaaaaaacgattgaaaattttgtttgagtgcacaatatgtgcattttataaaactaataagactaaataattagtacagaaatatttgacataaaacaaatgtaataatttcaaatctttatttgaatttttaataggacaatgaatttttttctataaagaacattcattaaaaaaaatatcatgagcatattggtaattctatctttttatgaatgctccttattttttttaattttttttaaaataaaataaatacatattttttatttcattatcgaaaagtaaattgtcataaataatgtatcgcacaacaaactcataactataatagtctcatgtagtaaactttttcattttcaataatgtaattcataaatttctatgttcatccaaaggtaaaatggtcatttttatagaaattagacggtcaactaactgtcaattgacaggaggggcatgaaagagatcaaaatcaaattttgggggtaaaaaataggggcatagaagggatcagctaaaatttcaagtgtatacgagggattttctctatgacatatttgtaattaaaaaaatacaaagttgacaagttatacgggaaaatttgcatttaagcctcttctcatcctcctagagagcgatttttttttaaaaaaataaatatcatcttcccggtattttaaaacaaatatatatttctgtaacttatttaattaataaatatataaacaaaaaattccacctactctcatgtcacaagtagtacaaaaagcaatcaaattctcaagcccatgggctatagcttcaactccaaaggcctcaagactgacgagctactgccatatgggctgggcttttcaggtggccggctcgcattcgcggctggagaacagtcaggtcaaacgagcttggtgcaaccgtgcaacacacaacatgtattataccagattttttttatcgtttcaaagttttacaaaaatatactcctcccgtcctataggaggagtatatttctataaaaatttaaaataataatttattaaatcttataaataaataaataaaattctaccacaccacaagtccactacaccagctacaactttctcctattacaagtgctggtggacatggattggattttgatgcctgtccgagatggcaccgacagacacccgctccaatcagtcccccctctgatcactttctccctttttttttcatcaactccatgatcgatccgtccattttgcccacgtcgtgttcgtgcatgcgacggtacgaataatatatcgctctcctcctttgctggctaatgaatgatttgaggtcactgataaatcgcacatcatgtgtacagtggcttagccaaatgatccatcgcgctggctgaactgagccacaaaaattaacggcaggacgagttgagtttggattgtaattgttgttgcaggtgaatggttacagttgaagaagaagccagcgtcatggggctcttgaattgtgataggagtagcttaccaaaacgaagaatcatcgagcccttaaacacccttttttttttcgggaaagagagaaattgaacactttgaaagtctcacctcgtgaacaatatgtaacacgcagcaacgtttcttggaaggtggcaatggtgtatgggtgaatcgcatcgattcttctctcgtcataccacttacatcataaaagaacatttcctttttgacaaaaaaagggtaatctatccatcccaaaataaatttattttcactcatttcacgcatacctatacaggaaaaaaaagaatactctcactttattaaatgttaatgcaattatttctcactttatatacttcgacttaaatgattactaaaaatacgtttaatttaggacaaactgaagaagcaaaaaataaatttattacgggacaaatgaagaaaaaacactaaattagtggagtgattatagtattatgcacagagcagtgacgaacactgcacttctgacaaatataccctttttagagctcaacagcaaacaatgaaaacaaaagggaacttgccggaatataagttcaccaacccttttgctccacgctataagagtacccgcaatggtaaagtaaggtgctatctataaaacatgtacatctcagcaatagactcgattaatagtaaaccaccttaatagtatgtctacattggtatctatagctctctcatgcattgcctcgtttttctctatagactatctctaagttagtagatagttttgctctctctcttcatttaatacattccaagtaggaaaatatgctgacatagatctcttgtagagagcctatagataaccattgtgggtgccctaattcgccctttttttctgacatttaacactaataaatgatataactaccctaagaccagatctaagaaaatacaatatcctaagacttctctgaaacttcggctgaacagaaaccatgggcaggttcaagttcaactatcatggtcagtcacaggcacgtgggttattgtacatttcgccgtacataatgccaactcataaacacttagaaatcgtctctcctaagatctatgtgaagagtttctaagaactgtagtttttcatggagaaaaatccaagggtctttcagccatttgcacaaggtggtgggctagctgatctaggtttaaagtctctcacattctacttatttgatagatcatttcttaatatttacgttattttaactgtagcttctcatataatctctagtttctcaaactgtttagattgttatctaaattctgaaaatttgtagttgtagaatatagaaaataaactagaaattgaaagctgaaattttcagtttttctaaactcttaaaaactaactaccaattagtaaattattgtaatcttctaactcccggacagggtcctagtctcgtgccgccctgcacaaagacaaacaaaaattcttgagaaacccaagtgtttcagtcatccggtcagccagcgaaaccatccaaaacttccttgtaaaaacgcccatgtcgcccatgacttccacccatagcacgagctgactgcaaaatataaaaatccggcaacactgacacagccacaagacgcgacacctcccctgaatgaatgaatgaatcctactaggccagcactgctgctgcctgctgctcccaactcgacgacgccaaccacctcgcctcgcttagctcccacctaaacagtaagagcacacagcccaaaccggcgggagatccgaagcgcagccaagaacgcatcactgtcctcttcgtcttcgtgcatggagttgaccggcctgacgcgggcggcggcggcggccaccgtgacgccgccggcgccgcgccggggatggggcgagctccggttcgcgccgctgctgcccggcgagcggcatgggaggaggaaggtggtggtggcggccatcagcgaggaggtgccgcggctggcggcgtcgccgtcgtcggggatcaagggcggcggggccggggagaggcggccggcgccggagaaggtggcgctgcgggcggcgctgacggtgcggcggaagcagaaggaggacatcaaggaggcggtggccggacacctcgacgcgctctgggacatggtcggccggaatgtcgtgctcgagctcatcagcaccaagatccacccaagtaagaagaatcaagcaaagcactccattttcttgggagtaagcttttaagctagcacctcgccgagttgacttcaaatctcacctttattcgagctgtttattttagttcttctttttttggataaagtttaagcttgttttgatcgtttttctactttactgggagctggaaatgcaaagttgctagtacctttttttggcttcagctccgtttgctcctcatggtcctgggtaggtagcagatggcagtcaggggattctgattagatgcagatgatcaccagatctttataatttataatggagttagtataatgagagcatggagatggagagcatgtgtccgttgcattaggatattcacactgcatttttttccaactaccttttcatgcttacaaaagagtatccaagcaattggagctactctatatactttttaaacactgacatctttcagaaaactagaaaaatcccaagatttgcaagttggagaaaggaaataaatggaatggttattttaacagagctttctttctacctttaaatccaaagcgcccaccggaatcttcagagtacttcaatgcagagcctccccttttcatgatcacatcagaattttttgcccctttagaaaaaaaaaagcatcagaatatttcgtgactaaatggatcataactgtgcacgcaagtaaatatctttcccttgtctccatgatccgcgaaagttcttgtccctttcttgtcaatttttacatgtctccaaatttgacttgccttgccaactttcccagctctgactgagttgttgctgctgctgatgatgatgatgaatctttcacagggaccaagaagccgatgcagagtggccgtgtgtccatcaaggactggtgccagaagaggggagccaagggcgaccacgtcgtgtacacggccgagttcacggtggacgccgacttcggcgagccgggcgccatcgccgtggccaaccggcacaacagggagttcttcctggagagcatcgtcgtcgagggcggcggcctgccgtgcgggcctgtgcacttcgcctgcaactcctgggtgcagtccaccagagagctgccaacaaagagggtgttcttcagcaacaaggtactctgaacattccgttcaattatttttctttggtccaaggaaaaaaaaaaacgtgttttgaggctgtgatattatcatggctaggtgatccttacagtagtcatgttccagttaatagtgatattagtcactaagctggttgtgcatcattgtctgtgatggtgattggggaaagaaggccattaactacaaaacgaggtggcaggccagcctaaaggcatgatttttagagttactgctagtgtgtcattgtcaaaaacccgattatttggcatgatttttattgagttatgtcatgtccaaatgttgtttaatttctcagcttttagatgggtcataggcctgtcagtagaacgtatctatggcctgtccgagaacgatcttttggcactaggttaaatgaactgagtggggcaccaatgccttatgcatcttcatgtgtataatgcggtgtggtttttccagcactttcaaacaggactgtcaattctttacattttgctccaaaggaagtcaagacaactataaaagaatttaggttaggttgtgatcccacttggctgttttttggccttcaaatggtgacttgatttctttgatgagaaagtgataacaattctaaaaaaaatattcacttgaagattacgtaattcagatttctgataatatatgaatggtctcatgcagccatatttaccttctgaaacacctcccgggcttagagaactaagggagaaggaacttaaagacctaagaggagatggcacaggtgttcggaaattatctgacagaatatatgattatgccacatacaatgatttgggaaatccagataaggggaaggaattcatcaggccgatccttggaggagagaagataccttacccacggcgttgccggactggtcgcccgccaacggataccagtaagttctgtttgcacacgatccttagcggattatagagaagggaattgggtaaaaggcagaaaggtgcgtgttattttccaactataactagcacgaagcttgtgcatgtccaattccattttgatcaaagaccaggtcactttcagatgtgatagcttgccccttcaataaacaatccttcaccacgtggtttgattccttgatggtgccaggatttgacaaaagaatatgtaacttttaacttctgaataacgcttgactttatgcaagacctagaagtcatatctatccataagcaggcaaaaatctatggcgtacactccaatggggaaaaaataccgagaattgcctaattgaaacagaaaagagcagctcaagagtatcagattaggatcatggcaatttcttctgggtgaagagtcttgtcaggtactgagtattgccaatagttaggctgaaagtatatgacatatatgcccattaacaaccgggaccaatagaactatagaccttatggatggccttttctatattgtttagtctttggaatggtgttcttggactctagccacagtaccgaatacaaactggccatgcaagtcctagtgaatattaaactaatcaatataatttgacattatccctagcaattattagactctcaggactccctgtaggattgttgctgtaatgtgtttctggattactcggaacaagtttttttttttttacgagggttctaagtggttaattattacttctatttgtgtcatcaaccatgcacttcactataaagtttaaagtggtccaacgaatgcttccagataaattttggaatttcacctaatcaaacagttaaaatgtagaattaactttatgctttacctgtgtagacatgctagcagagagcagagtagagaagccgcatccaatatatgttccccgcgatgaggcatttgaggagctgaagcagggtgccttctcatcagggaggctccgggcagtacttcacacattgatcccatcgctgattgcatccatctcagctgagacccacaatttccaaggcttccaccacatcgacaacctctataaggagggcctcaggctgaagctgggcctgcaagaacacctattccagaagataccacttgttcagaagattcaagagtcgagcgaagggatgcttcgttacgacactcctagcattctttctagtaagcaatgatcattaattcgttttttacctcaagctgatttgccagcagaaaaagtttcttcgaattcaagaacccttaagaatcaccactaacaatgtctccctcattctgcagaggacaagtttgcatggctccgtgacgatgagtttgctaggcaggctgttgcaggaataaacccagttaacattgagcggctgcaggtaataagatgaaatcatgatcctcagctcagtcacagaaatttgtttttaatgttgatcaacatctgtaatccataacctgatttttggtaaaaacttaactgagataattgcctggaaataggttttcccaccagtgagcaagctggatcctgcaatctatggaccaccagaatcatcaattactgaaacacacatagctggacatctcaacggactcacagtacaacaggtaccatcattttgatgaggtcttaaatcatgtccagtagtgtccccatggttattctttctgatcacatgtcacaattgaaggcaatggacgaagcaaagctgttcatagtggactaccatgacgcatacctgccattcttggaccggatcaatgcgatagatggacggaaagcatatgcgacccgaacaatcttcttcctgacagaagctggcacactgaaaccgatcgctatcgagcttagtcttcctccagccaagccaggggagcctcggccaagcaaggtcctgacgcctccctatgatgctacctcgaattggctctggatgcttgccaaggcccatgtcagctccaacgatgctggtgtccatcagctggtcaatcactggtaaaaaaaaaaaagaacaaacatgccataatgttgtcactgctgccttgacaagaacaccaaattgtcaggtaacttctgaacattgtgactaaccgggtcctctctttcaggcttaggacgcatgcaacaatggagccgttcatcctggcggcgcaccggcatatgagcgcaatgcaccccatcttcaagctcctgcacccgcacatgcggtacacgctcgagatcaacgcgcttgcacggcagagcctcatcaacgccgacggagtgatcgagtcctgcttcacccccggccctgtctccggcgagatcagcgctgcttactaccgtaaccactggcggttcgacctggagggcctcccttccgacctcatccgcaggcaatgccctctcctccccatcaccatccatcatctgattctgaacaaacgacgaagcttttgtactttcatggtcactgacattgcctgattcgtctgcaattctcaggggagttgctgtggaggacgcgacgcagccccatggcgtcaggcttctcatcgaggactacccatacgcgaatgatgggctcctgctctggtcggcaattcgaagctgggtggagtcctacgtgcagctctactacccggacgccgggacggtgcagtgcgatcttgagctgcaggggtggtaccacgagtcgatccatgtcgggcacggcgacctccggcacgcgccgtggtggccgccgctctccacgccggtggacctggcgtccatcctgacgacgctggtctggctcgcgtcggcgcagcacgcggcgctcaacttcgggcagtacccgctgggcgggtacgtcccgaaccggccgccgctgatacggcggctgctgccggacctggagcgcgacgcggcggagtacgccgcgttcctcgccgacccgcaccgcttcttcctgaacgcgatgcccggggtgctggaggcgaccaagttcatggcggtggtggacacgctgtcgacgcactcgcccgacgaggagtacctcggcgaggggcgggacgagggcggcgtgccgtggacggcggacgaggcggccgtggcggcgcacggcatgttcgcggccgatgtgcgacgcgccgaggagaccatcgagaggcggaacgccgaccacggccggaagaaccggtgcggcgccggggtgctgccgtacgaactgctggcgcccagctcgccgccgggggtcacctgccgcggcgtgcccaacagcatctccatctgatctggcgacattgccgatccattcattcctctttgtgttctggatcaataattttagtaaaatgaatatgaaataggagtattaatcagtatccgtacccaaacgaaaccaaaccctccgcttctccaccgctccagtgccgcagccctcgccggagttcggtgactgggggcctccgaactccgggacctgcagacgacgacatcctacgcagccttgtccctgcctctgctcaccggcgacgatcacctcgcgcccattcagggaccatgttagaaaacaacagtgttgtggtgacagacttctcagatgatgatagcaattgtgaatgttctgtaaaaaaggaagaagattgtgagagtgtaagaacgagagcaaaatgggcttttcagcatctattcagtttgcaatgttgaggtgaaggcaatgccttactgatcttgcaattatgctctgcgccactgaactttgcttgctcatagtcatacctcgtagttgctgaacatctcaaggcgtcacggcgtcgaaatcgtttgcaacacctgcaggttgtttggagatcttaccgcatttgacggctccattgtttggcttataatggtatatttgtaaacaataagtaatttgtgaataaaattttttatatatgtattcttagcgacctaaaagtaaaggttgaaaaataaacttcgattaaaaaaggtcaaaatcaccttcaaattataggttgaaagtttaaattttgactgataagcataagcgaaaagatgaggcctgaaaatgtgaaacatggcaaagacctgctgataagaatagagtgagcttgcacgggtacaagttcagaaacgacctgaagatcaatatttccttcagaaaggcctttcccttgtcaagtaggaacaggtgccaagccagaaatgccctgccttttaagactgaactctagaagcagtttccactaaatgatgtgttgagacactgcctgccttgaagacttgaactcttgataacaggttgctaattttcttcacaaagtccatcaatgtacaaagtaaagggacacaaaagtagggcttatagcatgagaaaactaaaaatttagtactacacagaagataagctacctgaacaaagattacacactggaaaagtgtcatatcagcgcattcacaacttgtaacacccaacaacagataagaacacgtgtgattccatttcatttgtataaagacaggcatggataggcaattttatgcatatcaacatctcttcttctttttttacaacaggattatgcaactaactcaagccaggcaatggcaatatccccattgcattgcttaccctaataaaaagaaaaactgagtaaagggcaatgagaccaactccaagtatcttgttaggctgcatgccaccccgtggcagcataacaagagcccagatcaatccaccaacgaggaagctcattgtgtaaatgagagagctgtcttgaggaagaacataagagtttggtgctgttgaccaagctccaagcagcatcgatattcccaatccagcaagtgtattgaacataggtcctgcgtagcatccagacatggcgatctgcacaccatctcctccattcattgccaaggcaacatttgacattaagtcacccatcgaattaccccatgctaacacagttaacccaagaattgaaggattgatccccaatatcactccaaaagcaactaaaagtgcaaccagttcattggcaatgatgtagaaccagataatgctcatcacaaaccctcccaacacccatgggaataaaaatctccgtggaggtcgttcatggtcagtgaacatgaaagcgagagaagcaagtgccatcccagaaataccagctatcacatatgctgctatgtgagccttagtggataccccatcttgactgctccaaagaaatgccagcagaacaggcgccaagccagcactagcaacagcatattctttcgaccaccggtcttcctcaactattggaattgtcaaccttcttggtatcgtcaaggggagctccaaaaacaagaacagcttggagaagctaactgtggaattatccacttcttcatcactccaaccccatagcggcctggaactgtcaggtgaaccacctctgatcccatgatttgagtaaatggccacatgagaagcccacatccactgaggcaaggatgtgtttatttgagccacgtcaccatctgattcctcctcaagaagtgaactgtacacggactcatcatcttctgttccttgtgcaaagatactccctctcacaggcagcagtggtgtgaccacatcaaacttaagcctccgtgcatgcttcctcaatacctcatttgcagccaccacaaacgcataaaccacataaatcgacacaaacataatcgctccccaaacggtcaccttcccaacaatcaaaataatcgacagtgctactagagtcatcagaaagaacccaacatccctcacaaagcatcttctatcaatctgcacattcttctccgccacgcacaatgacacagctccgacaacaacacaagtcacaaagaccgctccgcccaacacactgttcagcccaacatcaccagcgccggtccccataaacgcggcaatactcgaaacacatcaggcgcgccattgccaaaggggacaatgtcactccggcgacggtcggcgggagccgtagcagcgcggacatcttctcaaggctgcagcagaagtaatccgcggccgtgttcccaagcatgtagaacagagccgctaggcacacaccgagcaccgcatagccgagcaccctgaacctctcgcaccggcagtagaagaagcccaagtagtcgacgaacccgccggagctacactgcgggtgcgcccggaggaactcgcactgggacccgaacccctcgtgccgcgctaccccggcgcacgccacggagggatccaccggcggctgctcgccgtttagctccccgatctccgacaggttggacgcggggctgataggatcggcatcggagaggaatctacggtgccccgtatgcgaatcgaagctcaatacccgtggagaccgcaccaagctcccgccggagcggctgtagagcaggaagaggaacagcacgagggaggcggcggcgaggggccgaatccggcgaggatgcggtcccgccgacgagatcatctccggcgaggtcagtgcctagggtttccggggacgggcatgccgaatttgggggtggcagcgagtgattcgggcggaggggaggggtttcgtggggcgcgggtcgtcggggtagggtttgcctgctcggaggattggaaggtgcggtttgggaattgcgagacggagttgacgactcgaggaggaaggaggcgaacgcggctt

SEQ ID NO: 83415 - DNA, 508 bp, Oryza sativa
ttgttggaatatactgacaactcctacgggagggaggacctaggtcgactattttagcccaaagctaatgcggaatggacaaaatggtactcaaatgctggaatcgaccggcatgccatgatattgtatccggaaacccgcttggcttctatgaaccacattgtgcttaagagacaattccgatcctccgggtatgagctctaaacatgaagaagcatagaggttttgtcaggaagcattcatccgctacccccaatctctatacccttacggcctacactacatacctaatataatagccatagaacataacacataccagcatatgacacagcaaagaaagctctccatagaagccgctgaagacgaatttacccacagatgcgcatgactagaatatgccacatcttatactatgccgataatatatggcactaagggagtgccttacaaccaaacgaggaacttggcctttaaaacatcaaactatacttgctaaaaaataaca

SEQ ID NO: 83416 - DNA, 996 bp, Oryza sativa
atcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggtac

SEQ ID NO: 83417 - DNA, 770 bp, Oryza sativa
tcatcacgatactcatagtggcctgagtgagtctggaaggctgtcttgggcttcttttcaaggtgcaaccctaatttgggaataccctgccttaaaatcaagttaaaaaaaatacttagctccaaaaagctcatccagaagctcatcaatgacaggcaaagggtattttcccttaattgtaattgcattcaggtgcttatagtctatgcaaagtctccaggtgccatctttctttttgactagcagtgctggtgatgaaaaagcactattgctgttttgtatgactccagactgaagcatttcagttacttgacgctcaatttcatccttgagtgctggggtatgcctatagggtctgaggttgactggacttgctccttccatcaccctaggtcgacggcgacgacgaaaaaggcggccggagcgaaggaaggcggcggcgcggctcgggtcgacggggtcgacggcgttccggcggtcggcgaccgaaacggaggggtggacgaggtcggcgaggatgcggcgaagccgaaggaggcggcgccgaggtgggaggtggtccggggcgacgacggcggcggaccggagctcgacggcgacggcgaagagagagagcgacggcgcgagctcgattccggcgaggaggaaaggcggcgagaggcggaaacggacggaggaggtgcagggagggtttaaatagagcccggtcgagagagggtggccggggaagggaggaaaccggcgcgggaggtcccgccgccatcaatggc

SEQ ID NO: 83418 - DNA, 3638 bp, Oryza sativa
atgagagcataaaattcactctaatttttaatagagcggggatctttactgctgttttcctaaaaagggcactaacaagtagattgaaaaggaggtaaatagagagagctacaaaaattgcagatacctgccaccatgcttttcctggcatgctaaactggaaaaagttccgagcactacaaactatagaacgagtcttccctggggccattggaatgttgaaagagcaaatccatatgacccatttctgatctccaaaaatgggtaactttgtgtctatctcaattctacaaaaaacgaaatactaaaagatcagaatcataagtggagttactggatgtgaaactgatatatgagctaattcacatcaaaaggcaaatgcaatgaaatgggaaaaggcatgattagagtgttttgctgaacatacttgttcagtgcatagcaaggggccacaaaagttgcactgatgcgagggtttccagaatttgaccctgaatatccccatgcaccacttgattccatcttgaatggcaaaggcctggctcgatctcttcgaccagtgacctgtgagaggagttaaattttgaggcaaggataatgctgcctagttaaccaatttctttggccatgggaatcgtacttttgctccatgaataatgaagggaagacaaatggtctaagttgtggatttactgaaagtgcatcttagataatgaatcatacctctagtccatgtaccatgaatccataacagacagttaatacagtagcctcgattaagtaagtattattcaattttagcactagccagtagcttaagtaaagagactgaacgatgctgcagctacattttcatatcaaggtgcaacaggcagttcaaaacaaaacattggcaatcatagtccaccagaagccactgttaagagattcaaccaaaaatagaactactaaaaccaaattgaggtatgatgtgcaagtacggtacacaacaaaccatcctcatatctcaaatgtgcaatatccaggactagcattgcgtgccagtacattaaagtaactgatcattctcaaataaaaaatgtagcattaccttgtggtgagcaaattctatatgcgacggatcagagacgttctccatcaatgtatcatagccatagtacagatccctctggatggtcaccgtggagaacgcaggatcctcaaactccttcggtaacctggaatcaaaaacaggatcaaacctcgtcaccgacgaccttaaccaaactcaatcaataaaccactaatccagaatatacacgcacatcggaggcttggtagccgtggccttctcccacccattctcgtcgggccacacgaagagcagcccttgcgagacgagggtggggaacttgatcgcgcacgccttcggcgacctcacagccttggcctccggcccctcgggcgccgcctgcgggatccgggtgcacgcgccggagccatcgaatgaccagccgtggtatgagcactgcaagcaccccgtctcatcgatccgcccctcctacgaacacacagacatccagatcatcgccgtgaattcaatcggatcaaaattggcgcaaaagaggaagagattggaagggcgcgtggcgatactcataccgagaggggcgcgaggcgatgggggcaacggtcgtcgagggcgacccactcgccggattttgggtccttccagatgacgaggtcgcggttgaggagctggaacggggtgggcacgctggggtcgaggtcctcgacgagggacacggggtaccagtggtccctccacacgaacttctcgtcggccgacgacgtgctcggctcggtctccccgggcgcctggtccgcctccccggggacggacggcggcgccgccacgcggagccgtgtgtcggcgcgggcgcggcggaggcgcaggcgaccggaagccgagagcgccgggagcgaggggacccggcggctcgccggcagcggcctcggggagaggagaagagatgcggtcggagccatcacgggcattttcgtcgactcgcttgggaagcctcggagatctgaggtttctgtgtggttttgaagatttttggcgtgccggtttttatagctcgcacctggtgtggtgagtggtgactgaggtaggcgaggagaccagtgttcttccagaagaacagagtagtagcacgatggaggaggaggaaggcgagagctaactggcactggtaaaatcgcctgtttctggcacgaaaaccagcagccggaagggggattcgaattttctcgtgcggagaggtgagaaactgaagaagagagtaggaaacggaggtggaggaggagtccgtggttgcgtgacggcacggcggaggaggcgggggacaagtgtgcagcaggagcacgcatggcgttttgcggggtgtcgtgtggtggagcttcggctacgcagcggcggccaacttccctgggtatactcactcgtagaggtggccaaacgggccgggccaaaacgggcggcccgaggcacggcggaacctgtagccggcacggcccggcacggcctgctacagtaacgggccgtgccggcacagcacgagtagccgtgccgtgcttgggccgccggccgagcccgcgggccggcacggcacggcacggctactgtagtaagtccgcatctcatccttccgcaagtccgtatctcatccctcccaactgacggcccagcccgctagccgcctccgcaagtccgttgagcacccctcctagctgatggcccagcccgccagccacctccgcaagtccgcatcgcatccctccgcgccatttcggttcctgggccaaccgtgccccgtccacggcccatttttcattcacgggcccgtactgacacggcgggccacacgcatgccgtgccggcacgggcacggcccggccatccacgggccgtgcttgggccggcggctcggcacgtgggtcgggacggcacggcccgtttcatgagccatgcctaacgggccgtgccgaaacgggccgtgccggacccgtgcccgtgccgtgccgggccgggccgcccgtttggccacctctactcactcgtgagaatgacacgaacccaaccggcttgtgggagccggtccgcccattggattctgggttcacttcggcagttcggcgccgtggacatgaacaggcagtgtacggaactttgaccgcccgcgccccatcagtgcactttgtgatccagaaccgtttgatactactatggcatttatttatgagtaaattgcatgttgggcctcatatttttaccatggttgcaagttgcaccggaggtatgcaccttgcttaacctcgtcctctgcccatcgtcgtgctcaacctttggcctcccactgcgatgcgctacttaagctcgaggttaacagatgccatgaagcctcaccttgcaatcttgcagtccattgttgtcatatgctagccacaagatggtagaagcacaaaacaataatcatcataaggctgcaatccacctgcccaatgtaaatgtcctcgaacatgtagagcttggagtgtgaccaactgaccatgggcttgctgacttggtgaaggaatactactagaccccctccccc

SEQ ID NO: 83419 - DNA, 3374 bp, Oryza sativa
  unsure (1)..(3374): unsure at all n locations
tggagctcagaccgggcgccgccgccgccactcccgcgtttccgctgctcgcagtgacatgccgccgcgccactcccatgcctacgccgcccgccaccgccgccgctccggccctcgccgcccgccgcaggagagaggaagagagagagagggagcggcgaggagggagaagaactggagggagggcagagagaagggacacgtgggtcccacaattttttttatgtgccactgacaaatggtcccacacatatttttaaactctaaatgccacctcaacgccacgtgtaaagaagacccggtcaataccgccacgtaggcgccacgtcaacaaaaccgtccttcaaaaccgccaagggagtcaaattgcaccggttttaagagtttgggtgtcgagatatccggtcttgtggtttagggttatggattagattttgatcgcttttgagggtcactaagtgtacttattccttttctaaaagaagaggccgaaacaacaaactatgggccatgatgggctgaaacctgaaagaagatctagaactccacggattgtggcccatttatctaatgttcctttgtgggtttttcttttatgacgaacttaaaaaaatgcccgtgcgttgcaacgggtgaaggctattttaatcttattatcgttatacggtttagttaatatgaaatttactgtgagaattcgcttgtatatatatttttctagaaaatcatgatctgagaattcgtttggatatatatttttctaaaaaatcatgagttgcaattaggagtctgatcatctcaagttagcatgcgagtttttttaaagagatttcttatacgactccatccatatttccaaaagcgaacgaacttaaaatcccgactcaaatacggatctatattttcaaaagcaaacaaacttaaaaaccgactcatacacggatgtcgtatcattatacgacagtaccggcaaaaaatcttcaattttaatttttatataaatagtagagataagataaagatacatgtgcatagtagcttgattgaatatttctctgattaggttttcgtatttctcttggcaaccgtgatcgatcggttgctgttcttgatcgtcttgctgcacgcgtggattttcgatatgtgggtagtaatagatctcggctttaatatcatgatttttttaaaatctttttgaaacacgtataaacagcagatcgtattggattgagtttctgataaacacagtaggaattcttctcgatacagtgtgcgtgtagagaaaaatcaacaaatcaacaatggtatgtcttgctgcttgcctcggtgcacggcgacacaactgactgctgctggttggtgttgatataggtgcgcgacagcaggttccaaaccgtgttgccgaacagatcgcatcggcaagatgacaacttcgcgatggtggttggttcgtgacaatgcactggacgaaacacaatcggccgaaggcactgatccgaacaagcaaattttggaaaatccaatgtttaaagctcatacacagtgggacaaataaatagttaaattgacagtgtgtcacgccccgaactagccccgaacggagctagcccgtgacgctccaaattaacctgttaatcgataacagtcccaggaaacagtgtcggtatcacaagaagacataatatcacggcaacagaggtctctttattacagagtaggagtacagtcatgttgggctgcggatagttcccgagctcacaactgcattacaaaagggaaagcggaagccaagacttggaccattcatcacaggcgcgacttgggaactaggtcgaaaccctaaaactcatcgtagctgacttgctcctggaagaactcctcatcagcaggatccacatcatcttcttccacaactaggggggattatttatatagagcaagggtgagtacaggagtactcagcaagccatgggaattaagtgtttaatgtagacttcaaaggaaaggctgttgtttttgcaattggttttatttaaactcctttttgaaacaactaagtgagtgcttctcaaacgacacggattagacagtgcatctcgtccggtcggagtatgtgcaatgtatcaatctttgaattgattcaaagttggcacccggccaacggctttcaaacggccacccgggcctggctgatcccatcagccgcagattttccaaacatcgaacccattccacaatagtaatttcacaagcagtagtcaaacaaaactacgctaggaatcacctcacatccgcccatgaccgtgggcacggctgttcgaatagtttaataacctctacagagggggtacactttacccacacgacattactaacccggatcacccagcccgtgcagaatggccacgtctggagactttgaggctttcatgacaaggcgcatttcgaaagccgacacaggttcaccatatgccaacgagaggggtcccagaccaacaccaggttagttcccagaccatactgtgccaggaaacccgggggttctccccagcaccaccccgttgaatccacatgtctcttggcatcatggctcccccgattagctaattactcagccaggggcgtcccattacacctatgtggtcgcacttgtcttatgttcggatgaaattccaaggaaacagtccttaagtgtaagagcgggaaaccgtactcccggtacgtcctctggtttgtggttttggaaattcatttagttcgcaagcaccgacncaggtgtcgggttttccaaatcttttgtaaaaccccaagttttacccatcgttggatattttaaatttgaagggaagtgttccaatgctcgagcccgaaggcccgtgcatcgaagcacaacagtcgacaaaggaggtctaagtgttcaataattcaaggagggtaattgcagcaattgggattgggaccagcaggctatctcacaagccgcggccgaattactcgtgttaatcctattcatgcaatatttgcggaaaagaaatacttagatttaaattataggtgtaagatgatcaaaggtgacttgccttgctcgagatcttgagctagatcctcgaaatcctcgcactgcgggtcttcaggctccgaaactacacgcgaaacgggacaactcaacaaacggcgaaaataaagcccaattattgacctctaaacgtgctattaaatagatctcgagatttgaggaattttgggagttgaacggagtcaaacggacatacggttgagaagatattgaatttctaagattattggatttttggtctaaaggaaaaaggatttaattaaacccttttgaaaagaaaagaaagagggaggggaaa

SEQ ID NO: 83420 - DNA, 155172 bp, Oryza sativa
  unsure (1)..(155172): unsure at all n locations
tcttccagctcaacattattacattacacgtagtgcacagaatttacagataaaatagaccaccgtatctcttcagagattgccttgcactttctgccttcaaaaacatcgtcaacaagtgtaaaggagctttcaatagttaaaactcaaaaactctactaagatggtccttcattcacttgccatttgctaattataaccaaaactcagagggttggcattttatggtgtctttctggaagggttttaaggggaactagggctcagtgggttgtaaaggggtgtcatgatcagtgcactaaactttaattatgtgcccatctcaatgaaaagctagtgcatctttgggtaaaaattcctgtgatcattcatatcaagtgcccccacaggaacgtgtcatgtgaagttgctgcttgcttgaaggataagccctactgaattaggtggtggcttggcaacagtggtccaaaatgctagatgcatggcagagaagagaccatctttgtccatgaattgtttttacatggatcatagtacgagattgagaagcctaatctatttttatactctctcttttttaataggtaacatcatttgcatagctgccgctgatgggattttgagatataaaacaagtcttctattctcttttgagttttgtaatgcattgcctggggtctgcttgtactacacttcaggatcagagaagatatatatgcatatagaatcagttttattttgttagtgaattataaccagtggcttttaaaatggggttaataatctgccagcacaaaatccaattcatgccgaaaaagtgagcatgcctcgacccatgaaactatatgatgcatttagaactgaactatcccacatgatttatcactcaattcgtcattaccattttagtagtcatatactctggccaaaagaaaccaaaagttttttttggggggtaagaatttgcttgaagtctctatatctagtcatgttttgtgcatttctacaattcaacatgagctcatctaagctacctggtcatcgtttaaagagaaaaaaaatataaatattaataaccaatgcagtgcacaccggggatgcataactaaactaacaggcatcatggatacaaaatgtgcagcaataatgacctagtagcaaatgaattgtgtatagtgtgtgatactagtggcaaatgcactgcatgctaaaggcattatcacaatttggaagcaagggctgtcttgaggatacaaatttaactgaatgaatttaaatacatggtcgaagaactaacaaatgctatatatttagatgtatccagtgagtacaacaatatgactgtctgctcacctttccaaggtcggtgaacttgaaaaaaatattgaggtactacaatactttcttatttgaccaaacattctgttacaaggctacaagtttatggggcagtcactaaaggagcactcttctttcgcattaagaaaaatgcagttttatgcattataaaaaatacaaaaagcagcacacagggggcagcaaatcaccttttctgcaacagactgctcaaatgattgtagacaccttctctcatggcatccctattaccagtatttaaggtgtaaataactgctccaggatgattcctcaacctcgcaactgcattttatgtggagaatatctagtcagcaatactttatttatttatttttgcaagtgtgtgggttcaggaaatcagaataatgactcatgtgtacatctgaagaaagctgtggcacaaaaatgttgttcttgtaagaatattggagttatccttcttttgatgtttgacatagcatagctggatataaggtagagtctaaaaaaaatgtgcaacttcataatacacctataattgaattggtattttagagcaaaccaccatgtaaatggtacttcgtaggagataatgtacagttagtaaaatcattaattagaagcttctgtcaagatgttaattattaagtgatggtacctccgggaatgtctcggcccaatcttggtacaggaattgtggctagcactggaatgttcgattcaataactctcattacagcagggaagaatgccgaactaaacagctccattttacccacttcatcaataatgaaaagatcagtgtcgtccttgacctgatgtgtaaaaagagttattaactccagatcacatgataaataatttttaaaccagctattctgatcattgtacaattaatattacatgtatcgcatgaatgtgctaaaacaatgtgcatcccttactttattttatacatctttagtcagaatggcttacctgcagctccggcaatgctagagactccagagaagctatatctactttgtacctcccaacagtaggccatctaacagactcgcggctgcaggaaaaaaaaacatagatgacatggacaggaattcagtaagcacacataaaaatcggattgacagtgaattcaaatataagtatttaacaaaggtcataagtcaaaccttacaaatttagttctgagataataagtagagcagaatgttagagaggacaataaggaaccgcggaatttcatgtacttataaatcagtattttgcatcggaactttcagaaggagtaatatcaaattttcctggtgatggccagtgacattaactttttttgcaactacggtggcgatgagaagcgtgtaactttaatccatttttctagttggatcatttccttgctatgtatacaatttgtcagtcaaacggatccaagttcagcaaacaagggaaaatgtcagatggacatgaggctgcacatgatccgagacatgaataagtagcttaataagctggataccagcagtggggcgatattctaccatcattgtcattgcataagtgtgcaggtaaaaaaaatacaacagatataggtaactagattataccgagtttatccataagtaagaaaaggcggcactatttaacatggacatggatgttagctacctaggattgcagctaaagtgcctgaaacttgatcatatgcaggaatacagtactccagattttgaaaacgaaaatgtccaaactaccacatcacaagtaggtggtggtggcacaggaaattgcgagcattctatcacatattcttttagcttgtcacaacagccagatgcacttgatttcagtgtatgaaaatctctcgcttcatatatgtcagaaagggaatcataatccaagcatggtagcaagatgaacccgacctggaaaccttggaggaggcgagcggcccggttcgcccatcgagcgtgacgacctcgaacccgaccctttccccactctccctcacctcgcctacacaacacgaaaacaggtgagatttctgatcgcgaaacagcgcgagcgagcgcgcgggggagcttctggaaagggcaactcagcgcagtacgggtgtagaagccgcgaatgttgagatgcgggtgggattcgcggagggtttcgaacacacgcgtaaccagcgtcgtcttccccacgccctgcgagagcggcggcggcggcggcggccgtgaggcggttgacgaaggaaggagaaagggtttagcggttggggtttgcgggatggggattccttaccggcgggccggtgacgaggaggcacctcgacggcgcggcggccatctggtcggtcgtggcagccggccgcggcgaggggcgggtcaccggcggcggccgcagcgccggcgtcggaggcaggacgggaggctggtggcgctgctgcgttgagattcgtgtctgtctgtttcggtgtttgtctctctgccacatgggcggatgggccacatggtacacggagagcgcgtaaccggcccagcgaaggcgtaaacatgaaatgggccggatgattgcttcctgggccaaagtgtggtgtacgtgatgttgggcccagccgtctgtacaggacggccaggtggaagagatatagtaatgctttgggactactatacatttgtcgacagatttttcccaaaaaatttgacagatgtaattatagtacaatcatagtgtaattacattgtaacttatatgtaattacactgtaacttgcatgtaactacagtgtaacttatatgtaagtttcacataattttgaatcgttagatctattactagatttgttttggtgaggaaaacacacatatgtgaaagaatttgttcccacgacctccattttaccgaaataacatgttacggagagatttttgaaagttacatacaagttacactatagttacagtgtaattacatgcaagttacagtgtaattacacttcaattgatgtactgtaattacatctgtcaaatttttgggaaaaaatttgtcgacaaatatataacaaaatcgaatgcttttggatgaaattcaaatgctgcatttattgcctgcttatctggcctgcctcattttgaattggaataacttaattttagaattaattgaggattttcttgctttttatattcagcttttgtaatttttggctgctacgagtaaagggcaaagtaatttgcactctgggtcacatattattaccgaaatttcacttttatcatataagaaggtcctttttcacttgaactaggtatgcttaatatatgttaggatgtggattctcgttgtatggccatgtcaacgacaaactattacgtccaaagaatttgtatataggagttgcactttgaactgggtggccgcatgtcaatgactaaccacctcttatgtctacgtgggtcgctcggtttaaaaagtgcaataattgccaacagtatctagtttaatgagaaaaaacacttcaaaaggtagtttaaaatggaactcgacaaaaatgtagtgtctagtgtgtaatttattggtaaaagcataaaaatcctatcctaaaattagtttttacgtactttggctatgccataaattgtactcatgaaaatagcttccaatttcccagacaaacgtgcattgtttccatttagtgggtcacgtgtcttataacagacattctggtttagcaaacggtaaatctaattagagaggcctctctaattagttttaaccagagacatccgcgtgctagtactttaggagttttggttgctatcaatccattgagcaagtaggggaaatattcctatcatctatgattcaaataaaattttctcttaaattactcatccgatttacaatccgattacaccgttgtgttcgtaataattaaatctttataacaagatctcacatgattatattttgatgaaaaatcacaaattacttttatgatatgtctaaattacttttagatttcactaagttacttcttagacatataaaagtaaaatcagtaaagcctaaaagtaatttacatatattatagaagtaacttataaaaaaaagtaactttaattaatgccttttttcattgaacaaaatatcacacatatatatgtgtgtgtgagagagagagagttacttttagatttgattaaaatacttcctatacattcataatgctatgagatgattacttttatttttttagttaattccataatttgtgctgattaatttaatttctagatagagtcatgtttttatctctacaacggatttacttcaaataacatgctaaagttacattcgttttgttctaagtcacttctataatatatgtaaattacttttaagttttactgaatttacttttatatatataagaagtaacttagtgaaatctaaaagtaatttagacatatcataaaagtattttgtgatttttcatcaaaacataataatgtgagatcttgttgtaaagatttaattgttacgaacacaacagtgtaatcggatcgtagatcggatggatagtttaagagaaaattgtatttgaagtataggtggatgatgcctcttatagatagagtggtagctgatttagacaagccagctatcactagctgtgtagttacgccctttagcaaactgttttgtgtgtatgtgtgaattggtatggcagagttttagcatcaactatttgcactatcatgcagtatggcgatttttgaatgtcatttgcctcgatacaacatgctgagacacatagaagtataggtatagcattaatatttatccgtatctccatagtatactactatagtatcttctccatttaacaacggtgatctttttcagagagcacaacagaacacgcacatgttttttttagccctggacacgcacatgtagacatgtatttagacatgcagtaacagcatcatgtctcaaaatttcgtgctcgaggatctgccttctcacactcattttgtctgattaagcactcttaattaaaaaacggtctgcctaaaacaccagacggaaaaatgtaacaaaaattgcgggtaatagcaatataacagttgcaaatgtcaaaattcttttgttccactgacatgtgggcccacgaccttcagtacgcgacccctggagcacccaccaatcagtttcgcccacgacacgcggtggaccggtcccacaccttccccccacccccaccaaacgcgccccgaggccggccgatccgaaaccgtctacacggagcgctcgagccgaaccccgccttccatgtgggccccacgtatccccctaccccacatgtcattgggtagggcgatcccccgcccgagccggacgaccccgccgcaaccgaaaggcccccccccctctcccaaagggaaaaaaaataccaaacgcacgcaaagccacacgcaccccgacccgttcccagccaaggccaccccccgcccgcaccaccaccaccaccacctcctcctcccgccgccgccgccgcggccttcgatggcgaagacccggaaggccgcggccgctccgccacctccgcccccgcccccacccgcggagaccccagcgaggaggaaggggaagaagaaggggcggccgtccctcctcgacctgcagcggcgcagcctccgcctccaggcccaaaaccctagcccggccccgtccccctcgcggcgggacgccaatccgtccgacgaggacgacgacggggtcgggagtggggggcgccgacggcagaagcggctcaagagcgtcctctccagcagcggcggcggcgaggtcgggcgcgctccccccctcttacctgtcgcgccaatttttcgaaatttgcccgaggtttttgggggcctccccgaggagaggagaggggggtttttgccgtgggacacgcgatgatgcggttgccgtagtggttggatctgcgattttggaatttttttgaggggggtgggtttcgtggtacggctcgctctcgtggtggggaatctggcgggagggggagatcagtgcgactgtgggagtggcacttggggatttttagcttcttggagagcgttgctttttttgggcgggtttggatttttatttggttttcctatggagtccgggtctagggatcttgaccctgtcagcgctttaatcctttccatcgaagggaacagtacgcggatctgacaagttttgacggatttgacctttttcctcccggattattgtgttgcaagcgctgtccggggttgaaaaagcgccaaaagtcttcgttttttgtgtgccaagtctggagttttgcagcacttcgccctggcagtcgcaaaaggctgacgttcctccgtttccatggcgaattcgactctgacggctcctgttcgatgctgcaggatgatgaggcgcccgcggcccccgtggtggtgaaggtgnaggtgnagnagaagaagaagaaggtctcgtcgaaagcgaccggaaaggtgaggcttggagggaagccaagcattagtgttgaagtggttaaagaatttgaaattttctcgggttaactcctccttgcgcttgtgggagcaggggacgctgcgtcggatggcgggcccactacggggactcccctcccggacaaaaagttgcttctcttcatcctcgacaggctccagaagtgagtggcccggccccatcctgatgtagttctcttctccccccaataagagcttgcctctgattgcttcagctatgtatgtgtgtatctcttctttgtactgctcccaggaaggacacctatggagttttctcggagcccgtcgaccatgaggaggtgagcaattcagttcttggtctgctgtgtatttgtgttctgaagtttgcagtgatgatgttgacaactgttttgtgttttgtgtatctgttgttgtgcgtgcttgcatgcagcttccagattaccatgagattatcgagcatcctatggacttctcgacgatccgcgagaagctgttgaatgactcgtataccaccctagagcagtttgaggtatgatgcctgtagtttgagttgctgtctccttgcgtgttgtctgttttattggcttttcattcactgacactacagatgtttgcttctgtctactgttctgtacttcacgttttttctattgctttatatctgctaaggctagttctgttattttcctgtaaaatcctaggtctcgtgtctagcttcacatgtcttctctctcttttgtttgtaccacaagtgtctatgcagttttaagtcaaactagtttatcttcataattcactttcaatgaatttgttgatactggttgttggtattgtttatgaagccactgaagtgttttctgcattttggtaacaatgtcaaggaattcctgatttgagaaagtacatttggtatatccttgttcttacacagggtcaaattattgttttttttatgagttaatgccttcattaatggaaagtgctctctggattggcatgtagaggtcgcatgtgctactttttaatgatcatcgtggactgtagctaagagaaagcccagtaaacttcataatgattcctcctattttagctccaaagttgtatccattcaataactaccagttactttatgctcactatttatagtctttccctgttgatttgcccaacttagtggtggaagcttcgcattcttctcggcaggctagcacatggttcatttgtgtgctaactcaggctaagagcaatcccaaatttgatggttctgtatactcaaattggctgcttaaactaaaaatatcaatatctcaaaacactggtaaaccatagtccatattgaaactgtacttcttggatagattataactctatctatcccttcagaagtgagattcaagttctgcactgtatggtgtttgagtccaattttcaagttctgcatcaactcaaatgatctggggatgtttgtaaatttgtttctttctagtaacggatcttcatgtgaagtggacttcaaatagccttcatgttttctattctggcacaaatgttctccagccactattatattttcttcataatgtctatattttgttttcagccctatttttctcttaaaagttctgcgcttttctcttgataagcgtttcggaggagagagtttgtcatttcaggccattaaaaaaccttttagcgacacagatatggttgctttattattttgtttttggggtttatccgtgtttatataccactgagttctatcaaaggtccataatgtgctgctaacgccaacttattgatctgtcattgtaacgactcggtgggatattttgttcttccattttgtacaatgtattgagttttgaaaaattgctgtgtagctttgcacagcaacattgttaagagttttccacttgtcctgcatatgtttgctgtatggatttttttcttctaaaattagtaaatcatgaagcaaatcataatggagtaagagtaacactttgcttaagtagtttggatcttcgcttaaaatctctttttttttttggctttactagtatgaaccttctcttaatatctaatgtttttttaatgattgtgcagaatgatgtgtttctacttacatcaaatgccatgtcctacaattcagacgacacagtctactatcggcaggtatctattttactaatgctgtaatgcatgtgccttttgcaacaggactatgtgatccattttgtagatataccgccgtactgtttgcacgcattcaatgcttggtttatataggttattcataacccttgcaaatttcttatgcttggtgcagtttcttttcgtgagacttctataaatttgtgcacctgttacacaaatggcacattcttctttttgttcctgttgtgcttttgtagttggtgtttttatttcgtgtgaatatcattgttacactaaggccaacacaagtttttttttaatcaacttcctttggtatttttattttgatactcctttggactcttagaacattggaagtccattggatttgtgttatactgataatttctacaaagccaagacacctaggtcgctatcttccacagtatgtttccccagctggtagggatgaaaacggagcggatagtttccgtccgctcaggacaaaaacggatacggatacctttcggatcggataattctcggatagttcggatacggatacgaatacggatattttctcccggatacgaatacgaatatggtaccagggtttccgtcggatacggataataattcggatatccggtgaacggtgctattcggatatccgcaggacccatgagacataccccatttctttctaactctataaccttcaatatacctttatagattttaatagtagtttatctcttaacactagtcactattaatattatttaaattttaaaaaatatttataaattatacctcattttatataaaatgagctaattatatatgttgatatttgtttccattagaagttgagttggttttcgtgttccgagaaaaaattgtttccgtattcgtgtccgatcatatttgattcttattcgtattcgagataatccgtatttgtttccgtattcgagctatccgtattcgttttcgtatccggtaaaaaatatgaaaacgaatatggtatgagcattatccgtccgtatccgctccgttttcatccctaccagctggaattatactgcagcacaaaagaaatcgatacacttgcataaatacgaggcattgtatgtaggataaattccttctcttatctggaaactgttgaaatccattgacgtgatcctttctgttatcttttgtcttaagactattttattttgcaagttagcctatctttgtggtctttttggcttccaatttcctgagatgttcatttatctacttaggcacgatctattgaagctctggccaaaaaggatttcgagaacctgaggcaagctagtgagcctgaagaagaacaacaacccaagactgtacccagaagaggcagaccaccaaaatatgcaaagaaaattgagaagactgaaaatgatgtttcaccagatttatccaatgcaaaaacaaaatctgcagaccatgctgaaacaattagaaaaaggttgactggggacagaactcgaaatgcaaatatcacaacaagagactcaccctttcttcaacataatacacctggttcttttgctggtaaaagaacagatagatttggtgattattcaggtttgtttttattgctaattgctcgtatctctacagtgctgtacttatggagcttgagcatggcttgatatcgtggtatctttcaggccttcgaagtacggaaagaagaccaccccgactatttcagatgatgagcgtcgtagtacatacgatcagcaatacttccatagtagtcctctgttttctgcccttggtggtgagaggaaagtacttgtgccggtaagcacgttcagaaaattttgtcctgaataatttatgaattaaaagatttataaaccttgccaacttacctactgaacgtttgcaactactacttggtgcattgctatctcaatgctgagttattttaattatggaaacaggtgggacttcaacagcaacatgcatatgctaggagcttggcgcggtttgctgcaaaatttggtcccgtaggctgggacatagcagcaaagagaatcagacgactactgccttctggaacaaattttggcccaggatgggttgtggatggtgagccacctgagaactctcagtggcctcgagttcccatgctctctgatccatccatccagtctactggtgttccagctagcaacgtaatatccaagaatgatgaatccaatcagaagtctggactgacttcgaacgaggattctggtgaagagcatctagctagaaccgagccagtggcttctacatctgcatgcgttaacacaaactctgtatctgccaccaagctagctaccaagtgtgaaaacggggctaatgtgtcatgtgatggtgtgggtagtactggacagacacctcccttgcagcagcacagccatagtcgagagatccactcaaatatgaatggcttcactgccttgccaaacacaattagtcaatacgcagggcaaggattcttgggacagatgcagttgacacatgctcaagttcttgggatgttttccggagtcaatggcagaacaaatggctttatccatgggcacccactggtggctaatagcattaaagcaccacaaaatggggatgttggaaaggtagccactaatccatcaccagatgcaggtcatgattcagaagctgcattatcacaaaccatgactagttctgctccaagtttaagtgctggtgttcaaccatcaggttccatgccaagcgaaaagttagcaaatccaaaaaagcacccggacttggcattgcagctctgaagacaattagccattgacatagttcagcttagcgccgtccttgattggaaacatgattcagaatcccagcttctcgagtccttattctccgcttctgctatgctgatggatattgtagcagcacactgagtggttctgagggagaattaacaatggatttctcgtcgaagaataattcattgtgaggcgaggtcatgggaaggagtaactagagccgatgaatcgtttgactcccagcaaatttgttgtaaaagggtaggtagtctgtatagattctaatcttatttccgatgataatgtttcggatgggcagcatctggcatccaatgtgtaacattatactagtggaggtatacaagcagggagggaggcaagtgcataggtgtgcctttttcctgcgaggattgatccgattccaggttgtatgagactggcggatggacgactgctgcaactccaccccagttgagctgagtagcaagtagcctgagtcaccaaaatcttgctctgagcccctgacatgattctgtgttgacattttcactgacatgattatgtagtgttttaacatttgttgatgttgctcttgactgtacttcttgctctggaatctgggatacccggatacatatgctgttgatatttgatacttcccacggtgccagcatcagggttcatgcttttgacgaaaaccgtaacgttttgaagttttgtcgtggagctaaagtagatttcgagtgaaacttcgaatggtttttgagaattaaaatctgaaacagtaaatctggctgatattttgttgaaatttgttgaaatccgtcgtactatcatgtggtaggataccccggtgctcaatccgaaaggtgaactctggacaccattctgttgtccttggttttcacagcactaaggcaatgattactcacagtttcaatcacgaagacagcacgatcggtccagttggaaggtgaaaaaaactgggccgtgccattgtcctgcggatctgcatggacattgcatgattctttgcaaggtggcctccatgatctcccgctctgaaatccgatatttgcatccgtccagatcgcagatgacgaagacgatcgagtcgtaccgatgctgctgctgctgctgctgcacccaaatcgcgtagattttactaccacagcaacgcggaggccgtatcaacacgtgaaaacggcaacgaggaggagagagcccgtgaggttgcgcgccatggatggcaatggcgtcgcataccatcatcatcatcatcatgcttggcgccgctggcccattgatggtgagcatcgagatccggttgcctgcccccggccattccattacttcctcacagtgaaactgtttcggcccgtactgtcctccggtaccagtgtcgtccactgcctctactgttccacctccactttctccccccagcaaaaattgcagctaagcttgctgctgtttccatgccaagtgtatatattcagttacaaacaaaaaaaagtacagtgtctatataaacggaatccgttcctttgacctactgacctctgtgttaacactgggtgactgatatatgggttctctaataagcgagcctatatgttagtcacccacgtcaggagcggtacgttagcggagtcttatttttatgtacaccggctaacttgactattttccttcgtcttttgagttgcaagaaatttcctttttcttatctatccgaaagtatctcttttaatgtgctcaaaagataaaagtaagaaaataattccgcggagtatagtgcgacgcggagtgagaaaggtctctctcttcggtttattcactgatatgaaatgaaatttagcacttatttttttattgattcctggggctagacgaaaacccaattaaataattgattcctattgaaataatattagggttccttcgaaatgtacaattgcgaaaagacatgaataggaaaaaacaactgaatagaatctcctagtcattgtattcttataggattttaaaacataggaaactttcaaaattactgattgattggcacacagaaaaaacatagaaatagggtttcatagtcattgggtttttataggattttgaaacacgagaaactttcaaaattatcgtttgatttgcatacaagaaaaacataaaaatttaagacattgtagtaagaaaacttaaggtgagccctcatgtttctcttcggaactgtacattattactctaaaatgatccattccataagaattttaaagaaataagtattgccccttgaaaggaacaaagggttgtttcctactggaaacaaatcctttagaatttctatgttttttctttgtttcaaagcggccttacgggtaacatgaattgaatccgtgataaaatcatgcatccacgaccatatctcacgcacagtgatagtggtttcccactcgacatcttgattttgttggaatcaatctagcaatttttgtctatcattcatctgcttgattgctatccagtagggattgattgggacgaaaagattggcttgtgatctacgcaaaaaactctgatagactgatcatgccgaatcgtcaggatttgagtggtttgcaaggaatggaagcatatctatatgtactatcatgttaagacacagcttggctgcttatgatcaggcgtcctaggaacctaagtacaacatcagcaacacggaatactaatgctaccttacgacctgatgcaactgcaagtggccattgcaaacgctataatttcgccgtgaattcatcgagcgtgcgcgcatgtgaggcgaggcatgcgacttcacatgcatggagatggagactaaagctacaatcggttcacatccacttgccaattgctaattatgcctaacctgtcattctgtcaagttttaatcccacatttcgtcagccatttggtccacaattctgcaatggatgcgagagttcagcgtatgagttctccggtttatgatctcgcatctgtcttatcccagtaattcatattatgtgtgtgctttgaatgacagtttcagtgcaactaattgcactataaagtataaacaatatactctgttttttataataatgaataagaatccgatatctatatttataagtgaatatgaaaataaaatttacttataaatttttttgaaaaaaaatgtatggagtacaatcaagtaatcaactaccacttgtcgtcgcacttacaacataatgttaagaatttattggtcactctccatccctttggctagctatagttcagttgtgacaatactagtcggagtattaggcaccaaaactaaccaggcacttgacgccactgattaattaattactcctaactgactgataaatcaatctctttattgacgactgctcctgcagaacagcactccagctctactaactagctagctagatccgcgtcacctggtgctaatgataataggagtactagtaatcagtaatcacgagcagtgtgtagcactgttctgcattattgtccgtattctattcagccatttgtgcgtgttacacgatgacgagctactagcgccatagcttaattagcctttcagcgccggtcatgggagagccaaatactcgttgctttctcggcacaaatggacaaatcacaaatggacaaatagtgtgatgcattgcctgcttgattaattggaaggcctgtatcgcttaattctctttgcccatgttaattcgagttatcaattttttttaaaaaaactgtttagatggttttttaaagaaacaaggggacttcctctggaatgaccaaaacagcttcccagccaccatttgtgcatgaacactccccttgatttgtccatccaccctcaacattcaacaaccacgatcacacgacatgtgtgaccgtacctcctcgcagagaagatcatcaaagagagatgaattgtacagccaaaatggctaaatgggcccttgatgagttcatgaacatgttgagaagttcatggtccaatttaacaggtaataatacggcagtttgtctgccccgttcctgactgttggatcatgcatatttccggtttcataattcagactggccgggccagggctttcatgcaccttgtgtacgtattttggactactgaacagcacaaattcgcacctacctcttcaaaaaaatcaactttagacgaatctagacaagtattttatactcagaatttttttagtggagagagtatacatttcatctcatcttatcacatcattagaatcgattacataagatttcagtttgctgaaaaccaagcgaaaatccataaaaatagataactttcgatcaactccataagaaaaccaactccgctcatttttcataaaaatgatccccggttttcgctgtgtttcgatcggtattggaaacccttcgctaggaccatgacaaaaccaaaattacattaggttattagggccattattggacattgttcgcactgttgcaaagttggcaactttccctgaagtcgcaggcatgcaccgtccatcatgtcatgctgcatgcccgggccaatgcattgcatgacgcagctgcaatccattccgattcctgtttcgtctgcaaaagtttggacttgctcgatggcgatgatgataccctactccttgctctctacgacccaaatgatgagtccatgttgcagttgcatactccctccgtcaaaaaaaaaaagaagataaacctgggtttccatgcccaatgtttgaccgtctgtcttatttgaaaaaattataaaaaaattaaaaaaacaagtcatgcataaagtattaatcatgttttatcatctaacaccaataaaaatacgaattataaaaaaatttcatataagacggacagtcaaagttggacacgcaaatccagagtttgccttttttttagacggagagagtacatgattatatatcttggtatacatttatccatccagagatcataggtgaccacactgacttgttaattactgtcagattaactcctaattagtttaccggaggcacaggtaattcaagggctcagctttaatttgcagtactccttttttttttgactaaaattttttttattacttgaacaggatctgttcaatttgcagtactcctcatctgcagttagctagttcagaccaagagttggtcccttgatacaattttacatgtgagatcacattcacatgtgaccctctcctccaccaaatgcaattcgtggctgaaaaccagaaaccttctgaattttttttaagcctgaaacctcctcaactaattttctctgaagaaaagaagaggtttctgaattctgaaacatgttccactccacacaatagtctctggtagctgtgtaggggacatgtctgatgtctcacctccatatttttcaggtagatattgtattatagtctctattatatgccaataattgttttcagatatttttaatattgaggaaaaatcaggtctgctccatatgatttctttgtggtacttgttcgatttagatcagagcattactagttaattaatgccacgtaccaagtcccatgtatgcgggctgtggaccccaagcaaatatgattgtagattcaacagagtttggtagcaattttgttttgcgtccatcaagagctgcactgaaaatagcttgggaaagcatttcagggaacacttctccctgacatggcccagcttggcaggccacatttgaccttaaggcaatggctgatatggaacttgaacaagaggatagaacaagatggcaccgacagatcctttacccactgtcaaaagtgaaaaggttagctatggcctcttgtcatttttttaaaaggaaaaaatattttttcagtatttaattgtatatctagatgctcttgtcttgactatgcatagaagttgtgtccagctcttgttgcatgtacatacttcaccagaagtttgttctgtttggaagatgcatttgtctctcttggagaggacataacagtttcacaatttactatgcaatcgtagtatgcatcaaccctgaacagtagtgcagtactataatatgcaaaagttcatgttgtttattataatatgccatattgcattgcacaagccacaaaagaggggataataccaaggatcaagcaggttttatcaacaccattctaatcccacactcccttgtagtacttgtgatcaccacccccaattcagaaatcacaggctcgtttaatgtagattattggatatagattattgccacggatccatcagttgcattatcttcccctcaaggctcaagctgatgcatagaaaactaaacacaagcacgttgtttcatagtgtttctgaaacccaaggcgcacacacatgcatgcaccagcatcttccatgattactgacacgctaaccaagcactgttcccacatctgaagccctgcacttcttcataccacatttttacctccacaccgacgcatttggagaagggatatgagctgagtagggcaagttctcagctaaccaatgcaaatgcatttaagattcagcgtaacttcgcctgcctgaatcctggtgttcattgatgcttcattcagagagaggctgaattttatttacgatctccactgttcgcattgcacaatttgccctgtgaaactatagtgcagcgacgtatagtagtgcatgctacttgaacgcccttgtctcctgcctctgaatggaattcgatcctggtggttgtaccatgtatgactctctaataaacccctttggtacagactgggatcaatggcctggtcgccgtgaagctgttcaaccttctcgcttactcacatgggttcaggtcctggtctcctgggacaaaatctaatgaccatttctttgagatgagatcatcttcattgtgagggatgaagtcgtgtcagtatgagactattcaatatgatttagatttcgacgctaacgaatactatacgcacgtagatacacttataatagaattataataagattagttatttataatagatatccgcctctttaaacatatgtaaagtgttagggaggtattggccatggtgtgatgagtggtgtataccctttatctaaaaagaataaaatttcccccgcaaaaataaaataaaattttgactatgactctaaacaaatatttatccgaattcatggctgatttgattttttataagacggatgaagtaagagcaaatttaatagtatagcccactactagctataattcatatataaccaatctaataactaattcatataatagttgtttactatactattaatatatggtatcacctatcatacatatactgcgtcttagaatccgtgctgcaactggttacagatttgtagctcgctgctcttatctctcactttttatcttattaaaatatgtttataaatgtctaatagtctgctattgtacctgctctaacggagaaaaataaatatgcaagctatgtgacagtgacacgtgggatcctcaaggtcgtccgtgggatccacgtgtcaacctcgtgacgagcgtctctgctgcactgacctggctgcccacactccacagagaggagtgagagtgacaaatactcagtactatcttgtacaccggcgattgccgcggtggagatcacgctggcgatgaaagcaacgatttttacacaaacacatcacacactacatcagcagagccaagaacccttacacacacagccacactccatccccaagctcgcgggaaaagccaaagcagcagccaaagaaatccaccttttctagacaaaaattttagacgaaccgcgagactgatggccggctttcaaatacggcagccgggcgctttccctctcgattccccgctgcagatgagatgagatgagaggagaggaaatctccagggaaatttggcaggcataaatgggtagtaattgattgattggggtggttaatgccttccaagattgctcctctgctgctgtgctgctagggttgtgcgattcggcatggggaccaaaccagagaggggaggggggggggggggggcatgacgacgacgacgcccccgttgctataattccttgcnccgtttcgccaaatccctcgggctgttgcctcctaccccgcaatccctcctcgccggttggtgatcaatccggctcctgatttgaagtttctcttggggacccagggtgcccgttccatgcccggtttgctcgtgcattaatactagccgcttcttggataggaggacaactagtagtagttcttctctcctctcgctcgctgttccttgccccattctcttggcttcttcttcttcttcttcttcttgttgtggttgtgtgttatgataagagttcttcgccgttgagatgggttgctttgggtgcttctcgccggaggtggacgacgacctcaagccatccaagcccaattaccactcttctgacgaatcatcaggttcttgatttttttttcctctcgtgtttcagactttcagttagttccggtttttttgctgggattgtgactgtttatctttgcaggcgccgacgcgaggagaaaggtcgcgccgttggcgacggatggggggaacggctacgcgcacagcttcaccttcaaggatctgtcagtggcgaccggctacttcaacgaggcgaatttcatcggagaaggtggctttgggaaggtgtacaaaggcaagatcaatgggcaggtgagttcaacgactccttcatattctacttcttgagatctttcgtgctccaagatttggttttcactttatgtttttttttaatgttcttcgtatgtggtgtgtagatggtggcagtgaagcagctcacccgggacggcgtgcaggggaggaacgagttcttggtggaggtgctgatgctgaccgtgctcaaccatccgcatctagtcagtttggtcggcttctgcgcgcagggtgacgagaggctgctggtgtacgagtacatgccattcggcagcttggagagccatctcttcggtaagttttcctcaaactttgctgtgcatgatagccgcctagttcatgttgggatttggtgttttgaaagaggagtttgtctgctcttggcagtttacatgttactgttgaaatgactttccctatctttttggcagattacgcgccagtgttaaaatgcctcattttttgtacttattgtagttctctgcttgtgataattttttttgcctaactttatactcgactagctctccttcattccactccagtgatatgctttctcaaaattttagcctagaagcaatatcctgatatctttcctcactaattgcttgttaagtactaatgctgtgtttatatgaggaaaagataaaagaagaaatggcatggaacatttatttagctcaatatgaaattatatgaaaggagagagaaaccctgaacaagcaaatcgttgatatcttctccttttcctggttgaataattgggtgctttttccttcagttcctgaaaaactttcttgacatgtttctttagctttgctgctgtgtttgtaaatgcttttactgcagctcccatactgcactgagttttactcacttatcaatatcgtcattcttattaactaagcgaccatcataaaaatgtatgtctgttccacaatgcaaggaaacattttaggactgtacaatgaaagtaatcgatatccatggcgggatcataataaatcctcgtatggtagtactaactactaaccaataatcttgtagcattgacgttcttttttagtgttacattgtagtattagctcgttgttattatttcatttttaatataagaggttattggtgcaaacagttatgttctactattgctacaaagcctcactgaaaataaaaaaaacaaaccaatcatttatgtgctgaaaattttcactctgaaataggagtagatgacaatgatgataaagctgagattattgatgcacttataaaaacaaagagatataaacttcaactgagcaactcagctatctgtgttactagatttcaggatgatatctatctctattgactattggtgcatccaccttattagttctattataattgagattctgcatttaaagatgtaaaatattagaataaacaacaataaaggaactattcaataaatatgccgcagtcagtctacactttcttcctagtaaaatttctagccatatgtctttgcctttgccatctttcttgtcctgttcacataaagaccgaatatgtttttgaagctttcaaaaaccatgaatgaggaacttttattgctggtaagatgacagggaaactagttatcttgctgtgggttatcaacgtagggttgtaggccagtaagccagttactcccaacgactgggatgtatttattgtctattaaatgagaactaggttattgcaaagttcggaagttctattgtatttgcaatttagattgtgcaaaccatccagtttttgcaagggtgcaaaactaaagaaaataaatcagatctattattcagtcaacacaaaagttttgtgatacttgtttatttaatctccaaccagagaagccaccttgtgttgatcaaccattttcctagatgccaaattattcagcaaaataatacctaagtctagccaaactgtccccacggctaattattaaagctcgtaggccttcatggcttgtctcatgcctgagcagcacatgctctcctgaatgataccagcattagcctgctaggtaatggacatgatgtgaatcatcttaacttctttttgaagattcctcatttttgtaaatttacaatttgttgagatgaagtgttattccatatgatatcactgataattcccatcccataatgcaactgtgaaacaattgaatttgccatgcaattatgtgatagaattttggagctgtgcattatcaattgcttgtattgatatacttgatgtattttaggccactgcttaatgctacattctgaaattccttgtcagcagctagttctatattcagtaaaaatatcatcatccaccctacaatatttttttattcagtattcatcttgtacatttcattgaattgatagaaatttcacctttgaatagatgtgcctcttggcaagcagccactggactggaatacacgcatgaggatagctgttggagtggccgaagggctttcgtatttgcacaatgtggctgatccgcctataatttaccgtgacatgaaagcagctaacattctgttggatgaggactacagaccaaagctctctgatttcggactagcaaaagttggaccagtcggtgacagaactcatgtctccaccagggttatgggaacttatggctactgtgctcctgactatgtggtgagtggtaagcttaccatgaaatctgacatatacagttttggtgttctcctgttggaactgatcaccggcagaaggatctacgatgcttcaaggcctaaaccagagcagagtttactaacatgggtaagcagctttaccttctcctagtttatgcttccagtgttctatctcttgttctgctgcttctcaaaattggcctgtcatagttttattattagaaatttagaacatgaagtatcatggtgtatgctgtctatgcaagtccaattatttgacaatcctttaatttcaatgtttctggttcctgttgggttgatactgctgatataatcgcccatattgccatggcatatttttatatgaatatgagatgacacattatattcctcgtaaaaagcttaaattcttttaaggattttagctcattaatgctttcacttttttttgaaaacaatttttgcagtcaagaccatttctgcatgacaagaggaaattctacaggctcgctgacccagctctgcacgggtgctatccaacatctgcactaaatcagttggttgtgatcagcatcatgtgcctccaagatcagccccacgtccgcccaatcatctctgatgtcgtaatcggcctgaaccatgtcgcaagccagccatatgtccctgagcgctcctcagtgtcgctgagttccccagcaaggtgcgggtcaccacaatatgccggcacgccatctagaaggcgaggcggcagaagagttgctcagtatgcatagcctagactatatccttgtctcaaaagaacagcaagatctcagtctggtgagacgggtagatagttgaaactgtcaaaaatgccatatagtcaaagccttcttgattcaagaaccggtctttagcaacccgattgacacagtttgctgtgagattggtgatagtttgaagctgaccatgatgactgttgttctttcatgcctttcattgttttcagttccttaattctgttgccagtgtacatagcatcatcggttgtgctctgcttgggcagcagccatcagacatgcatcagtccggcctggaagcatggggacaatgtacttaattgggattttgatcaagttatttaatcatgtacaaagctctcatgcctttgctgcatattactgccatcttgtagctggaacaaatctgaaatgtctctgttaagagtactgccgcaaaatcgtctcctcttcctagctttgtactgagaattttgttgaatgagaaattgtgaactgtgcatgagaaggttgacgcctgtcgatctgaagaagaggtcctggatgatgatgtcaccagttaatcaacagtggactctgatgaagctgaagatttggtccacggagcagccacgtcacgtaatggaagcacacatcatgccagctatcatgttgtcttttcttccttcacctccaaggatagccacgatttcctctcaaaagagagaaaacggacagccatgatttcatcttgtaccataacccaaagtctgatccctttcttgctgaaatagctttcacatttcacagtactttgtccgattatggagtactccctccctccttaaatagacgccgttgacttttttaaacatgtgttgacggtggatatccgtaaaccggatacaaagggtattggggtacgctggtacgaggatctacgtagtacgacatcaaacaagcagaagacagattatactggttcaggccccttgataagtaataactctaatccagttggtatgggattatatgatggaaaccacagattacaaagagaataataggactcgatgataccgacgagaccgtagtcgagttggttcgactagatcacccggtgacttggctcctgcaggctccgacttcgtaggctgtggtgaatgtgtaggtggtgagatcgatgccttaggtcctcccagggggtcccttttatatcacgggtcagcggatctccaagtaggactcggagatatcggacccctcatgatacaatgacgacccagtcttgtccgagtaagacttctctcgtatgtggattctgcttctattatgtgatgaatttccttaacgtgtacaggaaacatccgtatacgcacaggtataccgtatcggtatacaacatatatccaagggtagagggtataccttatccgtaatcctgacaacatgtttgaccgttcgtcttatttaaaaacttttatgaaatatgtaaaactatttatatacataaaagtatatttaacaataaatcaaataataggaaaagaattaataattatttaaattttttaataagacgaacggtcaaacatatttaaaaaactcaacggcgtcaaatatttatggacggagtgagtattttgttctccggttacatttatgttgggacggatttttttttttttacacatggtcgtcactcatcacgaccttaaatcaggacaaatcaatggctgccctagctgagttggcccaatgcagaagcagaagcagtcgagatgccaagaaatttacacacatttataatccttttttctcgtgttaatattcggaacggtgacgtcagcgcgcctgcactgcgatgcaggtgcagcttccgggaaacggaaagcagctgccgcgatgcgcatgaacctgggctttgctttgtttaacgtaggtggctaatccaatcagattagtgaagaaaaagaactaattgccacctaatcatccactgcctggtgggcccacggcccacccgactgtggagcccacctgtcagtagcggggggtgccagttgtccagctccgcgaagtgaacagcgcaatctagcgaggagagagagagccacatgacgcacgtacgcacgcacgcacgtacgccggcacgagcacctgcgtggaccgagtccacggaccagcagaatacacctcctggagcttgtagggtgggtattcggtttcgatctcgttcttcggtttttcagttatttcggtatttcaaaagtgaagaccgaatttcaacgcaaaaatgttaggatcgataaattcggtctcggccttttccgtctcggtctcaattctgaccgaaattccgcaacattttcatatatgcaaagaaataatggattttttaacacaaaaatcacgtttgtcggtcctgacattttatttttaacacaaaataaattcgtaagcatgtttgagtaaagacttttattagattgcatgtctagaagaagtagggatgtgaaaattagagtttaatcctattgaacttagtggattgtaggttgcaattagacttttttttaaaattcggtcttttcggtatatacggttaactgaggagactaccgaattgacctaacaaaattcagtctttcactgtctaggaccgaatttctcggtctcagttttttcggtctcgatctcggtcttttcggttcggttttttttcctacccctaggagcttggccagagagcaagtggccttcgtgcaccgggtccacggagcagcgcacgcgacgaccagttcatcacttggcgccagccatctcagtgtctcgcgctgtccacgtccacatttccgtgtttggttggttgttctttctactccttgctcgccaagctcacatcgtttttacctatacaaacacgcgcacgcagtcacgcacgatcctattcaagaagaagacgacgagggaatccatccatcgatcgacatggggaatcgcttgtgctgtcatgacgccgccgacgacgagaagccggcggcagcggcggtgtcgggcggcggcggaggaggagggagggaggagtacaggcggtggccgatcgcggcggagagcggcggcggggagacggggagggtgctggacatgccgcggctgagggtgttcacgctggcggagctccgggcggtgacgcgggggttcaagccggagatggtgctcggcgagggcgggttcgggacggtgtacaaggggtgggccgacgagcgcacgctcaacccggccaagagctccgccggcgtcgtcgtcgccgtcaagaagctcaacccggagagcgtccagggcctccacgaatggcaggtacaccgcactgcaactagctagctagctcgttgctcgattgatctcgctgttcaattttcttggctaattttgcgtttcgttttggccataattagcgagatagtttcaagaatggctcctgttcttagctctgtttagattaactcaacattgttacagaccgcatatttattaaaatcttttctttcgcttaagaaaacattatctttaacaggacaaatggcttttgttttaattaacctgttgctttctccgcacaaatggacaagtcaactgatgacctggtataatgtgatgcattgcttgcttgattagaaggctgcattgcttactgttccaagctcacatgttaattcgagtctgtgttctctgattagccatgaactcatcggcgatttccaattctctctttgttttgtgcaagtacagtcagaagtcaacttcctgggtagacttgtgcatccaaatcttgtgaagttgctgggatattgcaaagaggagagggagctgctgctggtttacgagttcatgcccaaaggaagcttggaaaaccatctcttcaggagtaaggctacgaccatcaatctaactctgacattgtactactactctcatgtctgaatatcatgcttccacaaaattggttcattttcagctgttagtctcccactcctacctaacataatttgacgatttctaatacgagtaacatttagtacctgaaactatctttatgtttgtccgaatgtgaacagacaaacttgcccttcgaaattccggcttgacttctgcaaagtcagtgccgtacttcatcgtattgatctgaactttgacaaacgcgaccatcctgcattggttgatctcaattcttaactacggactagtcatacagtgattcatcaacaaatcacataaataattttgggcaatagtatcatgcatgtctgatttgctggagtctgaccgatcttcgtgcaggaggagcatttgaccctctgtcatggagcctacggctcaagatcgcaatcggagcagctcgcggcctcgccttcctgcactcgtctgagcggcagatcatatacagggatttcaaggcatccaacatcctcctcgacgtggtaaattctcttctcaactcatctcgcgaaattcgcagatcgatcgtgatcatcttccaaactccatcatttgagacacgcatttttcatcaggattacacgccgaagctgtcggacttcgggctcgccaagaacggcccggtcgccggcagatcgcacgtcacgacgaggatcatcggcacgtacggctacgccgcgccggagtacgtcgccaccggtaagcatgcaccgcaccaaactctctaatcctttatatgccactagaatttgaccagttcccttatatgccactagtttaagtttttttcacccttttatgccactcccaccactatagtgttagttgactgttagtcaaaggttagtttttttcgtaaatgaccaatatgtcctctcaactaaaaaatgtgtaaacttcaaaaaatcataactaatttattttaaatcttttttgattgaacaaaattttgtcagaaccagtgaaaaatgctctttatattaaaaatattgttggaaaaatgcatgtttcatgcttacattgaaaatttatttgtgatggtaatggctaaaattgcaagtgatgcagaaaaaaaatcatttttcatatgttgtatccagtagctatattagtactaaaatacctattgttggttgtatactaattcttaagggcaaatgcgtcttttttacaaaaaaaattaacggccaactgacggtggaccgacggcaatggcataaaaaggaggagaaatttgaactggtagcataaaagagagaagccaattttaagtggtatataagagagccggttaatttagagtggcatataagggattctctcttctcttaactatgcaaattccattcaaatttagccaaaatccccgaaatttcggttgtatatatcgcaaaggactaactgcaggctgcgtcgtcgtcttcctcgcgatcgttttcacttttttttcaggccatctgtacgtgaagagtgacgtgtactgcttcggcgtggtgctgcttgagctgctcacggggctgagggctcacgacctgaaccggccgagccaccagcagaatctggtggagtgggcgcggccgtacatcgccggcggcaagaagctggcggggctgatggacccgcggctcgccggggactacccggccaaggcggcggcgcgggccgccaagctcgccgacaagtgcctctgcggcgaccccaagagccggccgtccatggacgacgtcgtcgtcgcgctccaggagatcgagtccgtcggcaccgcgcggccggcggcggcgaagctgccgccgcgggcgccgccgcccgctgcgcaccggtcgccgcaccgtaatccttattccaagccgcgatgagctttgggattatctgcatactaacatagatttgaaattgaattgaattgaattgtattgattcttttttctttctacggcgcgtgtcatctttaaacaatctcactttgcaaatgattatactcctctgatccatgagattagccgtagtgatgaaccgaatcgagtcactgtccaggagagcgacaagatgacccagacctgtgctttcaggagaagcacatatacaggatgtgatttctgagataaatgtgtagacttgaggataaacatacgacgggtttagctctgaaaccataacatgccagaatttgtgtttagaggatagatgaaaaaaccaaaaaaaccacggacgccaaccgacaagatcacttttaagagttgattacaaaagcataacaattagacgttactcctgtgcgactaggagattaattcaaatatattttcatactgaaatttgagacacatatttaacaactataaaagggagaaaaagagagcttccgatctgttccaatgtcacaaaggaaagggtgtgtttagttcacgtcaaaattggaagtttaattggaattgaaacgatgtgacgaaaaagttgaaagtttatgtgtgtaggaaagttttgatgtgatagaaaagttggaagtttgaagaaaaaccaggccaaagtagcacaattcttacatttctaccgtactgtacatgatatacaaaaaaaaaaatcttcacccgtaaaagagcaggtttacacgagcaacatcgaaactactccaacatataaataacattgtattaacaataatgctaacactgatctaaaaacaacagaattcatctcgactttgatgatgatcttgtttcattgccagcactgcaactgctttcttgtgaaccctttcgcttctgcaatatgtgggtgcaagataagcttaccatgcaactaatgagatgaacaaagaaaggaaaaatatacactaatattttcatcaatacttacactggtgggaagacatttcagaattgcaaaaatgctcccatgaaggctgaacagacacgctgtaacgggtaacctgaggcaggctttcaaatgctgaaaccttgaagtgaacacttgagaactattgagtcagatgaaaccccaaaagagctacaaacttttgaactgtaactgactgctaaatctatcccaaagcttcatttcgacaaatgccaattattttcatcctctgacctactcacctacaattatgtacactagtttagtctgcctacacaaagttcctatggttatgaaactgaacaaaaggcatacagctccatcttctattcccgtggactccactgcatgaacttcagcatgcaaatcaataccaagcaccgacagggaacatcaacaattacttcatttccaattcaagaacacagcacggttcaactgcaacatcaacaggcagctgtccattaatttgcacctcagcccaagtatccaaatctgaagcctgcatacgccatcttgacttacaaccaaaggcagcgtcaggcattctttacctgaaggagcaatgagatgattgttttcagtgctgcaacaccactgtcaagacagaccagtttgaccgaaggaagcattgagcaacggttgaatgctaggattaaccaatattctaactgtttgattacttgatgacttgtatacatcaatacactccagcaggtctgcatcacaggttaaaagaacccactcagattcatcgtccaaatacttgaggtccacgtgagtatcctgagaaatgccgaaccgctttacgatctcttcttttagcctttgaaagccccaactaggctgaagacggaatatacatctttcctcgccatagatggcttttattttgagagaatcagacctagccttttgcacgtttgacatgttttctatcggtttgtgttcacttaaaagtacttgactctgagacctaaatagcatggtaggtctttcttcaacaaacatttgcagctctgcctctgcatggctagcagatttgattagtgtggagcactgattctcatccatagatatttcctctttgactgcaagctgaggagcactaccatgctgttgctgagtctttggaacactggaacaaccaaggctagaatttgagctctggctgcaggatggggagatggaattagagccagaagtatgtgaagtgaatctgccctcacatggacgatcaggaactgaaggttccagctgaaagttttgctcagatgctggaaaatggacatctccttgtaactctctttctgaccatgtggtcttggtaaaattttcatagagtgaactgagctgaactgttccttcaggaccatgtactgaatcaatgaccatttgcaatttcttcagggagtgcccaactttcttgatctttcgtgatggccaacgattaattccatgctgcctgcatattctcttcagtgtagtcgggcacactggaacaaacggtagaaacataagatcaatagtcagccacagatattgcagtttatatctatgcaaatagtgaatgaagcattagtcctatatactttcagttggatctattgcaaaaaccaagacatttgaattatcaattttatctcaattaattacattgtaagttccccgcctgattgtacacctgtcatttttttttatcctggaacttatctgaaagggttacatgcactgtaagcagattattactatgagcaaacttatcccacttcttttgagccatgcttcaaggagataaatgtacaggaaaagctgcaaaaaataattttaaaaaaggtaaggaagccagccatttcagagatcatttgtcattaaaatacctcctaaattctttgcagcttctttcaggctaccagcaaaatgcttccgaagatcttgcaggctaactgttttctccgtcttagtgcgccgtttttctactgctttgtccgagtttgaattgcttggatcactggaacaagtattttctttgacatcataatcttcatgccgcttaaaccctgaaaacatgctaccgtcaggtgccataactggagaagtatgccagccagctgtaacactaaatccttcatcatcttgtttgctgaatccgaatggcaagtcaacatctatttctccctttcctcccttattctgagcatccactaagctcgctatccatgatgatacctcctcagatgcttccaatgatgttgtccttccaggaacattaataccactacagagctcatccaagtcttcatgcacagacttggcataaaattctggcctggttggttgactaatttcaaatggtccatcatttaccagctcttttggcttcacaactcttaatgtatagcatacttgttgtatggtattagataaagaattgagcatggccctttgctcttcagtatttatgcacttcattggcaagaaaaactccaagacaaagtccaggcttccagtcttgacacttcgcagctggatggcaactgctgccctcaagccaaaaagtttggcatgatgcgagagagggtactgggtcttgctgtaggtggtaatgtctggggagaaacatggctcattcgtcccaaatgccctgccgacaacaccctcacctctgaacagatgatgctcggagcaagcctggtgaaagcctaatacggaacaatcacggacataacatgcctcatcaacagtggacacacaatgtttgtagctttcatcagagtggcggcttcccctcttggcctggcagatgcacggtatccatgtctgggctagtggcagattgtgggtatcacaaacagctctgagaacatccatgatctcaggtataattgctcggtaagaagcatcaacaacctggcatcaagcgggcagcatctgttactgagaacaacatttcagcaaagcactctgatctttaatatctttcatctcaccttggaacgaggatcacttgaaacatcagagctcctgagatcaacttcctgcaattttccacgaaatgtagttttattaagacaaggatgacaccaaggtaggagaagtgaaaagatttattactttggggattggtgtgcccagcagttatcacatcttttcctaatgacatttcatcgaatacgttaagagcataacatggtggcctgcaaagcatgggcatttttttcggctttggagaatcaaatggagcagtgttgcgcaaatctaccttgagagcattgcagatgttctcgatctccgcactgtagttgaccttctgcgtggtcatgacgagctcgacgacgccgaggcaggctcggctccgcggctcgaagaccggcagcgcgacgctgccgcggatgtcgaagtattgcgcgtgctggacgcgcgggtactcctcggtggagaagtagcggacgtccggcgtccactcggggacgcggccgacgaagacccggccggggagccccaggtcggcgcgcgcgctctcgtcggcggagaactggtacttcatcgacaccgtccggtagttggcgaggcgctggttccggcggtccagccagaacggctgcccgcaagtcgtcagcacctgccggtcgccgatccgcgtcggcacccagacctggacgagcagctccccgtcgccccgctgcgcctgcgactgcgactgcgacgcgatgcgctccagcgcgggcgcagccgctccttcaccgtcggctccacggccacctcctgcggcgccgtctggaacgtccagccgcggtgcgcggggctcacctcgaggccgccgccgccacggctgggcatctccgcctcgtccctgtcgtcctcgccggccgccggcgcgggggtagtcaaggtagtgacgctgctgccgatgtcgaacagcggggagaaggggctcgccgcccccggatgccagaactccgacaaatcgaaccccggcgtcgccagcaagaactcctccatgagatccaggtcaccgccggcgatatcccccgtcccgcccatcccgcatcccatcaatccatcctcctcctcgtcgctcctcggcggcggcggcggcgacggcttctgctccatgaccggacaagcaccaccaccaacctcacagccctcgcatacccccaatccgccgaaacgcagccgcgcggaggcgaacaaacacgagccacgaacctgggattaattgaaaaaccagagaggaaaccttttttatgccaaatcctctacgaatccaaggaatcgagcatggctgccacagcggaatccactaccacacacgcacacaaacgccgcaagacgcgagccttgaggaacccgacgagacatccccatcatggaaaggaaaggcacatcgccatcacgccacaatgacacaaacccaaacccaaaccccccgcgatttactagctatagctaagctagcccaacacgcgaaaaaccacccggtttactgcaaatcgaatcgcggttgagtagttgacccacctgctatctcagaagcagaagcagagcatgtcgatcgaacacagcaacagtggggaagagggggcctccaatggaacagtcaatttggccactcggattagcgagaatcgtaagggattcttctcgcagcgagaaaggaggagatgagaggcggtggtggaatcgtatttgagtaggcctcgcgctcctcctcgcagtgcgctctctttgattctatctcctgtatttttgtttgtgcagagacggaatctgctgcagcctctcggcgcggggtggggcccacgagaacacgttgtttatttggcgggagggagggggaaatggcgggaatgggcttggtgggggcctgaggtcaaccggatttgggtggggccgggaggggcaggacgggtaattttgggtgggggagaggatatgcatggggacatggcatgtcgtgctcacggggaagacgacgacggcgacgttccgtgcgctgtgcggctgtgactttcgcctcacgccctcacctgatcacctattcacctgtaccctctctctctctctgtgatcaaaataaatcaattttcatatataaataaatctcaaaatgagcactctctccgttttataatatagaaacctaggaccaaatatagtattttataatataacgaatctgaatagaagagtgtccaaatttattatactatcgaacgtctcatctagagctagattgctatattatgggactgatggagtatttcttatgtgcgtaagattgtaatagtcttttagcaattcattcttggccagatggtacaatgttttttggaaattggttttcaatgtttcgagattgaaatttgtagaaaagtttagtaacaatcttgaagtggagaaattggtttcaatcaacaagatataatacttcaagattactggttaatgtttcaatcagcaatatatattatacttctattatttttcagaaatttgatgcctgggacgaatactatgggatttaggtttgaaaccggtaatcttggaagtggacaaattgcatttggtttagtacaatcttgaaactattctgtcgatcgtatagcacaatgtttcacaggaaagttttgttattccctgatattttgatctgactatttgcaattgcagtggacttcagtgattgcccacggatccagcgtataaattagtaccaactgcatgacatcaaccggccaattttgtttaaaaaaaaagtctgtataaattacacgtacgcacatccctgttcgtacatgtgtagtacactgattgttacgcgagctattttcccttcgttagctgtcctgaatctcgagacatgttggcgtttcaactctcacttgctatctacttccaactattattaaaggaggaatcaaaagtttaatccaagcaagcaagagagctggtgttgctgacagacttaagatcgatgtatgtggcgttgattaaaatctccaatcaaagatcctcccatgctttgatattgacaccccaaagttcagctccatagggagaaaagattccgaatcaaccagcttgctggccatgcttaattaatttgattagtctagtagtagactagtggtaccacataaaatttcactgccgaatttagccctgctacaggcatgaacttggcggtaggtgaagcgacttccaaaacatgagggggttggtgagccgaattggccagtaagtcccatctcatgtgaagaagaaaaaaaaaaggagggccatgcaggctgcatctgatgctaatcactgtttgaaatgaacacatcataattaagcaaagtgactttgggtaggtaaagtgtcatccactaatagcaatggtaagctgtaaaaaattccctgattgcagcagatccaccttgaaaattaatgggagcagattaattaagcaccagttttaacttttatatgcaaacttgtgcagaccacaaggtcattagggttttcacatggtggtccatgatccaaagggaacttgttaatgggaacttggaatccattatttgtggtgtgtgggggtcttcatgtgggggcaagactttttccaaacaaagattaggttaaattaaaggagctgatgatgcaagcaactgagaagttgattaattagtgtctgattgagcttaacagtactggtcagtaatgcgataggcatgcgttcttgttaatcctttgacggtaagctattggttcctatttgttgtgagcccgcggtacatgtggatcggcctactggtatctatcttaagctaggtttgattgattaatacttaatggagaaagaactgaagatacttgccctagtggtattggactgtcttgtcagtttattgctggatccgccctgcatgtgtggatatgattatacttgctgccaacgaatctcttgcaaaattaactgatgaatcatgcatatctatatctaatactcgttgctaagcataatcgttgctaagcagtagctcgcgatagtgacattagtggttttcaagtcttggagagttggagtactcttggtgcatatagctcttgtacgtattctcaggagtaaaaaagaggaagaaaggttaacactaactacgtttggttgatgtgtgaacatattcttaattttcttgtcttacgatagtactagtacaattaatttctaggattccagtagcagaattagttgtgataattaacacaaccgtgggcggcacgcaggttgcaaaaagcgaaggaatattaaaatcacacttgcgtccctacatcgctaactgacaacttgctacactgcttaaataattctggcttgaacaaattaagctgtagcacgtagccagtttcttgctagcaagcacatagatggatcatatctctccaactcgatttttctgaacttctctagacacagagaccgtgacatgtccagacataacaaaagtccaatggatcatattcatatgagaattcagaacaaagattcaataaagctaaagctagctgtttgtgcaagaaatttctcgtcgccttgcatgattaaagtgacacatttgcgcgttgaaattaataccgattaactaactaacgtcgtatcaaatatagttccctgcagccagtagccaatggtattaggttctcccctttctttctttcttttttttttaaaaaaaaatattccagttccacaactggtggatcatgcatggatcgtatatattcttagtctgaacaatcaatccgtttggtacacttgaagctaagaccgtctcatccacagcttcgtgagcactaagaagtaattgcatctaaacaaatctctgcattaatcggatcactaaattcagacatcatacagatcgcagattctgaattttaattatatcatcaatggacctgatgatcgggttgcatgcagtagcagaaattaaccaagattcgactcccggcaccaaaggaacgaggcgatcgattgataagttatcccaacttggcgctaatgcgtggcgcacttaatttgtcctgcaaactcgcagatcatacgatcctgccattaattctccgctaaacctaacactcttcgagtttgtttagcgtctacttgtagattctctctgcatgcagcacgcgtggaatcccgaatccacattccacagccaaatcatgtacggccggtcgtgtagaggtaagttcttgtgttctttccaagtagcttaatactccccccattccaaattgatctacatattttataggtacaccaagaccaaaaaaaaactaatatctctctcatactatatttactctaacaacaaactagatgcatacaccatccccactatttcctagccaatagcaaatcaagatattacatgtgggttataaatatttgtgtgcatgaatgcatgcatcaatatccatttactctaatgcataaataacgaatagacttaataaatgtacacaaatatgtagatcatttaggaataacctcaaaaaactatatgtagatcaatttggaatggagggagtaatctacagtgacctgagtagcactctaaaatcctgagttcaaatctctataagagcgaatttcagattgggttatttgaagagctaagttccctatttgatagactaagttcctaaattaaaatggttgcatatatctggttggtatagaggcgggataaaaatacccttctctaaaaaaaacttaataatcggaaatatctgaaaaactcagttggattaaagcagaacaatatggttaattggatgattgatttattgatgcatgtatgtacttggcatgtgtttggtttgggaatgaaatatgataggttagactcatccttgtttttaggatgggatcgtccccactatccgtttagcatgaggtaggagatagtcctagtttttaggggatggcctatatgtcagtgggaaaaaaaaagtgggatgaattggtccaccagtttttgagtgaccaattttattcggatcttaaaagaatattctttttagagattattttatcccacctattttcaaaccagatgacttaaaaaatagcttcgacctaacccaacccacttcatcccttgaaccaaacacacagttatgtggacggctggacgtgagtgtcgatagagtaggcttcctcttagctcgacacttcgacatgcagacgcagataaggatcgtgcttggttgacggcttcgttggcgtcatggccataactaaaagcagaagagtgatgaagaaatcgaaacagctctacgaagtacgaatgggcggtcggtaatgcactgttagtgctacgtacacgtacggcttttaaaaggaagctaatgctttctagtggagtgcaagagaagcgtacgtcgtagaaatgcaacgttgcacttgtaaaagtcactgtgtcggcacattgctattcctttttgaaactcgtagtaacccaggccccagggtcaatttcaaatagagctagcctattgacctttttttgttgttgttttttttaacaaatcttttgttgttgttgttgttgtttctgtaagaacggaaaaaagctgtgcacagcacttgtggtagtgccaaactatcgtgtcccaactagaacaaaaaaatatattattgggctgttgttgcgttgctgcaaaggcctgaaatttcagtagcccaactgatggcccacaaagtaggttcatgcccatcccggccgctgcttaatccactagaataggttcgttgttagtccctcttattgagatcgagtttgatttgcatccttaaccgaaataccagatacaactcatcactaaacttctgctaccggagtatctgaagtcccatgccaggattgtgagctgttactttatctccttcctccccaccgcgatgccgtttcttccaagcctccttcgccgccacagcatccaccaccgcaccccgcgtcggcttcgcacgacttcatcgtcgccttcggtgagcccgtctgtgatgtcctcatgcacttgcgccctatgagaagcggaagcagcccgggggcgcgcaacatggtgtttcttcctcctcccctctctcctcttttccccttttctctgacgaggaaatcgtggacgcccacaccgccggctttgtctcgctagaggccccgccagcgacaacgatccagtccagttgctccttggccgccgtcgtcaccagtaacaacatgatcggcgacagcgcaatggctagccgtgccaccaccccacaccagtgatttcaatttcggaattttcgaaacccccccccccccccctcctctcggcaagtgatcatctcgggcaaatttttctgtttttctcattctaattcagttaaattatgttaaaatttcaaaaaaaaaattgctccaaaagtgcccaaaagtaccaaaatttcgagaattttagtagaactgaaatggccgaaatttcagctgaaatagaaattggaaaccctgccccacacaagcttcccaaggccggtgacgcccatggcggggccagcgccggcacagccgcatgccgtctcttcatcgctactctgtgctccattgtttttcttggtggggctctaacgaggatggtagcaacggcgacgaggatgcgaaattggggagagagatgagtaaaaagaaggggtgagggaaaaaaataaagtgatgcttgtatgtgggatctatgtgggtcctacgttaactcgtcgccatctcagccgctcacaatactgccatgggactttagatactccggtattataagttaaggagcacgttatatgtgatattttcggttaaggatgcaaatcaaactctatcgcaacaggagggatctaaagtgaacttattcccttatgccaataaagtggccatatgcaagaattccaaaaaaagggattataattaaataattaatttactgtatataaattattgataaaaggtgtgcttacaataatgatgaagtatcaggagaaacgtgtcttcaggttacagattattacatgatggtggtacacgaattgtgcggtgatagaaatcatatatgtcctctttccaaaatagactcgatcgatcggtattgctagagtatgagtagcaattattatccgatagagtgaggctgaggccttccgtgactgaagcagattgcaacgctgatcgatctccttacatgctcggcttcgcgctgagacggctcgccagtttctgacccagagacctgtcagcctgcatcgaaagacatagtagattgttcaagttgcagttcagaaccaagaacagattatacagatcatgttgtacgtttttttttcaatttatggaacaaactgtaatgtgatgtatttacctgagaccagtaggagagccagatgctcctgatctcgtgggtgaggcgagggtcagagagtgcgtcgatccatctcttgatgaaccggtcttgcctgcagtgcatttagcatttgttcatcagtcaatcagtctagttgactaattcagtttagttcagtctctcgacagttaattcggttgctgcatctgcatgtgtgtacataccttgccggatcccatgaacggtacctctcccctggctgcttgaagttgttctccttggcaatcaccacctgcactcgcaacccgatcgatcaaaaccagttaataaattgactagctattactacttctcctgttttagattataaatcgttttaactttggtcaaaattaaactgttttaaatttgactaagtttatataaaaaatagtaacatttttaactcataataaatatattgaactatagatttaatgatttaatgaaactaatttggtgttgtaattattactatatttatctataaacttagttaaacttatagtttgagattgactaaaattaaaacatcttataatctgaaacgggggaagtagtaattaagaaagaaaatatagtgaaatgtaaaacccaaacgcaaatcaatcaacagaattaccttctcgcggcggccggtgagggtggcggaggggatggggtagcggggggcgtgcttggcaggatcgtagcgggatgggaagtagtcgacctcctcgtcgcggtgcatgaagttcatgaagccgtcgtagtggttgttgtggtgggcgcacttgggcgcgttgggcgggagcagcaggtagtttggtccgaggcggtggcgctgcgtgtcggagtaggagaagatcctcgtctgcagcagcttgtcgtcggagtagtagatccccggcacgatgatcccggggcagaacgccagctgctcgttctccgagaagaagttgtcgatgttgcggttgagcaccatcctccccacgggctgcagcgggacgatgtcctcgggccacgtcttggtgacgtcgagcgggtcgaagtcgaagcggtcctcgtggtcggggtcgatggtctggatgaacagcttccactccgggaagttgccggcggcgatggagtcgtagaggtcctgcgtggcgtggctgtggttggtcccgccgacggtgacggcctcgtcgtcgagcagcgacttgacgccgcaggtgggcttccagtggaacttgacgtagtgcgacttgccggcgcggttgacgagcgtgtaggtgttgacgccggagccgtccatgtggcggtagtcggcggggatgccgatgtcatcgaagaggaaggtgaacatgtggaggctctccgggtggtgggagaagaagtcgaggatgcgccagttctcctggacgtgcgacttggggttgggcttgagcgagtgcaccatgtccgggaacttcatgccgtcgcggatgaagaagacggggaagttgttgccgacgaggtcccagttgccctcccgggtgtagaacttgatggcgaagccacgcgggtcgcggagggtctccgggctgccgcgctcgtggatgacggtggagaagcggacgatgaccggggtctggacgcccggggcgcggaggaagtcggcgcaggtgaggtgggtgatgtcgtgggtgacctcgaagaagcccttggcgctggcgccgcgggcgtgcaccacgcgctccgggatacgctccctgtcgaagttggccagcttctcaaccaggtggtagtcctccagaaggatcgggcctgaattttcagtgttcccagttcagttcagttcatcgatcaccactcgacttgaattaaactgacaaacatgctacggaacactatcgtaaaatcgtaattagtactaatttactgtagtgaattgctccccacggagtctggacctagctgagatgtacagaatcgtatgaaattcatgtgctctaacaaacgcaacagtttcaatttgtaggaggaactaggaaacaattcaattttcaaatgattccgcctgtagcttgaaaacacaacaggttctaatcttctggacatggtgttataagttgtaaccaaatactatcaaagtattttttaggaaaaaaaacaaatgaatccagactagcacagatttactgggatgacgttcttgaatttaaactggtagcagcaaaggctacaccacagaagacacaaaaagtaatctcaaaccacaggaggaagggggattggcgtggtcatacgtacctcgggagccgacggtgagcgagttgttgttgttccatacgggggcgccggagttggtgctccacagcgggccgttgaacgagctcgacgggcggtgctgcgcgcatcacaccaaattccgcatcaaaaccacaaaaaaccaacgcactctcaaacccctcgccccagaagcagagcagagcacgttcgttaccttgtagggatccatggctgattaattaacgacgacggcgtccggcgcgctcggtcacgttacgtacgaacgtctcgcgaatgtcgccacacaccgccctacttatagcgggccacaagagaaagaagagccctctgggtcgtgagtttttttgtcgcgtcccggatctttccgggctcaaatgatgtggagtacgtggggctacggcgcacgcaggcctagtagtacgcgagacggcgagagacgtgtgcttttgcaaagcgagcggtggtggatgggagacatggggggagcttgggatgagtggacatgggccgcacctcatccacacgctccaccgccggcgctcgccgtccagaaaaataacgggatttgtttctgctgcggcctctctgctcgtcagataaacgtagcgatttttttttttggaactgcactagcctctggaatgtgaacgcgacggccaatgggaatttttgatcgggctgcagatgctgttcacattgacccgatacgtatagtatatccatgtgtgtgtgactattccatttcccaaaaggcaggaaaaacatacgacaaaagccagttgagacagtattggttgttttttcgggtaccatatgtgcagagatttttcacctgatcccggcaaggattttttacactcactgatgtaaagtatcttgcatgcagatggaggcatcttgcgccgcgcggccactggcacgccagacgcgagagaggaggataacattccacaacaacaataacagattgagaaccgaaaggcgccctcaaacgcaaaggggtcaccagttcgtcacccggttgagctgcttaacaatagattcatacatccggcagaagaggttagagcctgatatgacaaaggtagccaaccaccttccatctttcactattgtagagttttagcttcacaagagccccttttcaatccaataatgccatcaacacatgagaaagcaaatttctagcacatcttcagtgaagagttagggtatctataggttgtaagagcaggcaagtaaacataaacaacggtcatgtacactgcagtaaccaccaatagctcaatatgtatatacaccaacccaaagtaccatcaatacaccaatatctcgatcacgacatgacaaccatgtatggaaaggttaacccacttgactcatttattcatctaaaccatgtacctagatgatgcctttgaatctgacggtataaaaccaatgaaccagacaatcttacaatctgagctacaggtaacaagtcgaggacatcttcgatcacaacagtctatcagccaatattcccaagaagtcgctccaccgcagcatgaacatttcccgctgtagcaatcaaagctcgaatgttctcctgtgtgtcaaagaaacccatttcttggagctgagctagttgtgttgcatatagctcttctggtggaactgcaaatattggcattgcttaatgagggcaaaccaaccgactccaactcgaaaagaatttcaaaaaaatattaatgtgactatttcttgcagtattgcactccaaaatttagagaaaatcacttaccattgggtgcactaggaacacctaggccaccaccagcaccgagcccactgaacatgctcatcagattgttgaggttagtattgcctggcattaaagtactctcataagtcgtgccattaaagtattctaaattaatttcaatgaagcaccaaaatatatactatcaataattcaacaatctaaataagacatctgaccatgtttaatatactaccagttgacaagatatggtaacatcttacatttcacattgatttctaatgatgaactcagaatcccatttgagttggatgcctgattcaactaccactaacaaagtaaaccagggtacaaaatatcaacaaattaaatcactaaaattgtttcctagaaaactatatttggtctggagggcattcatttgtttcatctaggtacatgatcgatataaatatctaaaaaggcaaaatttgagcatcctattgctctcttagtaaataaaaacttattgcaagaaatgatataatatgattctgcaatttatcaacaaatataaaaaaaatcttagcctatatgactctctagaagttgacatatgtatctgatagttctgtgaaagacagttctgatagtgaacatcagtagaggaagttacctgcaccagcacctgattgggttcgctctctggttcaaaaaagaaagaaagaaagaaaaggattcaataagcagtagtataggcgagacttacaaataaaaatctcttgattttacactcaacaattaacttagaaaaagaaaaggtatacataaacatgatgagcttaaacaggttaagttgaactggggaatactcacgggccagcttgttgttgaccaagttgtgacatcaaggactgctggaatgagattaattgctatacacacaaaaaaatcatcataagccatctgatttccatacactacagcagtataactaatttacctgcaaagtttcaggagatgtcaactggcgaacaaattctgggttctggaacatctccctcaactgagtgttagattccatcatattacgtacatttgggttgatattaagcagctgcaagcaagacgacatcattagataattaaaacactgtgtatcatgcatatcaagaagcacaacatcaactattccatgaaagattagagcaacgaacctgattcatggactgaggatttgacataatgttctgcatcatttgcatcattgtaggattttgcaacacctgactcaagaaggaagtatccgagccaccacccagcatacctcccaaatctgtagaacttaaccctcctaggccaccagctgtggcactccttgcattggtaactggagagggccttgttgctccctgtgcagctccagctgttgatttacgtattagtcagagagaatcccatctgcgaatctaggataccaaaacaggacaagaaaacatacaccaaaataaaaaacaaagtacacaaaacttaccagttgtgctccagggatttggaagtggattagtgtttggagcaggagaacctgttgtggattctgaggtggtcgttggtgaatttgcagctggatctctggcttggtttgatccatgatttcctaggagagcagaaaatgggtttgaacttctatcaccctccccagccatcgttgttgcattcagaaatggctcttgaacagtttcatacatgcggcggagcatattgaacccttctggagaagattcaatgttgctcatggctctgtctgtgttccgcatcatctctcgcataagttcaggattcctagctgcttcaacagtctggcggagaatgcttggatcattgaggacatgagcaagatctggattacgatcaacaatttcacgcatttgggggttgttcataattatattgcgaattagatcagggctattcaatatattctgcatgagtggcatattcattatttctctcatcaacgtagggttctcggatagctgttgttgcatctgggatagttctggaaggccagaaccaaatgagcccaaccctccactgttagcagaacctgaacccccaagaccatgcaacaaacctccaaaaccaactgctggtgaattggaagcagtggtagcattaatggcaggagttacattgttggctgcaggaggtgcggttgacgctggtggtggtgcagcaccacggaccatgtgaatggtgtgatccgtctcaacaccttcaagagggaaaataggcataagaataagcacatttggaaaatctttgtgactcaaggttaaacatgcactgcagcagtaaacttgctgcattcaaagagtaatgatttctaaaagcatttgtcaaaattgagtagatggacctagcatatctggtaactcataagttgatgtgcacgtgagcaaaataaaaattggtactacctccgtcccaaaatataacaacttctagccttcaaaatttgcccctaaatataacaactccacctacattctcttctcaaccaatcacaaccatccaccattcaaattacctacctacctcctcttctcaaccaatcacaatcttcctccgtttaattccatcaactttcttaatacacgtgtccaatcctaaaactccttatgggacagaggtaataacacttttaaaagcacaaaggtgggcaaagactgcataagaggataaccttctttcacgaagaccaatatccacacccaacgttgaaaagaaaaaccagaaacctcatataaatgattcggaaacacatgggtgcagatttgaataggttcaaatgcaagaggatatgatgggcatggatgcagtaggtgggatcaaaacccgatgctcagtatcaaattttactcattaattcaattccatataaagcttcatctagtggcccgaaagaatctgcaataaacagtacaaccctctgccttttacttgaaaaggaatataacatgcaccaaacagcatgcatcacagtagcagtttttgtagtacgtttggaagattgaatctctttcagttctacactgctgtggagagttgcccatgtggatagtgctgcgcatttagcttctgttgatgtcataacaagccaataattaatgctacatcataaggccatgaccagatgtacaagttatcacgttacacgtggatcattacgagtagttcataacaagcacttgcaacgaatgacgcaggacaataaaaacagcattataaagcttccatattcgctaatcactaagatgccattatgctgacaatatccagcaaggaatgttatattcctgcaaaaataccctaaccacgcattaccagatacaatttcacatcgcacgtgtgcacttaacaatgcaattggtggctccatgatgtttggaatcactttcatgtcaagaagggagggaagtgcttgttttccttctactgcatgttcgctaaactgcattataaattagagtagcaaggctccctgatactgccttccactgcatcttcactgggctgcattataaattagtgtgcaagtctccctgatgctgcttacccaataataccatcgtctaccaagtaataacatggaaaatcaaagagataattcacacacggcatgaaaggagcagctttccttcgcactcctgactcctcctacaacaacggcattggcgcattgtatcaaacatacgaactagaatgaatcggacctaaaccatcgcatctcaggcacagaccgagcaaatcgcatcaaccacacaagctagttctaaccgcacagaagagggtaggcacgtaccgtagctggctagggtttgctcgtccttcaagatccggcccttgtagatcagccgctgctgcggcgccggcacgtcgcagctctcggcgacgatcgccttgaacgccccgacgctgagccccaggtcggcccgcaccgcgagcttggagccgttggtgcaccggatgtgcagcgtcgcggccgccgccgcggcggctgcctcttccccgtccccgccgctcataaccctagctctcgatccgacgcggggctgcgccttcccgatccttcgacgcgtgcggtgcgagtgcgatgcgggcgagaggagtgtggcgtgtgttcccctcccccctcctcttcccgtgtcgcgtgtcgcgtctcgtctgcacgggcttgtgggagggaggagaacgaggagggggggaagaggaggcggcggaataactttgggcggagagattaacggcggaaataagtgcgcgacagagatggaaggctgtgattcctttgcgtcggtgggggcccacggcgagtcggcgaggcgagggaagggaggtggggtgggcccccacgtggaccggactgtaatatagtcgtgggtggatagaaggttctagcaccgtcacagtttatcttacgcgaccgccacgcgaaggcgtatttgagcataatacgtattctgctgtcgaatgtgtatagggtcctgtttgtgggagtccgaatattctgagaagcagccggtgagaagatagctggtgagaatctgaaaaagttagaaaacccagcttaatattttaagaaacaactgatgagccccacatgttagcttcctcctctctcctcctagctttcttcatcctctctccctgcgtctgtcgagcagcgggccacacatggcaaaaagcacccgatttataagttaagagacgcgttatatctgtattggtattacggtttaagaacactatgtgattccccgcgctttgctgcgataattacaaagcaattatcaatatatttttttcgacaatcaaactaggagtaaaaatgaagcatcaggttttatcaatgataatcatgaaacaaacaaatgatattgcgccttaatgtgaaacatattataagtatatattagatcttataaaaatggtagatggatttgttaaaatattgtgcaaatggtgtgagggtgatgattggaaatgcttacacattgatttgtagaaataaataaattgtagatgatgttgtatacctgtatgaggcttaatatgtaattattgctattgggtgatcatgtggtatgattgcatgttgagctttagacttagtggactataactttatagaaagtatacatactctaaagggacaattgcttatttgaccctattttaaaaccaaactaccagattgaccatactttttcatgtttgctcatttgaccccacttttcaaaatcgaagccaccgtttgaccctgttttcactagcccgttagggtttcagttaacaaaaagaaaaaataaatttactaacatgaatggaccaaaatgaccttgattacttgtcccaagttgcaaatcccttcatcccatcatcccacgtctcagtggcgtactggcgtggctggccggggcgtgattcgtgaagggaggaagaggaggagcggtgtcggcgagcaaagggagggacggcggtcggcctgggcgcgcggaggaaggggcggcatcgtggtgcgcggaggagcagcggcgctggctgtggcagcgcagagggagggccgcaccggcgcgcggtggagcagcgacgccgggtgcggccatgtggagggagggaggggcgtcggcgctagcacgcgaaggagaagcggctgccggcgccggctgctgccgcgcggagggagggagggaggggcatcgttggtgctggtgcacgtagaagcagcggtgcccgctgccgcgtggtgtgagcgaggcgccggtggcacccgtgcggagggagggaggggcgtctgcacgggcgcgtggaggagaagcggcggctgctgctgccgtgcggagcgagggagggagggacgacgtcggcgccgactggtggaggagaggtgatggatgttgctgccgcggagggaggaaggagcaacggcgccgactactgttggatatgtatttggatctgaaattttctgttcgacaatacgcttgaaatttttgtaaaaaaaatgtcaaattgaatcaaacgtttcaaattgaagacaattctgttaaacttgtttcaaatttgtcaagctatgccaaatttactacaaatatttgaaaaggtccaaatgaataaaaaaaagctttgatataatatggttaaatgagcaagggcaaaaatgacaatttgcttctgagttaacaccgttattgggccttcacggaatagggtcagctgtgatcttcggttttgaaaaacagggtcaaacgagcaaacaaaaaagtaagatcaatttagtagtgggcttcacaataggagaatcctctcacctgtccttctcacgatttgtgtccaaggccaacagggacagagtatgcatgggcttcagtaattgggctttgccccttttgccatctaatagtctcggcccatcaaaacaatatagtaccttactggtcctctaagaaggaaaaaaaaacatcataagtcagcaagaaatctttatacccaaatggctagttggatgaaagggtatatataactcattgcaaatcagaaatccagtaaatatctcatggttatcaaatcccatggcagttcgctatgttacatgtaatcaaattactgatgaagtattttcaacccaagtaaccatggcgacagtttcaaactttcagttcacctaagctcaaaagttcaaggggcagtacgactcaacattggtacagtacgcggagactaacaagccaaagtgaataatataaggttacaattatctggtagtactatctacgcactagactcagttctactacaaaaagacgtcaaggcaggcacttgggcaataacatcattctccagcatccacgtgagtttagctgcggtaaaagttcgcctgcattgtatggtggccaactgaccatcctgcacgcccaagcacttcgatgcgctgagcgcgttgattatggaatcatggaatggagagatcctggctaatttttgttgagtgactacggcttagccatcacgatttactggaaaataatgtggacagtgaaggacggcttccgtcagcaagatcatcttcactagcctccatattgagctgatcatactcagtggatacacgtggtaactcctcgctcatagtgtccatgattacttgcccaagaacaaaccggacctcaccagggtgcccatccttcagtaacttataatcaatttcctgcatccctcttgtcccttcatatgaagttaagtcagtatcaaggccctcaaatattctcaacactctctccctctctctgctagatacaagcacctgataacaaacccagtaacaaaattttagtacgctttgtatgtataatgtaaaaattcatttaggaacaaatatggggccaattaaacaatggttcatgcatcgttagaacagttcctactacacaatattagaactccattaggtggctctgaacaatgattgatcagtcaatatttgcatgcttacttgcagaagagcccaagcaacattcaatgattcaactatggatttcataccaggaattaatatgacaattgggagttgagacgtatgctaaagaaatacttaccagtcctgaaacttgtgaagcctttgagtatttggccagtgattgttggagagcatctatagatgtcaacgtatcaactgacgacttgactagtgatgctaaatgtgatgtttgttccatgagattctccagtttgctccgagaaggccctagtgtttctggaataaacggggctggtgctccaatgtcttgattcaagaagttgactgcgccctcccatgatccaaaatacattagtgcagcaaaagccctgattacctgggcatcatgtggagaatttaccaatgcactgtgaaatgtcaacagtgctaacctgtggaataacatgaaatgccatagacgtgacttgctcaaaatatacaagaattgtattagacacaaaatgggaacattcaactgcaaattgacagtggtatataatactagtgtagaaaaaaaaggtaacactctaaaaaaaaaagcaatgtgtgtgtcagtgtgcataggtgcgtgcgcaagtgtgtgagaaattccagggtggcatacatagataataagataatccactttgtccttcgggctaggactcacacaagttatccagtatactactggacactcaaaatttcacagaaatccatgcatatcttctagtgatgaaaactggaaagtcagaaccgctagactcacagtgcacatcagtgtgtccctaagactgcaaagaaaggaatattaacttcactatacatctctatcactctggtcagtgcaaatctttaatcagctacacttctggtttttgaattttgatgattgtagtctagtactatgcatctcctgcaaagtgtatatgtaggaccagccaatacaaaaaagaacactaaggcctcgttcggtttagaggggattgaagagtattggaggagattgagggggaataattccacaccacaataggtgtggaataaatcccctccgatccctccttcacagggattaaccgaacaaagactaaatgattttcacacccctttatataatgaaggtaaatgcgcacaggcattcatttaaagtttcttaccacaaacaggaggggcatggctgatcagcagagagtaatttatcaagattagccagtagtttctgcacatgtgaatgcacatcattatacagcatatataaacacataacgagccctagtcttaaaacttaaatattacacttctaagtcactgactaaagaaaaggaaaccaggaagacactacttacatagttacattaaggcaactaacaagaagtgactgtcaagagctgatgaacagtaacaaaactatagaactatgcagccaatacttcatgttcatggatattgatgcgtaacaacactagttagctaacactagccaacacatgtgcgtggtttaaattatttcaccttttattatgaagcaaaaaaaaatcatatagtatgacacatttccagagttactcaccatgagcattaaatctgtgtcatttgatttatccttcatctgatccgacatatatgctgcctaaaatgaaaatatcattacatatgcaagtaagataaagatggaagtggtcagtaccacaagcatgactctacttacgcaatggcatgatcgcattgctcaacctacctggaaaggcagcaaaaaatcgagaagtccatattttctaagtaacctaagagaagaagctgctgccccataagacaataaataattcaattccatcattaatcttgcctacacagtaatgaggtcaaaagcattagaaaaaaaagaaacaatggtacattttgccatcagtgcatgctctaattgtcaaaatgccacagggtttttgcccaattgctcttatctcattggattcaagtgtgacgcaaaaatgctagttagaggctaaaaattgtccaaattcccttcatctctattttctttctcctctctagctttcatttttcataggtgattgcaagtcacctatgattgtgcataaaggaagagaaataacttgtttttttaatatgctatcaagaagccatttcggtcatagagacagtcaaaaaccattgacttaacagtgtactggcattttgacaactctgaaagaaaagtagtgacatttgagcaattacagaaaaagtgatggcaggttgacagatagtgcaagccctagtggcaattatgcaataaatacatatagttccatggtgggatacaacaaaccttgtcaatatctgttatggacaaagaaagttcccgtattgcagcagaagtttcactggagaactcaaaaccaaggcgagcagcaattctcaagccacgcaaaatcctggctgaaataaaccagaatctaaattttctgtggatagattaaagaaatgaggaatattctttgaatacctaccagggtcttccttgaatgaaacacgggcaggaatcactgtagacacctgttatccactcaaggagttagccaaagggggaaaaaaacaaggatatttctggatatctgcatggattgagatgaaccaagctaattgttaccttgtttttgctaatatcccttactccattcacataatcataaatcttaaagttaaatggattaaagaataagctgccatgaaaggattacaacaatgttagtaattacctccagcaatgtttcaaaaagaagtcaacaacatctgttaaacatttcaggcacaagattttattcagaagattacctgtttattgtaaagtctcttttcatagaattctgccagagaagaatatccccctcatcataacgtttaaactcctctgaacatcctatatttttacttcctttcacatgatttgcattcgtgctaaagctagaaacctgttagaacaaaagaaatcccaagaaataagcatttggcaaagttgctgcaaagacaattgttcataatgtggattttcctatgaataacacacctcaatttttgtgccatacatattaacctggcatattggaaagcgtttgccaataattatacatcgttggaaaaccattttcttaatctgaaaaaaaaaagcaacgtctgtcaacttagcttttttttttcttttgcttttatccagaaaatgaacacttatgacaaattaatgcaccaaaacctgctggaggcttgcggtagtaatcacatcaaaatctttaggtgcccttttcagtagcaaatctctcacgcatcccccaacaagataagctgcaaaccctgcagtacaactttaatagagtaagcatacataaacacatccctatacatatttaaaagtgagaacaccacaaaatgttccatatgtgtactcttccgacaagttcaagcagcatattcatgcttcccaaaggatctatagttaacatgaaggaagctgagaaattgagttccaaaaccatctcacgttacaattttgaactattgcttgccttcacctcaaacatgtttccgattagtggggatgctttaatggatgggcatggcatctgcactatggcacattaagatagaagttcatgcattgccgggacaagtgtaataagattaccttcttttttttttgcctttggataatattacaatagctcacttggtgtaatgcaacaaaaaggaaacaaccactaatatattgcataatttcattcgtagtaatacatgttttaccgtacaggagcaaacggtggcatgagtatggaatatcaatgcacaaaaactcagaaatataaataagtgttcaagagatttattacccaccttttcgttttagcatgtgtaggacagtccaggcatggcgaggtatatcccctctagtaataccaacaaccctcgagtcaaaatatctccatgaagaagaatcaacaaatcctgcacaaacacaaatcctatttttaggtttcccgctgtgtaaccagtagttagctaaggtctgcctgcattattccactaaaagcagagatttgatcaaaatactaaacaagtaaacaactatgcagttcccgtgtaccaacaaagaaagtacgccatttccagctaaacgtaaacaagctaccgtgcagcacaatcaatagcatttgctcatttgctgaaagggcgaattgcacagatgtgatttactgatctacacgtgtgagcatcaaccatctgctctccgggggccatcacgagtgatcaaaacatcacctggtcttctattagaagaggaaccgccgttgcgtgggcccatgtcgccgccgccgccttccttcttcgagctgtacgccagcgtctggaagcaacagaacgaagcacagtaagacgagagggattccagcccaagcgcgtcgcccgcaaggcgctcgacgaaatgccccggtagcaggaccgcgagagactaacctgcagaccggaggccgcggagccgaggcggtggaggaggcggcgagcaggcgggggcgatgggtcagcgcgccgtcgtggcgtcgtcatcactcgcccgcggccgccggctaggtgagtgcgagcaggttgcgcctccgggccggtaggttagacgtgtgctactgggctggacgcagagccgcatctgggacgtcggctcatgggcccagagagtcaaggctgcgcgcatatcttatgcacatggaataagttcattttatatccttcaccttgacgcgaggaaagcctccgagctcgaggcgacatctcacctcctcggccgccggccatggcgacaatctccgcgactctctccatctccttcctcccttcatcaattcgcttcgccgtcgccaccacctccacctccactacctcctcctcctcctcctggcgtatcaaggtaaactccccccaacccaaccgctgcttgcaagagcctcctcggcggctctgactctccgtggtttgtgtagcgacccgcgcggttcagatgctgcgcggagccctcttcaccggagcaggagaacccctcgactccggccccgccaccagtgaagcctcctgcgtcgccgtcgtccctgtggggcatttccacgagcacctggtctgcgggtgtcgccgggctggggtttctggagaccgcctacctcagttatatcaagctcacgggctccgaggcgttctgcccggttagcggcgggggctgcggcgacgtgctccaaagcgactactctgtcgtcttcggtaatctcttagcgcttttgccgattacttcctgctaaatgtccgttgaaactgtggaaattctgaataactatactttctccaatgtaaggatcgaagtgtgtactgaaagccaagtataagtaccaatttcatctgaaatagtggctgatgatagtgtttctcagatattcattattatatggctaattatctatccttctattgatatatctatgatggtgttttgactaaacttgatgtttcccgtttgttaccttgatgaaagcaaactggtgatgtgctctgtagttttaacagttggtctctctctaatttgacagggattcctcttccactacttggtctggtggcatatggtttggttttaacgctctctcttcaagaaaatgggaagaagttcctccctggaattgatgatctggatattcgtttaacattacttctgatctctacttcaatggccactgcaagttcttatttcctatatattctaaacactagatttattgggacgtcttgttcatactgcttgttgtctgcatttctctccttcactttattttccatcagagttaaggtgagcgcttagtttccctttatttttcattgagacatttagtaattaagtaacctactcaactactaatgtttattgtattaatgcaggacctcggtttggaacgtgtccagaagtttgttggtcttcaattatcagtagcaattattgttgctcttgctctgacaaattcctacagttcagctacaacacagttaaacgggtgaggctcttgaaaatttgtggtgccaaatgtatttgtttctctgaaattggttaggtcttaagcgtcaaataatgaaatgcctgactaagtatatggcatcctcatttattacatttcgactatgtgttttctgttaaacctttttattttttttcttttattatggcattttgtttcatatgttggataagtctttgtggtccttggtcgtgattcttctttttgcttttgggtagtttcacctttttcaggacagcatctaccctttagcatatttttcagttgctaggacagctgcggttagtaggacagcagcagttagcatttcctttatgcctcctttatgctttattcagtttggatgccctctaggacagcatcccattcaaatttcgaattttagactaggagggtgcagcaataggctagcagccagctatggctatatatatgtatccaacttccctcgggtaggcatggcttttgtgtttagtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcagcaccggttgctcctccttcccctttcccttccccctctccacgcagcagccccccggaggtgcgccatgtccgacgctcggtctcggcgttcggtcgcctcgagcactcagcgtcagcaggacgccgagctcgccgcagcagaagagcgcaggcgagcaacggctcagaccgctgcagcagcagcagcgagggcggccagactggcggcagcggagttggcagcagccagggcggaggcggaggcggaggcggcggaagatgcggcacgtgcggcggaggtagaggttgagaccttgcgcaacagcatcaacggctccatcgccggcgacatcaccgccgacagggagcttgaggagctggcaagaggaagggcacgggagcgagcagagcggtgggcagcagcccacctccacggcggcggcggcggcccaagggaccgcgcgcccgccaacgggaacccagacgggcgcgggcgtgccggcggtagcccggagcccgcacgcggccctcgcaggcagcacggctctctctcccctgaccagcgccatggtcaccacggcgtccagacggtggtcagggactttggtcccggcggtgggtggcctaccctcaccaaaaccaactacatcgagtgggccgcggtgatgagggtgaggctccaggtgcggcacatgtgggaggcagtccggtacggtgacgtcgactacgacgaggatcggagggcactggatgcccttatcgctgcagtcccgcccgagatgcagttctcgctttcccagaagcggactgccaaggaggcctgggacgccatcgctgcggcacgcatcggcagcgaccgcgcccgcaagtccacactgcaggcactccgcaaggagtgggagaacctggccttcaagccaggtgaggatgttgatgactttgctctccgtctcaacactctcttgcagaaaatggtgcagtacggcgacgacacttacgacgaggagagagctgtcgagaagctcttccgctgcgtccctgagaagtacaggcagatcgctcgctcgatcgaatctctgctggacctctccacgatgtcgatcgaggaggcgttaggtcgcctcaaggtcgtcgatggtgatgagccacagcctctctcggggcccatcaccatcggcgggaagctccatctcactcgggagcagtgggaggcctctcagggtgacgggaggaagggggagtcatcttccccgacaggcggccgtaagccgcgcaaggcgcggggaggtgtctagctacggtgggcgcgaagacgtgccgagggtggtgcccgcagaggcgcccagggcgttgccaccggcaaccacaagccggcacgagacgacgcctgccgcaactgtggcaagcttggccattgggccaaagactgtcgacagccacgacgtggctaggcccacgtcgcacgggtggaggaagagccggctctgctcctggctcacgcaagcatcgagctacctccagcggcaccggccgcagcggctttcctccaccttgatgagccgaaggtactcgtctccctctgcaacggctccagcaacgacaaggctgatgggtggtacctcgacaccggcgccacccatcacatgatcggccgacgggagttcttcaccgagttcgactctagcgtccgaggctccgtcaagttcggggacgcctccggcgtggagatcaagggtgttggctccgtcaccttcaccgccaagtccggtgagcacaggctgctcaccggagtctactacatccccgcgttgaggaattctatcatcagcgtgggacagctggatgagaacggctcacgcgtgttggtcgaggacggactcatgaggatttgggatcgccgtcgtcgccttcttgccaaggtaaccagaggcactaatcgactctacatcctcagcgcgcaggtcgcacaaccagtttgcctcgccgctcgtcgggacgacgaggcgtggcagtggcacgagcgcttcgggcacctccacttcgaggccctgaagcagctcagtgccaaggagatggtgcgagacatgccgtgccttgaccacgtggagcagctctgcgacgtctgcgtggtgacgaagcagcggcggctcccctttccccagcagacgagcttccgagccaaggagcggctcgagctcgtgcacggggacttgtgtggcccagtgacaccagccataccaggaggacgacgttacttcctgctgctcgtcgacgacctctcccgctacatgtgggtgatggtcctcagcagcaagggagaggctgcggacgccatcaggcatgcgcaggctgctgcagaggcggagtgtggccgcaagctgcgcgtgctgcgcaccgacaacggcggcgaattcacagcggctgaattcgcgtcgtactgcgctgatgagggcattcagcgccactacaccacgccgtacagcccgcagcagaacggtgtcgtcgagcgccgcaaccagacggttgtggggatggctcgggccctcctcaagcagagggggatgccggccatcttctggggggaggcggtggtgacggccgcctacatcctcaaccgctcgcctaccaaggccctcgatggcagaacaccgtacgaggcttggcatgggcgcaagccggcggtctcccacctgcgggtcttcggctgcctcgcgttcgccaaggatcttggccacatcggcaagctcgacgacaggagcaccccaggggtgttcatcggctacgcggagggctcgaaggcctaccgcatcctcgacccggagacacagcgtgtgcgcactgcgcgcgacgttgtgttcgacgaagggcgagggtgggtatgggacaaggcggtggacgatggttcgactccgacatacgacgacttcaccgttgagtacgtccacttcgagggagctgggggagtaggcagctcttcttcacctagcgtgtctaccccagcccccgaatctccaccgactccgacaccaacacaccctcgggccacgacttcgactacgacgagctcttcgtcgacaccaccccagccagtgactccacatgctccagcaccaacagccactcctccaagcacgtctactccgacgccagctcgtgttgagcgcagcccggtggagttcgctactccgctctcccacgacggggagcgcatcgacgcgtaccacgacggcgagcagctacggtactgtacgatggaggatcttctcggcgaccagccggtgccgggactggtgcctcgcgacctagaggcacagttgcaccttgcgtgcgacgacggtgagcctcggtcttttgcagaggccgagaaacacgtggcatggcgtgccgcgatgcagtcggagatggacgcggttcaggagaaccgcacctgggagcttgctgacctccctcgtggtcaccgcgcgatcacccttaagtgggtgttcaagctgaagagggatgaagccggagccatcgtcaagcacaaggcttgcttggtggcacgcggtttcgtgcagcaggaggggatcgactacgacgatgccttcgctcccgtggcacggatggagtccgtgcgactccttcttgcgctggctgctcaggaaggctggggcgtccatcacatggacgtcaagtcagcgtttctaaacggcgacttgaaggaggaggtctacgtgcaccagccgccgggatttgtgatccccggcaaggagggcaaggtgctacgcctgcacaaggccctctacggcttgcggcaggcaccgagggcgtggaatgccaagttggattccacgctcaaggggatgggcttcgagcaaagcccgcacgaggcggccatctaccggcggggcaatggaggaaatgccttgctggtgggtgtctacgtcgacgacttggtgatcaccggcaccaaggatgtggaggtcgcagcgttcaaggaggagatgaaggccaccttccagatgagtgatctggggcctctctccttctacctggggctcgaagtgcaccaggacaactccgggatcacgcttcgacagaccgcctacgccaagcgtgtcgttgagctggctgggctcaccgattgcaacccagctctcactccgatggaggagagactgaagctgagccgcgacagcacggcggaggaggtggatgctacacagtaccgacgtcttgtggggagccttcgctacctcacccacacacggccggacttggccttctccgtcggctacgtcagtcggttcatgtagcgaccgacgacggagcaccagcaggctgtgaagaggatcatccgctacgttgcggggactctcgaccacggtctctactacccgaggtgtcctggcaaggcacacttcgtcgggtacagcgacagcgaccatgccggcgacatcgacaccagcaagagcacgagcgggattctcttcttcctcggcaagtgcctcgttagctggcagtcggtcaagcagcaggtggtggccctgtccagctgcgaggccgagtacatggcggcctccgccgcttcgacccaggcgctctggcttgctcgactgcttagtgatctcctcggcagagacactggaacggtggagctcagggtggatagcaagtccgctctggccctggcaaagaaccccgtttttcacgaacggagcaagcacatccgggtgaggtaccacttcatccgaagctacttggaggaagggagcatcaaggcgagctacatcaacaccaaggaccagcttgcggacttgctcaccaagcctcttgggaggatcaagttcctcgagctctgctccaggatcgggatggcccaacttccccgcaagacgacgcacaagacttagggggagaatgttggataagtctttgtggtccttggtcgtgattcttctttttgcttttgggtagtttcacctttttcaggacagcatctaccctttagcatatttttcagttgctaggacagttgcggttagtaggacagcagcagttagcatctcctttatgcctcctttatgctttattcagtttggatgccctctaggacagcatcccattcaaatttcgaattttagactaggagggtgcagcaataggctagcagccagctatggctatatatatgtatccaacctccctcgggtaggcatggcttttgtgtttagtgaatgaagaaaatcagaaaattgccccatctcgagtgccatcctcttctcagtgagagtaaccattgaaattctaacatcatattccatcataaattcttgtttggagcagctgttttggtcttgacaattaaaacgcatgttaagaaaaacaccgctctttctattacaatattttgttgtgggatttccctgattaataccatatgaacttttatcttacatattgcattgtcttcatcgccaaaagtgagtgactttcagttttctttttctatatatgcagcacagatgattttgttttagaacgatatgatacagagataacaaccgaatcaaccccatttgctattgcacttgcaaaacatttgcactctgttggcgctaagatgtatggagcattctggtgttctcattgtaacgaacaaaaacaggtacaacacaagctcttgaatccactgtacagaataccggatgattttctgtagcttcttacatgctctactctaatgcttctgtaaatatgctgatgctatgattttttatttcgtttttttatttgtgtgcacaactaaatctccaaactggaagtagaaaagtttttacttaccttatcatgtggtcatgcagatttttggtcgagaagctacaaaaattctggactatgttgaatgttttcctaatggagctggcaagggaaagaaaatggctcctgaatgtgcagctgctggtatagaaggttttccgacatggattatcaacggcaaggtacttaccatatctttgatgtttgtaagcaagctcatgattgtgatggcattgttttattgagcctattatccagaaatataatgccattgtatttcttcttgccgtactgaaaatctatatactcccctatactttgattagaagcacttctagcatcctgaactctgaaattgcacaccaacccttctgaactttataatactgttcagatactggcacattgcaaactttagatggcacgctaaactttaggtactgttcatgcaatcgacagttgcgttgctgtatcttcatggtctcctaagactgctgactgcttatcagcattcgctctttcttgacaaattgattgaccttcatgcaggttttgggtggcgaccaggaacttccaatccttgctgaagaatctggtttcactgttgagggaaccgagcaatcataaggtcagacacgagagcaagtttcattcaattgaaggcgagtgttttatggttttagtgaagaactcaggttgtgaaggctgactacaacaattccgcatgacataccgtcacaccgagggaaggttttcgttccacggttgcatagcctacctaatacagcccctaaccactgtaataatcagtaaaagctgctcttctctcatacggagattgggagatgatagaagaagcccaaatgagaggtgttgtataatcattttgtagtatgtagattgtgatgtaaaatgtaaaagggcgcattgcttctcttcctaggtacataatgtaatgtataataccttgcaatgtgatatttgtacagaaaagtgtattgttcagtcttttaccctcggataaaggcagttaatgagtagccagttgacgagaatctaaagaagtgtttattttgatggagtaatttgaatttagcgctgaagattttaagagatgctatagctgtcagaaccgataagcagttttgaaagaagctgatgaatctaactaggaagaagttgtgcttgttagaagctcgttaaagagaaccgagtgtgtgaaagaaccgaatgaagcagaatgcttcgtcctaaattagatggctcccatcggtgatatgggctcgggggtatcaggtttagagggaggaggctgccccccaatgaacatctcgcacagatgcgcgaagatggctagcgtcatcacggcgttgggtgcgagatgcaaggcatggatttcatagcaatccaaaacctcatggaagaatccgaagaatggcggaatcaaccccgccatagcgaaggacaagaggtgcacggatcgctccggataccgtggccgcagccgcgactcccccgccctcacgacggcgccttccgacataatcttgcgggggaggctaaggtgcctatccgtcgtaatgcgtgatgccgggagcactgtgtcgccagcatcttgagccatgatggccggcagagaagcggcggagggcttggcgcgcggaatagtgtgaagtggcgagaatgttagggcttaaggagcgagaagacgagtgggcggatggcgaaaggaaggaggcaaagtccctacctctgtatccttttatcttcgcctcacccgcgctcacctcctcgtttcacgcccccacgattgcccccacgattctcgcgcccgcggttgtctcttcgtttctcgcgtccactcatcacgtcgcccatggaatccgcgccctgcctttagtgcgcctatcagcggcacactcggagtagggcgcgcaacagtcatgggcacatcctgagcgaaccgtcaccactaccgccacaggagtagcaggcgagggaatcgatgcgtggtctgaccgaccccctaattttcgcgccttaagcatcctcatcattagcgcggtcagtggcggccaaaccgctgccgtggttggcacgccaacttggccactcggtaatatttccttggattccctgccgggcccacaactccagcttgagaagtcgtgaggcaccacgtcagaccgacctcaggaggccaatgtctgatatggtgctgggggctactgtcggagatatgggcccgggggtatgcgaagtgaggggaagttaccttcccatccagccgcgtggctctacagcctagccccactcccgcacctcgcgaagtcacggaagcggccgggggggggggggggactttcgagcgaacgggcacttgggtctcacaaccccaagcacttgtgttctacactcaatcaatcaagcacaggagtagggtattacgcttcttagcggcccgaacctgtataaaccccttttgtctcatcgtctttgggggattgaaccccctcaagatcacacagcttcgctcaccgaatcctcgaatctcacccgctgcccccggccgaactcacaaaggggggcctcacggttccctggtggaggagttcattccccgacaggcttattagacgataaaaattaatttataagtaaaacttttatagatttgttcgtaacgacttaaaagccaacattaaccaaaaaaattgcgttaaaagcatctcaaaatcaacttcaaaatcaagttcaaaaattcaaattttagcttattctttagctgtttaggccaaacgatggggcttgatgtcgtttaattttttttcttgcaatgtttgaccatttgttttatttaaaaaattagtgtaaatataaaaaagataaatcatgcttaaattttttataacaaaacaagtaacaaacaaaataaatgataattttatattttttaaataagataaatagttaaacgtaacgaaccaaaactatgattagtttttttttaacgtagggagtaatgtttccgtatcaatatgtcacaacgcattacacgtgtcaataaatcggtggtccgatgcatctataggtggaagggttacgtttaagacgaatccagaagcatccgcgccgcgacgcgaaccccatcgcagccagttcacacgtctgtctcgtctcctcgtcgcgccgcgccgcgccgccccgctccgcccgccgcaatgccgaagaagatgggagtcaacaccaaggcggaggcggcgcgcgagcgacgaagcgccgccgaggcggatcgccgcgaccgcgacgctcgcgccaaggaggaggcctactggcaggcggccgagggccccaagtcgcgctccgcgcgccgccgcgaggaggacgccgagaagcgcgccgaggcggccgcacgccgcgcggagaaccgccgcctcgccgagctcgagcagcagcagctcgccgccgccgcgcggcgccccgaccgcaaggccgcacgcgtcggcggccccgtcgtccccaaggtcaccgaggccgagctgctgcgacgccgggaggaggagcggatccgcctcgagcgcgaggctgaggccgccaagaagcgacaggcccgcaccgccgaagaggaggagtacgagcgcgtcgtgctcgtcgccaacaccaacagagacgactccatcatcgaggcacggtcagtggaggacgccatcgtcaagatgtccatcgctgccgagcctgcgctaccaccggatcgccaccccgagcgccgcctcaaggtctcgtacaaggtatggcactaacctatctgtgtgttttttttctttccatggcaactgtaaaatcctccttgtatttgtagtactcggggagaaattaatactgactatagtaaatattcttagaatcattgagatgtgactgcaattattgctggattcatggttcataggcagcagttgatgtacataaacacagttttacaaaggctgaaattctgtcctagttttagttggtgctatagtgagtttgagaccaattggcaatcactggcttgatctaaccaactggatttcttagtgtgttctatctagtaccctttttttttgtgctcttctgatcagcatatcctatcttaatgcaggcttttgaagaagcagagctagccaaactcaaggaggaaaagcctgggctgactctgcatcagtacaaagatatgatatggaagttgtggaagaaatctccagacaaccctctcaatcaggttcaaccttaaattcaaccttacttcgttagatcatattaagcaccttgttcttaagataaactgaaggtcttaaaacctgttttacgatgatctaagaagcaccccaaaactactaagtttgtagtgaaatgattgtgagttaatgatcacctcagtttgcatgaaggtgatgtatgtagtgctaagtgatgtggaaggtgctaaggagcctcttgaattttgccatcctaatcatatgaactgataaagaattcaacattcatcattggatgtacctctatggccttccttttcaaatatcgcaaatgcctattgattccttgaaggcttatagctttatgtgacattaaaattcacttcacttccagagctgagaaaattataacgcagctctaagggaattccatcagttgtgctcttagcgcacttgactgtctataacatcaaccttaattttgcaggctgctgattgatttcatgattaccttaccacattggagccaacaacctggcatctttcttttggttctttatgaacacaaggccacctgtaaagtatttacttttagagtcaaatctccttttgtttctgcatcattggtgcaatttagcaaatgtgagatctgtacaccggaagagtacaatgtaacatgctaagagtgttttttgataaagatatttgatctattatttattcattgaaggaataaacatatacttttatgtatgctaagagctgttcctttctattatcctgatatttggagccatcagactgctagatatgttcatgtggtcgtgcaaggtattggcactctgtcagactgcaatattgtgcctgaatcttatgcatcctgttgtgcagtctagctagagtcgttggcttcagaatgtcttccaattggatcggctgccttgatacgaggcaagcatttcttcttctaatcttgagagagtactgaattttgccatcctaatcatacttaactgatgaaggatccatatgcatcaccattttctgaaactcttcacattctcaaattgcaatctgaggttaaagttctgctcaactcaaaaattatcaaagcgctaatgatacattttgcagcagcacaaacattttatcccgttctgttaaacacagcaaaaccaggaagaatcgaacaccctccgtcgacggcgacacgctgtcacccggcgaccggcggcggcggcggagcatcaccgccagcagccaccccagattgccgctgctcgaactcctggaggagttcggcgtcgacgttctccgcgggctcccacgtcgcctcctcgatgtccacccacttgacaaggtactcccatttcccctccccttccgccgcctccctcttgttgacgacggcctccgcgacggcgtactccagcccggcgtcgaagtccttcaccaggtcctccgccacccacgccgccctcacccactccctgtcgccgccgtcgcgccactccaccaagtactcccgccacttgccctcgccgcggccgtccaccaccttctccacttcgccccactcgtacacggccttctccagctccttcgccgccgcctccagcgccagccgccgctcgaacgtcgccgggttgcccttgggcgtcttcgcgagcacgtcctggaccagctccagcggcgtccggccctgcccgtcgggggcctccggctcggcgcccagctccagcagcgcgcgcacggccgccgggcgcccgtacccgaccgcgatgtgcagcggcgtgagcccgccgccggcgcgctcgggtcgccccacgtcggccccggcctcggcgagcgcgcgcacgcactcctcggatccaagccccgcggcgaagtgcatcgccgtgcgcccctgcgcatcctccgcgtcggggtcacgccgcagcgtctcgtccgcgagtagcgcagtgatctccgccgcgtccgccttcttggcggccgtccaccacggcgtctcgtactccgccaccacgtccgccgctatggcctccgccgggatccacgaaggctcgtgcccgtccttccactcgacgaggtactccgtggcggtgaccgtggtggccgagccgtcctccgcgaacaccggattcttgatggtgcggctggacacaatacggtccacctcgccgtacgcctcatcgtcgtcgcctcccttgctcgctgggtttcttgggttggtctggtcctggaacaccgccgcggcggtgagccgccggttggggagacgaagccggaaagggacggtgatggagagggctggagttctctgagcattggggttggggggtttgaggcgggaaagggatgggtgtcgtaggacagcctccattggagtgggaggagcttgtggcgcgagtggcagtggagtggagggaagaggatgatgggtttggattcgggagggagaagaggataaggtgatgggtctcttggattgtgtgcgatctgagccactcgttttgtggcatggacggtacagatggagtagtgctattcacatccgccaaacggtcgatgatgcccatttcccaccggagatcggggttcgggtccccgttgccgcgcgcggaaactagctactgtagcatttagatttgcagctataccgagagccaactacttaaaaaaaaattatgacaattgaattagaatgtgacacatcctctatatctaaattcgatattctagtactatgttatcttttttttaaacggaagtaagtacatattaataattagatgattaaatttgtataaatatgttaacatgtacaatcaaaagtgtactccttattggcagttgtgcgtttggttttatgcatgctagctcatctttcttaacccaaatttcctctctccgtttcttgctagaccagatcacaacaccctgttttagtttaaaatcgattgacaacataaacaaaaactagaagttaagcttgtgcagctaggcggtgcttgattcatggcagagcaaaatctatggtgggtcacgtccagaaacacaaagaagaagctccatccatgcatcgactggacttgattccggtcaaggagatcgatctggcggcgaaggcgctggttcgcatgacgagctggatccgcctaatccgatttgtagctctctccctctcttgaaggggaagttttccgatgctgaccagcatgccggcaagaaaccaaacatgccggatttgacacagaggccgtcaagcaagttatgtggcagtgtggcacagggggagctagagttttgccgtggggactgagcgaaaaaaagggcaaccaacgtgatggcaataatttagcaagcatcggcaaaagagattgagaggagtgagataaatggggattgttggaacgacatgtgctgatcttgatcttgacggtgtttgttggcactgcctcgtagacctgctttttcatctccaggcaatgagtagacctcgtctaaaaatctccctcctctttctctaattgggtagttagatccacacattttcttcttaagagcaaatttaatagtttttttagggacatgcagagagctcctacaatttcactatagaagaagatagttgatataagaaaaatcagacccaaaaactttacaacagcacggttaattttagaaaaaccggcgaaaacccggcattgacaaactgaacgcaaataagagtagtccaacaagagaagaaactcctaaaacgaagccttcaagaaggtaacgccgacaagacggcgacaacgtccgatcctaacgaatctaaggttttcactcggagaattcccttgaagtggagttgaaacaagggctttaaaagcaacgccttcaagaaggtgaatggcacccgagggcgtcgccgttgctagcaccggagcagagcaaggttttcacctcggagaccctgtcaaccaaagcatccacaacggaagctcccaaatgccacttgcacaccgaaaggtacctacaatattcacaccacctgcacgacgaccggactccacaccacccgaccccgactgtggatgcgctagatctggacctaggagcccgatccggccgtcttccttgcaccaccatcgccagccgacgccacaaggtagcatcgggcaatggaggccgtcggcgctgcacaatcctttcaccgccggacgccgcgccgtcaccggatccacgaacaaatgccaccgccaccaccgtccccgccgccatcgggtactaccgtctggagaagcgcgcccctaccatcgctgaaacgccacaccgttgccggatccgcggaactctaccaccgcagtcgcaatctttgccaccgacgctgttcctgtccccgctagatctgggcggagcggcgctgatctggcggtttttcgccaccgcctccctaggtgactccccaagtcacccaagcacgtgagagatgaggggccccgcggcgaggcggaagagggaggtgagggagaaggggcggccggggcgtcgcctcccgcgccgcccctgggggaggacgatgtgagaggaggagggcttccgtgtctgtgtctatggtgcgtcacaagtttttcagcaagtttaatagtagagctcactaatagctattagcatattttaaagccaacataaataatatattagctataagattggtttcaatttttccctcctctccctttttctcactcatatatttaatgtatttgtatttgagcacgtgttaaattagctcttacatgagagttaacacattttattttttgtcacatctttccttcacataagctcactattatccttgctccaaaataccgtgtgttctatactacgtacgcctaacaaccttgtgaggccacttcttttctctatggcggcatctgaatctatgtggatgctagggcagaggctagagccacgcaccctaaatgtcccaaggaaaaaaaataatatctccaaccacgtttggtgaatagcctcattgtatcttcgtcggtcgtggcaatgccgggagtctagccaccggtgcgtatgaatcaagatcctctgcaatcaattgcaccgtatctttatcactgatatatagcccgattatgtagcctgataatctctgggttcacatgtcagtaaaaaaatacacggtgcagttactggagaggatctcaatccggtgcgtatacactcagcattgtagccgcccccatcactccaccggtccgcccccaccctgcttttccgaaaacgattcggcagaccggaaagcgggaaaggcagaaacacacggcagacggcacccaccacccaaactcgttttggcagtgaagcatcggtcctcggagccgccgcgccactgttactaaccatttgtagttgatggcacatgtgtcgccgtcgtgtcggccccattctccgggcgagatgctgcgagcaaaatggtcatcccccttcctccgcagctgcacaaccctgtcaaaactcaaaacgctctagcgcttctcgaagccgccgagattcaggccgcatggtgaccgttcttctctcctacaggtggttcaagcgcacgggtgggcccacacgtcggtgaccgattcacacgttagtctgactgaccgcacagtctgcgttcgatttcgcacatgcccgcaccgcactatccccacgtgacgacgacgatacgggcgattccacctgccgcaggcacggctactagtactactctactagcctactaccccacagcagccaggaaccagccacacattccacagccgcgacgcgacaccggaaacaaacgcaggtagcaactgcaaggggcagttggctggagctcggtgatctgtgggtctgatcgcgatgggacgctcaccggagatggaggtggacgcgcgcagcggctactgcgccgccacccgcacgttccggagcaggcgcgccgacgtgccgctgcccgccgacccggaggtcgacgtggtcagcttcctcgcctcgcgccgccactcgggcgttgtggccctcgtcgacgccgcgactgggcgccggatcaccttcaccgagctctggcgcgccgtggccggggcggcatccgccctcgccgcgcaccccgtctccctccgcaagggccacgtcgcgctcatcctctcccctaactccgtccacttccccgtcgccgccctcgccgccatgtcgcttggcgccgtcctcaccaccgccaacccgctcaatacccccgccgagatcgccaagcaggtcgccgacgcccgccccgtcctcgccttcaccacccgcgagctcctccccaagctcccgcgtgcccacgacctccgcgtcgtcctcctggaatccgcccgcctccccggcgacagctccgacccgcggatcgtcgccaccatcgaggagatctccgccacgacgcccgacccggcgcgccgcaaggaccgcgtcacgcaggacgatccggccaccctgctctactcctcggggacgacggggccaagcaagggcgtcgtcgccacgcaccggagcctcatctccatggtccagatcatcatgacgcgattccgcctcgagggctcggacaagacagagacattcctctgcacggtgcccatgttccacgtctacggcctcgtcgccttcgccacggggctgctcggttgcggcgccacggtggtcgtgctctccaagtacgagctcccggagatgctgcgctcgatcaacgcctacggggtgacctaccttccgctcgtgccgccgatcctggtcgccatggtggcgcacccgaagccgctcccgctcgggcagatgcgcaaggtgctatccggcggcgcgccgctgggcaaggagctgatcgaagggttcagggagaagtatccgcaggtggagatcctgcaggggtacgggctgacagagagcaccgccatcggcgcgtccacggactccgccgaggagagccgccggtacgggacggccgggcttctgtctcccaataccgaggctaagattgtcgacccagattccggcgaggcgctgccggtaaaccgcaccggcgagctctggatccgtggaccgtacgtcatgaaaggtttgatgaacattgtttacatttcatttagacttggcagcatttttattccattagcgagttgcacgctagaaattgtctgtttgtggatcactaatataaacgcactaaacaaattaaagttataaccgcgtcatttggacataaacatataaattgagctataaccgtgttctgaactgtcatgagcttgctgcctgaacaaagttataaccgcgtcatttggacgtaaacatataaattgagacccctgcgtcatttttttttgactaaggccacatggtaggtgccagttcgtaggactttgtttaatttactatatcgatcgggcggtagctttccatgagaataaagttagtgttgggaaaagaattgaaatgcataatgcatatgtatagattatacattgtttacatctgattatctgtaggcttccatgtgcattgtgcagtcaaactattataatgttgagtgatcttttaggtgagatctttcgcgggtgctctctaccagaaccatcgactgaatgaattgcccctgacattaattcctgtttgcatgcatatgctgttcgaggcatttgcctttgatttaatcgtgaagaggaaatcaattgtgaacacagaattatgatttatatattttagttcggcaagtaacttcacctttttctagtactaaggatcattggcaagtagattggttcagtgagtggcagaattatgttcattatgtggaacatcaggttcttgttcaatgccatgaatatcttgctatgttgtggcattatagtacactttgaaatgagtcgtgcattcagttttccacacctcaacatattttagtgtatctccattctttcctttacttttttttaaaaaaaaaattaaggtaaaggatttgcctgttatattaacaaagcatgtgttcactacattcagttgcaagcatatttattcagaatgagtttcatggaatcagtaagtactacgtgataaagttatgcaatggcagagcttacattttacttgcttaagaaacaagaggtgtttcaggcagttatacacaagagatttgctccggtccaacaaaaagtatctcgagataccggtacctcacgttatcgaatcatttccgatcgttggatctaacaatgccccatgctgccagctagatccaacgatcggaaacgatttggtaccgtaaggtacacgtaccggtacctcgaggtacttttggttggaccagagtaaaaatctctatacacatgagatacccttagccagctaaagcttgcagtcaaaattggtgctttatattttcctgctatagaaaaaaataatgggtgtaactcaaagttggttctcctcaggctacttcaagaacgcagaggcaacacagtcaacgctgacaccagatggatggctaaagaccggtgatctctgctacatagatgaggatggatatctcttcgtagtggaccgcctcaaggagttgatcaaatacaaaggttaccaggtaaaaatcactgggtgatatgtctgatatgttaggtttcctgaaagacttttaggctacgcattttcttatatctgtaactctgaatataatttgtgtatcactaggtgcctccggcagaactggaagctcttttgttgacgcacccagaggttacggatgttgccgttataccgtaagcttcatatagatgccagttatcacttctatagaaataattatgctaggttctcaatgggttggtgtttggttctgttgcaggtttcctgatagggaggtcggccagttcccgatggcctatatagtgaggaagaaaggaagcaacttgtcagagcgcgaggtgatggagtttgtggcaaaacaggttagcatgattcgatcgtcagatccaaaatagaagttgaaatgaaacatcatgttcagtgttcagtgttcactgttgattcagatttggcttaccaatcccgcaatttctctgaacttctgttatataatatacgcaggttgcgccttacaagaaggttagaaaggtggcgtttgtgacggacattcccaagaatgcatccgggaagatactgaggaaggatcttattaagcttgccacatccaaactatgaaatgccaatcaattatctactactccacaatatattaagcttgtcaagaatgcattcggcaagatattgaatacgttttggaattggcatagacactttagttgttgtgtaccctctttctcaatatggtgggtatttgtaaatgaagatatcatcagtcatgtgcatttcttctatacatgatctggtagagttacactgtatccattcttgtataatcaaataaaaaataatttccgagttcgagccttcgatgtacactcatgtctgcccatcgcagaaagaaaaaaagaggaaaaacagagactcatatctgtccaaaatcctgttttgggtctgatcagttcggtgatcaccagctttctttgccttgatgggcctccagcctgtaatggcgtatcaggacgaccttgtttttggatagtttcaggcagaccttagtttttttttctcaataacgaaatagaacatcccggtctttactcaaaagagttagagttacagccaagacagaccttagttagggcagcgattctaaggtttgagcaattttgtttgcctatacagaacacaacttgttacagttgtttgaggtggattgatctacttgttctaatttggaggcgttcacacaattattgagtttttaattgccaacaactcgaccgttagtctactaatgacctatatattcacttgaaaatggtacggatgatggtaggtggtcgacacagccgcctgcatttgatttgtccgtgagaaatgccaaacgggaaaataagaaagaaaaagcatcagacctgagctaaggagtacattgaatattagccggccctgaccgatgctttgctgctccaatcacgcaaattctatggcccaaacattcttcgcactacaataggatgatgggctgagcatatatcgcacgcatgtctgcttctgcttttgagccttttttctgttcccattctccgaccaagataaaaggtgaaatcgattgggacggatctcttctagagaggcggttaaagtggcctctaggatgtcgacgcagagcaacctttggaacagcgaggaaaatgacttgataaaggcgttaaagcaggggagaggcattataggattcggtgacagggacaaacaagaccacaattcgaattgttcatcagtcagcccattaagatctcgtcggatcaaggagatggaataaaggatcaaactcggtacatgtgtgcataaaaggtacaaataatgttctgtgcaacgagccagagaaggcgtaacattttatttgacagttgataggagtatatttcaatgctagtagacggagcagaacgtatacacacacacacacctgacagctcgatacaaagatgtatcgcacgtatataggactactaccccgtgcccggagttcatgccttttgccatgtgcagctcgctgaccgagtcccgacccgacaagcacgacgtgtcaccgcgctgacgagctacgaggcctcaggcctcgaaactggggaggaaggctgaagaaactgcggtctcggactctcggcggacgtcggaggacgccacgtagtacgtgttctggatacctgcgcaaccaagcgaacaaccacgtcccccagtcgagcgcacgcccggccgcccgtgcagcgcaaccacgcagattccacggagaaatcacggacaaatcccgccgtttcctcgtttgcctcacctgacgctccgcggctccgcgcacctgcggcctgccgacctgagtccgaggcgaaaccacccgctaggtgcgcagcccgaaccgggtggaaggctgcagaaactgcggcggacgaagccacagccccacgtgcgccgttgcggtatccgcgcatcgcaaccgagcaagcagccatcccccgtcgcgcgcatcgcccgtgcaaccacgcaaaagtacggagaatcctcgtcacttcctcgtgtcagcctcatccacgggtgaccctgccgcatgcaggacgccgcgcccgcgcgtagtttggcctgcacctgcacgttagccggtcaggatcggagagcgaagtgcacgagacggggcagagtcccatgattaaccggccgggtggcgacgggtcgcgttgcttgccgcttgatttgctggatccatcggtgttcgcccgggggtacggtgggtcgccgctgctcggcctggtcatctggcgccccttgttcgcttgtgtcacgggccagcgcccatcgagctgcaaattccgtgacaaattgacagcttagctgctgcctcatcacagcgtacagtagtatactactactagaagccctctgattcctcgatgcattcattcgtgcataccctggctgaatgcgtgcacggctgttcgacaagggacggcatggaacggaatagtggatgccctgtggttatcaagtttttagacccaagtggggcagttctacatcaccatcttctaatttaaaggacaaatcttgtttttgtatgttgtgattcgtgatgatagtataagacttatattatatggacaagttaatttttagaaacaccgaccagaacgtgctagtatatatcacaaaggacgtaacggaaactgttgtttactggagctaaggtcgattaaattgaacaccaatcagtcaatggagttgttagcctttgtcaattgcgactgagttgcacgtcactccattgtgtagccatgatccttggacaccggatacatgcatgccattgctggcttatttgcaagtgaagaagaaaaggaaaagaaaggggaataacactgcacaaaactaagacttgagttcctctttggaattaagacctttctttccatagttgacgaaattataccgtcatgactcatgagcatcctggctagctcccaagtccctttctccattcctccaattatgtggcctacgaaataagaactcaaaaatgcggtacatgcttaacgaaattaaaagcttggcattatccatccaaaaacgtcgacctatcagaggggccatacccatacatgatgcatgcactcataattcacatttatgatgatattatatagaacaaaacggaaatgaattttcagctagtcagtcagccagtctcgtggtcgtgtggcgtggcagcgcatctcaccgcaccggcgttggtggtgcgtgccgtacgaacatgataagccctaatcttttatcggctttgctttgcttcctctccacatcatgcaaaggcagccacttctgttccgttcattcttatccccccaacccccactactcagcatcacctcagctcagcctcattctgcaactccattcaactgtctgatcccttttctcgcacgccctaaattcttcagatatcagacagttgcttctttctttgctttgtttttttcttttcttttcctaccatgtctttctgccatccgtcttatactttcctgtaggaaaatgtatatgtgcgtgcatggtgaccaccagtgttagtgatatgggtatactattagaaaagcgacgatcgacgagatgcgtacaagtacattattatctcttttattttttggattaacacatgattggctctagttaaggcatgcttggctcataaatttctgtcaactccactgattagttcgtgagttctaaacgaatataattaaaaccggtaggtgataaatcaacagctgatctgcatacttacgtaacatcacaagagatttgagctgggtgactgtgtactattgaggacttgtcaagtagcatgtgtcgcaacgtgtgaacctgcggttcgactctatggaataagcatgctagcagtacagaggtttttgtttttcacctttcaaaggtactcccttcgtttaacaatataaatcattctagcattttttatatttatattatttacgaaatactaaaatgatttatattatgaaacggataaattaggaatcatgtcgtaacgaccagtaagtaaaatctgctgaactgtgtgcgtacgtaattagtcgcagatgcagcgagggaaatgtcgattctgcgtcaagatgatgatgctggtgatcgctaccctgcccaaaatcttgagcctgaagggtctctctgatatttcttttctgctcgcacattcacctggagtcactgaacactggtccagctaaaaagaaataattggacacattcaccaacccccaacatcgtaatttttcagtagtgcgattgcgcacgaactcgaagatcatacggcgccactccctctagctattatactaatctttaattaattggatgccacaatcttatagtattaattaatttgtttgtttgtttgttcatggccgacttgaaacttttctgtgagtcacacaataagctgcccttttaattgtactagtagttttttaagtgatcaagaagcgattgatgcagaagagcgacaggagaggaccagaaactgaataaatccaacgctctacaacaagggaagctcaccggccaacaccagctagcaaagctaggcgacctactcgctcaatgttcatcagtaatactagtatttggtttttctttgcgtgggactcgacttttgtcttgagctgagattcgtgaaatgcatggtactaataattaaaatcctggggttctacacaaatagatctcgttcaacggaaacaggtgattctgaatgcgcacagatgcagagacaggaggggttaatccgttagtataaacgccccaggattagcaaagatcgattttcatatggcgtcacgtaaccgtcaatattaatttcacaagcacatgaaaaggacaaatagaatcgaaaatcatagcgattattaattattatttcctctccaatttgcaaccggctctgctagctgtgtcgtccacatccgtttccaggagtcgacgtccaaccgtactacgatgattctacgctcctaacggaaaacaatctaccgagctacgaaacgagtgcacaagaccacgcaaaatctactaacacgattacctcataacctcccgtgaattaatcgttttcagatggccgcgtatctcaaaccccagccgcgcccgtacgatttgacacgaaacttgggtacatttttcagcagcagcagcggggcgtggagccaaaatcttatgggtatctcccgtgcagcgtcgagagatcgaccgctcgatgccgcatcggcgcaagcggccaagcgggccacttcgcgcgcgtgccgcgctgtcgagtggagccggtggccggtcgtctcccgtcccgtgcgatcccctccttttcccttccattttgtcgggcgcggccaccgccttttacacacccgcctgtcacgacgtacacctcctcctccacacatacgcacgcagccgattcgcgcgggatccgtacttttttcttctatgtatatctctcgttgtgggattagttattggtttggttactaagtggcgcctaattacctacttacagttgcagatacggggttggctgtgtgcgcgcgcgcgcgggcgcgggcgcgggcgtgtgggggggggggggggggggtgtataaaaccagtcgtcacgcacacgaatccacctcggtctctctcttctccgaagcgacccacactccccgtgcccgagccagagagtatggccgtctctgtccgttgctgcttcggctcctcctccctttcgcaccacgcgcgactactcctcgtcatcgttgcgttgctcgcgcctcggctcgcttccggctgcgaccgctgcgtgcgccgctccagagcggcttactacacctcctcgctcacgctgactggtatgtcgacacgacggctctgtttttgttcgtggttttgcgtgcagagggagcggccggattatggatcgactgattgattctgttcgtttgttcttgcgtggcacagccggttcttgcgggtatggcacggcggccgcgaccttcaacggcggcggattcctcgccgccgcgggccccgcgctgtaccggggcggcgtcggctgcggcgcgtgctaccaggtaatcaagctcgatcgagaaggagaacacaaccgaagataggcaactagcttagctgcatatgccatgtccatggcttccccatcctgaccgattcgctgctgcaggtgagatgcaaggacaagaagctgtgcagcaacgcgggcgcccgtgtcgtcgtcacggaccgcgccaggacgaaccgcaccggcctcgttctgagcagcccggcgttcgccgccatggcccgccccggcatggccgcgtcgctcaccgagctcgccgccgtggacgtcgagtacaagaggtaagcaaagctcaccaagctttactttttacccagctcgctttcttttcaccaaccgcaccttagctcgtgttccacacatatatagataaatattaactttaccactgttcaacagagagagtttcaccggtccgttgctgtagtttaccagttgcaaagcgtacgtacgaaatgtttggcaagtgctaggcgaggcaatagatagtgaacacgtacgattgtcctaagccggaattggaagtcaggctcaaattcgtcagcgatgtgcatgtgcagggtaccgtgcgagtacaggcacaggagcctctctgtcagagtcgacgagagaagtcgcggacccaacgagctcaccatcagcttcctctaccaaggcggccaaaccgacatcgtcgccgtcgacgtcgcccaggtaaaaacacagcacagcacagaacaatcattaacaatctgcaagtgtttgtgtcgcagaatctaacaatcgtgtgttgggagctgcaggttgggtcgtcgagctggaagttcatgacgagggagcacggaccgtcgtggagcatggcgaacgcgccgccggggccgctgcagatgaggctggtggtgaccggcggctacgacgggaagtgggtgtgggccgaccgggaggtcctgccgaggcggtggcgcgccggcgaggtctacgacacgggggtccagatcactgacatcgcccaggaaggctgcttcccctgcgacacgcacgagtggaagtagaagcccagccacacgtacttctcctgtcgtcacggccattttggttgggctttgatgagaaagaagacgtctctcggctcgcctccagtagagatttcactgacccgatttagagtcctcctaatccctcggcaacttcagaatttcctcctccgtttcttcttcttcttttccaactttgtacatgagctactaactaatgtgtaaagataaaattaaagcaagttacaaaccgtcccgtcccattgggagcctaaacaactaacgaaaaacgaaccgaattggcgccgccgtgaagcaacaactctcctgagaacgtttgcaacaaccaacgtatcgcagtttcaaagggctcacatgctgttgctgcctctggcctgggtgtgttgcttccggcaacattcctctctaccctgagtccctgacacatggcttgctcggctgcctctgcctacggtgtgcttggtcatgttgccaggtgcggagctaaaacgaaatggaggatggtaccacttgcttaatttactttagtttagatcgaatttaagctgatgcggatgtctaagtttatattgagagggtacatacatgataagaatagataagatatagctaaaataattttcttaaccgggttactggcaccctcctaatatacagcccctgcacgttgctcgttgctgttggtggtcagacttgctgacggagctggtcgttaaaccttatcagaattctgcatgaaatgtgaggtgattaccgaaccgtttccattatctgaaaaaaaatgtgaggttgattacttacacgagaacaattacgagggatattgcaattcagagtttcagacatgtatgtggtgggcatcagggcacggtaggtgagtgggccataaatggcagtcacagccatcatggacaccgcaactccacaagtccatggtgcgaggtatgatggccagttgcccgactgaactgaatgtgccggtgaaagtgagcttttaaagtgagatttccctcgcattacgttgccagtgatcgtgtctacgtgatggtacagggttggatcaacacagcatcttctgcctttcgatctgaaactaggtactagctgcaagtgaaccagtgattcagacttcgaagcacttcatttcttcatttctgctgcccaaattgtccattttctttttcaaaacttggctgtccacgctccacggcctaggaccaggtcatggcttctaatcaaacagctcatgaacgcatataaaacgatacgtttgaactaattttttcacaaacaacaaaaccggtggtagttgaaatcaaattaaaatggagtacttgaaaccgagggttctgcaattctgctcagcgccaaagcaatcaaacatccgagcaacttagcaactagcacttgagaaggttaggtggtcaaccgtacaccatgcgtgcagcagcatggatcaatcgatttgcagcaccagcagccaacaatctgatccgatcactgaggctccaacatttgtaggcaagcaacacgatgatcactaaagcaagtatgtcatgtgtgagagcctcgagtgagacagagcggccggcccggcggtataattcactgtccccttgtgcttagcttgcagtaggaattcagtaacctccaacacttggcattttgctgccgtataatcaatcatcatacgagccgaccagcacaagaaagaggactcgaatctagtggttaggagaactccaaatgaacaactgaattttaatcacgaagggtagttttgaatagttcttgttactgtctctgtttgcttgtttccacacatgagcctttggtttgaggtccatgttcttgcccaattagattcagaagtacaattctggttaggtgtttcagatggttgctcatttaggtgcacagaaatactagtgacagtagtattgaagagctgttgccaagttagcagaggcaagtcttgtacttagtagatatatattaagtcttatcatgcattcagacattaggataatcctaagagccgaagctaataatgttctcgtttggttcagtgaacaaaaaaatggacagctgatttgtaatattctgattctgtttcggataacagaaatcacaggtcagaatcatgagtactgtgcatagttctgagcttcttatccattagtaggacagggcgttcttattattatttttctttatctaaaaatattaggacgcaactagtgaaacagatggggcaagtacgcatcagcttcatgagtggatttatttgggagccatgaactccatcttgtgacttgtgaagagaaattggtggcctacctaaaccaacggtatctccattgtagttttgtaattgtgctaacaccaatgtgacagttattaggtgacatttttgttttgatcatgacaagatagaaatatatatcatgcaaccccaatcgaatataactactacgaacagagccaagtgacaaaatggttgcaatatttctttttcactttgttggctaacgaatcaccagcataaaactgatagtttatttcatctgccgacgtaggttgctagcccaagtattcaagctgaagtttgcaaagatgctacttaaatgatgacgatagcaactctatattagattattgagacgatgtttcagagaaatcggtgatgttactttctgaaggatgcggtgtcacacaatcacgaataagtgggtcactgttgttcaagcaggaggagttggtggcgactgtattaacaaaacctgaagagaaaatatgaacagagagcctcttaatttgactgaagacaatatttagttttaaaaaattgactgaagtgtgaagacataaataacgatctgacgtttgcagaaattttatgtgtatgcatgatatcagtaaatactatgttgttatggcgacacatgttgtttcatcttcagtatgacttgggttcagattctcgggaccccaaccagtgttcatagcttgactaggtaatacttgggccagcaaaaacaaagtaacagtgaatagggcaatgattgattttaggtggtgtttatattgtaaaacatagtgataagtcaggctcagacgtgttacctcaagatgacatagccacatcatgataaatctcgcttaacctagacgctcggaaagaaagctttggtgtcgttgatcagcacgcaactaccttgcagaagatgctctcagatcacatcgactatagcctttgtgcatatatcggcctactatcagccacatggcagggaacaatttgccaactcagatgaaatttatatggaacagttcagttacctgttaccgcatatatatgaaacaaaatataaataccatgttctagacagtgcatgaatctccatttggaacacctaatttcagatgaagcagtttaatcagcagaagaatctggaaaaatattattgatctaaaccggaatctggaaaaaaaaaaccgggcttaggtttttctgggccttaatctacggattacagcctgcagccaggaggatacaaacgttttgacgtcagtgggccaagatataacagtaccattgagaggccaagaatccaatacttatccggcctttcaagatccttgtccgtttatgtgttgaggtttgaaaatgactggttttggctgtagcctgtacgcagttacttaccaccgatatgattcatccaaatttggcttgctcacgttagtaggaaatcagacaaaataagagtacaggaacaaaaagatcaattaaaaacaaagggatcaagatcaactatactaattacccatttgatttttgtgatgattttcggcaagtcagtcacgcatactttggcatgttgaacttttcaaaattcaaatatgacggacctgactcctcatggacaagttcgacccatcttgatgcattcgacatgccaagctactgatatgtgtcatcattgcctctattatgcacatttgggagtagtgagacgacagcaacaggcatcacatcaagaggaggaatgtgtgcgttcactccaggaggatttgaaatatttgaatcacttttcaccaacccagcatttccttctgttatcagttgaacgcccgaaggtgcagaatcatcccagcatagagcgaatggtgtgtcgagatcacccttggtgtaggttctaacttggtggaggtccagacccggccgtgcgcctcctaagccggcccctcgtcatccgaatagcctcctggatgagcgtatcttcgtctggtattgatgactgacgtgcgttgcttgttgatggaccagatggatcaatctgcatagcttcagtgttctgagggccgtcgctggcgttagcttgaggaggaccagcatgtgcctgtggctgggcaagagactctgcaccaggaggaggaacaggaactggagttgtatcctgcgtttggttccttggtggagcagaaggagcttgggtgggttgtggtggcagtggaggcaccgaaggtgcaggaacaggctgaggtgcagggttcacttgccgagtctgtgctggtggtgggcgctgctgctgttcacgtgcctgcagaatagaagggttgcagtgaagtcagtatgtcagtcacacaaatataaactgtcacacatgctcgctactccctccgtcccataatataagggattttggagagatgtgacacaatacatggtcctaggatgtatcacatcccttcaaaatcctttatattatgagacggagggagtaataaatatatagaggtgcaaacaatcttttgaatcctacaactggtaaacaggacattaatactagaacagtaaacatcacaatgtgctcaaataacaactctatcgtgcactaacaaacaaaaattgttgacaccgccttataaatggcatggttaaagagtgcaacatttagtaattcaataaggaggtaatccaagcttctcaagtcacctactgtagtaaaagatcataacaagaatgaggctagtgttaatataaaaaaaataccatgaacagatcaaactatactagaagcaaaaatacataaatggactggggagtaacatcaacgttttaaaagatacctgtgggcgagatgtttgggtttgtgactgtgaagcaacatattgcaagatttcataaagccttgtctgaccatagttggaaaccttctggaagtaaagaaccgccatgtcgcaagctctagtcctcaactcaagcagattgtgatcgatatcagcttcgtattttgcaatccacggtttaaagaatgattcatacacataggcagtcccctgaaatcaacctgtgttaccaacaaacaagagatagattcttctagcagtttgaaatactagagtaccataccagtgttttgggataccacaaaaatacgacaaatgccagctttgcttcactgtacattggcaacctacacgcaaacaaaattatcatcagcaagcaggtaagatttcccctttactgttacacctgaaaaaaatacaattccaaatggtcaacttaccatgatacaaaattatccccaactctatcaaaaacagttagaacagcaagtaaaatcctgcaaaagccatgatcacacagctgagatcaagcataagaaatccaagaatgatagtccaaaataaaacaaaagggcataaaaagcataccagtactgacaccagaaccgcaacttctcgatctcaggcttgttcagttccaccgtcttgtagcaatcataggctgggtatgcatatccaagaataagcctgcaaaataggtaataacaaacatgtagcagaccaaaaccattacctactgcagtacttttgtacaaaaactgctgctacttacattaaagccccagtaatgaatgagccagccatattgactgttgaggcctaaaggttaagaaaacaaacatttgttagaaacactgtttaacagccaataacagcatccataaacaaggatgtcctatgagcatcgaatctacagcagcagttacacataaaccctcatcaagctccttcacaacacaaaacatagataagcagatcattataccgctttggcagttttcaacttttgctccccttattaatacagtcatcatgcgttttaaaaaatagtattcaatcatgactgcatcgtagattcatagtagcttttcggacccttaatttatagatttcagattctctataccagatccgttccaaataaaaaaaaaactgctataccaaaggatgaagagagtgggggggaatctatatgaacaacctacttagtaaacactagtgctaatttgaggagtttgataacggatcgacttgaatccccaaataaaaaatcaaacgagctgccaaaattgcttcgctaaattgaggaactacctagacagtaaagcaaccccctacaaaggcaatcactacgtttgtctcgcaaatctctccaaaatccaaatgcaagctgcttacaccaacatggaaacagagtgcagaacatacagcaaaaggatcacatctcaactgcaacagcagcctaatcccatatctgacaaacaacctgatgatactcgtagcgtgtatggaaagttggaaacacttctaacgggccgcgaagctacggcaacaaatcgaaacgagggagtatacctttcctccggccacaagcaacggctcgatcgagcgagcgagcgagacggcggcgtcggtgctgaccgaaggacaagagggcggagaagctcgtgtcccctgggcccggggctccgacgaggatggcgcggtcccgcagcgaactcgagggaggaggatgcgaggctagtattccggcgtctcccgtactcccagccgccgccgccgcccgcggctcgccggcgtagtgcgcgagcaaccgcactgtttgcgcacgagaagtcggcgacggtgggtgtttcggccggcggctggcggcttgggctgctttatattgggccgttagtgggtcgttatcttgggccgttttagattgggctcttacttctgagacctcttgttgctcgtgttcaagcccacctgttctccgctgcttgcaccaatgccaatttcagtctcagaaattcagaatccacacacaagtatgttgtcatgttcagattactgaaaatgcaggtgtgcaattagccactaagctttaaataaatactaaatttgatactggtattagttaattctttgcactcatgcagattagtattgtcggttacaattgtttgcactcatgcagatctggcgatctcctgctataccgggataccagttctctagtattgtcaagcttgatagctgcagcacatggctgcattcatcgatagatttttccgctagacgaacatgctcacattctagagacagatgccgcagccgtgattaactaactcagccgaccaaatcggcggccggtggcgtttgacataaaagaatctgcatattcattctagtcgctctcgagaaatgcccaggggttttccggctagctttacaaggtggtgggctagacgacctgggttcaaagcctcacccctcctaattatttgatattaggttcttccctaatattctagtttttattctagtcgctctctcacagtcacgtactgcttctcaaactacatgcaacgacattcacgaaccccaaccaagtcaatttggcttcactgcaaacgatggacgatacgattggatttcttgtcgactactactgcagacttcaacgttcaggttggagattctatccactaagagtgtgtttatttcacactaaaattagaaatttggttgaaattggaacaatgtgaaagaaaagttgaaagtttgaagaaaatatttagaactaaacaaggcgtaaatgatctgaagctagaagctggtctggataataatcttcagtcatgtcagtaacttctgcggttttggctacgaaaagcatttgcaacttgaggtgtgtttagtttacatcaaaattaaaattttggttgaattggaatgatgtgacgaaaaatttgaaagtttgtgtatagaaaaattttgatgtgatggaaaagttgaaagtttgaagaaaaattttacaactaaacacggcctaagctttaattcgtgcacaatataaagtactagtactatgtattagtacataaattttgaaaagaagggtgtgtttagttcacgttaaaattaaaagttttattaaaattaaaatgatgtgatggaaaaattagaagtttgtgtgtagaaaagttttgatgtaatggaaaagttaaaagtttgaagaaaaagttgggactaaaccaggccgaagtagtacataaattatccggtctctagaatgctttacatcagcatctcgtgatccttaatgtgcgtaaagagggtgtcattaattaacaggtcgttcagctgatcatgctgaccaatttgatcaatgatcaatcgatgatgatgatgaagatagtatgtcacctgctaagtgacaaggatggatggcactgctggcaggaggacacgtcgcatgctagcttttaacatcgagagccccactctacaaaaacacctcgagatttgtagattaatcagagcacagttagcgttcattaaattatttgcagtgcaatgcatctgatacacggttattgtaccgcctgttatgctcttcattgtccctggtaggccatggtgcggcaattcttttgttgcacgctttcatgtgtgtagatctatctgtttatctggagtatctcattggaatccctaaacaaaggtgtgatgcaggcaagtactaaaaatcacgagcataggttgtagacttgtagtagcacaaaatcgtagtggtataatataatttgatccatacataagagcaaacggcctttgtgttggtatatcagccgtagtctgcaaacactaacatgtggtcatggattcttccttccagattcagggggagtcaaatgcatcgtcagtaataagcaggacataggaaaacctggaaaatcttagtgcggacgtgcaaacggacgaaaaggatcgtgacagggcaacgggagatgatcagctatctagatactccaaccaccctgcatgcaggggagcttggaaacaagcctgcagcgaactaattctgcacaaataacaccaaaggaaagaacaccaaaggtcttgatctatagagttgatcacatcgacccagccaaataacaccaaaggaaaataatagtactacgcgagatgcatggattcagaaagggacaccaacccaaacccaatgattgatttcatcgtctcacagtccgatcgatcaatcgatccatgtagggatgaaccccacatggaactatcgaggacggtatggagtagcagcaaggccagtgccagcggctggcaagtcgatcgcaatgatttgctgctcgtacggccccgcccccctccatttgcattgcaccagacgaagatgagcattgaagtcgcgagatatggcgatcgatcgatccctctccttgcagcgcaggccaaccggtgtcaaacgtcccaatcgcacgagcccgagaggccccgccccagatgggacgctgcgccagtgcggtgcacccatccgcatccgttccgcccccaccaatcgatcgacccgacatattggcgagtgcacatattggccgggacagcggagcggaggggccccggtgcggaggaggaggagggaactaggggagcgaccgagcgaggaggcgttgtggcgcgcgacgccgacgcgcgcgcgcggccatgacggcattgaatgtgggacgggggagtgagctgtgatgagcgaggtgggccggcgcgcgcgagggggcgcgggtccccgaggcacgcaccggcgcatgcacgtgtccgcgcgttgcgccgtggggcgccacacgccaggtgctcccacaccgggtggcagggcccgcgccacaggtactggccctaaactaactttactctccgtgcaatgcaagatagatgtgctgccaatttgcacctgtatactactacctgtgtaatccaaacaagagtccaagacgcttggagcgagtttgaatttgttattggcctttgcgaatttgaatttatataaaaatatttagtccaaaaacgaaaatgacctatcaattcaagcatggcgcaagcgtggatctgaaatattttgaagtccggacaaacctcactataactagtactactatttaatataggaattctatttgaaaatttctaattatatgatattttaatggattatccctcgataagcccgggcatctgctcggggtggccggatggtaggattatcctacttcctcatataggagaatcatttacatctatggtagtattttctagtacatgtgagcaatttttacatgggatattttttatgttacatgtgatattttggtacataagagttactccatgtgctaatatagtaggagtatgtcggtcgtgaaaaaaaaaaggagttactccatctaagtagctaaaaaacggcattactgtttgcaagccacaggacgttggcactgacttttcaattttcactctccattcagttcaaaaaaattttcactctccataatgtactaccctgctgcacaagcaaaggaaatgaggccacagcaaatggttcgttaaacgagaaaatttaccctagaaagaaacaaataaacttattgaagtggcccagaacagtagtacgaaaaacaggcacagtacactatcttgtcctaactggccagattaccagaagaatcctgtagtccgctgctctccctagcttgttgaacacggtggttataccccttcaggacggacttcagaaccttgtatcgtaagctgatgctgcccaaagctcatggggggagtgaaaaatccaactcctactcgcgccactccgccactggcgcctggctagctgccgaacacagtatacaagaccacaccccctcccacccgtgcgggctctaccaatccacaccacaccaccctataaaaacgcccgcgatccacttgccacaccacggccaccaccaccaactcgatcgcacagcaaaaagcccatactgccaccgcgagcgccgggaagaacacaacagcttctcgagcaagccggaggtgcacgacgcagcaaatggcagcgggattccgccgacggctcaccgcgctcaccatccccaaggcatcgtcctacctccgccggacgaggcacaagaagttatcgtactcccgcgcccgctccgctagcctccccggccgcttccacccggtcgtcaccggcctgcacgagtcggcgagtgctctcctcgggtggactgatgaggcgccggcgcaggctggcacgcagtggatcggcgaaggggtcggccacctggcgcggctcttggcgggcttgacggagctgctccaccacccgcaggcgcaggacccgctccggccgccgcgcaaggcggcgccgtggacggagcggctgctcgacgacctcctcctcctcgccgacgcgcacgggtgcttccgcgaggcgctcctggcgctcaagcagctcctcgccgaggcccacgccgcgctccgccgccgcgacgcgacccgcctcgccgccgcgctgcgcgcgcgccgccgctcggaccgcgacctctcccgcctcgcctccacattgcgtgacctctcctaccgctcctcttccgccgcagcgacgtccgactccggcgaggccgcgctagccgaggccgtcggggccgccacgtgcgcggcggcggccgcgtccgcctccttcttcgcgggcctcgcgtccgcctccgcctcctctgcctcgcggtcgttggcgtccccgaccgcagcctctcccgcaaaggtagcggtcgcgccggtgtggtgggtggccgacctcctgcggtggcggcggcgcacggtgtcggtcgctgcctgcgagtccggcgcaggcgcaaaggagacgccattggacgaatgcatcgatgaggaagaggaggaaaggaaggcggccatggatcggctgctcaggctggaggagtgcgtcgtggcggcggaagacggctgcgagcaggtgtaccgggcgctcgtgaacgcgagggtgtcactgctcaacgtactgacgccgtgcttttgatcttctctggagggaaattcctggaagattagtgatcaggacaatgcggatttgtttgacatcattcttcttagtttttggtaggttgcgtacatgatgtatagggatcgtttcacaatggaatggaattgtgtttaggtgaaatattcagtaaaatttagttattagctttcaaatcaaatgtctacacaacctcactttcatggattacctccaaattcagaggttgctttcctgattcttaagcgacaagcagcaaccatataaacttatgttaattagaccttgatttggatgcgagttaatgtcaattgctaaaataccaaatggtatctggattcagctgcaattttattcccgtctcatttttcagctatacgcagccatgcagggtttggctctgaactgaaagataaccgttaagctgagcatgtgaggcctctgctttttattcacatgcatttttcaatcgcaaagatgaatctttgttaaatcgcgtaagccgttcggtcggtttggcatcacatggaattgggtcaaggagttaatgtatcacgttggaatcgaacttaccaaattgtctttctatttaagctggcgtttaggtcctttgatgcaggctttgcggctgcattctatagttatgtcttttcagttatttttagcacttaatactaatatactgaaaggagcattgaacatttaactatgacattgtctcagtgcttaaagtagtagcagagtataatgtactagcttcggtttgcaaagaagaaacacaaatgcaggcaccgttcactgttcggaaacgcagaatcagttcctctttcatcttgttagatctttcagataagttgggtggttgtgaaggttaatgcacctaaagccagaatcaagatcgtcagtcaagagaagctgcacttttaagccggatctttactttgcaaccaaaccaatacagtgtacatgccccagctttagcgtgctcatcaaacctgtgcaacctataatttatctagctagaaggtcgcgatctaaactagaatcggaagcatgcacggatccgtataatttggcgcatctgaacactgaacttgcgtcggctctgtactgaaaatctgaaacccaacatctctaaagaactagtcatggttggtcactagttgtgttatcagaacttagaactagtacaattatttattttggtgactaattctccaatcattttgcaccacttagggtcgaaatggacaagctaacggatcggttgtgttgtccttcttcccaaagaaacaacaatgtcatcgctcgtttctgtcgtcgtgcatggaagcttggtgctactttcgttttcggtactattgggccccagcaagatgggcctggaagccccacttattggagcccactacgatccaatgaaccatcacgagatgcagggagattttctgcacgttgttagcgttagttcgaggacgtgacacggtgatcatttgggagttagtaggacggacaccggtgcctatctaatcggatcactcttaattttcgatgtgatcgttcaggcaaacaggacagctaaagatcggaaacgtatttcttatgtgattcgtactcaaccgtgtaagggggtaaagttttaacgtgttacatcagatatacagacacatattcgaaggattaaacgtagtctaataacaaaacaaattacagaatccgcttgtaaaccgcgagaagaatttgttaagccgaattaatccatcattagcaatgtttactgtagcactacattgtcaaatcatgattcaattagttttaaaagattcgtctcgcaatttacacgcaatctgtataactagttatttttttcgtctatatttaatacttcatacatgtatccaaacattcgatatgacatggtgtaaaattttatcaggggatctaaaaaaggcctaattcaactaactctcattttttttaattagcatattttaaaactactaaacggtatatttcgtgtaaaaaaatttctatataaaaggtacttaaaaattaaataatatattttttttaattagcatattttaaaactactaaacggtatatttcgtgtaaaaaaatttctatataaaaggtacttaaaaattaaataatatatttgtcaaaattttaataattaatagtcatttaattatatactaaccacttttttcgtttgtgagccgctaatcagcccaaattcatgtaccacaaagaacacattataattatttttttcattggtaggcaaggtatcaatcaagagtaaatcaattgtggtggctttatcaatttcaatatatcggttcggacatactcataaagataaggatgagcgcacgtgttgtgaacgtttgtatttgtgccaatggtatttttttaaaaaaggagaagaacacgccctttgctgctttgcataacttcgtgcagttttgagctaccaagaaaaggcccatgggctaaacctaccttgttagccgaagaggaacggaacccagaggtgacggcccacgaaacagaggagccagctgggacgacgccgatgatagtacaggtacagcacgatgtccgcagccgcaaggctggcggtacacagcacagctcagcgccaccgaggcaggggtcgtgtcgcgccgtccgactagcgctggcactgccagtctgccaccgcagcaggtacggcgcctcgtccggccatctggccaagttccccaccaccacccgtcttcacctgcacgctgcacgtacggccgcggcgtctctctctctcgcgcgcgcgccgtctcgtgtaaacctgataaacccacgagaccgagctccaaccgcgctccggccttgcggcgtgcgtgtctcgtcgtggcgtggcgatgccgccgggggcggggggcaagtacgcggtgcatacggccgcaaaaacccggggggggggggggggggaacgcatgctgcgtgagcgaccgcgcggcgcggcgcgtcacgtcgctctcgccgtctcgcggaaacgtgtccaaccaaacgcacccaggggagggggaggggcacgcaatgatcgaaagcgcaaagcggcagcgaatcccgcgtgggatgagcacctggagccgcaactttttcgccttatttcttccggccaatggagtagtactgtactactactattgtgcggcaggtgaagcatccatatgctaatctgtacttcgatgcatccgtgcgtgtgcgatcgatcgatggttcggttcatgtcgttatcatgataaccggattattcccctcttttctgctttaataatgattaacttgaattggtgctaaatgctaatcccgtgctcttccggtgtgtacgtatatgtatgtacgtagctagtaatgatttgggcatatgctttaataaggttttcgtgggaaaagaagaaaaaatggtatcgcaaatttcccaacttgtcttttgcacgggaatagtaatcgcgatggcgatggagaattggggatgctggtgtataaacattgcacatttttatactgataatgaccctatgagagtgacagcagctagccattatactattatctactagcactatccaacgatttcgttggcagttaacgcgatgtaatcttctgccacatcaggttattttatcctggtaagctgtcagtgcacgtgaggaggattatcttaactatgagttcgagaaaaatcttttgatggctctaaggcaggagaggagagctagacaatgcactggcgccgcagacgatgaattgataaacgaattacagtggcaccagcacagtagcacgtcataagtcatgtacttttagcagtaacaaaagctacatgtccccgttaagcagcagtaaattgtttggaactggctgagtgattagtaaacgacacggtgtcgtcgttgcccgggtgcgtgccagatcagccacaaaaaaaatggacagggtaagttgccaacttggccactttattgtcctctcttgctgttgtactggaaatgaaaaaataattatcaaatattaattaagggcaaattaaggatcaacagatatttggctcggctactcgtctgcctctgggcaaaaagcaggagcttttctttctcctttcattgttcgaaatgggaacggaagctaacagcatgcaactggataattccatcaaactgacgagtgatgactgatgactaacgactgagctgatcaggtcaagtgatgtcttgcgaggcagcgagggatctgaagaattctgatattctgttgactctgcattgagcactacattcaataattgctaaagtattctttgtataaacacaatgctagcctggatttctgaagaatgaagtctggataaaaaggaaaaaaatacgaccgagttgctccaatgagttaacactacttgaacccttggccaaaactgatttacatgtgattgaaccctcggccaaaacgagagctaatttattggagcatgcatttgcttggactaattcttactgtctgaaactctgactgtttcaccatattcattttctgtcagcactatatccagtagacactgtgcttgagtaattgagttcaagttcaactactttaataggaggtggagacagcgaatgactagtagtaagaaatacctaaacattggatttacccgttccaatttaggaggatactccaattttgagctgccacttgctacggcaaaagtcttctaccatgaattaatctacgggattgcttttccccgaaaaaggtctacgggatggcactgtttctgctgcttttcggctgccaagtgccaacacgtcgtaatcagttactgtagtgttacactaacaacagtttcataggactaaaacatcatcttcatccgtggaaatagtttcacgagaaaacgaatgtatgtttggatatggattatgagaggcaagactgaaaaatataaattaataggagattaagacgaaacggtacgtaggaagaatggatggtcaattggttgacatctacgattagaacttaattagattctaaaaggtgaaactttaaggttatttacttcgttgctacttttaaccatatcgaattaccttttcttgtcattattatcttatcaaagtttgacaattataaaatttccaattttataagctctatcataatcttggtaaatctttaaaccaaatacatccaacaccatcaaaattgaaaagtcatgtagcctagtggttgcagtaacctgagtagctacataggagtgaattttagattgggttatttgagcgctaatttctaacttaaaaaaggttgtatatatccggttggatttagaggccggataaaaatatcattctctaaaaaaaattaaagaaaatcaaaatttggcaacatcaaaacatactaaaatctgacattatcaagctttaatagggttaaaggtggcaacgaagtaaatgcacactaatttttccatcccatttagtcaaacatgttttgtgttcaaattactcgtaacaaatacttctcgtttttgggtagaaatacccttctctaaaaaaataaaaatcaaaatcaaaatttggcatcatcaaaacatactaaaatctgacattatcaagatttaatagggttaaaggtgacaacaaagtaaatgcacactaaattcttcatcccatttagtcaaacgtgtttcgtgttcaaattgctcgtaacaacttctcatttttcgttagtatactacccgaattgtcacgcgacatgttttatgtaaaaataatttctatacaaagagtgttttaaacgattataatatatatatatatatatatatatatatatatatatataattttataatagttaatacttaattaataatatactaatgagtattctcgtttctaatctaccatcccaaactcacagatcaaccagcccttagggccacggtatcatcggcgaaaattaacatcggtgccctggtgggcactgatcaggaaatttagctttcgtgcctccaggtgcccgtgtgtcatgagactcgttgccgcggcgtggcagcgacatggtcgccgaattcacgggagcacggcgattttggcttcggatgcacgtcgacggtagcgacgcgcgtaaaccgcgcagggggtttcgcgtgactgtggctccgtacgtcgccacgacggacggatttattgtcctttcttttccctttcgaactcatcaaaaaaacaacaacaaccaaaaaaaaaaaaacgagagcacgagttaaaccgttgactcatggaccaaaatactagaggaacagagcaagtgtgggccaaagcatgacgtaacatcagaaattactccaaaccgttcgttttcagttttcactagtcgtttccgtatgctctgcttacaggttgatgccctcgaccatttcttatcaaaatttgacagagaaataaagtttgagctatggagcccatgactaataaccgaatcaagaaacgtaaaatagtttaggatgagacttttatatatgtgttattattggtttaaaaataatatagaaaatagacctgacgaaaaaactaaaataaaatccaaagttaggcctccaatttaaaattttgttgtctttagctaatatgtgggacaacctttctctagaaaaaaaaggtgaataacatactaaaaataattagaattggttgaaagaaaggaaacacataggtaaagggttatcatttcacatcatgtcctctccttctccaacactatgttttgaaaggcacatcaaagagaatcttagaacaccatcaaagcatctcaagcaatttatgtgtgtgttttctctgatttcagcttcaactaaactgttcaatatgaatcattgtaaggctcacacaaaacaattatgtcatatggttccatttattttcctatcattaaagcgttttgcgagttggatgaatgtttctatcgttgaattgaatatatggaacattttagaggagtttacctatgtatagttagtgttgtcgtggtgtaatttcaacgtgagagaaacaatgatttcaaagatatttaatacgaccaaacaaaaaatagacatccgagtaatcattgtagtatttcctttttttctgtgtgttgggaacgtactcatgggtgtgtgaatatagtgttatatatgtcggtgtagctacgcgtatgtctactgtataattgcaagaaaaaaattttaggatttcaacgaaaatttagtgagatcagatatgtatcattggttttcatttgtttggtgtgtcagaggcatactcgcgaggagagctgctaaacatacggtattatgtttactattgttttatgataaatgttctctcttagtgtttgttgacggttgcaagtttcggtcccacgctaaactacataagcagatggtccggcgttggatcgtactaagatcgtaataaaacatcgtatgtgcagtattttccacttgtgagtgtgaatgtagtgttatgttgtagtggtgcggactgcggaggaaataaaatttgttccaaaacgatgatgacgacatctccatttttgcttatcccctcgctagatttgccgagatgtgaacaggagacaaacaacatatcaccgtgcccacggcctagcctcaggccgtaccctgcactgcacacgcgcacgcacgcgcacacagcggcgtactccgtaggcgtaccgcggcagcgaaaaccgagacgaaacccaaacccccccattcgagcgagcaggtgtttgtacaaaggccgccgcgtcgaaagcaaccactcctcctactcgacctcgcgctcgctcgctcgccctacaggccaccgccgcaccagggggggcagcgagcgagcccgcgaggtagtcggcgacgaccaggagggggactgggatgggttgctgcgggtcgtcgctgcaggccgggacccacccggagaagccgccggggatggcggcgccgccgcagcgcccgtccttctccctgaaccagcaccaggcgccggggtcggcggcggcgcagggcgtggggagaggggaggtcccggcgttcgcggagttctcgctggcggagctccgtgccgccacgggcgggttcgccgcggagaacatcgtgtccgagagcggcgagaaggccccgaatttcgtgtacaggggccgcctccagcgcacccgccgcgcgatcgccgtcaagaagttccccaagatggcgtggcccgatcccaagcagttcgaggtacgccccgattcgggaagagcttgttgtgcctggagaattcgtctttgctgtcatcagtccgatagattaaggttatttgctttggttcgcaggaggaggccaagggggtggggaagctgcgccaccgccgcttggcgaacctcatcggctactgctgcgatggggacgagcggcttctcgtcgccgagttcatgcccaacgacaccctagccaagcacgtcttccattgtgagttattggaatatctttcttttgataagttcctttctgaatttctgatcaccaggagactttttttttccatatccgataaacactggtcgcaaaaagattggatttttctgccttgtagttcctgattagtgtggaagttggcaaaagaggacatattggtctgctttgagcaactgctggctcctaccggcttcctgcatttggtgtaccgaacgaatgattgggactgccctttgtcatatcttgttcttattcggttattgttggcaatgatcttgagtcagtcgaactgattatggcacaagcttccttaacacactcgatggaatgttggtgttgttatgagtctgtcagcagctatatgtgtacacaaatggatgccttaaactgattcagggtctccaatgtggaaatgtcttgttattacagtgaccaatgcagttggtaacttttttatgcatttaaggttacgggagattgtagttcacttgagaacttaggcttctttatatgttgtcttcatgtttgatgaacaacctgacaatagggtacactggcagtggtgaagggtgagctgtcgactgtattggtaatagttgtcgcaagtactgaattctgtaaaacctcaacaataatgcactgtattacttctttttgtgatcttaattgcattcaccattcatgcaagtttgaatttgcgcaaactagatgtgtgttattaaatttgcagttcatttatcatgattatttttttttacacatttgcaggggaaaaccagactatcgaatgggctatgcgtttaagagttgcacaccacattgctgaagcacttgactactgcagtagcaatgaacggcctttatatcatgacttaaatgcatatagggtcctttttgatgaggtaagcaaccaattcttttgtggtgtttgtatgttttattctgtaggattgtctcatgtggtagaggaagtgaggatagtatatttatctctacaaatacctccctgcaagaagtagtgtgcaatctacggaatggcactgatttaatttagtttgtgctcttatcctggatgcttcctctgtttgttgatttgcatgcttatattggaagtggaaattgttggcatctctagtacctggaagaaagcacatggcagaaatgaaaatgtcaactctttaccaattgtgctgattggagaaatgattaggaatctcatcaaagaataaatcgctttcccatgatgttgttcacatgaacctctccttcacatggttatccagatgttatccgtttatctaaatcgttaatgtatttatatttgcagaatggtgatcctcgtctttcatgctttggcctgatgaaaaacagcagggatggcaaaagttatagcacaaaccttgcatatacacctccagagtatttgagaaatggtacatatgccttttaccctgagactaaaaactattcttttcctctgagatatgaactgctatttattaaagagaaaatccaagaaatgatattgacaagcgcccaattccaagaaatgttatcaacaagtacgagttccatgaaataatatcgtacaagcaactttgtcctagaaatgccatcgccgttagggttccgttagcatccctcctttaggtgctatatgatgaacaatgtatttaacgacacgggatggatagaaccctaacggcaatggcatttctcggacaaaatcgcttgtacgatggtattttatggaacttgcactcgtcaatggcatttattggatttggatgtttgtcaatgacatttcttagattttctctttattaaatggataaatacacattgctctttttttttctgtatgcatgtaattcttgctttatgcctaaattttttatttgaattgcctactctgggcattcataggaatattatagatgttaaccatcgtccattgatgacagaactgtaccttccactctaatggcatgacacatcatatgcacaaactggacctataatcaaaataaggcataataatcatgttctttttccctgccagataaataaataattcatcttgtttgcctactgagtgcttttgtaagcattgatatgtgctttttaaggtgattacgaagaaatgtcaagctcatagttagccagctaaaacatatgggtgactaacacaaaggcagccttaggataacaaatataagaggaaaccattctaaatgtaaggtttttttttttttacatttcttcatggtatattctcctttttcaggtagagttactccagaaagtgtcatattcagctttggtactgttctcctcgaccttctaagtggaaagcgcatacctccttcccatgtaagtttattttgctagtaaagtatgccttttcttgttcctctttatcctagctccaatgcagcataagaagtccgaaatccgtactgaaaataccttggccaggtggcatacaatgctattctgcttctgcatatatatttcttttgcatcgtgctgatgcaacactcctgtgcaactacagtagaacagagttttacttatatagacatgaacattaagaggttgactgctgcttgaattcatagtatggctaacactcttagctgctccaaatattattttacttctaaatgtaacttggtagcataatcacatcgtaagtggtaacaatgcttaaaacaattaaaacatgtgctttcttattgacaattagctttgtttcactcaggctctcgatatgataagaggcaaaaacattcaagtgctcttggactcacatttggaaggaaaatactctacagaagaggcaactgctttggtagatcttgcttctcagtgtttacagtatgaacctagggaccgtcccaatacaggaaagctggtctccatacttgatcctttgcaaacaaaactagaggtaaccattgtgtttttatccttacttttctaaatcttttttctgtctttgatggtttaagccttctttactaatttatggctgccatattttgactgacctaattttattttaaaatacaaacaggtgccttcctatgagatgcttggcattccaaagcatgaagaagaagcacctcctgctcctgctcctgctccagctccacaaccacaacaccctctatcccccatgggtgaagcctgttctaggatggacatgacagcaatccatcagattctagttgccacacattacagagatgatgaagggactaatgaggtaaatattggagcactttgatttctgtcatatggcagatcgttgtctaagaaatctatctcttcatcaatctccctgttgcagctatcgttccaggaatggactcagcagatgagggatatgttagatgctaggaaacgtggagactttgcgtttcgtgataaagattttaagacagccatagagtgttacacacaggttggaacgtcaaatatcaggaaccttctggtgttacaaaaaaatcgttagattgaagttatctcactcctttacctcctctttgggttgcagtttgttgatgtgggaacaatggtatcaccaacggtatacgctagacggagcttatgccacctcatgtctgaccaacctgatgctgccctccgggatgcaatgcaagcgcagtgcgtataccctgattggccaaccgcattctatatgcaagctgttgcgctctcaaagttaaatatgcagagtgatgctatggacatgttgaatgaagcttcgcagctagaagagaagagacaagagcgtctctggtctaaagatgcgtctgctcagtctcctttgcggctcaaaggtttatgttgagacgtgctgctcttccttcagaaaattgtgatacattccaggttaaagagttgggtgtaatggggggaaggtgctgcagaatccttttttttttctctttcggaccagatgttgtagatcctgtgattgtaactatttggtttgccatttctattatgcattttttggggggcacatgtatatgtaacattaattgaaaaagagagagagagaaacaggcaccatgcaagggaatttgtggtggttaacactagagttcggttgttgtgaataaggtgcacagttgatcttgtagctgaagctatttaaccaacaaaccattgcttgtgctgaggaggcgagccggcaaggacatactaagcatcaccacaaggggtgtgattagtttacgccaatttacaaggggtgtgtttagtttacgccaaaattggaagttttattgaaattggaacaagatgtgacagaaaagttggaagtttgtgtgtgtagaaaagttttgatgtgatgaaaaagttaaaagttcaaagaaaaagttgggaactaaaccagacaaagaaagaattatgtactcttatctggaaaagaaggtagcccagcgaaatcttaaaaaggagggagttcttcaaaaggaagaactgcaaaataacccctacccttaggccttggttagatttcaactttttttctttaaaatttcaacttttccgtcacatcaaacttttatgtacacataaacttccaattttttatcatattgttttaatttcttcaaacttctaatttttacgtggaaaacgcaggcttagtactatatatctgacatgcggcaggcgcgagctcgatctgtttccatgttccaccacgattaaccttccagacacatggaagagacgagcacctcgtgtcgccagtagtagacaggatggatggtgatcaccggtctcatttgtttcgtttatgtttacgattatacgaaccacttattaatatttttttagaaaaatatgagaaacttttatacgtgtaccaagctatttctagatccgtccatgcgtgcacgcacatcctgattatcggtttaagtcttgctttcaggcactgctactatagctgttttgactatcagggcatctgtatatggaccaaatagtccatataggtgggacccatataagtggtcttttattatttctattttcacaatgtatatagatagcaattgacattaagatgggacccacactctaaaaaaaaattacttccaaatgctatagttctctcatgaaagaagcaaaaagagagatagtatattttaatctatatgggtggtctttatagctatcggtagcttatcatatggctcttcctaatgccacctcccacaatggtaaaggtacccatatagagttataaggactgttttttggccacattgtggatgccctcatggtagtacatttcttcaataatttatgctcggttatacaaacttttgtaaccccagatcgaatacaggagaggcgacctcaaatccttttttttacttaaaaaggtagaaaggctttaccttataaccattttactaatggtgaatcaaagattaaaaaagggtgaatagctaatttagtccctcaagtttcagcgaaggctcaatttggtccttcacgtttcattttatccacatagatccttcaaatatttgttttgtcttgaaatcatccttgggtccacttaatatgccatatggctatttctagtcaatatttctattagaaaatgtcatttttgcccttaatttgtatacatctatatactagaaaagagaaagccaacataaataaacaacattacagatctacttcccattatttcgacatgtgcacatgaaacttaagcaattgctatcgtatacacttgctagtacataattttttttcgttttacataatatactatgtattatctataaaaaattcaagcatgcaatttctctcttatatatgtgaatgatgaggggtataagtgtcatttatgaagagagttgttggttcaaggataagtttgaactaaaatgaaaacttgaaggattaatatggatagattgaaacatcaaggactaaactgagtctcagatgaaacttggaggaccactttagctattcacccattaaaaaaacaaaagtaggagaacacagggagaacagtagaggggtaaaaaattaagggcagagaaacaaacagagcaacagaaggaaaaggtagaaagatagaaaagaagaaaaaaaaagacaaaggggctgggaaacagccctaaaattaactcagcttgttcatccattgatggataagatcgcgactgttgtttgcgacacggtgcttccaaagactgaggtcttctttgatgtggtgtataagctgtgaaagccgtataaactttcattccggaatgttagttgcacgattccgagccttccaaagggtgtgcacgcacgcggcaaagcaaattggccagccaggttgcagctggttcggggctgtatcgtcatgacagtctcgacgacctcaagtcttcagtcttctcactgctttggtcttcggcattggcagtgtcccggtctagttcctgaaaaaagttataagttaggggaaagttgtaagttcagaaaaaaaaagttaaaagtttatatgtgtaggaaagtttttgatgtgatatgatataatggaaagttaaaaatttagggtagttaagggttaactaaacacggcccaagctgccgcgtgcatacgccatgctatgctccaaatgctcgcggtcgctgttgcactgaatgtgccgtccttgacgggctcatctagctcgtacggttgcatgtacatcgtttgagttcaatcggacggagtgatcgagccgaccatctcgcgcgatactgtcgtatataaagccgtgccgtgcgctctgcagtctgcagtctgcacacacgatcgagaaacacaattgacagtacagaatttgtaagttgttgatttgcgccatgagaaggcttctcccgctcgccggcgccacgctgctgatcgcggcggccggcggcgccagcgggcagcaggcgggtgttgggtcgatcatcacgcgggcgatgttcgagtcgatgctgagccaccgtggggaccaaggttgccagggcgccttctacacctacgacgcgttcatcaaggccgccggagatttccctagattcggcacgaccggcaacgacgaaacgcgccggcgcgagctcgccgctttctttggccagacctcccacgaaactacaggtagtactcactactcacaagctagtcacaaccttcacagttcagatcacttaatttcttctgtttttatttgcaaattaaacggattactccatacaaaaggtggatgggcaactgctcctgatggaccctttgcttggggatactgccgggtgaacgagatcacgccgtcggacccgccctactacggccgaggacccatacagcttactcagtacgttcataaaaaaaaaccgcacacaaacagttctaagttattgcaacacatatcgtctcatgcaatgaaatctattactactaatctacaaataatcaatggatccaccaaaataaatctgatatgatgcatgctctcgtatgtattatgcagtaagtacaactaccagctagccggggacgcgttgggtctggacctggtgaacaaccccgacctggtgtcaagcgaccccgtggtggcgttcaggacggccatctggttctggatgacggcgcagtcacccaagccgtcgtgccacgacgtaatcaccaaccagtggacgccgtccggcgatgaccgtagctccgggaggctccccggctacggcatggccaccaacatcatcaacggcggtgaagagtgcggcaagggctactccaccgacaacgccaaggaccgggtcggctactacaagaggtactgcgacatgttccgcgtaggatacggagataacatagcctgcagggaccagaagccctacggaggaggttaagcactggagacgatcgactgggagtacgtcgtcataagcggattctcctagtgctagtacagctgctggttgcttgctaatggctagcttagccttcgcgtacatacgtatatgtacgtgatactagtacgaataaagctagcagagagcgttcgcggatatcatgtaacagatatgagtatatgacacatggtcgcttatctcacatgttattgtgaaataatattattactggtggaacgatgcccctagttaaactgatcgtgtgaccggtatctgtgttaattttcttcaattgctttcgcatctcagctcccacggcgataagcgatcatgagctagcgctgtctctgccgcgcgctgcactcgccgtacgtacaagcccaacgccaaagttgccgcttggcgccgcgcacctaactggatctatctcccccaaccaccgaaacaggaggcgagagtcgcgaagactggatcgggggagcatatcgatcagtcttctgctagtgctacatcaaacatattttacttgcaagtgtctttgacaaactcaaactcgtacagcgctccgaaggttgtcaaaagcgaatattgtttgcgcagaaattttggcccattgggtgagtagtgtcccctgcgggctgtggtccgaatcagccaccagtttgtttagcgggcttctccgcgcacaaaatttggcccatacatctttcttgtattgctgggttcctaggatctgttgtttcgatctgttataatcggtgcacaaaaaattggcggcgcaaacatgaatataaagttcttgaatcatagtcttataagagattctagcattgtcaagtcagaaagcatcatattatcttgagagaagaccaaaagattgattgatatctcggtgctactactatatgtacaatcgaatccacagctagccattctacgctacttgttcttcgtcgacgggtgatttgatctcttgctcttgcacatgcatctggagatcgtgatcgactcctcttgcttcgatgcacaatgtaattctctgccccttgcttagtagtagagcagatgggcgtagggagacaggcagtgctggtcctgccacgggctgcgcagctgcgtcaggaacgggtcctgcagccagtccatcgccggaagctgcaggctcggcagctggctcaccgccgggagctgtaggctcgtcgccgacgccaccgtgaccgtgacgtctgcttcttccttcttggcttcccttggtgcgccagcgccgccgttcttgctgctgctgccggacggcgccgccgacgaggatgaggactggatcaggaagccgctgtcgtggacgtcgtccgacgagaagtagtcgtcgccggtggaggcggaggcgtcgtggacgagggatgctctcgtcgccgtgtagtctccgtgacttgatcctctctgcatctcttccattgccgaggctctctgctccagctccttcagtggcgtcgccttccggtatatcttgcagagcaccatgtcctcctgccgccaaacacagtgtgagaaaaatccaagttaaaattgtactactagtggagtatttgttctctggagtaaatttacatgtacaatggtaaaaatcaaggcagtcaactcccaagtcaaccgtgtcaattcttaattcttaatgcttggtgcgctttcgtggaatatctacatcattgatactgcaagtctactgggacaacgactacattgcaccccattttcacaccaaaaacaaccaaattaatgagagcattcactgccaatgtactaatactctaatactagtactacatatgacatgatcattgttcgttcaaaaaagaaataaatgacatgatcattctcacttcattccgatcattttttttgtgaccattttaagaattcagtagtactaatattttgcgatcacttaaaggattcgttctaataattaactctgcaactgattgttcttgttaattgctaagagagcattagtttaaccttgggaggcggcgcggcggcgcgggcggcgccgtagtcggggaggcggtactcgttcatgacccagtccgtcttggtgccgcgcggggcgcgaccctggtagaagacgagcgtcttcttgagcccgatcacccgcttcgggtcgccggagctccggatcgccctgtccgaccccgtcgccttccagaacccgcgctccgtcgtccggttcggccgcccgccgttcccggccttcctgtcccgcggcacgaagaagtaccactccctctccccgatcttcgccatgcctgcacatttttacaagaaacacacacatcatcatcatcagatcatccagctcaaacactgtctccgttcttgctgaactctcactgtgtgttggtgtttacctgggaggtcccagggatcatggcggtagatgttgagggtgccgatgatgttgaagtggagcttcttgcctaggacgacgcgggagaggtagaagtcgaggagctcctcctccgtggggtggaaacggaagcccgggaggtcctgctccacctccatggacggcccagccacagccactgccgccgccattgatgacagtgtgctctgctcgctcgctcgctcgctctgctccaggtggtggtggtggttgcctctgcacttggcttgccgatcttgatttttactggagacgatggacgaggtgaggtggagatggttgtggatgtggaggcaacgagcttatatagaaaagaaaggcattgcattgcttgaatactttaacgcggtttcatggagaaaaccggtcgcaatttcttagcactggtgacaacgaccagtgcagtctccagtgcttggcttcagtagtagtaaaaaataatctgggcggcttaacagtaaaatttatttaactgtatttaatttggagggttttgcttatttgtgagtgtgcattaggagacttgtcaggtcacacaaattgactcatttttcactcacctgaaacatatggcattatggcctattcattcccttttgctgtgccgaatatttatgagtaactctccaatttggctgctggggtgagagttattccacagttttaaatttgaaaacgatatctgttttacataattttttttacaaataatctgttttactcaataattgaagtgcaatcatttctgcaggcattctctcggtttatttattggtcttcatgttttactacttgattaagatcgtttagaattttcgtgattcgcataagaaattaagtgttccttacgaagttcatgtcgtccgagaatgtaactttctcaacaggtggaggtaattagccatgatatcgtctaaatgagtaatttaatttgtgattttttttgcataacttgtcattaattactactacctccatattaaaatataagagattttgtccacgtagataaatagtctacatgtaatcaatggtgtgtgaacgttgcataattgtattgtgtttgtatcagtggggattttttttagaaaactcataaaggatctaccatgcaaaatttcaacaagctggatatctacatacttaattagactttctgctgtaattccacaataaacttcagccttgtcatcggatcatataattaaatgataccatgttaactaaaccaatatgtaacactgcatggtcttattaattaggcgattatatattgttgagcctctcgaaactgtgaccggactagatcatatacgatgtccacatcaatggaatattggacttggtataagcttgtcggatagagattgcgaccaattccaaaattaaagatgtcattgtcatgtactacattcttttctgtttctcttcgagataccgcgctaacctatagttataaagttgaatgatagtaatatgaaaccctaatttattccttcttaagaaaaggaagaagagagagtaacgtctggttaatcttgctgtattattccgggaaaggcggccacatctcattttacttgcacacttttgtttgctgaagggttggcgcagcatgatcttcgtctgactaatctgttaagaaaaacagcttattgttaaagattttaaacatgtttttggacttaaagttgccgaggatcttcgatacacttacaaaggatcatggagcattgcagatcaatatagaagtaggacaagtgtaattaccatcagattaccattttcatgcgtgcatagtagtacttgtggtctaattaattgcctcttttttaaggtagcatcacggcagtcctaccttttaaacatgtggtatgtgacatctagaatacttttcttttcaatgggcagaaaaacgactggagagattatctgttgatcaggcatccccaatgtgaatttgaactaagcaatttaatgatgaacaggcagaacagaaactgttggtcagttccacgttttaccgatgacttgatggtctcccaacatctatctggaaagcaaaacaggtaatgaggtttccattttatccctgcttttaccttccctttcactttcttacgggagactggagttaagtcagaacgaaaaattacttcaatttcaggtaagagactagaattactgtaccatgaaaggtgcgataacagaaagaagagtcacaagccacagtgtcgtggcttcgacaccatgtcacccttgcgtttggtccatttgagaggattgcaacaatcagatcttcaatcagcaaaggattggaaatcccggaccaatgatcgttagcaggttctcataggttgttcatattctctaataaaccaaaacggcttcttagagataaaaattaatttataggtaaaatttttatatgtatgttagcgtcttcagagttaatgctgaaaaagaaactacgttgaaaatgtcttaacatcaactttaaaattaagtttgaaaattaaaagtttggctttggctatgacttattagggcaccaatggggctcttagccggtgattaggggcctgtttagtttccaaacaaaatttttcatgctgtcacgtcgaatgtttggacacatgcatagagtattaaacgtagacgaaaaaaaaccaattacacagttcgccaggaaattgcgaaacgaatcttttaagccttattgtgccatgatttgacaatgtggtgctatagtaaacatttgctaatgacggattaattaggcttaataaatttgtcccgcaattttctggcggaatctataatttattttgttattagactatgtttaatacttcaaatgtgtgtctgtatatccgatgtgacaggtaagggcaaaaatttttttccaactaacgccgcgtttagttctgaagtttttcttcaaacttccaactttttcatcacatcaaaacttccgtcttttacgtcacatcgtttcaatttaaaccaaacttttaattttgatatgaactaaacaaaggctaaacaagccctaggttttggaggtcagccatcaagctcgtttgagaactccagtgaggcagcgactagtagacatgaaatttttcagccttttcgaccttagctagctaactataggtgtgtggctgcctgtcgcgttttggtcatcttgaccgactttgaacaaagactgcatgcatattcatcatgaaaaggactagtgtgacgaacctaacgaattcctagtggaccaaccaaaggccccatcgtttgtcttttttcttgacaagccaaaacagcttattagagaataaaaataaatttataggtaaaaattttatatatgtgttcttggtgacttaaaagccaatgctgtaaaagaaactacgttgaaaatatctcaaaattaatctcaaaattaagtttgaaaatttaaattttgacttttttttagctgtttaggtcatccgtgggagcaaaagagcttatatagtttctcactgtttgacagcgacattacacgcattgggtgggtcgtgacaaaaatatttgaacaaaactcggttcctactagttatgtgtacaaacaccgatcacaactgacaggacagaaaggatgaaataatttcctcatgaaacggtcagagttcctgaatttcagcaagaattcagacgggataaggcgatcggagttttcctagctacttcctaaagttataacaggcaaagcgcatgaaggtttatggtgtataaacaacatgtaagttaggcaaatgcctgggaagtcatgcatatgagaatatgattctagtagctcttgtgcttaacttggtaaggaaaaatgtgtctaatgcatgcctgtgtgaatgtcctgaacagatataaacagaagactgcatgctgattggttccatatatagctctcacaaaaaaaaatataatcactaatgtaaagagaatatgaaagcatgcgtagtattagacgtagtttctagagtataatcaacgggagacggattttttttcctgaggacatattcccttttttaatgtcatttaaaaattcttcaaaaaaattaaaatcttttgatacgataaatcaatatgtgatgttcattccacaaacatgcaaattcaaatttgatttatataattagaaacgaaaataataattttgactatgaattgtacgttctattaatagttaaatttatttaatttttctacttgtattaagttaaatttaatcctacatgtttgtttagtgacatattacatattgatctatcttactattttttaaatttttagtgatattttaagcgacatgaaaaaggagagaacatcctttcaagagataaatagactttccttagcttgttagtacagttcagtagtgccaaccacaggaccacttatacatatgcatatctaaactgtttattactaactaaataaaatcatttatagtaaaacttttatatatgtgttcgtagtgattgaaaagtaatcgataaaaaatccacaaaatcaactttaaaattagggtaaaatatgtaaaatttgattcacgttgataataattacctgaaggtataaaaattaatatagaatttagatatcttaagatactttctcaatgatttaaaatttctcttagaactaaattttaaatttaaagtttggtttataagcataaaataagcgaaacgataggctgcctgtcataacgaagtacgttgatgcattttctgtggtttggctaagaaaaataacgtgcttagttaggcatcacgcggccttttcttttcctgttgaaactagtagtgaatttgaaggttgcattacactgacagacagtcaagtaccgtaccactctttctcgttctttccttgaccggttcaaatgtactgtgccggtacaaacaaacaaacgaacaaagtatgaattccaagcctctaggttctaactactcatccatcacataaaaaaacaataacttgaattccaaatccatgaccatgaagatatcctttcatgcattcacacatttcaggacctcctttggaataggggaattgttagaggattatacaattccaactaattaacggcatggtacgctgtcaattgttcggtactactccatgtccatgtccatgtccatgtccagcagaaattaagtcatgtcagtttcagtgctctttgttagactactgtattttgtaagcactcaacactaaccacaagagtagcagagaccttggtggtggactactccgcgtgaaagtcagtaggccggccgttagtgtacaagagatttgcttgattttcctctgcatgtccggttgtccaccctctgaaatggggaacagagacagtagccatagacgtctcgtcaacgcagaggcgaggcgaccattcaagtcgagtcgtccaccgaggagaccacacacctcatctccctgatcaattggctgagcagttcgctatagccagtgcttgttccattttaaaatataagagattttaaacgtggatataacatattataatatttttatttaaattcgtaatattaaaatatatcttatttatttaaaattatttatattttggacggagggagagctaggtttgcggaaattttcaatagcctcatgggcagacaagttaaagcaagttatctaagagaaaaggttaaagtagttacagtcacattataaagttctgttaaacaacttgcagcagattcggcccatctgcaaagtgccattgttaagcagcatatactaatactcctactatgtgatttgctatttgacgcgtgggcctactagccgtacgaaataaagtcgtattggacgcgtagctatgttgcttctacgtctgcttcgtcatggttcgtttcgttcgtacgcagggaatcaagcatatgataaccactggaatagtaacggtaatagcaatggctagagggagctccagtggcctgtgcgaagcatacggaatccgaatagcagcaacctccttcagagatagacgtactgtacgtacttgccatcaactaagcagtttcagtgaaacttccaccatgctttaatgctttgcctgatcccagattcccagacttcagtgcaacacccgggaaaattcggactcgccgcactcgctgcaactcctagcatgtgtttagattggcccaaagtttagaatttggttgaaattaaagacgatgtgactgaaaagttatgtgtgtatgaaaggtttgatgtgatggaaagttgaaagtttaaaaaaaaaaactttggaacacacagtagctcgcaaggcgccattccgccgaattgcttaggcaacaggctacttgcatgggagttcgtttttgcgtgtgcgattcggtgcggttgcggcaccgggcttgatggattgggtagtggccgaggccgatggctctccggcaatttgttcggcccagccgcgcgtggcgagaccgtgggcgtgggagttcacgcacgcagggagcgggtgtgggttgccgggctaaaaagccgccggcaacagccacgtcccgccgcgcgtcgcacgtccgcgccacgaggcaccgacctatccccgcctcgcgcgccaagcgctccacgcgccgcccagcgccgcaaggcccgcaaatacgtggatcccccacggcgcaacgccgcaaataatttacccgcacgcaagcctgcacgcgaacgttcgcgacacttcgtaccaatccattgtccgtcgaacgccagaactatttaaccaagaccaggcgcgcgaagagcgaacgacgctatagcttcagctacgtagccgttgttcatcactcactcaactcagctcagtagtcagtgcgtactagggaccgatcgatggagaagctggtgccgaacacgaagaaggcaatggaggacaaggaggagaagcccaaggtgccttcgagcgacccggacctcgtcgacctcgtcgccggcgagcagccgcagctgcagcgggagcaccagccgcccaacatctccgagatgaagccgctgacgcgggaggcgtacggcggcgggatgtacgccaacgaggggcggagggacccgacgcggccgcgcgccagcgccacgcagagcgccgacggcccggaggaggccgccgtcaggcccaagcacgcgccgccgccgtccaccggcgaccgcgacctcgacatcaccggccagtcctacatccagtagtttgttgtgtgtgtccgtgccgtgacggtgtatgcgtgtagtcaggcagtttggtccggaacaaagatgtgcataggtcgttccacgctgtaacgaataaatgtaagtttacttgctgtaatttggcccaataaggctaccggcctaccaaccggagatcgttagtcttggcctactaactcttatggaccttgccaatgggctaatctgaccaagtgcccatggatcataataaagtcacgaggaacctctcttatcagcccgcaaaattttaccgttttcatcccttaatatcctttaatataattaatatcccttaatataaaggattttgatattttgcttgcactatttaaccattcattgtattttaaaaaattatataaatatataaaaaaaagttgtgcttaaaagtactttgataataaaaagtactttgataataaagtaagtcacaaataaaataataataattttaaattttttaataagataaatggttaaacaatataaataaaatatcaaaatctcttatattaagatacagatatggtaatttttaaatgattttgaagttttgttttcattatgctttatattttcaccactacctagctaaaataaatcttactaaaataaacgtttggatgacacaaaacattttaactggatagatgctgccacttttccacgacaacaacgtaagctgccatggccacggcagaggcccgcggaaccacagccaagcgtagatagcctccaaaattctcgacggtaacacgcgtgtcaccgtgtcagtgtctccacggtcaatgcttatccagtatatctatccaaagccggggaggtaggagacatgttccacggcgccgcgccatctgcaccggccgcgctgagccacgagttacctcagcacctggccgcgcttgtggcgggagccggccgtttcactctcgcgtgcgcgtgacgtggacgatccgtggccgctagacacgcgagtcgcttttccacgtagccttttgtcgcgacggtctctggcctggtcctgatcgggttcagtagagccgcctggttggtcgccacttgggacaggagcgctttttgtccacatgctgtgactttgcgtggagccacgtaagatagaccaggccatgtgatccgtgatcagtgctatactatgctttagcgtacgtgatttatggaatttaattttatgatataatatatatgattttaaaaacattattttagtataccatcttattgtcagaagttgaaggtttaacccatcacacattttcttaagttcttttctttttatttttgagactttttggttgtatgctcacaggcagagatcagagatacaatccatttctattatttaaaaatttttactttattttcatttataattctaatgaattttagcattgtaaaatttagttgaaaaatagactaaacaaattcttatcattgttttcttatgaagttttagaaaatcccaaagcttccactgttaaaactctacataagactttaaactgaagtctgacactatcaaaatttaatcccaccaaaatatagcaaatggtaccgccatttgtaatactaaatattggtaaggttaaaaattacaacaaagtaaaaagcccaacgtgcgtatatagggaccagtgtcgcgtgataataataattttatctttgctagtgtgcgtgagacacaagcagcacaagacatgggacggggtcttctagtaggagtgccaaaacaatttgagctcacgtcttgggattccactaccgattttaaactgcattttcagataaagtgtgtgaattatcacaaacaaaataaaatgctttttttcattagtttccagaagagtaggggagagaggctggccaacttgttgggccgggccgaccgtgcggctccctgcgtaccgatcaccacaaacttagcacacggtggcatccttgcggtgggcccacatcggggggtcccctcctgattactgccaatcttgactcccaccgacaagcgggacccaccagcatccttcgtcttcttcccaagccccatgttcttctccttcctcctcatcgccactcctctcccccacctgcaaagatctcccacccctaaacaaatccaaataaaagccccgaaaaaaaaggcttgctcatttatgtctcctcatttccgcgagctgattcgcaatcaatcgctctctcgctggttcggatgatgcccgcggtttccctcttcgccaccgcccctttaaaaccctccccctcgcctccgggctcccaccaccgccgccactgagccagtccgccgccgccgccgccgctcctgaagccctcgccgtggcatgagaagatggccgcgtgctccagggggctcgtggcgcggccgttcgatctgaccgcgaggggggcggcgcactggccgtgccccgccccgcgacgccgcgcgatccgatgctgctgccgcgcgcagcaggagccgcggaggcgcctctccaaggccgcggcggccgcgccggagcgcaccgaggagtggcgcatcgacgggaacaagcccgccgctgccgcccggggcaggcgtcgcgccagcctcaccgcaatgccgtcactccccttcccttctcctcggtacgtgcacggcggctcgtcactgaacatggcccatttttctgccttatccagtcaggcctcgcatttgccacttacagtaacatgttgtctaatcattccaacatatggattgttttttgctttatgctgaattgtcgtagtgacaagttaatgtgccaatgcttttgacacacgctttatgtagtggaataaaccgtacctttctgctgttgcacgaatgctctttgttcagagaatgaattttgatggtagactttgttttcactagtatagttctaggaggcagtggaaacaacagaatttctatccacggtgcacgccaagagggccagctcctcaatcccgtgatactccgccgaagagaggtgggttccttgctgatacttccaaattttgtgatagacatagtgtactccaaaaggaaacacccgacccgcagttccaagtgtatttttcagctttgctaaggaaatgcatttgttttctttgccacctgccttatagacactggtattgctagtgagaaggaatggggaatcaaccttctggatgaagcagtcaaggagtctgggacaaatgaagatggaagcacctggtacagggagagtggagacgatcgtggtgataatgggtacaggtgtcgctgggctaggatgggaggacagagtcatgatggtaccactgaatggaaagagacggtatgttcttgttgttttacccttaactgataatattctagtacaaatttatcaagttgtatacctttgtatgatgcacctgagttaagagttaccatctcagttttgtgcaaacaccacattttcgtatgagaaggatctagaaaagatttctgggatgtagccattatattccaatgacttctttatgtaacttctgatgctaatgagctgttgttgatgcttgtggcactagttagaatcgaagatatgtctgccatcctgcaagttgcttcgtgcttgttccaatagctatagcgcactctgcaatagatccaacttgcactttcttacttgactgagaatagggatttggaattataatctcccaggatttcataggccgtagctaactcttttggcacattaatcaatgctggacagaattcttgagttgttaaaaagattttttctaacagatctcaataatttattatgtggcagtggtgggagaaaagtgattggaccggatataaggagttaggtatgaacatatctttataatgaaggctctggtagcaaatggtctttgtaatttgttgttaaatttcctaagaattcagttaattttcttatttatgtgtgcccttttccttttgcatatctgatcagccgtcgttgacttttcattacaaatctctcacattaggtgcggagaagtctggaaagaatggtgaaggtgattcttggtgggagaaatggaaagaagttctttaccaagatgaatggaggtaaattattagcatgcaaattcatttttttaatgatactagctccttgcttaaataatacaaaaatacataatctccactgaattttaactaattttgtcaccaaaaataagtttactgttctttgtttctgcctgctgaagaaaacaattgtttggggaggggggggggggaggacaattgttgaccccttggttatacttctgtgaacaaagaactttgattgtgttaagcgcttggcgcttgcaatttcttgttgtctgtttggaacaattttgtttgaccatatatccatgctctatttacttatatttgaaatttagcacattattgactgttattaccagacatggctatacacttcaacttggacttttggacacatcatatgtgcaccaattatcgattagcatgcattattttcttattcctcttatggccttctagtacctttgtttgaaggaaacttgttctgtgggctcaactgctttaggattgttcaatttagtttgaacaataactgtctagaaccaaaacagcataagctctcctgtggattgggatatttgacacgaatatccagtgaaaatcacagtgctgattcataaattatcctgttcagagagtagttctaatttctaaacatactgggcacataatatatttctggcttagtgttatgatcataatgatctgtacttttgagtaaaggtcctgaattctctttaagatagggaaattaaagcaaactaggtgataccccgcgctttgctgcgggattcacgaatgagtatatgttaaatattgtcgaaatgatgaaagttgaaatgttaaaaaaataatatgaggaagatgatttgatacatacttgttgatctctataatataatattatagatgatatgtcatgcttgcatgggatttaaaataggctagaatagtaattgctagtgagtgaaaatgtggcatgcttgcatgggattttaaatgggttagaatagtaatggctagtggatgatgatgtggcatgcttgcatgtttagctttagctttagtgggtaccaactatatagaaagtatagattagttaataaatgaccatctagcacaacattgtaaactgtagatcataacatgatttacattgtgcaaacagcaatcttgcaagaatagagaggagcgctgaaaagcaagcgaaatcaggagcagaaaatgctgggtggtatgaaaaatggtgagagttatctcaggctttcgtttaggtttggttgcaattgttctgcaaaatatttgcttgaactgttgaagtgttcatgtttctttcctaggtgggagaaatatgatgccaaaggctggacagaaaaaggtgctcataagtacggaagattaaatgaacaatcctggtgggagaggtggggtgaacattatgatggccggggttttgtattgaaatggtgagcctatatatatagtgctattttgcagactattgttatactgtactttagtttatcttcaagcactataccatacactttacattgtattacatgtttcttatgctgcgcgcattgtggcctaaatttgtagtctaggttgtgcatttacattgtgcatcatatttgaggcacaagttctttatacttttaatttatttgcctgttcaatcatgattggaacatccgatgtatgttaattggtaaccactgcaattcatttgtattacaggacagataagtgggcagagacagacttaggcaccaaatggggggacaaatgggaagagaaattctttgctggaattggttctcgacaaggggagacatggcatgtatcccctggtggagatcgtaagtttcatcgtcatttatatatatgcacagtatccaccttgatgatgggctttgttctctttggatgctggtattaggcataaatgctaagcacctttggacctttgatgcatagaaaaagtttgcctgctgcattggccgaaattcacactggtgcaatctattggaagctatgctggatattttaacatgttgcttttatatatgagctgtatctactgtctgcatactcaggtttagaagttagatcctgtttattgcattgttaaatgtgtgcaccgctcgtagtgtgacttatgacttatctgatttccaattgccatccacttatctgatttgatactttcaggatggtcaagaacttggggagaagagcattttggtaatgggtatgttccatcatgacgctggtctcgcatttggtttgactgacacttgacattaataaatgaattgaaaccacatgggcttgtccttttctaatacactatatgtcattctgcaatggttcttcttgcaacgatactacctggcattacagtagtagctttcttagatactgttgttctcttgtatttcagaaaagttcataaatacggcaagagcacaactggcgagagctgggatttggtagttgatgaggagacgtactacgagtaagattatgtcttgtttggttcttccagacatcttcggagtattttcagatttacaatttggcgttgatctgtgcattgtcaattagggcggagcctcattacggatgggctgatgtcgttggagactcaacacaacttctgtcgatacaacctgtcgaaaggccaccaggagtgtacccaactattgacttcagcgcttcatctccagctccaccttcggatgatccaccaggcatgcctccttcgcctctggaatgagtcatacctgtgccagtacaaaagagaagcttttctgcataggtttccaattttgcctgtaaggggaacattctttgtagaaaggggatcaaccgcagtattgcgttcattggttcattcattctttcgtagcatgttttccttccgcggcttagcgttttatcgttccggactgctgtttgatcaattaggcgaaataatcagtggctcgcgatcatattgtctctatgcttatccatgtgcatttttgcataaaagctccgtataaataacggaggagaaagctctcaatgatatccacgcgttttttagcattgccttgcgatgtggacacctctgtttggctgttggtttgtgtggcgaagagacgtcaacttcgccctgctgtttccattttcctcgcatccagctccggcctgtctgtcctgcttgtatccaagtgtgctgccgtggacgaggctactcgttcacatttgtgactttgaagtccagattggcctcttgtgcaatttaattagcctgacttgggttgccaaagtcttagcgtagtcaagctccccttgaagacgctaagctgcatgcatggctaacgtttgtagtcaaatttccatcggtaattttgaaatttcagtgattttttgttctccaagtctgactcaaaccaatcaattccacacaagttcaccattttctactttgatgcaatcgaaccaaaggatagggaaaggcccacgctgcaaccatttaagtcgccacaagcactagcatcgaggcatactcctcctgctccagtgtcaacacgacagtcaaacaaacaccaagcctctcattcccacctctcgaggagagctttccccaccatggcgtcgctcaccgccgccctggccacgccggcggccgctgccctcctcctcctcgtcctcctcgccgcccccgcctccgccgccaacttcacctgcgcggtggcttcaggcaccacctgcaagtccgccatcctctacacctcccccaacgccaccacctacggcaacctcgtcgcccgcttcaacaccaccaccctccccgacctcctcggcgccaacggcctccccgacggcacgctttcctccgcccccgtcgccgccaattccaccgtcaaaatccccttccgctgccgctgcaacggcgacgtcggccagtcggaccgcctccccatctacgtcgtgcagccgcaggacgggctcgacgccatcgcgcgcaacgtgttcaacgccttcgtcacctaccaggagatcgccgccgcgaacaacatccccgaccccaacaagataaatgtcagccagacgctgtggattccgctgccctgcagctgcgacaaggaggaaggctctaacgtgatgcacctcgcctacagcgtcggcaaaggggagaacacgtcggcgatcgctgccaagtacggggtgacggagtccacgcttctcaccagaaataagatcgacgaccccacgaaattgcagatgggacagattctagatgtcccgctccctggtacgtgccttgctgttactgtttagtatggttcttgcaatcttgtgatcgagctcagaagttttttgtttaacagtgaattttctcagtagactagtcttactagtactataagagaagaaacttgaattagttaggcaggtgtttagttcacttcaaactttctaaaattccatcacatcaaatgtttggatatatgcatggagcattaaatatggacaaaaaaaaaaccaattgcacagtttgcatgtaaattgcgagacgaatcttttgagtctaattacgccatgatttgacaatctgatgctataataaacatttgctaatgacggattaattaggtttaataaattcgtctcgcagtttatatacggaatctatactttgttttgttattagtctacgtttaatacttcaaatgtgtgtccgtatacttcaagaaaattttagcacacgaactaaacacggccttactcgtattactacctctacatggttgactggggagactgaagattagctgtgttgttctgttagtttgcatattaaacttaggttaggtatggtaaattatttgcaatatgctgataatatattgctcggattcagtggtatttgcaatgaacttaggctatggtccccttgcatgatggagtttatcagaatcaaaatatctggttgtgactcggaaagttgctctcaagaaaagatagctagctgcacatgcttcgatcgttgagagattgagacaacatgacacatagctccactagcacatgagtagaaagccacaaaattccatcgcaatgttgaggaatttaagctttagagcttgaattcctgcactctttggacttgtataattagttagccgttgctatcaccggacaaactatctgactttgtggtttaaaattacggaataaactaccaataccaatccacaaagttgaccctcgctactcacaaggtttcaaaatatactattatagtactatcttagatggatcttgatgtttactactattcactttcttcggtaagaatgtcatatgaaacgagttcctagacctagtactaacttctggaaaactggtgtcctcagtgtgccgttcatcaatcagcgatacctcagctgatcacaatctgatgctcctcccggatggcacctatggattcaccgcaggaaactgcatccgctgcagctgcagttcaactacctaccagtatgctcccctattatttccatctccttctaagttgtttctgatcaagcagtaaccaaagaatttacatttcttttcactgtgtcaaccaggctaaactgcactgcagtacagaacaagggatgcccgtcagtgccactgtgcaatggaacgctgaagcttggtgagacgaacggcaccggttgcggatcaacaacgtgcgcctacagtggttactccaacagttcatcgctcatcatacaaaccagccttgcaactaatcagacaacagcctgccagagtaagttgagcccgcaaacctgtacaaactcagagtctctgagtttgtttgagttaaagaaacggcaggtttctaatagttgattttgcaggaggaggatctgggaggtcgcagttcgctaggtccatgtggagcatgtctgttatctccttccacatggtgttgatcattatctgtttcctttgatgttggagactactgcaactctagatggtacatttcaaagagttctctacgatctatgattgttgtatacgatatatgattgttgtcgtaacttagattttgatgactggtttatccagctttgaaatttgagttttgactctgttctttagaggatgagtggcacttgtacggctgcttgaataaaacgtcgatgtattgtattcgatctgcatctgaaaaggaatattcattagataggattattcgaaataaaaagatcccacatgtttttgttataggcgttacatgttctggatggatatataatgtaccatgcggaagtatgaatggacttcccaccttccaatcttccatctacacttcaagccttgcataaagcaaaattgatcttagcaagtctcaggcaaatgctcgaaactagtactagtttctttctgatatcattatttttgttgcgacttgtttttagtattgaagatactttaagcatgacatattttacatatttgcattaagtttctaaataagttgaatggttcaatatcattttcaaaagtccatgtcatgcattcactcctttcatttatatatgacgttggatagttcactaaaatgaattaaccaactcatatataagtggaggagggtgtgtttaaaaacggtgagggtatattcctcattttccccgaataagagggtatattcttttttatgattacttttaagtgcatcctacatgatgctgcacttgactcagttttaacacggaatttatgcaacatccgtgttggtcttcccaaatactgtatcatcagaaaatatcggagtagtcgtgcagggcgctgtcatcttggcagcaaaaccaatcgcagctagtacaatagtacaagactacaacttggatttgctttgcataggcaggcttcccatggccctggccttctcccggagcaagaacttctgcgtcttccccgtcgacgtcttgggcaggtcgccgaacaccaccgtcctcggcgccatgtaacgcggcagccgcgcacggcagaacgcgatgatctcgtgcgccgtcgcgcttgccccgtccttcagcgtgacgaacgcgcacgccgtctcgccccagtggtcgtccggcctcgccaccaccgccgcgtcgagcaccgcgtggtggccgaacagcaccgactccacctcgatcgagctgatgttctcgccgcccgatatgatgatgtccttggcgcgatccttgagctggatatacccgtcagggtggcgcacgccgaggtcgcccgtgcgcagccacccgccgcgcatggcctcctccgtggccgccgcgtccttgtagtacccgctcatgaccgtgttgccgcggagcatgacctcgccgacggcgcgcccgtcggacggcacgctcgccatggtcaccgggtccttgatgtcgacgtcctgcaacatctggtgctgcaccccctggagcgccttgatccgcgcgcgctcggcgagcggcagcgcgtcccactcgggtctccacacgcaccgcgtcgccggcccgtacgtctcggtgaggccgtacccgtgctggacgttgaaaccgagctcctccatcttggccagcacctgcggaggcggcggcgcgccgcccgtcgagatgagcaccctcctcggcagcggcctccgctccgacgccggcgcgttcacgatcatgttgagcaccgtgggcgcgccgcccatgttggtcacgccgtggcgcacgatctgctcgaagatgaccttgggcacgacgttcctgacgcagatgttcgtcccgccctgcgccgccgtggcccacgccatgcaccacccgttgcagtggaacatgggcacggtccagaggtacaccggcatggacgtcatgtcgttgcagagcagcgcggccagcgagttcaggtacgcgccgcggtggctgtagatgacgcccttcggcctcgacgtcgtccccgacgtgtagttgagcgatatcgggtcgcgctcgtcggccggccacctgatctcgaagccccgcggcgcgtccctcagaagcgcctcgtactctagcccgccaccgtcgctgctgctgctgtcgccggtgtcggagatcgcgatgacaaggggaaatttggctttagcatcggcgagcagcctcagggcgtcgtgggcgacggcgaggaactgcgattcgacgaggaaaaccttggcctccgaatgtctgagaaggacggacaccatggccgcgtcgtgccgggtgttcagcgtgcagagcacgccgccggccatcggcacgctgaagtgcagctcgtacatcgccggaatgttcgctgcgatgacggcgacctgaccagcaattaacccatgtcttgttgagagctgaattggcaccaagtacaaagctcatcgaggcatcaagctctggtcgatcacttaccacgtcccggcggccgacgccgaggcgcgcgagcgcggacgccccagcgaggcaccgttcccgcgtctcgcgccacgagtactccctgccgccagagacgacggccgtgcggtcaccgtacacgacggcggcgcgctccaagaagctcaccggggtgagcggcgcgtagtttgcatcgctcggcatacagccttccatggcagctcgtgtaccagcaatcgggatcgatttgtcacactaattagcctctctgaagaagaaccaattgcaactaatgcaatccgatttgtccaaagtgagttggaggataattaaacggatgaccaacactaaaccaaaacgttgttctccatctgagtcagtcttctttcgcgtgcattaattaattgcatacttgatgtgtgcactccggttagattaaagacgaaacgcaggaggtgtgagacgctgagaatacgtagtacatcacgggtcactcaatgagtatcatgctagtggaattatttttcgaaagcacttccagttggcgcaatggaaaaatgccaagagcatttgatcgagacagagggacaatattcaactattcagagcaagctagaaatgcagaattgtgtcagcgttatgtacgttaatgtcggccttttcaactgatgaatgctattactacaggataatggaatggtcgttgaattgtccgtcactattgtcttcgtctcgctccctttacataccttttggatcccctcctagatatcatcgagcgatttgaattcggtgtgcactgatacgaagctgcgctcgtttctcacttctatcttctacttcttcatttttcacatgctcttttcctaagctccatcttcaattcatggctccaaggttactttctacccttatcttatctcctactctttttgccccaaagctcaatccaacgccttcatttttcacatgctcttttcctaaagctccttcttcaattcgtggctccaaggttaccttctatccttatcttatctcctactcttcttgccccaaagctcaatccaaggcctttgtgggtttggggcgataagagcatcaccaagagatacgtataatctttcccaaaaaattatttttgggttttctaaactgaaaataggtagcgaaaaaactgatatctccaagagaaatctaaattttattccaaaaattaaaaaggatccttttgttaaactaacatcagattccgttttcctcccactcacgtgcgcccgcgctcctcactgagaaaaatctggcgcgaatgagagattggggacggcagacgcgccatctctctccctcgaatgaagagagtgaaagatgcggggagggggtttccaaaaaaaaaaggatccggataggacatctattggagactttttttttcaccaaaatctaaaaaaataggattgtgggtgaagtaagggaactattggtgatgctctaagagaggcgtcgaagtaaaagcttgcgaggtgtggaagaggaagagattgccgacaccctctccatggagtttgctttcattattgcctctattctcactaattggtactaactccatcccaaaataagtgcagccgtggatccgtgtccaacgtttggccgtccgtcataaaaaattttcaaataagacgaacgtttaaacgttggatatgaacaggataaaaactgcacttattttgggacggagggagtagtgcgccactcaggggcggagctaggtaggagaggggggggtgcccaggaacccggtcaagaaaactttttagctatagttcatttattttcactatatgtgcacccctctcaattcaaacttagacacttatataagtataaagtagagtaaaacaagtgagtggcacccctcttcatttcgttctagctccgcccctggcgccactagttcaaaatacatagtattggtaaatatatctcgtttaaagtgaaaagatcaaggatagggtggttcatggtgaatcttaggtaaaaataccagctccaatatgcaatttactgaaagtaaaattaataggagccacatgatgggcacaattttggtgaagccactaagataaataagtcatttggccaacatcaaattttgccacagggattggtggcaacctgccagctgacatagtataaattgaaaaaccactcgataaattaatcattttttttaaaaaaaatccaaacttaaactcagacgttcggtaaattttgttcaaaattcacaggttttcgagtggtaatgacaaaaatcggcaaaacccctcgaatcagctaataatctttggaactctgcatactacggcatcccatccaatgtccaacaacagaaatgatattacagtttactattggcagacttggtgagactgcccatggcccgggccttctcccggagcacgaacttctgcgtcttccccgtcgacgtcttgggcaaatcatcgaacaccaccgtcttcggcgccatgtaatgcggcagcctctcccggcaaaagcttatgatctcgccttccgtggcgttggcgccatccttgagcttgacgaacgcgcacggcgtttccccccagtaatcgtccggcctcgccaccaccgccgcctccagcaccgccgggtggctgaagatcaccgactccacctcgatcgagctgatgttctcgccgcccgatatgatgatgtccttggcccggtccttgagctggatgtacccgtcagggtggcgcacggcgaggtccccgctgtgcagccacccgccggccatggattccttcgtcgcgccgatgtccttgtagtacccgctcatcaccgtgttcccccggaacatcacctcgcccaccgtctgcccgtcgtacggcacgttctccatcgtggccgagttcttgacggcgacgtcctgcaccgcgatgtgatggaacccctgccgcgccttcagccgcgcgcgctcctccgccggcaacgcgtcccactccggcatccacgtgcagacggtggcggggccgtacgtctcggtgaggccgtagatgtggtacagcacgaagccgagctcctccacggcgagcaagacgcggggcggcggcgccgcgccgcccgtcatgacgcgcacgggccccggcagagccctcctgtccgcggccggcgcgttggcgatcatgttgagcaccgtcggcgcgccgcccatgtgcgtcaccccgtgccgcgcgatgctgtcgaagatgaccttcgccgtgaagtggcggaggcagatgttggtgccgccctgcatggcgacgccccacggcaggttccagccgttgcagtggaacatgggcacagtccacaggtacgtcggcatggcggtgatgtcgtacgcgaggaccgtcgcgatggtgttgaggtaggcgccgcggtggttgtacaccacgcccttgggccgcgacgtcgtgccggaggtgtagttgagcgtgatcgggtccatctcgtccaccggccaccggatgtcaaactccgacggcgcgtccctgacgagatcctcgtagtccacgcagcccgagtcgcgggcgccggcgccgtcgtcggagatggttaggagaaccggaaggctcgcggcgctggttgagccggcgaggcgcctcagagcggctctcccaacgtcgaggaggtgcgactcgacgaagaacaccttggcgccggagtggctgaggagggtggagatcatggccgcgtcgtgccgcgcgttgaacgtgcacaggaccgcgccggccatcggcacggcgaagtgcagctcgtacatagccggcacgtttgggctcaggacagcaacctgaacatgggacacacgacaatgtgggtcatacgcctgggcctagttttcagactgacccatgattaaatcaggtcgaaattatttcgatcgttgagtggcctgaccaaggaacatgaagaggtggagtggactgtgagtgggacctaaaatccttaccattttctccagaattcctatggatctccgaataaccaataatttgcatggaagccacattacttcgcagttcatactgaaagtataaaagtgaaagatctaaactgcagagaaggccattcgcatgatcgagagttttcatgacttcgctactattactcggtgtcagtagactgtagactcagatttataactggcgttgcaaaaatataaatagcggcaatgcacgaggatattagcagcaaggtaaaattatcccactaactgaagaagtatacgcggcaatgcagaagctttatcgctaactgaatcaagctgtttattctcaaaacaaaaaatcaagctgtttacatgctgatgcatagagagaacattaatatcaagagtactgataggagaagatccgcgaggacgtgaggttatctagcttcaactattcatgggctcatggcaaagattagcggaaatattactcgtaaactatatgtttagcatacttaacaagttttctaccaaaaactttcgggccatcgatctaagctgcatccgccacttcctaccttgttggttcaaaagaagaaacatctaagtagcaaatgctcgcgcacacgataagctaaaagagctagcagcattggtgttccactcaccacatcgccgcgggcggcgagcgcggcggccaagcggacgcaccgcccccgcgcctccctccacgtgtaccgcctctccccgcacaccaccgcggcgcggtcgccgtagacggccgcggcgcgctggatgaagctgatcggcgtcagcggcgcgtggttcgccgcgcaccgcaccgtgccggcatccatgtccagcacctctccctcacacagtcacactccacttagatccaccatcccgcctccatcgcctcgagttatcgaggtggtactaaacgagagctggccgtgctcgagcaggattgctattgcggccgcagggttgggcctgcattgtctttggggctttacttgccctggtgggctttgattggggcgacctggcaagctgcagtgtgaacgaacagcggcgacttgttttcagatggaaaaagtccactttgactcccttaagtaggccgaatctaatacggactcccttagatttggtgtaagggagtcagtgtgaatttttttttccttttcagatcaccacacttaatcaaatgtggatttggtgtggatgaattccctttttgcttcgtacggcgttaggaagatgcaaaactagttgaacttgaacacttgcctcctttttattacccatccacggtgtgctatttttttctgacggattatacctaaatgagaaacatcacctaattgcggtgtttggctaatgggattagaaaatgaattcccaccaaccaaaagatatctttaaatcttaaccattcattattcctcttccatttaatcctaaccctatattcatttctcaatctcaatcccacctcctattttccattatccaaacacacccaataggctaactacggtagaatttctttttttgattttttttagataatagaatcaaatatcccggcctttactcaaacgagctacaaccaattattacatagttcacaaaatagcaaactcacacagtgagtccagaaccacataatgaaaattttaaacaagcccaaaccaatacttgatgctactaagattcataaaagaaagcttgtactaggccttaggcactgcgctgaagtacataattgctgatggtctctacagaatgaaccagtcctaacaagttatgatcctggctcagaaggaacgctagcttgcttaacatatgcaagtcgtttcggggagaggggcagaaggaaaagagactcctagcttaagtattctcgccctgcttcaaaagtacagggcgcgcgctatgccgctatggctttgacataacaaggacattactccactatttacggaggtgctaggccacgagaaaatatatgtgattgggccttgcacattacagaatttcactagattggcccgttagatgtaaatgctaatcgttaaatcaggccgagattatttggatcatcaaatggaccgacaaggatgggaatgaagtgggctgtgattgtgagtttgtgaccgagaccttaagcttatccatctacgcatctccagaaactcccaatggaggtccccgtgaaaccaatgattgcaagcaacattacgcgtcgccgagtttcatgattttgccacgattactcggtgtcaccgtgtcacggtgtcagtaccaatcatgtgacttcaacacgagcgtgcgcatggtacgtaggctaaactaaggccctgttaaatgggactaaaacttttaataccctatcacattaaatatttagacactaattataaatattaaatatagactattaataaagcacatccataatcttggactaattcgcgaaacgaatctattgaatctaattaatccatgattagcctatgtgatgctacagtaaacattctctaattatagattaactaggcttaaaaaatttgtctcgcaaattagctttcatttatataatttgttttataagtagtctatatttaatactctaaattagtacctgaatataggaactaaagttaagtctctgatccaaacaccagctaaactgcctaatcgccgcatcaaagctcgcagacacgacacgccacgccacgataagccaagacgaaaagaaagcaggaacagatcaaatcacgggaagctcgtgttggtaagtactatttccactcaccacatcgccgcgggcgacgccgaagcgggcggcgagcgcggcggccacgcggacgcaccgccgccgcgcctccctccacgtgtgccgcctctccccgcacaccaccgcggcgcggtcgccgtagaccgccgcggcgcgctggatgaagctgagcggcgtcagcggcgcgtagttcgccgcgcaccgcaccgtgccggcctccatgtcgagcacctccccttcggcctccccctcccttcccgcgaggctggagaatagcagagatgctgcgctggatctggcagaagtaaacgctcgctgatggcgccatggcgataaattaatcgcgcggggggaggcgagattagtagtataatccaagtgaggaattgaataatcttggggagattggtgatgacatggtggtgatccggtgctgatgcggcgagctagcctacgcaacgcacgggatgcggctctcatggtgtgtgactgtgccagtgacgctgtcatcttgtatagccgtgtctgtgtcactgtgtgaggctactgttcactccggcagggacgcagcgtatgcatccatatgagctggatttttctgcatcggcatatcgtctcttttcttcgatttttttttgtaaggagtacagaagctttgcccagtatattaaggtggtgtttggatcacaagatactaattttgagtataaaacatagacaacttacaaaactaattacataaataagagctaatttacgtgatatttttttaagcctaattaatctataattagcacatgtttactgtagcattacataggataatcatagattaattaggctcagtagattcgtctcacgaattagtccagagttatagaatatgttttgtcaatagtctacatttaatatttttaatctgtgtcaaacatccgatgtgactgggacatcccatccaaataaggtctaatagagagagtaaaagtatatacagaattatgtacaggtctgaaaaaaagccaaaagaccccggaaaagggcttttcttcgaattggactattctgcatcagcctctcatctagacctttcttctaatggaatgaatgatagagctttttctgccgatgagctgcggcttaccatttgcaagcgaatacgacatccgttctatttttaagtgtaactatgagttttatctgttctatttttaagtgtaactatgagttttattttccaactttgatcgttcatctaatattaaattattttataattaataaaaattacattttaagtgtaactattagttttcgtgtctaacttttatcgtccatctaatataaaattattttataataattaactttttattgttataagatgataaaacatgaataatactctattattttataataattaactttttattgttataagatgataaaacatgaataatactctatacgtgatttatatttttatttttttaaaaaaaataaaataagacagatttaaaattgaacaaaatattgtttttattttttttcaaaatttttttaaatacgaaactccgtagtaggcaagtgaccacctcgatgggaatattttagcttaatctctcgcttatccgcttagcttcacctcatggtagtagcacatagcacccgtcaacttacttatcaaagggcctgtaagtaaacaagagggaccaaattttaaatttaggtaattggcaggggccgcgcgaacgcgtaccccctctaccacaaattatgacgtccactctcccactcggggagatggtaaaccaacgcgctcaccaagtgcaatgtgagccattgatctaggccacggcccttcttgatcggccgtcgaccccgtccaggtaagtatgttgcaacgacgcaccactagcctcttatatagcaggcgctcccatccccatcgcctcgagttgtcgaggtggtactaaacgagacctggtcgtgcagcattgcagctgcctggttgggtctgcattgtattgggcctaattgctgtggtgggctttgagcctttcattggcgcggcctacttggcaagccggagtgtgtacaacggcgacttgttgctttctggtcacgagcacttcagcatcagatggattcggtgtcccgagtggaattgtcaaatcgatgattttagattcctcctttgctacatacggcgttagaacgccagtcatcacacaaaaccagttgaatttaacaattgcctccttttttattatcccatccagatgtaacattttttttctgatgggttagtacatcaaaagaaaaacatctttacctaataggctagtactgtagaatatacttcacgctactgattcagaaaagaaagcttgcactaagtcttaagcactacgctgatgctactgggattcaaaaaagaaagcttgtattctgaagtacatagttgctgctggtctctactaccagtagcaactatgtactggtctccactaccagtacatagtccttacaaagtaaccagaaaaataaacatcacattattacagcggtccaaaggccacgagaaaatataactggggagcttcaggaccatgggtacctgggcaaaaaagagaagcacccttgcataatcagatacccagtgctgtcctctgggaagaaatgtcgaaacatatgctattcctttgaactgccagccaaacatcatcgaacctttttttacttcacaacacttcctggaaagagaacatggattcagacagggtcctagaattactgtgcatcaaacacaaccacatttcttttcacaggaaggtgtagatactaataagggtgtcaacgactaatccgcaaaacccacttttaggccaaaataagccacttacccgcttagtttgacctataagtgggttcacgggttagccacttacacccttaggtatatgattgatgggttcaaaattgcttatttatgtacgggtgagttgttctagaaatgcaggaagtctttgtaaaatcacatgttataaaatggacaaaaggcaatgtgtattactgacaatagaaaactaaccattagctttgtcatctgaaaaactaacggcaacatgctcaaaataatctcttctggcatctggcgtttaatcagaaaaaaatgttagcatatggttaacatgtagctaaaagttaacttgaaaacattggatcacaaaaatttcacccacatacttaccatgtttcatagttaaagaagggtcttccttatctttatacccaactacctttgcagggtttcctactgccatactttaaacattatatataaaaaaaaaggtcagatcaatttgactgaaatactattgtactcatcaaaataaaaatgatgtaaaaacatgcagcaaaaaaaaggcacacgtgtaaaataaataagcatttcattacaaaatacatattacagcgatcacttggggatttgactatgtaaaggcctgctggcataatttgcattatttttcagtgcaagacaataagacacaactgaaggactccttaacccaggaaatatcgaagagcctttcctagggggtatgccaaaagtgaaagggaatatataatctgctgagcacaagagaaagattcttcaccaggcactggtattttggttgatatattcttagattagtctgggatgaacataaccaggtgtcactaaatcaagcaccttaatgggaaacatgatgccatgagcccatgagaaaaaaaataatatctccattaaaatccaaatacttaaaatttacactacaaaaatcaggcaccttttttttatatccgatataatgaagttcctagtccaaaattactttatcatgatcatgttatccccccgcccaccccggcctgcccgcctcccctgattttgctctctttacaaggaaaccacattgcaagaaccagaaaggtcatatctgtaaatgattgtttctacaaatttgacattgcagcaaacactatttaaaaaatattaataggctagctcctaacctgtggggaggtacatcctttaaaacaagggaaccagcagcaatcatggcaccttcgcctacgtttatgttgccgaggatagtagcaccagctccaagaagagccccctgaccaatcttggggtgtctatctccattttccttgccagtaccaccaagtgtaacaccctgtaggaaaagtctgagtttcggtatccaaacaatatcatccatatcgaagtcattgttgttataaacctatctcggcacattgtagtgtatatatgttttaccaactcattagatgtataatcagcacacctgttgtagtgctcaaaactaaaattgcatctagaagtactgctttattttgaattttgcagctagcaaaaactgagttatgctgggcacctgcattaatgaaacccagtttccaacaatggcagtttcaccaataactagacccgttccatgatccaacaatattccctctccaattctggccgctgcagatttagtaataaagaatgtaaggaagataaagtgggaaaaaagggaacatgataaggcataaaagataaaccacaaatgttcataacttcactgttcaaaaatcaaattttaaaagcaatataaaaagaaccaacaattatcaactagaagagtgacataaaattgtcctgccaaagatgataaaacaggctaaatatcgcatatcaccatacaacacttgaatgttaaacacactagcagaccaggaaaatgcaaatatacatcattacagaacaatcatatacctgggtgtatatccactgcaaaaacctgaaaggaatatgataccaaatgttactgaaacagaactatttgctaaagcaatgtaaaaatatgcttcataaagaaatcagtgttcacctcactgatacggctctgcagtgccaatgccagaactttacgaccttgattccataatacatgagctatcctataggattgcacggaatggtaaccctgaagtggttcacaagcaacattagagttcttcatatatgttgatattgtgttttctttgtagcgcagagggctcttattacacataaggctgaatcgaagtatctagcaaatacataccttgaggtacaacaatgcccaactgtattgtgcacaggcaggatctctgtctttaaaggcctgaatcagcagagcgattttatagttgtcaagagatcaatgggataatacagaatgaagcttcatgcaaacacaattacacaaacatggtacatccacagaataatactataacaatgctcacctgagcatcaaggcgaatagaacggcgtatatctttgttgttcatcataacatcattgaaaatgtctattaactgagttgcaagcaatgttggatcttcgagcctgtttgcaaggacgaaactcaacgccctctcgagacagtcatgagatagtacgctggcgtacaagaagctacttaaaataggttccttctctgcctgtgaacagtataagaggcaacaatataaaactaaagctctatcataaataaaaaaccataaagtcatatttaaccacgtatgatgtagctcatgtttaaaactcattcgcatgcaactggagcttggttttattgcttggtcttttattaaaaagaaactaaactttcacacagtcactgatatgcttccgaacctgcgatattggccttcagttctccactaatcagataaattagctataataaactacttgcctcttcactcctagtttttaactggagtaccatttttgcctcctgaattacttggctacactgaactggcaactactcctacacaatagtaactgattcaggagaacaaaatatactaataacatttttttttctcacaagggtcaaggcaactaaattttaattttaaaaaaacattactcaattcatgctatttcccaactgcgcttaactcactcaacacaagtgaaagcagaagacaatatagcgaagtgctaactcagaagaacaagtgaactagcatttctaacccctcaaacccaaatcgagccgaaagaactctctggacctaagaacatgcagaacttcaattaatccaaacacgaccaccaaaaaaaatcgtattttttcctcgttccaacccaaaattcagagtctgtctggcacagtagcagaaaagccgcgatcaaatcagaaggataaaagaagaggtccgatcaatccgcgagagcgatctcgtgagagtactcacctcagacttggcctccgacttgacggcctcccatatggggtccccggcggcgtcgactatgccccgcgccgccgcggcggagctggcccgcgagctccccatcacgtagatggggaacatggtctccgaccggctcctccactcccccgcgcacgatccgcagccaccgccgccgccgccgccaccctgcgcgagcctccctctccccctccccgccgcctcgccgccgtggtcctccaccttctcgagcaccaggcacccgcacgacgtcatgggtgccccccaaggggagggggcttctccctcgcggcggttgtcggccggcccgacgcggcgagtcgccggcgcgcgcgccgcggaagaggagcgagcgagagaggagagggaaggggacgagagcgaatcagcgaacgaaaaccaaaacggcgagtgcgaaagaagcggttggggagcgacggggttattttacggaactgacggcgtcaccgcgcgtctggggatgcgcgcccgagacgagaggagacgagacgacgagaggccccacccttggcggcttgcgcggcggcggcgcgaggaagggattttgcggcgaggtgtgggggaccagagggtggtctggtgctggaacggcagccacggctttttcggtttgcgcctttcggctcgatggctaccactatccccgcgaccccgccccgcggcgcgggggggaaaggggatccagacaaatcgtacggctcgcggcgcccgcgcggccgggtgggtggatgggtggacggggcccgggacgtgtgtgtgtgtggtgccgtgcgtgcgtgcgcgcgcgcgcccaggtcgcgtaggtcgcgtgtgccgccatcgtgtgcgccgcgcgatggtgggcagcgggatgcgccccctgtgccgcgccggttgacacgaaagccttgggtgtgtgtggtgccgtgcgtgcggtcgcatgtgcgcgtgcgccatcgtgccgcgccgggcgacgggtgggcgggtctgtgcaggaagcgtggcctggtcgacacgaactcacgaagctttggtgtttttctgtataaagcaggtgacgccgccggataatcgccaacaacagtgttacagtgtactggagtagaacggaggatgtgatgggcattactgtcatcgtgtcgctgacgcgtgacatgttgtcaacttcctcttttcggctgtgtttagatggattcaaacttccgtcattttctatcacatcaatatgtcatacacataataactttcagtcacatcatttctaatttcaaccaaaatctaaattttgcgctcaactaacacagccttcatctactagggtggtgtggacgggaaatttaactatttgccactcttacgagtgtcaactctccatatgccactattagatttggcctaacatatttaccactagagagagattacgccctaattttttgccactttcgttgggttggagcaccacatcagcatgccagcatggaccggcctagtgaaatgacaattttacccctccattctcaagtggttaatagccaacataatacaattaaatcaactacgcacacatgaataaatgataaaacataataacttgagaacaactcaacacataacatactgcatcattaacacacatgcgcaacaaaaatcaatttttatcccataataacttcttcatcgttagaaatagtactaccaagttcataaccactatcaagttcagagttactgtgaaggccatacataacaagttacatgccattacgcaaggccatacatcattacaaaagcacaataatagaaatagcaacatcaggccaggccatacacttaagttcgttaggccatacacttaagatattcacaccacatagcaaaatatgccataccaaagtgcacatatcatcgcacattacttgcaattagtttttccaaaatatcatgccatagtagaccacaaataaccaatttcactagcaggttgacaaatttcaatccaaaagtttaggtggtgttgcacttttcttcttgcttgcgagcttttttctgggtgtaagcttcttgggtggctccactatagctggagctacttgagagctttggtcaagctccaatgccaacctcctggtgtttgtgatggtgtaaataataaaagaagtttagttcagtgtataataagtaatgaaagctagagaaaaatgaaaagagcataatggtgcttacctcctagtgactggtccagggctgcttgtttgtgatggctgcacttgtgtttctgcagctccttctctagctgtaactgctcttgttcttggtgtagttacttgttcatcactaacaccctttgatttcttccttcccacctttgttgttgttttcttgttcctcttcctgccaaaagaaaaacagttagcatataacagcaagaaaatgaataataattgagatgaaaatacagcacacctctttttggtgccagttagttcacatctagcacttcccttcctgtgtccaaagacaccacattctggacacttaatttgccttgtagccttccccttgcccttctcaagagcagatgggatcctattcttcctttgcctacccacttttcttttcttggacacaggagcaagaagcttgaattctttctcaacttgaggccattgcttcttgtctgtaatgttagggatggttgatgcatatgctgcctgaaatctgagcacagagaaagccttatcaacatatttctccatatttggttgcctcacggttgtgatgactgccaatgcatgttggcaaggtttcccagtaacttgccattccctgcaggtgcaagtgctcttgccaaggtacaccacatgccttgttagctcctcatcagtatgtatctctgtaacgtcagcttggtaaggatc

SEQ ID NO: 83421 - DNA, 2727 bp, Oryza sativa
  unsure (1)..(2727): unsure at all n locations
gcgccccggtgaccccaactccatccggcaccacctcatccggcaatgcggcgcgtccagcctctgcacctgatccagtgccggaagggcgagaagaagtgcctcatcccgagcacgttcatgcgcgtgttccagggcacgcgcttctgcctgcagccgccgggcgacacgtacacgcggcggtcggcgttcgacgccatgctcgccggctgcgtgccggtgttcttccacccggcgtccgcgtacacgcagtacaagtggcacctccccgacgtgcacgaaacctactcggtgttcatcgccgaggaggacatccgcagcggcaacgtgagcgtagaggagacgctccggaggatcccgccggacgtcgcggagaagatgacggagacggtgatcagcctcgtgccgaggctgctctacgcggaccctaggtcgaagctggagacggtcaaggacgccgtggatttgacggtggaggcggtcatcgagagggtcaagaagctgaggaaggagatgcacggcgccggcgcgtcgtcgcgactctcaacggcattaggtgcaaacaccaatggaggtttccaatcgagttagaccagatgacaaaaatagttaaaagggatatgatagttaagttggagagcaaaacatgggatttgaaggagtttgatttcatgtttaagaaaacgtaatttgatttcacctcaccgtacgtaggtggccgaatgctgaagcatgcgtgtctctattggttgtgggtaggctgaaataaaattttgatccgtgcttcgtggaaatggattttcagccgagaggatgtctctcgcatgccatctaacaaatgagctttgacatcacaaattaatacgtgatatatcgcttgaagttaaaattcaacccaagtcatcgcaaaagaaataaattaaactctaaatagttcatgtacttgtgtaagttgaatttaaatattcatgtttgtaaattgatatatcaaatactaacttctctttccatttgaaaaaaaaagcgtttagaccataagaaacgagtgacacctccttttggagaaaaatactttcccagtgcttcatacacagtagcttttgtaactagtgttatacattacgaccgctaggatctctttgattcggcaagaagattgcaagggctcgggtaggctgtgcatgggaaaagacttttcatacaaaaggaaaggattaattaaagagaaccagagaattgaataggtatggaattaatcttcttcatagcttttgatttatttggtaataaaaggattaaccgaccaagaccaggaaaggaaatggtggcagctcgcgagtggtggccggcaatcgacgagatatttaactatctgccatatttagatgtggcaattaactatttgacactagacccacatgtcatagacacgtgtggatccacgtgtcattaagataggggtggcaaatagttaattgccaaatctaaaagtggcaaatagttaaatgccccgcaatctacacgccttgagccatttaggcatatctttgatgtgccgccgctcgcttgtggccattgcgctacgaggagtaggcgtagtgaaagagaataaaactccgaccttgtcgtgtaacactccaatcgttgtgtgggccgttgggctttagcttttctattcagctttgggctttaattcttctcggacttttttattttctaaaggaataagttcacttagtgaccatcaaaagtgattgaaatctaatccgtaaccctaaaccacaaaaccggatttggaggacggttttgctgacgtggcgcctatgtggcggtattgaccgggtctcctttacaagtggcgttgaggtggcatttagaatttaaaaatatatgtgggacccatttgtaagtgacacattaaaaattgtgggacccacgtgtcccttctctctctcccctccctccagttccttctccctcctcgccgctccctctccctctctcctgcggcgggcggcgagggccggagcggcggcgggcggagacggcggaggcgcgggcgtggcacggcggcctgcgactgcgagcggcggagatgcgggagtggcggcggcaggcactggacggcgggcagcttcaccgcctcctcgccgacgacgaccaggcgtttgagcaggaggacggcggtgggaggcacacgcggcaggttcgacgacgacgacgacgtcctccaccgtccagattgggtgattggctccggcgtgctggcactagcgtggagcgtggcgcagctgggttgggtggccgggccgcttgccctcgccggcttctactgcgtcacctactacacctccaccctgctcgccaacgcaaccgcgcgccgcaccccgtcaccggacaccagggnaccgcacctacatggacgccgtcagatcatacctcagtaagtactcacctcctcaacaaacgccatttttttttctttctcatctccatcttgttggttaaacctgaacgcaatgccaaaatattttcagagtcctagagaggtgttccatgttcatgtgcggaatctcccagtacgttaacctgtggggcaccatggtcggctacacaatcaccgtaaccataagcatggtgtgagtaaccgaacagatcaccccaactcccctcccaactgaacttcgccatcggtcaggctactaaatttcgtctgtttttatttcc

SEQ ID NO: 83422 - DNA, 1845 bp, Oryza sativa
cttcggcatcacgcagccagccgggcaggtggtgccgcctcgccggtggcgaagttgggggtcagaattcagatccccgcgcccttgacagtttccataccgaggcgtggcctctgcgcgcgcgcgaatctgagctagatcaccgcgcccttgtcgattttccatatttggcgtggacgggcgcgtgcgagatcgcgagatgcgaaaccgacgaacgagtctcgtctcgcggcggcgacccggcgcgccgcacgcgggggcaatcgactaagagagagaccaagagagttaatgccccataaattaagtctttgatccgagaaactaatcccgtgtcaactcttcaggggatgcgattaccgtgcaacccacgtgcaacatcacggttcacccccaattcaacctcgaagcaaccgccttagctacctgcttacacacttcggccagaaaaatcgatcgctacagctgaatttacgagaaacctcttgttaagattgaagtcgaaatttaggggctctttgaatcatagtaatagaaaaatggaggaatatgataaacgaaaaattatgatagaaatgtaggtagaaatcagagaagtgcaaaacatatgaaaacacatatattaccgtttgattggattgcaggagaaacacacgaattgaatgagattgatagactaagagaaaaaattcaagaggtgaactctggctaaatttcttctaaaatctatataaaattatctattccacataaatttcaaaagatatgatatgatttaatcttttgttttaaatgcttttataaaatttttttggtatgattgaaatcatccaaaatttttatatttttctccaaataaaaaaggccctcagaaagttctaaacgttgggtacagaactatacagtgcccgagacttttcgtctagggtccagagattatgcacatgtttctcaggcacacctgcatgcatttgattggtaaaccgcttctactcacaagtcacgtaaagagcaggtacaaaagagcagactacaagctagctataagcatattttgagaagataaaagagaagagagaagagtagcgggctatatatttgtagccaactacaacacacagagttcaagatgcacgtgtgtatgataggtggggccaagtctgaattgtgcattgtatgtttataggtaattattgtatgaattggctactaaattagctatagatgatttggagccagtagtcggctatattagtattaaacttgctctaaacagtttctactcctgctacaccataaacaactcacaagtcgcatctgcacagaaatttactccaactaattgacttgctcattgcatcccagttaggtcttcatcacacatgacacaggattcccatgacacatgcatggtggtttcgagatttctcattgtctgttatctgaaacctgaaggctgaaactctccacggccatggagaggaccggcgcccacggcggcaaacgcttgctgcctcgcctcctcttcctcgccgccctgtcggtcacgccgtggcttctcatcttctgcctccacttctccgtcttcgatggcgcaccgccggtcagctcgccagcggcgcgccagtcgctcgtcgccgtcgtgtccgagggcggcgaggactcgcagcgttttctcctcgagcaagaggagcagctcaggaggctcccgtccgcacgcgacgtcacgacgacgacggcggcggcggtggctggggacgcgcacgcctgcgaggggcggtacgtgtacatccacgacctgccgccgcggttcaacgacgacatcctccgcaactgccgcgagtg

SEQ ID NO: 83423 - DNA, 3136 bp, Oryza sativa
cagctgtttctcttgtaacaaaaacactgtgcaacagacccggaaaaatggttgacatttattactccctctgtcccaaaaagactttaactttggctatgaatctagagaagcatgtccagattcatagtgaaaaatgaagtctttttgggacgaaggtagtagtacctaagtatctgctcttccttttcagataacagctatggtgccaaaaataactgcattgcaagaagcactgcccaaatctattggacttctttcatttgatggtggtatagcaggtaatggtggcagccaggtttttaaattacaatgtgtgtgttctgtttccgtttggcctgttaatacttgcccaaaagagaaggcaaagcatagtatatctgaagggaccatctatcatcttaggagcactcaagttcaattgaaatatgagatggcattggtgaatagcactccataatatatcttatctatcctagatattgatgctactcagagactgtattctacaattcttcaattgattctgtgaatgttgcgaataggtcttaaagtggtgttattagtaattatattactccctccttccaaaagtctaagtcctatttctttttgcaccaagaccaagaagcaattaattcattcaccatgtgacaaaaccaatgaacatgcaaccaataaacactaaaatggcttcttgggttcctatcaacaatttaatttagcacataatgactacaagtaggacttagacttttggaaaaatcaaagaatgaaataagtcttagacttttggaaggagggagtattatattgcacctttaaaggacaagtagttgctagtaaaatggtgtattgccaatttagttcctaaagtggtgttcgagtagctataaaaagtttgtagtcttttgttaagaatgggatggcctcaatttctttggacattgtggttattgacaggctcatttatagtcaccatataccaaattaaatattgttaaattccccgcacacttactactaactgcagcttgtgtatgtcataggttgtcagaagatagttcatgaaatattgacttgggaagcaaaatcagaagtgaaaactgaagttcttcatgatctcaaggaaattgggagtgctttgtattggatgagccttctggatattgttttggtgagcatatgtttgtacgcaacttcattagtttcttttctagtcaaaatggtgccctgccgtccttctctgtgctgttgcatgtaagcatgtgtcctagaaactaagcttatcgtagatattgaaaacaaaaacagtttagcggtatgtagagtatagtcttgcagtacacctactgagaggagttgagcatcccttggtctttgcacctaggatatgaggtagagaatccatattattacttagtcatttgtattttattgggaccttgcattatgaattatctctgaaagatttctccaggacaagtttgtgtctcctcacctcatgcagccatattaatgctttttttgtccaatctgctcactgttatgctgttcggtttataaacattataaattactggcctatgcggttttcccttacacaatggaagtcctttcaattgtggattttttttttattccagtcacatatttgttatgaagtactctcgttatcttactgacaagcatgctcatttttccagagacaaatagacactacacagttcatgcagtctgctccatggttgggattgattccaggaaatgatgggcaagtgaagcatgcatactctgataatactccatttaccactttgttaagtgctgccaccaatgcagttgcatcaagtcctgcatgcccaaatccatcttcatttcttgtcatggcaaagcaagctgaagctgccagtaagtgcagagcctatttattgaatcatattttcaaatgatagttttgtgttgaagtttttttttagataatggaactttattgaactcagccatgtgttgattttttttagtatcaaaaaagaaaaacaataagaaatttgttgtggacccgtgccctccaaaggtttggcaggaaatggctatctcaattgtatcaatggtgttatgctatctaaaccagttagtctttgcttgaatgggttgagtacgggtggcatatcatcctaattgttgttgaacactgagatttggttgaaatttctacaggtctactctacaaatcaaacctaaactctgggagtgtgcttgagtatgctcttgctttcacgagtgctgcgctggataggcattacagtaaatggagtgcaactccaaagacaggatttattgacatcaccacatcaaaggacttttatcgtgtttttagtggtcttcagtatgtaagtagacttcattatcaaatatctgttacagtatgtatatctatgtcatccatcatttacagaccttttagccaacagctggtaacaagaaatgttgggtgacaataaatagttttatggtaataaatagtttttcttcttttttttttctttagagctacttggaagagagcatcaatccttcgaggaaacaagaaatgttgggtgactctgtagcttgggctggctgtacaatcatgtatttactgggacagcagcagcattttgagcttttcgacttctcttaccaatttctcaacgtggcagaagtagaaaatgcaacagtttcactttatcaatattcagataggaacaaaagcccgaatttcttgcaggtgagatcatttcccgatgttctagatctgaagtaaaatgatactcataatattgtacttcatttttatttccgacattcatgatgtgcatgagtagggttacgagggtatccttgaagcgatgaggaaagccaggaggctcaataaccatgttttctccatgttgagagcacggtgccccctcgaggacaagattgcatgtgctatcaagccaagtggggcgcctcttcaccgtatgaagtttacgaacaccgtttctgcgttcgagacattgccacagagagctacttgagaggctattcggcgtgtatgtgtttccttccttcttttttttccttgtacgtgtgaggtcatatgttttatgtt

SEQ ID NO: 83424 - DNA, 10887 bp, Oryza sativa
cggctcggcccatcaccggcttgctcggcaacatctacaacgggcaggtccccttcgcgcggcccatcggcttcgcgacgcccaagaacggcgtcccgatccccaactccaatggcgccatccccacgtacaacggcaacaacggcatcccgctggacaccggcctctccggcgctggtttcctgcagccggctaagggcgcctcggcggcgcaggtgcagctcggccccgacgggctcagcctcgggttcggcaccatcaccgtcatcgacgacgtcctcacgagcgggccggacctcggcgcgcagccgctcggccgcgcgcagggcgtgtacgtggcgagcgccgccgacgggtcggcgcagatgatggcgttcacggcgatgatggagggcggcgagtacggcgacacgctcaacttcttcggggtctacaaggtgggatccaccatgtgcaagctgtccatcaccggcggcaccggcaagttcaagggcgcctgcggcttcgccgaggtgcgcccgctgatcgccaccgggcagcacgtcaccgacggcgccgagacgctgctccggatcagtgtccatctcgcctagtatagtacctggagtgctcgaccatgccataagttttgccgttggttctcacgtccttgggttgggttgctttgctttgggcgtttcatggttgcgctgtttgctccatgtgcaatgatcttacaagtgtgtgtgcgtcctctgcagggattaaactttatgaaagcagaaaaacactttagtattatggtaaatccatttgggaaagaaagttactttcatgtgcattcactgtaagttgggctccagtcattcatagcatattagcagcctcaatcacaacggtatttcacttcaacgctaagaagaaactgaattggaaatcatgatggatgtacattaacaacgagaatcttagattttatcagagaaactagcaagatgagaaactgcgtcctcaaggcgcgacaagtgtacagcaaacctgtccttcagctccgccaagtctgtttcactgagagcactccgcatgatcttgagaccgttctgtacaagcatcattccttcacaaattctatctggcatcttcctcttctttgtttccacatcattagtaactgaaacattctcaggcattccttcacaaattccatctggcatcttccttttctttgttttcacataattagtaattgaaactttctcaggctctggaactagaggaatttccaagcatgattcaaccagtttcttcagcattctcccctctgaaactagtgaacatatttgctcttcagaccatttgtcatctcgcaaggctacctctttctgaaggaaggctttcaattctgacataaacccatcctcatctatgtccacccctgtgcatgtgtaggaaagggcagcatctacaggaacaaatttccagagctgtgcaaaagaagtgcgagcggcaaagtacccaaaggaacccattgcaaggtgaatgagtgcccaatgccgctccctcagcaagaaatggaacagatcccacattgcagaacaaagtgggtttgcatcgtcttcagtagtgttcaagtgaccaagaattgccataaatgaagccattgatggtttgcactgagagattgctgtatttgaattatcaaaactggacatgaacagagtgtgcaactccaaagttaacttctccaactcactgaacgcacaaagatgcctcatgtgcgtaataataaccaatatggaactgatgtgcttgacaaggaggttcttactgctatcaggtgaagttctataaagattaatgagagaggtggcaatcttgaacatagtagcaatacttttttcatcaatggtaacgtcctttatttcgctgcataaaatattgtgtacaaaagaattgtttctttggttccaaaaataaaagcagcattttagcatcagactgaataatagtaagagacaagggacttaccaactctggaaagcagaggctagagcatgtacaggaaaccctattatgcccgaactagaagaagttggcaagttgatttctccatgattcttgaagtagttctgattctgtagatacccagcaaaagaagtgaacagtgtcttcacagcatgttcctttacaccacgagataatgaatcaaaaggaaatccttccatcaacagtgctaagtacaagatcgatgacttggaagagctatcattcagcatggtataaatttgatcaattgttgcagacgatgcatagctcaagatgttacatgatgcacgagcaagcttcctcagagcactgagaggtgcaagaacttcctctggtgacgctagagtctttaacagaagaaatagctgattgattaaataggttgaagtttcagcttcagcataatgcatgaagaaacaccatagctctgttagaatttccaagcaaaggaaatggggatggaaaaggttctcaagtaagaagacttcaaactcactccaagcagcacttgaagaagaagcagcaatcataaaagtcttcaaggcttgtataagagaagtatatacaggttgccagacaaccttaggagaatcatcatcactacttagtgcaggaatttggcagccaagtacatatgagtagacatcttccaacgttaaaatattaagaaacagatgtagcttcttacataattcaatgaccacctcttccctcaaccatggggaagcattgaggaagtgcaagaacacagtaaattcagctggtaaaagtgccctgtttatattatcaacatcagaatccacagaaaaaatgcaacccaatgtagcgaaattcattgtatgatcaacttctccggtgtactctgaattaccggttcgtactttttccaaaaagtactgcacgagctggcatttagactctggacttacttgtgatgacttcataagtgtgtctaacagaagaaaggaactaggctccaataactgaaaaagtaattcacttgctgctttcaactggggatctctgcagaacagaatacttgagtgtgaaatcagcagtgcacaccggattatgctcttgtatatagccattgtttcagatggatatatagaacaaatcctagcggcgttcgttaggaaatatttgattggtaagaaagcccttctagcttcagcggtaccaaggacttcttgtaatggtacacaccatctctcagtagcaaccctcagagattcaatggcaactgagataggaattaaaataatctctcttacattcaccttttcttctaccatccctttaccaagctgcagtaaggaaattatgcccttccatgatatattcagtaaaatcacctggcttccaccactggatgctgcatgggttcctattttacacaaggactgaatagtgcatgctgtaatctgggcaatgttgctagtaagatctgtctctttgtgttcctcagttgtctcttctttaggcatgctcattatgcactggtctgattttgcagcctcggagtacactctgcacagtttgatggtttcatctagaaaaacaggtgcagccttagcaacatgtcctgtagttccgagtttctgtcaacagagagcatagacaatgactccatttctacaatattagcatttcaatgatttgaaaagagcactaccatctcatatgatcaaagttggataaaaaaacataaattttagcctgacgaatctatgtattagtcaagggtaggaagcacttccaattaaaggatgaatttccaatattctcacagaaaacatctctttaggagtaaacaaaacttgtaagtaatttgaaacagataaggtctattgttattgtaatgtcatggaggtaacatatttactctagttggccattatttgctatttcccctttagatttttgttgctaagttactttcaggagatgaaggatatatatatgcaagatagcatataaaactatcttataggacataaatcaagcaacatgatcataaaaaaaaaggagagaaatatagatttcggtcatgcaagttaaaccacctgatacgaccattgtgtaatataggaactgaaccgttaccttgtcaagtattgagctttcagtcagggttagtaactccaaaataaagtcgccaacagcatgcacagtatcttcggcaatgcatttagatgcaacagggaggtgcttggaagagatatttaaggtcagtgcaattatctgcagtcaaataagttgaacttgtattggaacattctagatagaatcacagttacagaaaggaataaatgatgtaatgaatctccagaatgtagaacaattaagtataaactaatatgagctggtgaaaaaaatgtagtgattgagagtagtactgttcacttgcataggtctgcattgaaaaaaaatgtagtgattgagagtaatgtacaaatgttctttctgttattactgataactacatgtattgcaatgaaatacaaacagatcttttttaagagagagagagagagagagagagagagagagagagagagactcaaagcccttgacctcaggaaataatctggagtgttcttcctcttgggcatcttcagattcatcaatagattcaacagaccacaggagatgcctcacacaccacgaaccagcctggcataggtgcaccaaaaaacaagcaaatgttttgattggttgagccagaaagcagataggcaggcaaggtaggtacagctggcacttatgatgaagcaagactccatttggaatggcaacaagtacctttgaaccaagagtaagaaatggccccaagcaattggttgtatctaattctgagcatttaagagcaacctgcagaattgacttgtgtagcatgcagtgtgatacaccggaacatgtggaatcatcccacgatgcctaagatgttgtcaaggtaccataagaaaactccttactagaaaacactgacaacgtccactaagaaacaatgaatcagtgagtccatccgactggctacatatatcatcgtgtttctggatatatcaagtataccgagataaagcaataaaggatacgatcagactttcaaccactaggcccagatcatctgcacacaactgaaaaggatcctcgagttggttgataagggaaattctgttctccaaaacctgctattatatacagatcatgttgttattaatgcctggaagagtatggattaactagagcgcgcacaaatccccaaaccccaacggccaacacctacagaagttcgcggagattcatcttaaatcccacccagaaacatccattcccccatccccaccccccaaatctacatccattccactcgaccgaactctctattcgtggaaaccaatcacggccgcagcactcgaacaatgtatcaagctaaaccctagaagtggcctaacggagcaaatggggacgaggagccgcacgagcacgcacctcggaggacttgatggcttccacgagggacccgagctcgctcctcctcctcctctcctccgcctcctcgccggcggcgccgccgtcagcctccatttccctcccccgtctcggccgtgcacctcggctttcccgcctcctcccacccctctgcgcttcgtggaggccaatgtccaatcagctggagatccaggccgagatcatttgtggccgtccatgggctgaatcggcccattccgctccactttagccggttcaaacggtttgtcgcgactctcgttggaaacagttattcgcttggttgacttttgaacagtactacttctgatcatttatctcattgaaaactagtacagtagtaattgtcatacttaagttacttagcaaaaaaaccaaataaacgataattatatactcctattctttaataataggaaaggccaaccgatgaagcccttagttgtcatctactgtaaaaaaaaatgtgaaagtcatatattagtttacttaaatgccgtgggaatggctgaagattagcgtgccacctcagccgtcttttgcaaaataaaccccatgcttttgattaattacgtgccggtccttgctatgtccaccgtccgatcttgagataggctcgatctggccgtcacgttccccctttggcggcccttccacacccgtgggatcgttggatctctaacagacggtgtggatttcgccaacacgtccaaaccctagccgcccgtcctctcctcccccatgcgtgccgtctcgcccttctccccccatcgcgccgcatcctcaccctcctccttcctcgcgtgcgtcgtcgccgccgcaactccctcctcctccactccctcaacccctccactccctcaaccatctcgccgtgccgccatcgccgcctccactccctcaacaagccatctcgccgtaacgccatcgccgctccctccccgccagatctcccagtgaggagactagggccgccggatccggtgatcccattctccttgccggcggatccggcgccctagagaggaacgagagccgccgccctttctcctctttcatccctgccacgccactgcctcccaagccctctccaaccatttgattcatcggccttggcctccccctccagtggatccggtcgccagccggacggagtcagcaggccgccgccacaccctcttctcctctccctctccatgagcacctcgctcagtgccatgagaagggaagggagagcgtaggctcagccacgaccgcgacgaaggcaaccgcggctcggcgacgatggttgcctgcctgcctggtcgttcgttctctctcttttcctttgttgttttacctcagtgacatgagaaggaaggaagtgattggacattagttcttgatgattacagctttgatttgcttctaacgtgtgaggcttgatttagttacagtgtgtatgttatgtagaaaaatttccctctgcatgtacctcaacactgtcatgtgtgatcaaacttttttagcttgaagcaatgcacactgctactaaaatttctatatgctatgattattatttattcagtcaggaattgcatatacagctatggggggcaaaacgataatgttgataggtttatttgttcccatttgtgctgcagggtgtattttcatattcagatagttttggaagctacaagtacacatggcttacctcttgaatgtacatcaaaagagtttttcatatgctgctgtactgtgttcctcattttcagtgatgaatgctatatgctcgaagcacattcattacaggtatgctccacaccaatttccatatggtttatttttgttcatctactatatttcctaaaatttccatgcataaatatttatgttagctcgaaagaaatctgtaccgttatttgccattacctttgtacagttctttcattctgtaatcttatcttctcgagtggtattgatgtgttgtttgcatctgcttgaagtgcatacactgcatgcatgcttcagcttcacatcaatgttcatgtatgatcatctaatatatggtagcagcatttaactcagtgaagtctttcattctgtccaccatttttgctgctcaggttttttgttccaactatataaatgcctagatggtgaaaggaatttctctgtacaaaagagaatgctcatttatttaagtagtaaggcatcatattcttttagattttatagaatatcttagcaaaatttagagatattagagccaatccttcatgccatatttctgtacaaaacacgaagggtgactgatatcattcctttgagtgatgaaaagaaagatgataccatttttgagtgatgaaaacattatcagtctctagaatgacctttatttattcatgcttcatgacatgcctctattttcttttttattaggtcgcaaaaagaaatggatatggattgggtccatcatggaaacagacacaaatttcttttgaaggtacatttcaatttagtttgtgcatcaactggttcaatgggaatgttttcctagacatgtcctaaccgttgcgatccaatggtaaagcaatatcataagtcaatctttttaatattctgtctttcagttggtttgcttttacatgtctatgctcagagagagattatttcactatttagttcaccggtcttttttacatgttttttttcattaattgtgaaaccacacttttaaatcctaaaagttgtggagccgatctgtttcgtcaaactatagtgtaacatgctgcttctgtgctctacaaagctcattgtttccacattttatattacgccagctacttacaaaagggccagagaagaaaaaaatgggacctacctgaagaagtatgcaatgtagaactataaggcttatgttattgcatccatactttggttaagtgatcatgcatgctttcgctcgtaaactttgccatgtggtagtagcactttgtactacctctgcttcgaaaatagatagaacttctggtagaaaaattggtttcatgtgttagaactgtgatgccaggctgaaaatattatctctctatatataaatggttgatactatactattttagctgtactaacgttattaaaactttctattacctttgtcccaaaatgtaataacttctggccctatatcttgaaaggaatgtttaggtacacagctcaaaattgcaatatattttgggacagaggtagtatactttttttcagctgtactgatgtcactaatcgcacataacggaggattgttgttgactagggcatcggcatgctacacttgaaaaaaggtcattttctatctgttcattttagctttgcatgcatttaatagaaccaccagttggcatggtcttctctttgtagcatccaatagtccagtgtgattctagcgtatagagaaaaaggggtaccatgaaacctctgtaaactcattgtaattgacatgtaatttgcctttttttttctatttattcaaacttcctatacttttgatttcctcctttagcctagacactatttttttgtgtgttccaatttttcttacaagggtcgtttataggatatagatgaaaacatgaaccaacgctataggtgaatatagatacatattattccttgaacatattggacttcaattgattcgggcggcgcggcgtagcgcgcttctattgctagatactttacttaaacgtcgtgggagtggtgaaaatttaggccgccacatcatcaatttttttcaaaaaaacccttgctcttttcgctaatagcgtgtagatccatgttaacatggctgtcggatcgcatgctagggttgatctggccgtccacgtttcccggcctgactgcccttccaccatcatcagatcgttggattaggggaacggacggcctggatttgccaagaaccctagccgcctttgccttgcgtgcgtctcacgtccaactcggccgccaggcgctcttctcgcctgcgctgcctcgccctcctctcctcacgcgcatcgccggttcgccctcctcccgccgccgccataccgtcgccgcttctctccccagtaaggccgccgcacctgctccggcgttcggtctcccgccggtggatccggccacttggagccttggaagtgagggagcaagccgtcgctaccaccctctgctgctcttcttctccgcacctccatcgcccctctccccctctcagctccgctcagtgccagatccggctcaggggccgccggatttggtaggaggaggaggtagcagcagtgcagctattgaggagaaggaaggaggagggtcgcgacatggccattactgtgatgagaacggttagggctcggttaggtcgatggctaggaacgacgacggctagcggcttggtcaggtcgacggtaaggaacaacaatggctcagtctttcctacgttttttctgcttttcattttatttttctccgggagaggcaacctgatattgttgggctatttgcgctgaaataatatgacatcttgcctggatcacctactgatacgcattggagtcacatcgaggagcccagagtaaccttccgttctgtctttaagcaataacaatcccaattgtgaatttgtgatgtctaattttatatctctaaaatcccaattggcatgtccaagatacacggacgaagcaatatctgttcatgaatgtgatttgagcaacatatataacaagtaggttgtgttcagttttttttcctcggctcatatgggaaagactagggatgattttgatttatttattttcttattggtacttaaaaaaggatcatttttacctgtttacacatgagtgcttgcagtactaatacgaatcattgccatgggttaacattgaggcgattacgccacccaatttggtgagaagatagcaggtggaggttagcagggctgggcatcccttgcttcaggtcttgctgtccattcatgctgctaggacatgtatgttggtcctatatacccttcctcagccaccatcctgcttttcttttgcatctgttatgtatgctaaattgctaatttccgcatcgcattatttgttcttagttgtagctgtcttcacttagaatgcacatgcctattttcattgcctggtttcttcgttgtctatggtaagttcaagtcggttaatgcatatgtttgtgtttcggacttttttcttagaatcaacaatgttgtttagtgacacacattattttttcccctctactcttttagtttgatatgaaacacatttctcatacactccctccgttttttaatagatgacgccg

SEQ ID NO: 83425 - DNA, 6522 bp, Oryza sativa
gtcatctattaaaaaacggaggtagtatttatttttattcttagaggtaatagtatgcacacaaactgagcaggtattcttttcaggctcttttgaagaggttaggtgtttttatgtgatctctgcaaattattgattctataatgaggttgcgtaaatatgaagtatgatattatctagattccaattacattgtgggacatagtaattctcattgctattgtaggccatagtgtattgattcctgtgcatcgcttctttctggagttcagttaccacgttggtgcttcatatgcaacagcatggaccaatttactatgccatgtcctaagaaggtttgtgcatgacaagaaggtatctaagataacactctttcgttaatgccaactgttaaacatagaaatcaaagtaatttattttgctaccatttcctttaggtggcactcacatattgttcaattgtactggggacattaggctttattactgttattgggatcaatcagatatgcgttttctgctggttttgctcatggctatgtacacaagaaattttagattataaaataaatatgatggaccaatgtttccagctactacttccggtgtacatccttttttattatgtgtcacttcagatttggtctttgttcaaacctgcctataatatcaacaagaactaaaactgaaagatttcaacaagaatcatgtacttgcaaaaccattgttcaaaatccaagatttcatccctgaagtgttcgtttaaaagttaaggcaattttctgttccggattagcctttcggcctgcatcaatggttttaaacaatctggttggattcagttgccctatgagttacttttgtagtactgatgaatctgaaaatttaccctgagttctattgggttctaagttaatccatggtgtattcattcaaagttggcatcccataccacataccgctgagataatatattgctagtttggtggaactatttcactgattatcatatgttatcacatattggttgcatatttgtgcaaatggctgaaacaattctatttttatttaatcgctttgcctttcaagctatattattgtttcagactttgtgatgaactttcttgcaagatatctaaagcttatctcaaagttgataagttatgtactaatttcagtattatgtttgcttttgtcagggctagagaatatatgcattagtgtacttgaaacaaaacagggtagagtggcccaatggcactatttgtctttccaaatcgccactatgtcagtacagataaacgaatagaggtatgatcatttgtatatggtttagatttttcaacaatattgtatcaaagtattgttttcctcatatcttggactgtagtatgtccttgcaggatgtaaatgttaactcaagttacatttcatgaacatatttggatctcttttttgtccacacgcagcgtagcgcgtgtctattgctagtagtaattagacacagagtagatatgttccaaaggtggtgagaattaggccttgtttagttgaagaaaatttttaggcttggttgtcacatcggatatacggatacacatttaaagtattaagcgtagtctaataacaaaacaaattacagataccgccaggaaatgcgagatgaatttattaagcctaattaatctatcattagcaaatgttgactgtagcaccacattatcaaatcatggcgtaattaggcttaaaagattcgtctcgtaatttacacgcaatctatgtaattggttttttttctacatttaatactctatacatgtgtttaaacattcgatatgatttcataaaaaattttattttcggaagtaaacaggccttactaatgctagatcgatctgacagaggccgttgaccattgattcattgaattaatactcctatctccaggagtgtgaatacggtgtggtgtccagcctctggatctgtcggtaagacagtaattaggagtgcactagaagcgcactaggtcagtaatagcccaaacctaaacggctagaagtattgacgagttcgtcgcatctgcattgtctaattttttttttcgagacgacacgtgttcttacataaatatatatacgctcattactataaacacacatagtaccgtataagcatattaaaagatttattgaaaccgtattgttttgatatttttgaagttgtcatagacatctcatcaacaatagccaaatgcctcgaaaaaaaaagcgccaaatgcgagcacccgtaaatgcaatgcctagattttggtaagttaactaaggctgtattcgggaggtgagatggggaactcacctcctgtgcatgcaaaatagagcgacgcattttcttatgattaattaagtatttattttttaaaaattatattaatataatttttaaagcagcttttatatagaaaattttttaaaaaaacatatcatatttagccgtttgaaaagcgtgcatgtggaacacgaggggtgtgagttgggaaactcaccgaaaataatacaacctaattactccttgaaacagcgaaccatcattttcattcggtggcggagctagacccggctaccatgggcaatggctcgggctccgcctggcaaatgcagctatgcatccatagattaacacttaattagcttgctaattacattgcttagttcactactaggccgtatgaagcaacaccacatcgacagatgtgcttaacacaaacttataaagcaaatgctcatgttaaaatgatctatgtattatatagacttgtatattttttttttgtttgctaggtttgctcgagctcataaaatattttgaatccgccactgttttaattaaatagaggagtaaaactgtacaagtgtacaaagtgaaaaaggagataatgtaatgctcaggaccttcagtccgagcttactaaaactctagacaactgccgagatgtaataccgttgcttataattcacccgtaaatgcattggctagattttggtaagttaactaattattacgagtcttagtttttgtaatacagccgcttgtaatttactgtttgtaatgcgagtacaccagtattttttttttagcaaaaccgatttcttttacttatatttgagagtttgaaccgggctcgcagatggaatcggagagacatctgccccgtacccgtacgtacgtgcgggcgtgccgcggaaaaactccccgattccgtcgaggagtcgatctcctccaccgcgccacacccacatatacaaaatctcgatcccgctcgttcaataacgcgtccgcgcacggcgacacacccgatggatcgcgagcggcggcggctgcgcggccgcggcgggaacaacaaccacccacggcgcgtcctggccgacgtcgtcatccgctgcgaccccacatggctggtgacgatcctcctgttgtcgcttctgctactggggaaggcgacggggaccacggcgacggtggtcgtctccggcagcatggagccagggatccggcggggcgacatgctcatcgtacgggagcggcgcaacgacggcgacggcgacgacaacatccgcgccggggacatcgtcctcttcagcaccgaactccaccccgtccccatcgttcatcgcgtcatcgagctccacgagcgacacgacggcggcgcgaggcagatgctaacgaaaggtgacaacaatggtgtcaccgatagaagctccctctacacggggcagtggctgcacgatcaccatattttgggaagagcagtcgggtttttgccttatcttggttggccgcgttgcttgatccaagattttgtacttgacaaactgaatttgtgacgccggtaggcaggtttagtggaagctttgagcttgtttcaccgatgattgactggcttgtgacttgtaatgcgagccatttgaagttgtcgtagtgcttgtgggtagagatatgcaagtgtaccggcccgtgaatacaattgtaggccaaaaaaagtgggtaacctgtaggttctcagtcgtggttcggcttgctgcacggttatgggcaattagaggttaataattagttgtgtttctttctataaggtgaaaccccacgcattgctgcgggaatttagtatgataacaataaaaaaacatgtaagatagctagataacatcagattaagtaaattaatatggtttataataatttaaatttaaatagtatgtagaatggtgattcaaacgtaaaaagtaaggtggtatgactttatggaagaataaaattaggaagatagtttggaccgtagattaatcatctaaatgctaaaaacaattgatgtgatatgacttatttagaggaaaaaaggagaaagataatttagaccatagattaatcatttaagcactaactaagtgagaatgaactatataagtatataggatatcataaaacataataaagatatacattgaaacattattttcaattatgtgaattatgttggatgataatttaacatgtttgtatttgaaaagctcttaaattataaaaactataaagatatagcatatttgcatgatgtttaaatgtgatgattgttagtggatgatgatgtggcatcttgttaattagtggatgatgatgtagcatctttgcatgttaagtttaaagagttagtgggggataattttatagtaagatatgatttctctgtctttttttctcttggagagaggtgaaaaggagaagtaggttgtagaaggaaaaaagatatacagtacatataaaagtttttcttacatatattttactttgtcgtttcggtaatgaatcttgattttttgaattcaattgttgagaactttataagagttctataagaattatttaagtactcataacattactcactgcagtatgtatcaccagcagaccagctctccactcatcaactctttctcaatacaagtcgtaggagtgaatgtacttaagtactagtgtcagaaaagaatgaaggactcttgaaacaaaactggaaccagaatgccattttctggctaaaagatccgaaacatccaatgggagcgcagacgaacccactgagatactggctcacgtggcacactattcatcgcaaaaactagcatgtcaaaaaatacattcgtattcagcatcaactggtgctacaatattatacactggtccgagcgcgtatgtagaactgttagtgttgacatcttaaacaaatatgaactctcattaaacaatcaatcactggtaattacactggtgcacgtctgtacaactgttgactgtgtatgtcacacttcttttgagccacaatttaaacttatttttaactcgatgacatgttaaacaaatatgaactcattaaacaatcagctagtaatttaatgtctcccatgcaggtgctaatatactgcactctctgtcaactctgcaccgaagcaagtgtgcgcaattcaccaacttggagattagtaacaatttgagcataggctctacagtctcggttagtccccccagatctccattgcagcagagtgtcgccattgcaagggtgcttggtgaagcgtcctctatagggatagtctttgggtcttcgtcttcctccaatcagttctcgagacattggtgttgctgcagtatatattctacactcgaaatgcatattagagtgggcagcacgatcagacaagtggtgagccaaagctgcttcacatttttcttccttttgatcgaattggtctctcgcttgcatttcactccatggatagacgtgcatgaggtttagtgtggtgattagttcttggatcttgaatcggcagctgatcaaatccgcgccgaaaggcggtggtcggcagcaacgccgggcgaaggggatggagaaggtcgcggttggcttgttgccgccgctgcggttcatcgccgtcctcgccgtcgtgtcgtggacgtcgttcatctactgccatttctccttgctcagcggcgggttgctgctgggccacggcggcggcgacgacggcgccgacccgtgccgggggaggtacatctacgtgcacgacctgccgcgccggttcaacgacgacatcctccgcgactgccggaagacgagagaccactggccggacatgtgcgggttcgtcagcaacgccggcctcggccggccgctcgtcgaccgggccgacggcgtgctgacgggcgaggccgggtggtacggcacgcaccagttcgcgctggacgccatcttccacaaccggatgaagcagtacgagtgcctgaccaaccaatcggcggtggctgacgcggtgttcgtcccgttctacgccggcttcgacttcgtccgctaccactggggttacgacaacgcgacgagggacgccgcgtcggtcgacctcacgcagtggctcatgcggcggccggagtggaggcgcatgggcggccgcgaccacttcctcgtcgccgggagga

SEQ ID NO: 83426 - DNA, 6562 bp, Oryza sativa
ggttggttggcgatgcgtggcccagccgccgtgcgtcccgctccacggaccaacgcttccgagcccccgatgcgcgcggccctaggcacgcgaagcgaaccgtgtcgcgcggtgatgccctcgtacgcctcgcgggccgtggtcgcctattagccgtgatgcggctgcactcctcggacgcctcgcgtcgcaggccgcattcgctggacggtcttcgctgtcggcctgcggtggaggccgcgcggccggcacatgcgaaattggcttccacggaccgcgcacggagcgggccgcatggctgtatgggctggcggagtttacacgcctcttctgccgtgcagcttgcggccatgataaaccgaggttttccccctttttttcccctagatcagacatacttgtgcagttgtgcggtgggctatggttgccaacgctgaggtgcacttcggtgagaatctgaatggattttgaggataaaaccgagctattattgaaggttttcagtaatttgttgttgtaatacaaatatttaagaaatacaatctcatacctttagattacatcatatgtcttgttcaatgactataaatgaaacaacacacttatcctttctttcttatatagttacaatcactgctcgcaaaggcatgatatggagaatgcatgagccatataatgtgatatgcacagttcttttttgtcatctattttattagcaaagctgatgagccctcgcctagtttcttttgctgttgagatccaatcccattttaataattataaatatgatttttttagtgttgacaatatcataaatctctatcaagtaaatcaatcatatacataagtatcacaacaacacgtgacggacgcaactttacaatatagatggagcggtgaatagatatgttctcgctcgacaagagcaattgaacccaacacatattgtattaatagttcattcgcataattgtctcaatctattgggtgttcacagttcacatattgttttacctatttttgatggtccatgactactataaaagggtagaggggtcttggagtcgtggggcgacacgggtcgtagctgggtcaatcgacccaccccgcctaatgggtagatctgccctttgacgtggtgcctttctctaactttagagataatggttttgttcggtagccattgctgcacaaccaaaacgctgcaccccaaatttacgacaactggatcagcaatagaaacattgtttaagttgctatagcccaaccacattaacaagcttccaaacagagccaatatagcacgttctcttcgaaaggacatagtaaatgataagtagcatatttttcccgacatagatatgacaaacaataattactccttacccgtaaacttaaaaactacaaatatccgctttaattttctaacgaattgtataactatttattccttagattcctaatagatacgcaataatgaaccaacacaaccaactccctcccataaatatttgtatgttgttttgccgtcagacttgctcacttagtacctgctattttttaaggtgaccgtacatgctgactatttgttttttgaaaaatatgacgctataaatatagttactcccgttgtccaatactttctcgtcagcaacacaatatttcgttaggaagtggattgcatgatgaatccttttgcacaattgtttggcctactattttttacaattataactaatttaaatttcaaaatgttacaaattagagattagaaaggccaaaaaaggcgaaccgtaacagcccaacaaacttcgtctatactcaatagttaagtactccagggagtattaagcagcacccaaaaaaggacaaaaacaactgcaaaaatcgagtacagttcaatcacagcaagaaactccttgtaccctgatatgtcacgaaacgcattcaccgctgcgtacaaaacaggatgcataaaaggatagaaacggcaggcggcatcatcctcattcattcagttcttgttttggccacctggggcgcgtttccactgcttaaaccttaagcaaaccctaatggaaggtgctggttaaccaaggggggcgtgtttagtgagatgctaatacatccaaatcgtccagggagacacagtgcttgctagacacaaaacttaagaaccaccccacccccacgtgaacgccatggggtaattaccatcgttaaaacctatggatttctcgcatcatcgcaagaacccagacaaaaatctcttgctttaacttgcaaaccgaagcaaaaaaccccaaacaaaaaggggtaaaagggcttgatgataaaaaggccaggggatcaaatagaggtgccaagaaaaatcgaataaaaattttccatttctttatcccccgagtcgtgacggcggcggcggcggacatggttggtgataaggacgcggcggcgctggctggagagctgaccggcgacgcgggcgccagcttgaacggcttctttgaccacacggtatgcgtctctctctctccaatccccgtgtgagaggttgggttgccgtattggctaggtaggcggctggaagttttgattttttgcgtggttcttgcagggtttggagtcggcggtggtaggggaggggcaaggggaaggggaggaggaggaggagctggagtggctttcgaacaaggacgcgttcccgtcggtggacaccatggcggcggaggtggagtcggcggcgcccggggcgccggcgcgcgcggcggtggggccgaggaccaagggtttgcggcggcgccggcgggtgactgctccgtggagcctggcgccccttctgtcgcgcccgcgtcaggcggcggcggcggcggcggacgcgggggcgccgcggcgccggtgcacccactgcgccgtggatgagacgccgcagtggcggctcgggccggacggcccccgcacgctgtgcaacgcgtgcggcgtgcggttcaagtccgggcgcctcttcccggagtaccgcccggcgaacagccccaccttctcgccgctgctgcactccaactcccaccgccgcgtcatggagatgcgcctccagagcgaggaggacgcctcggccgccagccgcgtcaacgccaaggcacgccgcgccgagcgcgcggcggcgcgcctcgccggcaaggacaagaagtgatggaacaaaaaaccgttgcctcttccccggcggaggcgaagttggacggagacgattagcgcgtgtcatctcatctccttttgcatttcttttcaatttccattttgtagaacattaggattagagagaggtttaagaacatctgccaaatcttagttcttggcaaggaaagatcgacagacatcaaagcagcctctcgtcatgctcaatttttcctgaaaccatggcaaccttggtgttgtaaacaaagcaagcggtgaaagtgctgttgctgtttttgcttattaggtccctcctattcctggtagtagcagtagcaaaggcgatcaacatacacagcgtctgaatgtctgaatgcgacgtgtgtatctatgccatcatcggccgggcaagccgctgctgcagccttgcagccgaaacaattttgacggctctagcagtctaccagttccatttcttcaggtttggctgctggtagtaatggtagtatggtagactggcagtagaacatccatatgcatatatccatctctgtgtgaggctgaggcaccggcaaggaatgaaaagggcactgtacttattacccgtcgaggcacagtggcgctgtgctggttgtcgattcgtgtcgccgggcaatgatatgttctcatttcatggggtgatgctgctgcagccgcgttgccatggcaagaagcggattaactagttcgttgcctgaacgaaaacgacggtgagagcaatcctcacatggatggcgtcgaccgggagaggcgcaggtcgcgtggtccgcgaactacaggtctacagcaacaacaactcgtggcgctgggggactagctggtgtgtgctggtgcgtagtcgtcgccgcgcagcgcacggtcggtcctgggcatttcgtcgcggtagggggcgcggcatctcaggggcgagatgagatctttatgggtggcagtggcggtacggccccggagcacgtgatggcggagagcggagaggaacactcgcggtctcgcaccggccagattgttgtttgcttgggttgggtacttgcgttgcgtaccaccagggcgcagaaaacaaatgggacaagatcgctagcatacccggatgaaggcggctacagcctaccgtatgtgagatcgcactctgcttatgattttttgtgtggcgtacttcccttttattttttatatctagcagatagttatactccattctctccaaaatatagctcttgtttcaaaagagagcactctctctaacttggaatgtaatcgtttttaggcttgtgcgtaggtattaaggccatgtttcttttagcctatgattattataatctagattattaaaccagattactgtaagctggattataataaactgacatagaataagctgtgagttgtttgtttgtctagattattggaggcatggattattgggtttgaaaggctaaagtctataatgccctcagctatctattcggttgatggtataggtgggtaatttttctcaattatgtaggggtagtgggtctttagccactcaataatctgaaaaaagctcctctagagcagcttattagattataataatctggcttatagattataataatttgctataataatctatttgtttgtttcagcttactcctaataagctagattataataattctaaactgaatcaaacagggcataagaaaagtagtaagaagaccatactatcctatatagggtctgttcggcagtcgtgactgtggctgtggcgcagccaacaacaacagtgccgcaagcatcagtgtaacgtgcgactgttgtatttgcagcgcggtcttctgaacacacccataattattcctaaggatcaattagtaatttagtatgcactgctaggaacttagtggtgccaacctatttgctgtcatcttcgcacacacgcgtgtgatgcattggcgccagaaattgaagatgcaagagctagggttaaacacattaaaaactcactaactaatcacaggagatgaacaaatcaaaatttgaagtactaggcagcaaaaccatatgcgcggtaatataaatgagaggggactacatatatatttattgacaaattttttcctaaaaatttaacagatgtaattatagtataattgtagtgtaattacactgtaacttatatgtaattacactgtaacttgcatgtaactacagtgtaacttatatgtaagtttcacataattttgaattgttagatctattacaagatttgttttggtgaggaagaaagcaaattatagcacacgcatatgtgaaagaatttgttcccacgaccaccattttatagaaataacatgttacagagagatttttaaaaattacatacaagttacactatagtcacagtgtaattacatgtaagttccagtgtaattacactaaaattgtactgtaattacatctgtcaaatttttgaggaaaattttgtcgacaaatatatagcaaaatcgaaatgagagatagtaaaaaaaaatcactactcataatggcacatcacatcaataatagttaatctatcgtcttctatttagattatgcaatgtatgagtaagaatttaattgaaggcacaaatcggttgttcaattttttcaaagaaatgaaacacaactcttaagtttactatccttacaatattcacaccagagtaatacttaatcacaaactaatattagcaaactgatccaacaaccaaactaaagtctatatataacaaaaatgaaaaaaaatacttgttatttcgttaacaaaaaatcaaagaagtaatgtttatgaacatgtcaataatcagctctctttgaaggtaaataattaatttgatgaaaaaagtttttctcaacaaagtaatagtcataaaaaaagcaatatgatcaacacaagcatagctaaaaagtttagaacaatccgtagtaccaagacgaaagatgatgacatacccatttaaatttgctaactaaatacatcaaatattgagtatccataataaactagtaaacaaagaaagcgcaatatactaaaaacacaaatatgaattacacgaaaacaaataaactcaacttttctttttccaatgaagtgaactcaaagtcaccctgaccagaccgaccctgacccatccaaggaaaccgtcggtcggtctcatcagacacgcccggtgcaccaaacacggaagaaaaacctttcctctttccacggttctccctccctccctccccgatccactcctcccactccgcccgccgcccgccgcccgccgcttgcaccaccgccaaaaaagaagaaatccatcgcccatgcaaccctccgtgcccg

SEQ ID NO: 83427 - DNA, 1868 bp, Oryza sativa
atctgccctgtgaaccggttgttccggaggctcagcgaaacgagcctctggcacgacgcgaggctggccgggatcgcgccggatagccggttgttcgacaggtcgagggccgacaacgacgggcaatcggcaagctcgtccggcacgccaccggtcagctcgttgtccgccgccgcgaacgtctgcagcgcagggatggacaggatgttcgacggcagcgccgaccgcagctggttgtgcgagaggtcgatgaaggagagcgacgtcgagagcgccaggtcgtcggggatctcgccggacagctcattgccggcgagctccaggcgctgcagccgcggcagccgcccgagccccaacggcacagtgccgttgagccggttgttgtgcgccctgacgcggacaagcgtcgaacacgtcgtgagccccgcggggatcgcgcccgtgaagacattgttgaacagtatcagcttcgtcaggttgccgctgtcgcagagcccggcgggcaccggcccggacaaggcgttcgtcgacacgtccagccactgcagcggctgcgctttgccgagcgacggcggcaacgggccggtgagtgagttgttccacagctcaagcacctcgagcttggggagctcgccaatgccggccgggatgccgcccttgatcttgttgcacatcaggttaagcagctgcaggttagtgagctgcgccaactccggcgggatcgtgccggtgatcgcgttgtcggagaggtcgagcatgatgagggaggagaggttgccgagctccttcggtatctggccgccaatgttgttcttgtagaggtaaacggtgttgaggtacggcagccggccgagctccggcggaatggggccctctaagctgccgatcgccatgtcgaggtactggagcttggcgagattgccaatggcggccgggatcgcgccgctgaactcgttgtacccgatgatgagctgctccaatgacgagagctcgaacagctcagccgggagagcgccattgaggttgttgcccgagaggcccaagaacttgagcttctggagcttgccatacgtcttcgggatgccgccggagaagaagccacccctgaagtcgagcgtctcgagcgcggtggcgttgccgatgtcggccgggagcgggccggcgaagttgttcccggacgcgttgaggtgcgtcagcgaggcgcacgccccgaggccggccgggaacctgcccttgaagttgttgtcgctgacgtcgagctcgcggagcgtcgggatggacacgagcaccggcggcagctcgccgtcgaacgcgttgctctgcaggacgatcgaggtgagcccggcgaggccgaggatgtcgtccgggatggcgccgctcaggttcatggcggcgaggttgaggccggtgaccgcgccccgggcgtcgcagcgcacgcccttccatgtgcaatgtggcgcagagctccatcctttcagctcccccaatggatcgacgagagacgccttgatggccagcaacgcggcggcctcgtcaccggcattgcacacggcaatgcagctcaagagcgccaagaaggagaaggacaaggtgaagaacaagtgtctagcacttgtcatgctcggttcttctgttcctcccttgtcctctacactcctctggcccctctctctctctctcacacacactgtttctagttttgtgttttcattgccttgtttgaagcaatagagaaatggagggaaacttgtaggaaggtatataagaggatgtctatgattaggattggattaatgcattaatctatgtgtttggagacaataaaatactactttggggcatgctaatgcattggcgtgctaatgtgt

SEQ ID NO: 83428 - DNA, 4003 bp, Oryza sativa
gaaaatgctcttggaattattgagagcttcgggagacatggcccatgtggttaagagaatgtgcgaaaaggggattgatcactcgtcattggagagagaattttgtcttgctggtttaaacaacgagaattgcaatcattgtaaacacagaacatggaagttttcattggagccgattccctattttcgttgtgtcaataacatggttgtttttgcagatataatacatagttctaaagtatgggcatgaaacggaattgctgttcaattgccgacggcctgaaaggagtacacattcattctagtatatttctactctaccgtgttccgtattggtacatactaattttcagtttgttctgatcaatgttcaagtatgacagcaagcagttttttccaccattttcatcttttagaacaaattaagctttaagaaattcagttaaactcaaccatcatatatgaaagaaagaagggataacacaagtggtggtcttaatagttcagtagtctgaacaaatggaattttactaagcggacacgcacggttaacgccaagattactttagttgaatactccctccgtccaaaaaaaggcaaaccatggattttcgtgttcaactttgactgtccgtcttatatgaaaattttttataattcgtattttcattgttgttagatgataaaacatgataaatattttatgcatgacttgtctttttaattttttttcataattttttcaaataaaacggacggtcaaatattgggcacggaaatcaggttttgtcttttttttttattttaggacgtagtgagtatgtgtaagtagattttagtgaaggcaggggtagagatgcaagcgtgtcctggtgttaaacaaatgattgaccaaaaattagtatgctattcttatcttgcaggttgaatggaacttttgtcagtgatcctggtggtggagctgtagcctgtagggactgtaagattctcttccaggtttgataaatagctcccaggagtaaaaagtgatatgagaatcttctaatcttctgactcaacagtatgcttagctactgcaggatctttggcggtagtgagaacttctacaggtaaggttctaatcatctcctgaatcaactattccagtgaacaataaaccgttagcacttagcagtaatcttgtgaaacaattataagctgtactttgtcaaagcttcatgtgtacattatatgtgtaaagtctaggaaaatatatcactacaacaacactagcaagcagcaaccgaatttgcagagtccaacgagttataaatcgttgtcattttcacctgctgtgttgtcagagtccgaaggttgtgtttagtttagcgcaaagtttagattttgattgaaattagagatgatgtgactaaaaagttgtgtgtgtataacaggttgatgtgatggaaaagaactgaagtttggatccaaactttagatctaaacacagccttcattatgaaggaaaattcatggagcaagtttttttgttactttattcatagagcaaactttgtattcggggtagagaagcgcgttcacagtatacaagttgcccagacccaaaccaattatctccatcacatggaagaacctcctgttcttttgatgattagattcttgagaacgccatgctttggtttcctgttttcatgaccaggttgtcaaatttggggatcttaaccaacaggggttcgcttcaaatatttttttcattgtacgcaataatattgacctgccatctagaaaaaatactgaatctgaccattaacagaatacgtacataatcttgtacttgtaaggtttatttttggatgttttgctctgaatatggaagcagcaatgcctctgacaagggattgggagtgagttactacttactactacagtaaacgttattctgttactactacaatagtttccaagaccaaagcaagtccaagaatttcaattagcattgccctagacatgtttctttttaaaaaaagatagtgtgatatctttcctttttgtgcttggaaagcatagctatgatggcgtgattgatgttacgctttggtggtatgaatatgaagctggcatgatctgaccttatgcttgctcagctatggcattattttacctgatcgtctgttctttttctcttgagggacatcaactaggttgcacacatcaattaggatcataacaagcagtaactggagtagagcagaagcagcactgtatatcttagggcaccaaactaagcaatttcagtttataatattccatttagtattacaccaaaggttttggaaccactatagtaacaactacacaacattgagcacaagccaaacagataagcaactgcaagaacaatatgcatcagcacggtataaactataaagatacacatttctcacacaattcaccttttgctctgtcaaatatgtttggttgtcatgtagcagtggcaaatactccatcctactagtaatacttttgctctgggggacatcaggttataaacaagcactgaaaagtacaaacagcaacaggacccttgtcctcccatcaaaaagtcagcccaactgacccaactgtttctacctttatgaagtgtactatcctgcaaaaactaatcctttctctgtaggtgaattacacaacaaacaacatgatcctaacaattactcgcccaactctgaaccttcccatgttagcaatggaaacaattattggacccacctggcaggcatacatgatacggagtataccaatggattctctgcaattgcagctttccgagtaaggtaaatccagtgtgtagtagttactgaagagttatgtagcagctcattcatatgacaatctgaagtccctgctgttttcagtcatacgacacagccgttttacctcttgtaattcagttatgtaagatgcatttgtgtgctctttgtttggctcaagcagacacaaaatatgatttatgaagaggagtgagaagatagaggcaacaaggaaagtgtaagccatactagccggtggccgaaattcaatcatgcaggagaagatgcagccaccaactgcaacaaatgcaggcacccttccgttccaagttccaactcggttgaactcggccttagcttagcttagcttcgctagcccacatgcacgcacacatggccttccatcttctctcgtattatctctcctctccgttttctaattgcgacttggcgagagacagcgtggggctaagatggggggccatgtgaagtgcctccgctttgcagcttctgaaaattctctccgtgccggcagattattgagccattattaatcgtgtggcattactcatcgatcactagtggtttttttccttcctgcttgaatcatagttcaaattgcactaatttcagctaataaaatatggtcatattccttgatatctataattgaacaagggaagtttccaaagggcatcaccgtttgttatattcctacatattcctcctctatggaaatgcaatgttagctagtgaaagtaacatgccaataagaaactatgacacgataaagcaggaaaatgtcatttataagtacttatcagttaattagtattccatattgttgtatgtttatattgtcattcggtcatatagagtacgagcaatagccagataaattaaaagtcgcgaggatgcgtcgtctcttaattaatctcttaatctatcccttcattagactgcagtatatatgctggccacatgcaagcgtgttgcttttgctgattgttgttcggcaatatggctagctccaacctccgacgtacaaacacctgtagttgggtgaacatgcttgtttagttagggcgctttggtgcataaattaaactgagtattgcttgtattaatgtacagtatcaggaggagagaatatatgtttggtatggtgaaaggctggatagttcagaaacagt

SEQ ID NO: 83429 - DNA, 6897 bp, Oryza sativa
ggcggacaccgccgccggcgccgcggcgagcattgcccgcgcagaacttccgctccccgaacccgagcgcgtctccgatcccgcggttcccctccctccgcctgccctcgtctcggagccgccacctaccaccgctactgtcgccaaagtggaagatgaggagaagcccacggccgtcgcccaccaggaggcggcgcccagggattacgcgttccagcgagcgctcaagaccgcggagaacaagagcgacccgtgcggcggccggtacatctacgtgcacgagctgccgccgcggttcaacgacgacatgctccgggagtgcgagaggctcagcctctggaccaatatgtgcaagttcatgagcaacgaagggcttggtccgccgttgggcaacgaggaaggggtgttctccaacaccggctggtacgcgacgaaccagtttatggtggatgtcatcttcaggaaccggatgaagcagtacgagtgcctgaccaaggactcgtccatcgctgccgcggtgtttgtgccgttctacgccgggtttgatgtggcgaggtatctttgggggcacaacatttcgacgagggatgccgcgtcgctggatttgatagattggctgaggaagaggcctgaatggaatgtgatgggcgggcgtgaccatttcttagttggcggcaggattgcgtgggatttcaggcgcttgacggacgaagagtcggattggggcaacaagctgcttttcatgccggctgcgaagaatatgtcgatgttggtggtggagtcaagcccatggaatgccaatgattttgcgataccatatcctacttacttccaccctgccaaggatgctgatgttttgctttggcaggatagaatgaggagcctggaacgaccatggttgttctcgtttgctggggctcctcgtcctgatgatcccaagtctatcagaagtcagcttattgatcaatgcaggacatcaagtgtctgtaaattgctggagtgtgatcttggggagagcaagtgccattcccctagcgcaatcatgaatatgttccagaactctttgttctgcttgcagccccaaggtgattcgtatacgagaagatctgccttcgactcgatgctggctggttgcattcctgttttctttcatcctggttcagcgtatgtccaatatacgtggcatcttccgaagaactatacacggtactctgtcttcatccctgaagatggcgtccgtaagggaaatgtcagcattgaggacaggcttaaaagtatccatccagatatggtcaagaagatgagggaagaggtcattagtctcatcccaagggtgatatatgctgatccaaggtcaaagctggagaccctgaaggatgcattcgatgtttctgtagaggcaataattaacaaggtgacacagttgagaagagatatcatcgaagatcatgaagataaagattttgttgaagagaatagctggaagtatgatctgttggaagaagggcagaggacaattgggcctcatgaatgggacccgttcttctctaagcccaaggacaagggtggagattctactaatccatctactaatgctgccaagaactcctggaaaaacgaacaaagaggtcagaactaaaatacaggtagttagatatgtgatcgaggaaaggaactagatatcctctctagagaagctccttgcaaataccttgcccatatgtcaaagatcctccaacgcagtagctctgatgatcatgtatgttcttgatgatctagcccctacaggtgtaagtggtggtagaaaagatgcttggggaaaaaaatgcacggccttcgagttgcccttataaataccatttcacactctatttttgttttgctttgctcaataatcctttgtaagtccttacgggatttataggtatatcaattttgctgttgtttctgttttgtttgctttgatctgtatgtgtatggtttagaatttgtgtatactacctttttatactcacaattagtaagcaatcaaagagatttttgtagatatgacttttttcaagcaagatataacttttgtgatcgcacatcatgcttcagaaggatgcatccttgcagatttgagatagctctactctattgtaacctaatggcaacaggacatttatttctgtttgttcagttgtgtagggctgggccgctccagttaaatgattgtggaagcctaaagttgtcctattccaatagctttaacaggctatatagttgactatacataaataacaaactccattgttagttacctccaactgaacttgcttgccaatgatgagctaaataaggtagatgctattgtctatcaaacagtgatagtttttgaatggtcttattattgattattactactccctcttttccatattgtaaggtgttttttagttgttacggaacagagggagtaattgcttctaagctttatctagcactgataagatcgagggttcttccatcatttgtcaatgacttcctcagttcctgttcatggctatgtgccaatgtatcctgccagatagattgtttgtatcttgcaagaaactcagatctggccatgtgggatcaacttttggtctaatatctgttacttcatattcagatttatctggttgggaatttagagattattggtgtcatcatggaagtgtagtagtgaattgatttaacaaaaaaaatatttattctgttagtccatttatggcagcgttggaatgaggatgtgcttacctcttctctatgcttgtggtataggttgatgaacacatcagggctctctgaagaatgaagtagaagaaattacagttctaattcaggtatattctcgcaaccctgctagctttgaaatgcaatacatattagctatctatattagcaaggcatgtagtggtgcaactgaaattttcttttaggaattgacttctgacaatatatgattagcaaactaataattttatcactatagttgtagttttctgaaatttactcatgattatattatagaatctggagagtttgtctggttcttgatgtgtcggtccatctgactatttctctcctttgtggtcctttctgatataaatgagactatgggaacattatcacgtagtaccaattagtaactggtacggttcagagtgacatttacttttgttttctgcactatggctgtcttaagttgccctcttattgaagctcatggtatctatcacaagaatctacattcatagtacaaccatccataataattgctgcaatctagtataggtataaaaatctggtgttcatctcttttgagaagaaattaggatattattgttgactaacagccggtcattagttcatcaaagctcgcaagtcagaaaggcaaggccacgttcatcgcttgtaagccaaaagcaatcatgtcctgcacgttcccacgttgctgatgaacttggcatgaaaaagcacggcattgttccgacctttggggctcggatttggggccctgcaagtaagagatggtgttatatccaagcatgggatccaatcggtggtgttatatccaagcgtacagagggttattatattggacggcgatgctttttagtcgaatctcttgttttaatcatttgcttgttgctttccaagttttgttcctactacgagtttatgcttaaagcattcatcctcaaaagctgatcttcttgtatggagtagctgtgtatataagctaatattaaactagactaactttaccataattgtcgggctagagagtaaatacatgccttgcatatgaaaaatagtcgcaacaactgtagtttgcatctgtttaaccttattatgctgttgtaatccgtatctgcacaaatcaaccgttttcagagcacttgctactatagttgcttcctggttgtcagatgtcgacttcgtttgaagcccgtatcgcgcttacaagtggagaaggaaacaaggagcccaattcccatcggggctcgggagccttgacctcgtttccgcctctcaaagttcggcctaccaaagaactggatatatcatctgccgatttttggccaatacgagcccaataggattgtctgaggccgagtttagttccaaattttttcttcaaacttctaatttttccatcacatcaaaactttcctacacacacaaacttttaacttttccgtcacatcgttctaatttcaaccaaaccttcaattttggcatgaactaaacacaccctgattcatgagctattcttcctaagttcagtagaaaattcctcgatatatcttttgagtctaaaattcgtccctaaatcgaaatatcaggtatagcacatcctttaacttatgataccgtgttaactttggtttctcagtagtatagtggttggttttggttgatgtggtgagcgggactcacgtttgccccacatgttagctgtcctctacctctcccacacgcaccgggaatggcatgtcgccagcaccgtcgtcaggacgtggccacggttgggtcattggaagtccaccgcccagaagttggcaacgtcggggcaactgcattgtctctctcttgctcgcatcacgcattccctgctgcgtcccgtacccaagccaagctccgatccatcacaatcaccagccgcagctacaaccacagtgaaacgcggatcgaaagttgtgaccgagtagggggcaggaggtgtcacttcatttgccttccaattcggtcgtcccatgcatcaattgcccccgtgcacgtgccgccccctttgtcgtctccgcccccacaagcaacctgtatagccacacgcgaaaatttcccccctcttgggtattgtggttgctatagttgttgcggtgagtgggaggaggaattggagggatcagggatgaatataaagaatggcaggggttcggagatgagggaagcgatggcgggtgcgggtgcgggtacggcgccgctggcaaggcaggggttgatatagtcgttaatgttcgacaagttctagagtacactgggagggatgggagacaggctaaggaaggattttgggtccatgaacatggacgagctgctgtggagtatctggacggtggaggagagccaagcaatggcatcggtgttggggatggggagaaggatgggagggcgcgcgacaaggatgacgaacggggcgagacgggaagaagacgactcgctgaggaagacaatgctacttgccgtggaagtttgctcctccacgccgttgaccgtgccctgtggccccttcctatcagtcggcatgggttgggggacggaatggctgagctagcttctccccgccgtccactgtcctcctcgctacatgtcgtcggcgctcgtcgtcgattgtcgtcctcctcattgctcgccgcctgctgcccctccacactgtccgcagctagccaccaccctggtgagatgggaacggaggggagggagagagataaaggtcactgacatgtggggccacatgtgttccacgctaactcagcgttgttgaccctggtcaactagtcacgtcatacaaaactagctgctatattgtcctgagacctagtaatccagttttgtaagttgaggggtaagttatacctggtattacggtgcagggatgaatatcaaactcggtgataaattgaggaccaaaagtgaacttattccttcttcctctcctggagaactaggcctcgttttgccccccacgcgagaatccggcagcaataacagtacggcctgccctgtgagctctgcacctctcctgctgcaccaaaattgggccctgttacccaccgtgattgtatcgctattatattcaattttgctatatatttgtcgataaattttcttccaaaaatttaacagatgtaattacagtacaattttagtgtaattacactgtaacttacatgtaacttgtatgtaattttcaaaaatctctccgtaacatggtatttcggtaaaatgaaggttgtgggaacaaatcctttcacataggtgtgtgctgtgatttttttcttcctcaccaaaacaaatcttgtaatagactagcaaaagtgcccgtgcgttgcaacgggaattgtaaagaccaaaaaattgaggaaaagttgagaaatatttacattatgtaattcattgaaatacaaatttcggtattttttaagtaggtaggtgtataattaaattagtttacaagtaaagtaagtgcgagaaataaaatgatatggttaaaattaattttattaaattctccatgattaattatgctatttggaattttattggaatttgcatagcttaattgctaattttcataatactaacatccttgcaatatttatttgaatataaatcttccactctcttgttgggccattttcagcccattttattatacagcccgcagccaagccggccgctttcctcccttctcctctcctccgactcaaccgcacacttgtctggcccaaaaataagtctaatttactccccctactttatctctcactgtcgcgtgggccctaaccgaaagtcgaagttaaatttttttgttggaccggtcgacctgctgcggcccatgaagcgcacgcggcccaatagtgattctgcccgacgcgggaccgagccgttcgtttagatggacggctcagatcggctcctaatccattaaaaccccggaccgaacccttatccctaaccctacctttttccccttcctcctcccaccgtaggccactctctccccaccggcgactgcgcacctcccccacctccgccatcttccccgcgccccttccccaccgccacctcgccgtgcccctcccccac

SEQ ID NO: 83430 - DNA, 6983 bp, Oryza sativa
ctgcacccccggcccatcttacctgagagaggaaaaatagacttttgtggaggaatttgatttgggaaggatttggattcgggatttgaatttgacgatagatcggggattcgagatcagggattggcacatagactgacaacaagcaaagaaacaaatttcgcaattagggtttttagaatttaaattttcccgctaggcgccacgacggaacgggcgctacacagtgattgtgttgcgaggtggatttggacacaacgacttaccaagccaccgtcaaaaacatcttcaatttttataatagtagagattagcaccagacaatgtgatgattcattgaatagaacatgaaaaaaaaatacaagactattgccttaagacagtagccaagaaaaaggaaaaaaccaccatcatcacgcgccaacaacacctacacacaacccagtagaaagctagcgttggaccgactgccactaggccaataggatagcaacatcgggactgcccaaaaaccaaaactaacaaccgggcaccaagctcaaccctatttacacctttgggattaaggggggagagggtgagagagaagaatggatcccttctcccccctacagcccgccaacatagccaacttgcataagctaggccgccactgtaagaggataacatgcatttagagagagcttactccaattaccagagaaagtttttggaaaggggcctcctagacgtctccagggagatcaacgacgatgagcaccgccgccgtcgtccgttgaggtcttagggagaactacaacaaggttttcacccgccagctataacagaaaaaagggatggctcgacaacgtcctcaagaaggaagatgatactcgaagtgccgtcgttgtcgtccggtacagtcgggctaggttttcacccactgcctgccccctatcgatccacagttatcgcttcattactccaccaccggccatcctttgtgagcacgtggacaccaccgcatcgacgtccccgccggccagcctccgcgggtcttgtgggcttatatataatcgcctaacatttctctgcatgcattcggcccaacatgtaggaactaggaaataagacgaggttcaaccgaactaggtcactgccattgcgggtcgtgccaaaatattctggaagcttctagaagctagaaccatctggtctaggattttactgggagatatagctgggctccaatcacatggtaagcccaatttaacttggaaaaagtacacgcaaggccctcaagatacaaagccgtctctcaaccacaaaaccggatatccggcatccctcaacttataaaactggtccctcggcagttttaaccccggttttgtcccacgtggcgactgactcagcgtgggacccacgtgggccccacgtatcagtatgaaatgtcatctctgtttcccctcttttctcgtctctctcttctatctcaggtgacggtggtcgcgactccggcggtgaagggcggtggccggcccggagctcggcggggcgaggcaagagagactgcgcgagctcaagacgtggttctccggaccactccacgcggagtcggcgccgggctgcgggcggagcgcggcgggcgagagcggcgatgggcgggcggcgggcaagctccaggtcgctccgtgcgagtcacgtcaccgggggcgcggcgactggtgggtgtgggcggccgccctcctccgactttgccccctactcctcgcacatcacctcctgccggaggcaggcaggcgcggactgggcggcgatgacgacgactcgccctcctcatctccccgtctcccgccggcctcctctcccacttctcccgccggtgcggtcggccggctctccccccactcccgtgctgcatccaaatcgaattgagatttgagatagtgggagagcgccatttgagttgagatggatgccgtcggcggcgggaaggtgaagaaggcgacaggcgggaggaaggccggcgggcgaggaagaaggcggtgacgcgctccgtcaaggccgggctccaattccccgtcggccgtatcgggcgctacctcaagaaaagccggccggtcgatctcctctccgccgctccttccccatcggccgcgccgaccctcttccccaccgcgtcggtcacgccgccgaccctctttcccaccgcgtcggtgacgccgccgaccctctttcccacacacgcacctcaagatattcctctctacccatcctcagcagacatggcgagaaaggagggggaagggctggatctggtagcgatggaagaagagctggatctgtattcttgggaacccgtggtgacgcttgccatatctttgctggacagagccatatcctacttgggtgaggacactagctgggcggaggggcggaacaagaacagatttggtggtttcagcagtcaaatgttttattatctccaacctgccagaggaaggtttcaagacttccgtctgcgtctgattaattggccaaagtcgtactgttgtggctatgaggaaatctggaagttcaggattgcggttgagctattggaggatttgatcgaggagatcgaacaccgccggctggaggaagatggtcgcattcctgccttgttcatgaatgctaaggcaaagatcgccttcaagtttgcgacaaatgattatttcagggaggagtgggacaggctgttccaggagttcacaaccttcaggctagaggacttgatcacggatatcgaacaccttagactggaagagagtggaaaaaagatctccaacaagaagtttgcgagatctcctgatcagtataaacaacaggctaggctatttttcctgctagagagaggtgtatcacgtttacgcgaccaattaccagcggtggtcgaacatgtggttagccaagatagggagctggttgaccttgagaaggaggagttgcatgcagagctggttggccgagatagggagaagaagcagatagtgcagtggttggtcgagcaaccagctgaaaactctgagataatttttcctttcaaaaaaaaaactctgagataatcagcgcagatcatatcaggctctctgcaattctgggtgtggccggcatgggaaaaactaggcttgccaagctagcttgccaagaccccgttgtgtcaaccactttcgattttgttgtgcgggtgcaagtgccttatgatttcacccgggagccgccgtcgccggccgcaccaccctttggccgcgcgcgccgccgcctgtgcgagagcagagagcgagaggaaggagagaaatagagaaagagagactgtgatgacgtggtctccataacatgtggggcccacgtgggtcctacgctgagtcagccgctacatgggacaaaaccggggtcaaaaccgccgaggggactattgtgaccggttttgtaagttgggggacgcggatgtccagtttgcggttgagggaggattttgtatttggctaacaagttgagggaccttgtgtgtactttttccatttaacttcgtcctatggaagacccagcttaaccttctgtccactgacggcaaccatcagggctgaacagcccaaactctgttgatgtaggcccaagtaggcctaacctggaaactctcctgtaaatgtgtacacaactactaccgtatattcagatgatcagatcctatattctccctgtttctggctcaatatagagtcgacgatcgtgtcatcagttttaaataatcgtcaataccggtctaatttataagataagctcagttaatgaagtactccagtttttccataagccataaccctaaacatttcgtttggtactccctcctacccagcccacctgtcctctctcctctgtgaatgtctcattgcagatttgcagcctcatcatcagcacagcaggcgcagaaatcaagcgtgtagcgagcgcaggccacatccaggagtatctttcagtccggatctcgaggcactgtcacaatggtaaaaccgtaaaacacgcagtggaaatttgggagtaaacagactactgtaggagcactaaacctaggcacattgctaatctgctgtttttgtcagtgtgcgtcactgtctcgacatggtaacatggtctgaaagggaaatgcactgtttctgattgaaggctttgcctggagcccatggggcacacacgatgacacgaagtcacgaacacgccggtgatcgtggacccaacaaacgtcgcgtgccgccaagtttggttcggccggccggccggccggcaagtctctcgacccggtggcaatttctttgatgctaaatctcccatttggagcgtaatgagttgacaaatggcgtcatctcccggcagttttgggtaaccggagactctcaccgcacatgccgacgacgttcgtgagacccactccctccctgttcagttcagggtacatttcctacaatgatggtgctcgactgtatcgctggagggacaggccggggaccaacggaaagtgcgtaaataatgtgtggcaaatagtaggcagtgtgcttcaacagacacaacctcctacattttttctactagtatcctcgatcaaatttacatattctcttcgtgttttttgctgtgtcatgtgcctttggtccaaccaaggagtagtactagaatccatagctggctttataacggtgttacgccatgctgatgccaaggtacaacttgtgctgttttatttgattcttgccctttgcgttgcatggaggaccaaaaacgattccatgggaaggagaactggagaaggggaagatacagtaaacaaaagcaggtgtcggcagaccagcacactgctatatagtactccagtgcaaatagttttttttaaatcccgtgtttcattctggatcatgggggtggatccggcaccgcgtgacggcaactgccgcaatagctggacagccggcgcaaccggtgcctgcgaccggcacgtcaccgcgcgcacattgccctgtctccccactttgaccgcctaccgacgatttcgccggcgagagagtgatcacgatttggctgcaggggcgtccccgtctgcccccctattcatttttctgatttctgtggttgctgccaattgaactccggtaggttacaaacgaagccacctaacaaagcgtcatcttctagtaactgaatttttctgtgaccgagtcgaagtcgaaatcgatgtgcaatgatttaacagacgagagcacaccggtgcttagatttccatattgtttagtcaactaacagccggtaggattcgagtaatttcaactaactgcatgtttgagaatttccattagagagttttgttaccattacatcgaagtcctgtttagaaagtaaaattaatgaaccagagattgtgttccaaacaggtctcgatgaatttggttacaaagaatacaggctgcaatttaagtagtctaattttaactcttaaactatgctcgaagtctatttattatgatgaaaagtaaaagataaactattttttatatctttgggttaaacgcatatatgtattaggtttcacctattttacattctgccactttttttttgctaattgctatataatcccactagtttagcatgaagatgatataatgccattctgttgtgttagatgacaccaacaccattaatttattgtgaattgactttgttaggcactatgaattataaacgcacattgctactaccttcgtcctagaatacttgattctttagaattcaaattttatcccaaaatacttgtcattatggagtactagttgtcccattaatcactttctattcaaaagttttcccattttaccctcaataaccattccacttcctatcatatattatttattaagggatattatatttttttattaaaccttaatatatactaaacaatctagaatgacgactattgtgggacgaagggagtaaaaaatatgctcctacctcagtttgagatgaggggtatttatgtcgtaatagaatgccacggaactttcaacaatttttacttttcctaatttcaaaatttaaagatacattctccaatccaaggacaccgtgacagttagctggttttcggtggtaaattgacaattacaacatgccctaatagcaaatatacaattgtttctacaattattacatataaaaatgttgagtcatatttttgtcacggaactacttttacgtcacatgtctgatacgttttacaaatgtaaaaaaaaaaaacaatggccaatggttactacagagaaccgagctactagcagtttttctcccggtgagacaggaagtaaaagaaaaaaaaaacgacccactgccaaatggttgtatcaaagcatcaacaattcaccccccgcatgtgctggtagtatgacggcgtataaaacagcacatggaaacagatgaaccacaatcatatggtaaaaaacaaaaacggaagctcaccttcccaccgccacgtcccggctccccatgcgaccgcgcctatggacgggcgccctgcccacgccactgcccccaccgtcgcacgacggccgcgtcggtcgccacgtctccatctccctccacaccacctggtttcctcttcagtttcctcctcattattcctcctcttcccccctcgccgcttacaacatccatccccaaacccgcattcaaaacaagcaaccctcctcccgaatcgaacaaggaaacagatatcgcctctaaaacccccatcgtctcgtctcgtctcgttcccctctccatcttccgcggctttccgcgcgatccaccgatccggtttccccgcgccgtgcccggagtcggcgctccattcccgcgccgggttttggggtggtgtgttgatgcggcgggattcgagccctggcctgtgagttgggcgatggctcggcggctgcggg

SEQ ID NO: 83431 - DNA, 644 bp, Oryza sativa
cagatcattactacaggtaatatagctcctatcagaaagatcaatactattttcctttagttaatgttcaatggtttgccctgttatagatttcattccactttattttctagtcaaaataatcagacagtatgcacacactgcagagaatggagaaaaggtcaacaattttccattattaaaaattgagaatcatggtttttgttctcctcgcgataatacgaaactaaattgtgtttcatggatggaagacaaacatttcgtggagttcaccaagcagtttcacagcaagactggaccctagctctcccagacagagtattcctcctgttggtgttgcaagctcgatcaatcttcaaattgtttattaaacgaagtctcttatttcctagttgtaaatgaagtgctgcacttagaactgttctaccacaactccaggtaatcaacttgtgaacagaaggaaacttggcatatggcagagtcagcctcgatttgttgttttgaatctccaggctaaaatcattgctgttcaagaggttttctacccattacgggatattgtcgatccagtcctgtttttcttcctgaagcctctggttcctatggcaatttcttcctcaaaattacaagtgaattaatctttg

SEQ ID NO: 83432 - DNA, 4856 bp, Oryza sativa
ccatagagagagagagagagagtaattctgagttgaatgaaatcaaattaggttgaccatggttctgccacattaatattttttcttgtcgtactgcgcattttcatttttatactataacaaaaacttgtttcttctaggttgtctcgaaacagttctcccaccaacgcataattgatgttaagtagtactttctccaattcatattaataagcatataaccaaaaataaaaaaaatccaaatttatcatcacataaccattgtcccttagtttggcgtgtaccattattgcatctatacatgagaattaagtatgcatgtatgcatgcagacatttagggatacttaggctattcctaacccaataattaggatgatgtccatagcattaaataagctgccacctagaatgaaaaaggatgtggcaagtgaataaatgaggaaagagaagaaaaccatgtcttgcctaacagatggtttctacacaacatccaagacatcatgtgagataagtagcattaaatttatgtcggtgacatgggaccgggagtatcatgactagaggcttgaggcagacacaatcgcctacgtggcctggcaccctcggggggcgtcgggcccgagggtgatgtgttcgccctcctctttatctccccgagggggtcggaccgctcccgcctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtctatccggtctgtgaccagtcacagaccggtcagatcgtgggttaggtggcgacaggcggtctgacgcacgcctcgccccatcccgtcaggacgagagcctccaagcactcgtccctagccggagccggcgtgttagctcctggagatggcacgttggttccggtcagatatatgccaggcttcatcctaaccattacaggcaagatattgtatgaagaagggcgagcatgcagattgttaaactgacacgtggtggacaagaatgaccgatttgagaccggtctgacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagagaggggggaggaaaaaggatcccagaacaatcgggggctggctcacactttgtagcttcttcatacacagatccaccaaaacacaggagtagggtattacgcttctcagcggcccgaacctgtatacatcgcccgtgtcttgtgtgtttccactctcgcgaactttccacagaccaggagcttagaatctcacccagggcccccggccgaaccggcaaaggggggcctgcgcggtctcccggtgaggagccccaagctccgtcatctggcgcgccaggtagggggctctgcgagtgatcttctgagctctcgcactctttcgtgtgtgccaagcttttcctgttcagcccaatggccgaacaagcaaaggcgcacaacctctctccgagcgttagcggtgacgatggggagccaaacccacgccgtcgagctcgtactccaccgccccctccacgccaaagtcctaggcgggaggaggcgctcgagagggtccaaggatccgcgacttcgacgtccacgggtgatggggaagggcggccagatggggagcgtcgcctcctcgtctacggcgacggcagcacgccccagggcgcgctccaagctgcgggcgtgctcctacgtcacccgcccgttgtccctgacccggagtctccagcccaacgttggctggacgacgtggccaacttggtcatgacggcacggcagcgcctaggtgctggtgggcggtcctccgccaccaagacctctcgcgctgctaccaccggctccgtgtcgtcaaggcggagggcgcggcgagcggcggctgttgctcgccattcggccgccactccttcgtcagcgccttcgacccaggaagatctgcgtggggggccggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcggctgtagagcatttgtggcgagccttcggaacgtccgttggcccccaaggttctggcccaccatcgccgaaaaatatgacgggagcgtcaaccccgccgagtttctccaggtctacacgaccgggatcgaggccgccgggggtgacgacagggtcatggcgaatttctttcccatggccctgaagggacagacacggggttggctaatgaacttgccacccgcgtccgtccactcttgggaggatttgtgccaacagttcaccatgaactttcaaggcacatatccgcgcccaggtgaagaagcggacctgcacgcagtacagcgaagggatgatgagtcacttcgctcgtacattcagcggttctgtcaagtccgcaacaccataccatgcatccctgcacacgcggtgatctacgcgttcagggggggtgtgcggcacaaccgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgctgctcagacagggcggcgtgacaggaggaggaagaagaggtcagcccataccgacgacgagggtcatgtcctcgccgtcgagggcgcttcgcgggccacccgaaaggggaggcctgcgggcgacaaaaagaaggaggccggcgctcccagcagggagcgcccaaccggcaagtggtgcatcgtccacaacacttcccttcacgacctcgcggactgccgcgcagtcaaaagtttggctgagcggacgaggaagtgggaggaggagaggaggcaggagcgccgagagggcaagtccccggcggttccttccggcaatcggcgaagtgaggccaaacagaaggcccccgccgaggacatcgatgacggcaatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgtggtggtcggaggttgccctcaccttcaaccagaccgaccacccatcgtgcgttgcccggggaggacagatcgcaatggtggtttcccccactgtttgcaacgtgaagctggggcgtgtcctcattgatgggggagcagccctcaacatcctttcccccgcagcctttgacgctatcaaggccccggggatggtgctccggccgtcccagccgattatcggtgtgacgccgggtcacacttggccgctaggtcatatcgacctcccggtcaccttcggtggatccgccaacttccgcacggagcgggtgaactttgatgtggcggacctcagtcttccctacaacgcggtcctagggaggcccgcgttggtgaagttcatggcggcagtccactacgcctacctccagatgaagatgccgggccccggtggccccatctctgtccatggcgaccttaaagtcgcgcttgcttgtatggagcagcgcgcggaccacctcaccgccgcgtccaacccgagggaggcgacgagaggcttggcacctccgcccccgcccccccgaggcagcggatagtcacatgcgacgaggtcccggtcaaggaggttgccctgggcgacggcccgtccaagaccacacggatcggtggtcttctggatggcaaataggaacacgcgctcgtctctttcctgcgggcaaacgctgacgtcttcgcatggagaccggcggatatgcccggggtccccagggaggtgattgagcaccgtctcgccgtgcggtcgggcgcaaggccggtccggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactgcattaattacccccataggaacttattgttatacgacaatgcccttcgggttaaagaatgcaggtcctacttttcaacgtactactcgaatttctttgggtagccaaataggacgtaatgttgaggcttatgtcaatgacttggttgtaaagacgcgcaaccaagagaccttactctcggatctagcggaaacttttgagagtctccgctccgcccgcataaaactgaaccccgataagtgcgtgttcggtgtacctgcgg

SEQ ID NO: 83433 - DNA, 26799 bp, Oryza sativa
  unsure (1)..(26799): unsure at all n locations
ccgcccacacgctcctgtcgtcgccggggaggggaggggagaggaagtgcaggagccgcggccgcccgtcgtcacccgcccgcccgccggatctgccgccacgcgctcctgtcgctgccggggaggggagagggaggggaggagctgcggccgcccgtcgtcgcccgccctcccgccggatctgccgccgcgcgctcttgtcgctgtcggggaggtgaggggaggggagagggacgggagaagccgcgggccacccgtcccgcctgcgcccgctgccgcctccccatgtctgccggccgccgccgagctcaccgccgtcccgcctgtgtagaaggaggcaaaagaaggtgagagagagagaggaaaatgagtggaggagaaggaaggtgagaagataagggagagagaggagagaaggggccggggggagagagagaaggaagttcaaattttttgaatgggatgggattaggaggcccacctgcgaaaatagggttattttcgcgtgcgggcctgttaagtgacttgcacacgaaaattgattttcgtgtgcgggcgacgacccggcttcgcttcccccatttttctgtgcggtctcacttacggaccgcttggaaacaaaatggggtggcgtccacgaaaatcaatcctgtagtagtggcccaagctcggtttctgcaaaaacactatcttgttttgacgattcccgttgactcggaatgaatttggatatgagactggatgcgtttgaaaggtagttagataagctttcatcaagtccaagatcacccaaatcggatggcatgaaggcgctatgttcttttgaagtcagtgctatctccggaggccgaactaaattccaaaactcattgggcattaatatcttgtagatcctctattcatcggatgtattttttggcaatgatttatatttctcatgcttggttgtatgcatatacttgatggtcatatcatcctccccttcttgtctggaaaccgtcctcggtttcttgttgcaattgtcgtcataggagagatcacatgaagaaatagcaaacgagcaaacattgagtagcatcatttgttcctcataaatcctatttacatcaataggaaaccaactcacttcatttaataaacatgtcttaaaatgatagagaaacttgaccatagaatctaatggtgcataacactctccttcttgaatattgtcattgatcttcaagataagttaggtaaatttatcccaatagcataaaatttgtacgacccatttagtttctcacatttttccatatttggaggagtatgtatatcgaaacatatataaacgccatacaccttataatctcctctagtattatatttactaatgacatgataattattccaagaaaaacatggaaaatcaaaaattttcttctctaagatatttagatcacaaagaacaacaaattcgatagcccaaagtacataaagaacataataatttcagctcttcttggtaatcagcagtaacaaagacacgtttattttgagtggaaaccaaatattcagaaatagaagtaatgtgttctttcactagttgtggcatgtatataagtgaagcattgcacaactcttcatcattacaagcattatcaatatcaacacaatctgaatttttagcttgtgataagacaaattagaaatctgttccactagaggttgctctaacatagcataattagaggacaattgtagcatatcacaatctttcttaccatggttcagttgaccatctgttaaattacctgaaacgctctgaaacgctctgttcagctagtttaggtggttcattcttgttttcttcaaaattgtgttttctttcctgcacgatgttatatacagtagaaggtacaagaatattctcatgtatcatagacatttttgtttctttctcaatctgactttcaatatcgcaagattaccaaaatcagagttgacatgaaggcgctaggtccgtttgaagtcaatgctgtctccggaggccgaactggattctaaaactcattggactttaatatcttgtagatcttccattcatcggatgtattatttgacaatggtttttatttctcatacttggttgtatgtatatacttgatggttatatcaataactgaccatgcatcaccgaaattacagctgctactttagctctctcggtcgcgatactttagctctctcggaatgggaagtaaatcagagacccttgtaaatgtcttttgtgtagtagtgtacccgttatttggagatgagatccttaattaagtccaactgattctatctcgcctgatcatctacgggttccatatatataaacaatgcttgagacaggtttctcccttcacgaccccagtgtctagcattcgcgaaatgtttgggaatttcaattctagttatggacaatatatacagcaggaatgcgatgcaacaggaaaccacttaactggattaagggttaaataagacaatttagaagtctttagtacccaagacttgatgaaggaggcgttgttccttaagtccagcaaccaatatatccgtgtcagccgccaaagtccaactgatccggtgctttcagtgaatactttgtcactaagggtttcttcaaatcgaagtttttattgagatttcgcaacaagtgagaaagaaaatgtgggggcactctggaggtgattttgggtgacaaatttttttttaaaaaaaataaactggagagaattttcgttgcaaaacctaaaactccaagctacataattgctgcggggtgttgctttcatgaataattgttggggggaaatttcgtcccttgccaattgttacagttgcttcttaggaatcatattgatatgttcgaacaacaagagggtagaactgcttgtatagttcactaaaaagcctactgattgattaaatcaatcaatggcttgaaactgtaaattcgaaatcagtgcatctaagggtgagtttgagaggaggggaaaagacaagattgggaagatacgcaaaacgaggtgagtcattagtatatgattaattgagtataaactattttaaacttcaaaaatggattaatataattttttaaagcaactttcatatagaaaatttttacaaaaaacacaccgtttaatagttcgggaagcgtgcacgcgaaaaatgaaacaaactaactcacaaactcctcgtgccgaacgctccctaagttctaacttatagccatctcgacagtggtgtttcctatcttagagaaatcttgtcatccttttgcacataatagtgagattttattcgtccagactatatgaaatgaattatcaggtagaatggatgtgcaactgtgcatgaacgtccatcgtccaaaaaataatacaaaagtaattatattgtttcttcaactagaaagaaaacctgcgcagatgcgcggacatcttatttattgttttatgaaataatgttaaaagtagtcatatctcacgatttgtacgttgtgaggtagaccgtagtctttaatatgcttaagaatgtatgtcagattaagaaaacattttatctcagttacatataaattcttctattatcacataaacttattatcactattttatctattaatagatgaaactgtatatgtcttacttatttccaaatccatatataaatattctaaaaataccacttctaccgattaataggatataccattaaaattaaaccattaaagttaaacatgaatggccatttagcacgtgaaaccaatcataatcgtaaagactttcttactctactgtcttgaatgataggtctctcatcaagatagttgtgctccctcgagaacttggagcacaatttaatgtctaatttactatcacacccttatgtagtattgcattggtatactgggaccgccttaactcagcctatatatgcctctgttatacttacaatagcgtagcaaaatctcttgtttatgcttggtgcccctcggagaaggacaaagaaaagataaaggtgttcaaggtagttgtttttttttaatttttgagtagatttgtgttatagagtagacacaatatgtttaagattttgatcattactactcatatttttatagtacagctagaatactctcattcgaaaagaagcgaggtctatcaccttatggtacctaaaagaaaatagccaaagagagacataccaccacgataatctccaaagcgctatattattgttcaaattttgataaatacctatagtttagcacctggtttagtttgaacacctactattaacaacaacacatgttatacctttactaattaaaataatgtatttattcttccaaacatatttatcaattacgtcgtatatttgtcaagtaatatttgatatcctaaaatatgatataaaattatttaaaaattatcagaacattaattattatatattagctcaagatgtgatgtatttagaaccacactataaattttataagacacaaatattttatttaattaaaggaatataacgggatcacgaatttgatatataattcaaaaataatttaaaagataactgtctatatttgatttgatatttgatatttataatatagacctagtttatatttgcgcatatttatggagtaatatatattttatatggtaatgttttatattttaaagaccatcaattttgttccatgcacgtatgttttttattacatatattttttattggctttaccattttctacggtaggtacgtgcatatttttttctttctaataatagttatacgtaagcttttgttctcaatccgtactttttttttctttgaccgttaaggtgcatatatgcagatctactaagcagtacgttatgttttatttttgttttcatctttatttatcgtatgttttcttccttcctccggcaaacagtacatatagaaaggtattatatatagatctgatttattggtacaaaataatgggtccactaattaaaatgaaaatcaactgtataaatttaatcgaacggtataaaataatgggtccaccaatttaaatgaaaatcgacggtgagattagattgtgccatgtggcggcctagaagcaattgtaggagtgtcatatggcggcttgagagcgtttgtagaaagtttaatggacttttagtatataatagaagatagatagatagctcgattcctccattcttatctagttccatgtactgttgtacggtccgtcttaacttttcagaaatttggccgttagataataaaaaacattacaaatcctcaatgctaaattacaatgaaatataataaggttctaaatgaactttacattatttagaagagcaattttacggtccttgaggaggtaccatgaggtatcactttttttattgtaaatttggtacctcttggtacctaggtactatgagataccatgagataccaaattttacactatatttttggtacctcatggtacctcctcaaggaccgtagaattgctctatttagaaccattttcctcaagttcagtttatatgccattttcatcagttgcttttaatggttctcttttttgagatatttatttttatcagagatttggctaataaaaagatttcacctagttcagcattactaaactaacattcggtgctgcttgttgacagccaaccgctacagtaaaataaaatgaagatatatatctactggagagggagtctctccctggtgtcaaaaacacaccggaacgcatggaaaacacccagtaaagtatgttacggagtgccccacccggcaatcatcacccgggagtgattcaactttcccgtgcatgcatgccgagtgtgcttccgacagacactccgtaacaaccagaaattgccgggcgtcatcgaaaactcggcaacaggctgaccacaccgtccaacggagcaaactcgtaacggaagactaggactaacggttaacggcgataattgcatagtgtagcagaacacccgggaaagcgttagagcttaccgtgtgtctactagtagacacggtaaagtattgcttgttaccgggtgccaacgctaattaacacacccgtgcatcaaggggaaacgcccggtaagagcactcgtgcacacacagttacgttactgtgtctcatcattttgacccaggaaatttgttttggtggggtaaattaatacgcttgatcattaatattagatgcaccatgatactagcatcaaaataacacacatcaatggcaatcacacataaaagacaaaataatgcatttagaatcattgacatccattttcaattaataagtttgatgacaatctggtaaaaaacaatagcaatatcaatctttcgaacaagaaatctatcttctcgcgagtacatgctaggacaaccaagaggtctagcaaagaatgagtccacaaagtaataagaaagagtagggctatgttgattgatacaaaggcaatttgacagcagctcgaacgatttagaaaatacgctggctgacttggatacctgagactgcataaaagaagtaacaattgagtaggtagaatatcataattaaagaaactgatctatttcaaaacaactctttcatgcgttgaataaaagcatactactaaacaaaacaattgaaaatctcttttattcgtactatcgacatagtaaagaaaataattaggtaatctggacccatgcatgctttatcccaagcctcaagtgactagtcattgaagttctctaccgatattccggtgttgtttttgttcaagcagggttgtcgttgtaagagttccctatttggagctagacatcttaaggctaattgcattaattgctatggaaggaaaataaaagacagaatcctccctacagttgaatgaatattattaattaaccagggaccactaaagcttgggctaagggcacccgcgatggttatatataggctctctacaaaagatctatgtcagcatatttttctacttggaagagattaaatgaatagagagagagagtaaagctatctactaacctatagatagtctatagagaaaaacgagacaatgtattagagagctatagatacttatgtagacatagtattgaggtggttactactaatctagtctattgctgaggtgtacatgttttatagagagcaccttactttaccattgtaagtgctctaagcagaataggttagccaacttatacaccatagtaaatggttagtatgaaattaagactgctacagctagggtagaatagatattgcatttcaaaaggtcaatatccaagaatgggattgttgtgtcttgctagacatatatgttaatgtctaatcataacaattaacaaggcacatgcaggcatagttgctactcaaccagatcaaatgttgcaatatcatgacaaaaatagtgttccacatggagagttttttacatcatgtgattcaattttcttacaagttgaaaccgttatgaaaaataatcacatatttggtatagcgaaaataagataatgttagcttacatattacaggacctggatgttcataccactgatttgttcaacaagcagggctacaatgttgttcgtgtgacctgccaagaaaaaaattactgtgaaatggcatgacaagcataaagccatgtaaattttggtaaagttaacatggataggtgccatacaaataccgaactaaattgtaaattctctaacaatagaaatcataacgagttaaatgaaagagtaatttgtatattagacccccttttattaccactgttgcagtctgcaccaggggtaaaaggaatatattcacattggaccagttatatttaccaaatgattcaccttggtcctagttcttctacccctggctccctcttttctctctctgtttcctctcttctctgaccagttaacaggtcaagtagctagctatctaaagtcggtgctaatgccaaacttctcccaggattagaatcgaagccgcatccgtgtgatcaatctcaatctccacatttaggttcgcacttaattaagctcaggaaggaacgagaaaaaagaaagaaaaattgcccccattgctgtcgagctatctgctacagggaatggcttggctttggcttgattggtgaagttttaccgatcgccgccggcggcgaggatcgtagaggggggcctagtagtattccccaagggcatgaactgtaccatggatgtcaccaagccggcaagcccatggtcagttggtcacgctccaagctctacatggtcgaggacatttaaattggccaagcggattgcagccgtatgatgattattgtttttgtgcttctaccatcttgtggctagcaagatcgcaaggtgaggcttcatggcgtctgttaacctcgagctcaagtagggcatcgcagcggggggctcaaggtcgaacgcggcgttcgaaggacgaggtcaagcaaggcgatgggtgggatggatcagctggactgctggaggaagaacgggtccgagtagaaacaattggtgaagatagatggtccaaagtgaaaatatgtgcttatctccggtgcaacttgcaaccaaggtaaaaatatgagacccaacatgcaatttactccaaaaataataaatgctataaccggttacttttttctgggccggcgagatctgatataagaaatttcagtattgtttactttcatagagacccaaaaatatacaattacaacttacaacatttgtccagaatggccattgatttcccatactgcaaagtacgtccagtactcttcctaattccattatgtttctttctgttgcacacagccatattcggctcgttctatttaacgccaactcgatccatttctacacagccctcacatcccacatgttctatcagtgagtaattattgaattgacagtgtgatatataggaacattctaatatgggcataggaggttaacggagaaatgatagcattatatttttctttggtggccaacgatgtgttgatttcccttgcacccagtatttctttttctggtagcaatatcagatgggctcttgagctgctcagcatatgtacagtatacatttggtccattattttttctgatccacaaccagtatatgttcctcagcatgtacaatatacctttgctcgagacatggaactagatgtccagtttcagaaagagttgtgactgaaggtataaagaaatacaagtaccccggtatacataatacattatatatgttacacgctctatatagaactttgcattcatcatccagcctgacgaagagctttggaatcctgttaggattactaattatatttgcattattcagagttctattcatatattagcgtttcttgaattattttgaggggcatgctaaatcataatacaatatcaaagttatctgctaggtgtttatgtattcaattaaaaacaaattaaagaactaaattttttattatacttctagccagtatctgctaactatatggtgctaatggatttctagatctatgctggtatgcccatctgcacttgtacgtgaatgacccccctgtagagtaaacaaattaaaccagctactatcattatagtggccaaattgttgtcatcatcctcctcttctactcctctgtggaccttgaacttaactgtggtaggaaaggaaattaacatcaccattatatatggaaacgagaaaacgaacgaccttaacaaagatttgttttacatttaaacattctgttaagtgaaaaatcaattgctctcattatcttcgtattagagcttctcgcagaggttttggtgttcagggaatgattcgaaggaaccttactaatattcaataattattgttcaaattagttaaaacaagcaattaattaatgtgtgctctcaaatgttctttcttggacactttgttttttaaaatattggtagtaggcaagccgagtttgggaaattaataaatactttcacctttttgacagcaattaaaatttatgtcttcacctacaacgaccgaagataattgctaaagagtaatagctttgctcttccaacgctatcaagccaacatatagtgacaaaacacacatctttccccttacatgttcttgcaaatttgagactacgaatttgtcctagctggttcccagttatacatattggatacaaaccctcgctgcaggaccacaactatcgattggtatatgggaatgagaggacaaaggaagaacactataaatagaggcgtcaagcgtccaacattctgtcatactcctgcagcgaaacatctctgtctgacctgcacctgtccacaagcttgtctaggtagatcgatggctgtgcatgtagagagcgtgtgtgtgagatgcagccactgttgcctccctctaccatctgctgggttcaatgtgtcggatgaatccttcaaggggaagtcgttgccatctctctgcatatcttgcattaattagtggcatcttctttttcataaagtatttgttacatacagaggtgaaaattaatgcagcaaaatagggacaccataattaacgcccatatgatataattatattgtggcactttttagtgtccaatatgaaaataaacatgaataactacatatgaaaacattatttgtgtctgtcgaaacaagatttcggcaatactaaaagggggtggctattaagctaaaaaagtggatgtgtttgaagacaagaaattttatataggttcaggccttcttagttaagaagtaataccctactcctgtccggggatgattccgccgagtgtattattgatcgtatgatctaggagaaagtcgtgtccatagagggacccggacccctccttatataggggaaggagtccgtattacaaaatactgtttatatccctaacggaatatgtgattatagataaattacaatcgtaaccgactagaatctcgggtatctccttgacatacaagtttagaaactaacccgagtcctcataaagatattctatctatatctagtaccccgtacctaaccagactatacatgccgtgtagatatgggggtatccataatctccacagtagcccccgagacctttacagtcgacgaaatggccttctctcagaacataaagcaatgatccgagtgcttcaattccttctgctctggtatgccgagtactaaaatcaaaaactgtgaagggcgaaaaaagaaataaaactgggtgcatcgagtagatgcacctaattaggtgtagcccccgactatgtggttagttaaaaaactaaacatgtagtcaagaaccgagtggttttacaaccaaacatcatataacaaagcatacgtggtattcaaaaaaacacctagtcgactgctttttagctttaatgtatcgagaatgaaaatatgaaaggctgagtgataaacactcaaaaaagtccacaaataggcatatttgacaagaattcgagtaagaaactcttaagatgatccgccaaatatgataaaaatcatggtaattaacgagtctaatagtctaggctatgaccctcaccacaaccaaaataagcatataacatgccaagagaatgactcttaataaactagtcatctcgaatcaacccaaacagattttgcagcttaataaagcttataaaaatagtataacacctttctgtcgggcacctttttatttgcatcgtagtaattccaaagaattatctaaccgcgttaaaaaaggattttaacagcatcgggtcacatcattgtgagcacaatttgccaaagaaaaaaagcacctaagtccctagggatcacaacgggccatgctggtaataatattgggctgaagtactgtataggtccaggctcattagcactcccgataccctaacaaaacaccgtagtccaagcgacgcttcgacttccccgctgagactctcgccatttccccattcctcgctagagtacaaaaccgcgccgacgaagctagggttcatcaatccgctccaatccatcctcaaaaaactccacgaaatttctccgcgcgtccaccgcaccaattccccatccctctccagccacatctcggaccaaattagaccatttagctcacattcatggcggaagagagagaaagcttcgagagtcagtgggcgccctccaatgtgacggaggagaatctgaaagaaatggtggcgcacggcgttcttctggcgaaggaaatcattgggtggcgaccagcgttcggcgaagctttcccgacccctgatacacacgaggtcgtggtattttctcacttcttctatggcggattttctcttccaacctcaagattcttccggggaattctgaatttctatgggattagcctgcatcatttgaatccaaactccatagttcacatcgccaattttattcatgcctgcgaagcttttctggcattaggcctcattttgctttgttccgccgcatcttcttcctcaagccccaaccgaacaagagcaagccatgcgttgttgggggcgctggtttccaactcagaggaacattgagccaaaagtatttctccatgcccttcaagacctcaaacaaaggctggcatgcaaactggttttatgttcaaaaccctgaacccgcagtccctgagtactcttgtctccctctagtctatcaggacacttggaactcgctgcctatgggaaatgaagccgctcaggcagtagaactgatggaccgcatgataaagctgaaagaacaaggtcttcaaggagaacagatcacccggcatttcattaagagccggttagctccaattaaggagagatctcgcacagcttttgaatttgacggcaagcatgatccaaattgtgaagatccagattcccttgattttaaggttatgaaagaaagaatgtacaagattttctccaacgctatcgtagtcagctattcacacttgctgccagtggtgccatacaacgcattcaatcctcctccaccggtacgtatccaaacacttcaaccttcctcaaaatatggtcttgtctcttgttaaatcagttgacaatggaagatactatgctcaggagtttgctttgatgaagtcggatcccccaatcgctcagcgtcgatcacctcgccgtcaaactggtcaggggagcggtgaaccaaagatccggtctgaagcccagccgaacacctctaatccagccggccagtcggattcccgcaagaggaagttagttctgagtgacgacgaaggcgatgatgctggaaagcttggagataaagaaacaatcggaaaattgccgaagcatgccaatccaaagaagaaaacatccagtcgtcctatgccgaagatcaggaagttttccaggtacgaatcatataacgatcttccttgtattgacgctcacttatcatgaaaacaatgctgataatataactcaaacttgtaggaaaccatctgatatagacccttttgggaaagactctgatccgactaacatggagacgagttcctccaaagaaactgggccgactgcaaaggatcatccgagtgacaatcagccggcaaccgacaatgtagaatctagctatcaacctccgactggaaaccagtcggccgaagctgaagtcagagttaaccaggagcccccgactggaaaccagtcggacatagggccaagccaagagattcctgaagttgaaactcaagcaaacagccctcgcggacaggatgccagcaatgacccaagatctggatctcctgcaaaggcacaagaatccactcgtcctcgtccggaaatcatcacgggtaaatactttgtctgaaatcatgttgatccaactgacttcatttgattgttcaacctttatccatggacacattaggaccaatgattggtgatgaagaagaaattctccgaatacgagtggctgaagattcgcaccctcccattctggtcaagtggtgggatgacgacatacaaccttaaggaatcgtaataaataggcaaaaagaggatgaagaggtatgcctattgaaaaaggcactcggccaggcaactcgcattgtaaacgtaagttccttgacgcctgacgtcaaccatcttgtttgccatttagctcgagcgctaataaaactattttgcagaggattcaccttaggaatgaagcaaaaacagcaaccttagagaaattagttcctcatctcggaacccttgaagctaccagagaccaactgcacgaggcaaaagaacttgccaagaaaactgagcatgatctaagggatcggatcactgagctccaggagtctaattttgaattgagtggctcatcaaaaggtacacacaaactctgtccaactaacttgtgctgtcatctttgtaatttcggttaaccagagtcaatgtagtgcaagccgccaagatatctcaactggagagaagcagattcagactctggaaaatgacaaggcagaactggcaagacagagggactcggctttgaaggatgttgaaggtaccatcaatcgataccccaaaagccattatcttctatatgctaactcattaatgtgaatttgttgatgtagaccgtaagatcaagtcgcaggctcaattcgacgtcctagtcggcaaaatcaagaggctcgaaggggccagggatgaagttgctaacgatgctaccccactggtccaagcaatgttcttcaataacaacggtccgagtacattcgatgcttccgaaatcttcgacaagctgagagttgctccggatacatatttcaagaacatcaaagaggccgggagtatgggagcgagtctggcgttggcaatgaccaagttcctttacccaaaaatcgacattgatgccattgatggatttgcagacgggacgagcgaagaagctgctcttgaccttatcaatgatgcgtagaaagccatcgacaagatagcagtttatgtagtcgagagattccaagacaccgagcttcgaccgactggtcctgataactccgatgatgaaaaaactgatactgattgatgtaatgtgataacaatgattctgatgatgatgatggaggcacaatttgtacaatactgatgaatatatgttgtgcttagtgtttcaaacttagcttctgatttcttaaaagcttttgtcaagccttattgagcctaaaacccgcaaaagctattaaaaagctttcagtcctcatggactaagtcgaaaaatcaggcaaggcaatgataaatcaagtaagcaaattgaattgataaagatcacactccattattattataatagcccctgactaataacttcaaggagaagcttgatgttgtcagtcaaaataggggaatacagaagcaaaacttaagcataaaaacgacgtagatgttcgatattccaagagttgttgataggtgtaccgtcttcatgtttgagtcagatatgaacctggccgagtgacttctgagattacaaatggcccttcccataaaggggataacttgtgccgatcccgtgtagtttgaatttttcttagaaccaggtcgccgactaagaaggctcgtgatcggatgttacgattatgataacgacgcaacccttgcaagtatcgggccgactgaattaaggctgcttcgcgggcctcttccagtcggtgtagatcatccactcggtcttctccgtagcgctcctcgcgaaaattgcgaaaacgcaaagattcaaattctacttcactaggcaacattgcttctgctccataaactaggaagaatggcgactggcccgtagaacgactaggggtggtgcgaaaggaccaaagtacggatggcaactgttccacccatttgccggcataaggattcagtcggtcaaaaactcgtgcctttattccttggagtaccatgccgttggctcgttcgacttgcccattgctcataggatgcgctacggaggcataacaaattttaatgccgaagttttcagaaaaatctttaaatactccgcctgtgaattgatccgattgggtaccccaaaccgatgcacaatgttgatgaaaaaatctctagctttatctgccgtgattgtgatgaccagtttagcttcaatccacttggagaatttgtcgatagccacaaagagatgtgtgtaaccgccaactgcctttataaacgggccgaccatgtcaagcccccaaaccgcaaacggccaagacagcgggatggtttgcaactcttgggctagcagatgagtttgttgggcgaaaaattgacaaccttcacatatccgcacaatcttgtcagcatcggacacaacagtaggccagaaaaaaccttgccagtaagccttgccgacaatggtgcgtgcagcagcgtaattgccacagataccagaatgtatatccttcagcaaattgtctcctttcctccaaagacacacagcgttgcacgattcctgatggacttttcttgtacagctcagtctcatgaataatataaagcctgctgcgcctggaaatccgctcggcttcatctttatcttgggggagttcttggttggtcagaaattgtatgaggggctctctccagtcggcttcaaccatggctatgtcttgagtgtccgtggcctcagctgtttctctccttggtacggttggttcgtaaagatgttcgacgaacacgtcagaaggagccgcttcgcgtttggatccaaaatttgctagtctgtcggctgcttcattattgtgccgaagaacgtgggtgagtttgagtccatcgaacttatcctccaacttgcgtacctcttgtcgataagcgatcatattgtcgtcaaggcaggaccactctttcataacttgattaacaactaactgtgaatctccgcgaactatcaaacgcctgattcccaaagagattgcgatccatagtccgtgaaggagcgcctcgtattctgccacgttgtgagatgtagagaaatgtatccatagcacgtagctcagtctttctccagtcggggaaattaaaacaaccccggccccagtgcccgaaagtctctttgacccgtcaaagtgcatagtccaatactccatcttctcctcgagcgtgtcctcttggcactcggtccactcggcgacgaagtcagctaaagcttgggacttgatcgaagttcacggcttgaacgatatatccaaggacatcagttctaaggcctattttgtgatccgcccgtttgcttcacgattatgaagtatatcgctgagtggaaacgatgtgaccaccatgaccgagtgaccttggaagtagtgagataatttcctgacggtaattagaacaccatataacagcttctgaacttgaggatatctcgtcttggagtcggccaaaacctcgctgacaaagtagattggtcgctggactttctgaacatggccttcttcttcacgctcgataaccagaactgtgctcacgacttgagaagttgccgatacgtacagtaatagcggctcttgtgggtgtggtgaggccagaactggtggagtagtgagaagtttcttgaagtcttcaaaggctttctgtgcttcgggtccccactggaaattgtctgttttctttaacagcttgaagaagggcatcccccgctcgccgagtcgtgaaacaaaccggctgagcgccgccatgcatccagtcagcttttgaacatctttctgggaactcggcggtttcatgttgaggatggcgttgactttctccaggttggcctgtatgcctctatgagacaccataaatccaagcagcttccctgacggtactctgaaggtgcattttttagggtttagtttcatcctgaaagcgcggatgctcgcaaaggtttcttccaggtccgtgatcaaatcatccttctgcttagtcttgacgactacatcatccacataggcttcaacattgcgaccgatttgagttgagaaacgtctctggatcatgcgttgataagttgctcctgcgttctttaatccgaaaggcatggtgatgtagcagtaggccccaaagggcgtgatgaacgaagtcttcaagcagtcggattccttcaatcggatctgatgatatcccgagtagcaatccaaaaaactgagcagctcgcagccggcggtcgagtcgactacctggtccatgcgaggcaacccgaaaggatatttggggcaagacttgttgaggtcggtgtaatcgacacacatgcgccattgcccagtcttcttccgaactaggactgggttagccagccaatcgggatgaaggacatctttgatgaagcccgctgctaatagcttggtcaattcctccttgatcgtgtccttcctgtcttgtgcaaagcggcgaagtcgttgtttgatgggtttagcgtcttccttaacatgcaaagagtgctcaatcacctctctaggattaccaggcatatcggatggtttccacgcaaagatatctttattattttgaagaaaggtgatgagcgcgctttcctatttacaatctaactcggcgcctattacagcagttttagtaggatcagaaggatctaggggaattttcttggtcttggcttcgctttctccagtcttggagatcttggtcgtagccacttctccttcgcttgccgtggttgcggccagtcggatgtcttctcgggcgaccgcgatctcgcgggtttgggccatctcgccgctttccttatcgcatgtgacggcttgtttgatgtcgctccgcagggatatgactcctcgaggaccaggcatctgcatcatcatgtaggtgtagtgcgggacagccataaatttagctaacgccgggcgtccgagtatggcgtgatacgctgtctcgaaatcagcaacttcgaagcagacgttctctgtgcggaagttctcccgagtaccaaaggtaaccggaagagtaatccggccgagtggtgtggcagataaccctaggatgactccgtggaagggcgcattactcggcttcaactcggtgcgagggatctgcatgtcgtccaaggtcttggcgaagaggatattgagtgcgctgccgccatcgatgagggatctgcgaagcttgatgttgcgaaccactgggtctagtaccagggtgtaccgtcccgggtggaccactcagtctggatgatccgagcggtcaaacttgattgttgtctccgaccatcgaagatattggggcgtatcgggctgaacagcgttgatctcccgttcagtcagcttttgctttcttttagactcgtaagccagagggccgccaaagatgtggttgagttccttgcgatgatcttgaaaacctgtcggggcatcatcatcatcatccttctttttcgatgtgctttgttctccatcagaggtctttcgtgcattcttggcatattgctctgcaaactgcttgtagacgaannnnnnnnnnnnnnnnnnnntggagttgggatgatgcggacattgggagttcatgatcttgtcaaaagtgttgacgcgcgaacgttgtcggaggagtgtgtggtagtcgcaacaagttcctcaggcttacgcttgcggtccttgtgattgttacttccaacccctcccgtagtcggcacatctttctttggcttccaagtaggacccgactgcttggatgcgataatggagtcttcggctttggcatactcgttggctttttcaaacatctgtttgaccgtcttgggaggcttgcgtccgaacttgccgactagatcttcgtgacgaatccccttggtgaaagcggcgatgatgacgtcgtcggtaatgtcagagatcttgttacgttgttcagagaagtgtcggatgtaatctcgaagggattctccagacttctgaatgacgttgtagagatcaaactgtgtgccggggcgaaggtgccctggaagttggcgatgaagtggtcgcgaagttccgcccatgatccgatcgtgccacgtggtaacccatgaagccaggaccgggcagaatccgctagggccacaggtaagtaggttgccacggccttgctgtctcctcctgctgcgcggattgcaagaccgtagatgataagccaagactccggattagtggtgccgtcatacttctcgattccagtcggcttgaagttggctggccaatccactcgacgcatgtcgttagtaaaggcagctactccatccacgtcgtcgtcgtagcgttctggtgaatggcggtgggcatggcctcgtgctgcacggcgctggttgatcgtatcacgaagatcgacggggcaccgacgaggtggggagaaaagccattcaactcggcgctacttgtgtcgctcaggaggcgagtgaacagatcgctcgtcgtggcccctgctcctgcgattggatcctgcgccggcgatgctgaggcttggctggtgataatcatgagatcggagatggggaacccggctgccagtcgacatgcggacgcttccggagttaaccgggaccgaagtggcaatcatggtcttggtctggttcaagatgttgacgacttgatcagcttgattgagtgcgtcttccttgaggagggtgtcgaggagggtgattttctgcgacaacgttctgttgaggggtacggaagaccgctgtcccctcaacgtcttgctgcccgatgagatctcgcgctcatcgccctgcgtccaaggctcgttgtcgtcggtcctcggcctcctttgcagcccattcgcgttcttgttgctcacgctgcagccgttcttgctcttgtgcttggcgctcctcttccagtcggcgtcgctcagcctcctgttgtacgcgtcgtgcttccgtttctcgggcttggcgttgttcttccgtctcgttgtcggccatgaaaacgctgaaatagagaggggtgtaattatcttcaaagctttcgtcaaagtcgtcgaggtcgcggttgtcgtatcgatagctgaattcgtcgtactccacgatctctgttggtcgtgagtcgacgcaaggggaactgaagtagccttccaattgatccgtcgaaaccgtgccgagtggctggagtatgacgccgacttccctggagctaggcaggatcggtgttgaagctgagttccgcctaggcctacggggaggagacgcccttgtagtgaagacggcagccaaatcgtcggggagtttcatcaggattggcgggtaggccccatcatctcgatctggtgttgttggagtagatgggatctcgtccgagtggtttgaagccgactcgatcaagataagcttggggtagatcttggccgagttcggaataccgaacggggctgagacctggtctctccctgactggttcgaatctgagtcaaggagagagatcttgccgaagacgttggtgatgaagtcgaggttgccgaaccgaaacgcctgcccgggagggaagacgaagtcgtcgatgccggagacggaacccattgcactgatcggcgaaaaacttgacgcaacccctacctggcgcgccaactgtcgaaacaagatttcggcaatactaaaagggtgtggctatcaagctaaaaaagtggatgggtttgaagacaaggaattttatacaggttcaagccttcttagttaagaagtaatactctactcctgtctggggatgattccgccgagtgtattattgatcgtatgatctgggagaaagtcgtgtccctagagggacccggacccctccttatataggggaaggagtccgtattataaaatactgttcatatccctaacggaatatgtgattatagataaattacaatcgtaaccgactagaatctcaggtatctccttgacatacaagtttagaaactaacccgagtcctcataaagatattctatctatatctggtaccccgtacccaaccagactatacatgccgtgtagatatggggtatccataatctccacagtgtcaattctgtcatcttggtaggaatcatatatataatgggtgtaacatgaacatcaccggctgcaacaatatacgctctccatatttataatgggactttcggaagaatgggagtggtcgatctggacaaatttgcgagagcactgagagtgtgatggctatggttcagttgggtgtgcccaaacaagccttgggcagtgacacacccccaccttgtgatgagctcaatagaaaactatttggatcagcaactaaggtggagactgatgcaaagcaattatttgggaatcgaactggattggggaacaaccactcaaggaatctgctccgactttatacaagcatgccaaaatcaaagtaaggtcagtccaggaaagataagctaatgaccaatgggtagacgatatctggcgcaacctcacaaatcagctagtcaaggcgtactttgaggtattcaaccaagtatggagcaacggcatcaccctcacggaaggtgtcgacgataccataactcggagatggacgagcaatggaaaatacagtgcgaggtccgcctatatagcgcagttcaatggaaggataataccggctgcagcaaaactaatctggaaacaatgggaaccctccaaatgcaaacacttcctggctcttgctacaaaataggatttggacagaggatcggctacagatcagacaatggccaaataattgtttttatcaactatgttataggaacctagaaacaactcaacatctctttaaagattgcccttttgtgcgacagatttgggagagggttctaagtaggctgaactgtagtgaaattgacctgacagatgatgaaaatgaactattgctagactggtggatcaggaaaacatctcaaggtgggaaagacaaagccaaagcaataaaatcagtccacatgctagtagcattggaaatatgatgtgagcagaacagacgagtgttttggaatcaagaaaaaaccatgccgcaactgcgggccaagatacaggatgaaatcaagctatggagcatatgtggagcaaaacacatcgcgagattatcaacctaatactcattgattgattagtggtattttctacttgtcttttcatccctcttccctttttcccttttcttctttcatcgctggtgatcatgtaaataattttttccctgcttaatataacaccaggttagcctggagtgttgggtggctgctgcattactaggtgtgtgaatagggtggtggtttaggattaggagtacattgacaattcttctatcaatctatattatatactaatatcccactgcacatcctacaaatacacttaagtcatcacgtgccacttctataaatgctagaaaatctgaggaataagaaaaataatatagctattgaacgtttttaaattggggcatttgcaaatttgccaccggttttttcaattttgcaaggatgccactcgagtgacagttctagtggcatttttgcaattttctagtggcagtcttgcaataacgattcaaagtagtggtaaatttgcaattgtcccttttaaattagtggacccattattttaaaccattttgatttatctgaatgcaggcacacctcctagccctttttaatcttatggttgttcagttttaatccatactttgttatagattaagatatcgactggtcaaattaattccttgacttctctcacgggaggtgaaatcggctgtagagattctcctcgatggcaagagcttcggttggggtatggaatagatgagagatgataaagatagatgtgctagtagtaaactcacaaatacattggaggaagctgggaaaggatcatagtaagcatgattttgcatgcttaccatcgacgttatgttcttctgcgtaccaacgaactaagttagtttggttggaattggcaaacattatcttgatgtgttcggtgatcgggaggttcaccacaacctctacgggccactccttttgacttcttactttcatcagcactagcatctattgtatctagaactcgtgcatacaggacaagcatctaagtcgacgtactcttattaagacaagagctatgctgcaccgatatatagcacaacacagttctcatactctgcttatgagctcaacatgtctaggtacgtattagcaataaatcgaggatcaaaattatatcgatttatctgcgaatggaatgcatcaagaaagaagtgctccgtagacctgcatgtacattctaggattgcaatgctgctatgacatgtcaccctagatcaaccgcgtggttggggttagtatcggtctccttagatcatgtcctctactatttgtcaccaattctaaagcgctgattggggttagcatcggcctcctaagatcatgtcctctactatttgtcaccaattctatgtcctaatatcatctactcgagttttgttgtgctttactgttcaagaccgggaaggtttacaagtgagcgcatacaagtttgagatctctacaaactaaacagggcacacaacatagcagaatagaggaaacacgtagaaaacgagagcgtgaactgctcatgtttcctgagttttctcttttctatttttgtagaaatcaactagtatactcgaaaacgtacatgggcagtgcaacatgggcacgaactgagaaaattctggacaggcacagccaatcaacggagtcatgcaccgccacaaaggagacgactgattttggagaacaaatcagaattctaagtcgagaattccaactgttttaatcaacaccttaattactctatacattatcatgaaaaaaccaacttgctgcatgcaaacgaagataaatgattctccctccgtttcacattataagtcatttgacattcttcctagtcaaatgtctttaaggttgaataagttcatagaaaaatatagtagtattttcaacacaaaacaaacatattattagaatatattcaatgataaatttaataatactagtttggtattttagatgttgctaaatttttctataaacttgatcaaacttaatagagtttgactagaaaaaaaatccaaataacttaaaatatgaaacggaggaagtagatatctcagagccattgcaacatccaaaccacctatgcaggggtggcaatatcattccaaagcagatgttttgtgtggcaatatccaggcagtagaggaaggcactgggcaaggctggggtggaggttgagttcccaacaggggaaaccaccggctacaactataatctccacttgcccgagctcatcgccatcgttcagccatcactagggtggagctcacaccggtgtccctgcctattttgccttctccgcgtccatctccggccggtgagcaggagtgagaggagatgccctcggcgaggctggccttgagaggctcattgctctcctgcctcgctgacccagccttaagtgccggccttccatttcaccccactgtggagtcgctaaagccatgaccatcaacgaagaggcatttctggaggccacgatcctcgtgctagggcatatgggctctcactcatcttacatcacatgtatgaccgcaggcaacgatgtcttttcgccaatggttcacagtagatccaggggttatttttttttaaaaaagtcacatgtaggagaaaaagtggggaaaatggcacacgaaagagaattagtgaggacctgatgacaaacatgaacgaaatagtaaaacccggagctaattcttattatttcttcctaccacaccacacagtacactctttttatatacttatcagaacaacaataagattctgagcattatatagtctgatttcttgattacaccgcatatctttaatcccgaaatcagggccagagatctggcttttcattgggccatgtggctccctacaaatttggttacacccttcaaagatttgccacgtgtcaaagtgatggtattcacgggtgtggatcccctggagttgtctccaaatccacacggtggatttacttaatccaagccgtccctttaatttgatggattagattaaatccaatcccttttcccctggttacaactagcccgttttatttaaaagaaatactacaatgtagagtctataaaaaaatattatctagtatagtagagaacatgttaccttcaaactttctggcaacaattagataagaacaaacaaaacaaaaatattgcaccgatagaagtttcttgttctgtcgattattaggatgaatgagttcgatacaggtctcaataccgttaatttcataacaactcagttaaaaaagtttaaagataattattttttactccatgatctataatgctcttccgagagtattgatctgaatggacggacaacacaaaaaaataaaagtaaataggattatatctgttgtaaatgtgtaattagaaagaggtgacatggctacatctagcccatagaaacaaagtaaggggtcagattggtccaaattcaccggttggagttggaagccaactccaggggatctgcaccctggtattcacttcgcgagatagccgaaaaacattcgcctggatgcacttgctgggtgggcctggccctggcatcttgcaaggccatg

SEQ ID NO: 83434 - DNA, 14370 bp, Oryza sativa
  unsure (1)..(14370): unsure at all n locations
actgcttagtttacatgtgtagatctaatgatgcgttaatgctagtatacatctgtaatgtcatgatttatttataaaatatattaaatcattatatgcctatattctcaacaacatgttcctctcctcccaccccagcgttgtcaactcgattgaatggatccatagcttcagaatctcttcaaattaagttgaaaattgacggctgcgcgcttttgcgcggtggagtgaatttcagttcaaacatgcatgggatggaagtcgctcattgaagaaaggttggaggcgcaactgccgaggcaacaataaagcacatgcaacggagttgtaataattcatcagcggaaaagctagcggcctctctcctcttcctgcaaatgaaaactaaaaaagcagccttaacgttcgtgccacaaaaggagaagagaaaaaaaaagagaaacgcatcgaattcagtggttgttacatcatctttaatttgagcgaaaccgatgccgtgctgacgccgtcagcccgtgcccatcgacggcgacggacggacggcctagctgacggagtaattagcaggcagcaacagcaagtgccatcttctttggtgtttatttaccacgctgccattgcattgccatccgatcaagtactgtacaatcactgctactgttgaagcttagtgttcagtttgaacagcaagagcaatagtataattaaagcgtgtagcagccttgacaggcaggggcaacgagctgcctgcctgcctgcctgatcaggttctgatggagcttatgacgaactcaagaggccagagagaaaaaaaaaacgactgtcactgagactgccaggtatcactcgctcgtcttgtgtttgtttcacttgcagtttggcagtgatcgagcaaaaccaacacaaagctgatcgatttattactgcttctccatggattcatcacaactcaaatacagtctctctctttcatgcaattcatcaaatggaaggatggagataggagtaagtttggtcagagtgtttggtgtagttgccagccaggctataaacaaacagtagattggtgagttggcaggggaaatgcccagttggagcacgacaggtcacacaaacttttgctgtccgtccacgtccaaacaggacacggccgtgggtccacaaagtaaggctctgtcgtgtgggcacatctgagccgtctggtgacgagacggggcccatccgtgccgcactgcagcagtggcaattctgtagatataggcccactcaaagggcagttacggaagctggagccggactgacttacccgtagtaataggagagtacatcgggtttccgtttcatgggccaatggccgtctcgtctcttcttccacgataatcgaggcatacaatcgctgccggctgaaacgccagtgaggggcattccggcgaggaggaggtggtcgtcgcgtgctagctgcggcggtggcaccgtgttcgttccctgtacttacagttgaacgacggtgtttaatttggattggtgggtgggcctcttgttatctcctcagttttgcatgtttccactcagctactaataaacaggggaggggaagcttcccgtgtttcccgacggaatgcggcgccaatttggattggaaggaagcttaatcgccatggatggagatggaaggaatcccccgaaatccggacagagacgatggcagtagcagacacagtgggtggccgcccaccattttgcccttcttccccgcgtcgccatgcatctatccgccaagcccgcagcacccatataaaagttgcaatctttctctcaatccgcagccgcagcgactcgctcggaccccctccctgaccccattcaactagccctgcaaaaaaaaaaaaagacggccttttctttcttttttgtcctgtggtttctctactccacagtcaccacaacagtggagtactagtgtttactgtttgcctgcttcgtctccgggcattaaagtccccggagctagcctagcggtgcttgtctctctctctctcattttggtgtctttgaattcaatttttcatcacctgttggttctgctggtgttcacttcatttcttgctgaaaccgaaatgcttttgaagcactaggaggctgctcgagctctcggacatggcggtggtctccggtccggacaagggccggggagcggaggcggtggttgtggtggccgtgcgggccgccgccagggacatctccaaggccgccctcgtctgggctctcacgcacgtcgtccagcacggcgacaccatcctgctcctcgccgtcatgccgccgccgcacaactctggtatacatgcccttcctcttcaacagctttgccaatttacgatgccatgcatttttatactgtatcatggagctctttggatttggtcttcatggatcaactttcactagttcaattatttcctctcgttttaatttcaggcaagaagttctggggcttcccgctctttgcagggggttgtgcgagcgcccacaggagcgtgttgactcagaattcggatgtcgctgatttgtgtaatcaaatgatgctgaaacttcgtgatttttatgatccgaacaaggtatcaaaagggagctaacactagctgctgtgtgtttttacttcaatctttcagcacaagcacctttttctctttctctttttttttttgctaaaaaaatctggttacatttttgtgtagataattacaaaacttaaggttatccctgcatctcctggtggtgtggctactgaatcaaagcgtgcccaagcaagctgggttgtgctagacaagtaatgttatcctgtactacatttcacagtttttacagtgcactgttacttttaacccctcttccgtatctgcatcattgagcaatggtcttgttactcagggagttgaaacatgaagagaaacgttgcatggaagaacttcaatgcaacattgttgctatgaagcgctctcggcccaaagttcttcgtctgaatctggtgaggtctcccccaaaagaatcaaaatcacctctcccgccacttcctgagttgagtgattcagttggtgaaaccgaaagcagtatcaacgaacagcgatgtccgattcgtgaaccggctgtgacaccaagtagcagtccagagtcagaaacagcttttggtagcactgatgttggaacatcctccgtttcaagctcagaccctggcacatctccatattctgcttcagaaacgaatagcacattcaagaaagaggcaaccaaggataacttccagcactctgatgtcaatgtatctgattctgagagtgaagcttcaactcctccagcagcatcatcccttcagccatggatggctgacattttaaaaggatctgcgtcctcaagattagcaggaaaccgtcctagaagaactcgtactcctaccgcagatgctttgctcgagaagatctcgaagctagatctcttggctgaaatcagtgcaatcagaagcaggtctgacttgaacttcagaggaaatgtgagagatgttgtttcattgtcaaggagtgcacctcctggaccaccgcctctgtgttcaatttgtcagcataaaacacctgtatttgggaaacctccacggtggttcagctacgcggaactggaacttgcaactggtggcttctcccaagcaaatttcttggctgagggtgggtttgggtctgttcacagaggtgtcctacctgatggccaggcaatagctgttaagcaatacaaacttgctagctcccaaggtgatgttgagttttgctcagaggtggaagttctaagctgtgcacagcaccggaatgttgtaatgctgattggtttctgtgtcgaagacaagaggcgtttgctagtttacgagtacatttgcaatggatcgctggattcccatctctatggtaagctaattattattctgcaaattctatgtgactgatgaatatagcttagagcaagtttaatatatagccaactactagctccaaatcatctataaccaatctaatagctcattcatacaatagttatctataaaccattaataaatggtcccacctctcatacacacacaatattagagttcgtgctacagctgaccacaaatatgtagcctgtttttcttctctctcttctcttctctcctccacatgtgtttatagctgacttgtagcctgctattggagaagagtgcattggtcctgttgcaataactctctgttgatttagcttatgtcatggccatgttggagtaaaaagcatgagtgttaccttttcaaaccatctgttactccttaggccgtaacaaagagacgttggaatgggctgcaagacagaaaattgcagtaggagctgcgagagggctgcgatatctccatgaagaatgtagggttggttgcataatccatcgtgatatgagaccaaacaacatccttgtcacacatgattttgaaccactggtatgatattccatccctatattatgttggatcttagtcgatggatatgaagatgcataataaacaagactggtcatcttctttccattgaaatgctgttctgtttcaatagatagtaaaattcagtactacatgattaattgatcatatatgcatgcatgatgctgtgaagatgtgccgtacttgtcattctaattggcatcagtggtctttagcctcaacttccttccacataatgagggtgaagtatcgtcatatcgtgtgcaggtcggagattttgggttggctagatggcagcctgatggagacatgggtgtcgaaacaagagtaattggcacatttgggtaagtgctcagccatacaatccatcaatcctgtcctttgtgaggtgtaacttgtgaaaaaggcatatctgagaccattttcggccatgtgcagttatctggcacctgaatatgcgcagagtgggcaaataaccgagaaggccgatgtgtactcatttggggttgtgttagtggaacttgtcactggacgcaaggctgttgatattaacaggccaaagggccagcagttcctcactgaatgggtgagttcgttcacctagtattgcactatttagtgctatatcatcacattagattatgttaagcttggatatttacttttctgacaagtgacaaacgctgataacctcctttttcttatagtacaatggtaagtatgttttgagcctgatggcctcagtagtgccagactgtcagtttccactttcctctgttgaattgactcatccacagttccacactttttcctgatgataagtggcatctctgaattatcattcctgttttgatccatttgcaacaggcacggcctttactggaagagtacgcgatcgacgatctgatcgacccacggctaggggaccggttcagtgaaaatgaggtcctgtgcatgctgcatgcagcaaacctgtgcatacggcgtgaccctcattcgaggcctcgcatgtcccatgttagccacacaccattcttctccacatttctcagtacctatcacctaagcttgatttacatctgtactaataatgatgtttctcctcgcatgtatgaaaaggttctacgcatactggagggcgacatggtggtggaatcaggttgcgtttctgctccatgcagtgaagctgggagcaggagccggcgaatgcttctccaacaagagcagcagagcagcccggctcagcaagattcacagatcatggttgatggtaaaccacagtcctatgtggcgaggagaattgcctgggatagagatacgcagagcttgtcccacagattctagaatctccatctgcacaagaatgcagccaattctgtgcagcctgtactgatgcaattcttttctgctctgctcaaggcctgcagtgtgtgtacagtagtagtggtggtggtggtacagtagtagtaggcttacattatcttgagctctatctaggcttgtaagtgcctgttttgtgtcatgaacgggggaaaaccatccatgggtgttttatgggagggattgttttgcttgtttggaatctcatgtgttgggaacaagatagacaagattgggtttgctattgcttgttctatggctaggatgctgatgtttttgtcaccatgtatccagtagagagcatatctgatgactgatgaggcccagcaagaacagctcccggatgcttcttttcagactccgttgcgagcaatcatccatccgttcattcagcaacgagccatcacgtcacgtcggccgatgcgaaactgaagcagtggtggccacagcgataatccggcagggactgtgggatactgttggtttttacagtacagcaactgcaagatgaagaagctgtggcgcaagtaattgcgtgcagtgacagtggtgtggtggcctcggtcggaacgagacgctgccactagctgccattctgccaatcaatcatgcctgcacacacacacaaaagatgattcctttgcttttgaccattccttggatctgcacagtaactcacaccgtgtccttttctttcccttcgattttctgctcaacttttttcaccaggtgtaaattttctttcagaataaatcaaattcccttcgagtccatttgatgattagcttggagattcatacttcgatgagctcgtcctcatttcggcccacaatgagcttctgggctggaccggacaagagaagtacaaccagtagtgggctggatgtgcattcaattcacacatggataaactgttcctctacaaccacatctgacaaaatcaaccttacagcaccacaggtgacaggtttcagattagcctctttaataaaccatgggatccattctcagctgagcaaaatctctgaaccaacgcacacacgactactcatcagaaacatggcatacactgtccactcctgtcggaaaatagaagcagcacatgagctactatgtctgacaaacacagcaatggtgatggatgggtgcacctcggatatgcacggggatacagacaggcgataaacacaacactcctatctgggaggggcgacataacaacacagtactcaactcgacgacgacacagttttcaggtgaaccaacaagacaaccgagccgctagatccgagcgttcgtttcatttcccacctagcgaggggaactgggcctgatcttcgatcaccggagcggcagcctgtctgcgaccaccgttgccattgtaaccaccatagaaacccccacgatcaccacgacccctgccacggccacgaccacggccagggttgtagtacctctctccttcagccggcttcaagaattcattgatgctcagggacttcaccaagaatggaccaaacaggagaaggacaaagacaagtcaatattgtgagccagaacagccagtgtaggcttatgattaatgagccaaaaaaatgaaataccttcttggtacgttcatccttttcatccttttctttctttttcaagtccttgtcagagccctgataataataaaagttgagcggaaatagacatgtactgaaacatgttcagaggacataacaccaagcatacaacttaccagcttgataaacacttcctcattagcctttttgacagagagctgttgcatggcctgcaactccttgtcgacttcaactttcctctcctcagccttcagtgcaagcaaagctttccgcttctcctccagcactttctcatattcctccaaagtcatctcctgtgaaatggtggtagaaaattgttatttcactatcaaacgaattgctacttgaatcgcacggagtgctaacttcaagcaattacttagaaaaccctttaataggcagagaaatgagacagtagaaacaccagaatgagcaaacacatgctatataacaggcaaccgttaggacagtagggataataggaatatccaaacatgtactagaaccaacacaagaacgcctgaatgaccaagagaatttgatcaacaaatggaaggtgccatagctgaacgttcaccatggagaaaagaacgggaaaggcccaaataatattatggatacccaaaagatctactacatagcagataggagatagcattcaatacagaaggaaaaaaaattaaacaacagaaacttcaggtaatgatattgaattatgcagaaaatcaatatatacagcagcttctagttccaactgatgcaagcaaaattgcaaactttatatttctgtatttaaagcgggcacaagtcatccaccagttttgagtgtggcagactactcacagaatatataaaaccttcccatcagtcaacttaaacatcatcttaccgaagtcctggctattttgtaacatgagtatcaaaagcaaattaactaagcagtaacgcgatacattctgacataattatattgcattggctagaaatgagcaaaagcacaaaactgaaagcaagaagagcctgcaaaaactggagaacataatgcagttctcaaaaaggcaaatttaacccacatgtaaaccagttgaatgattgaactacattgcttagaatagtacagatgacatgttttcccacactaaatgaatgacctgtagctagtttctgacgaaatcaaaaaccaaaactatatgtacccgttgtgcttaaaatgcatccacatgtttgaccattcaaaggcaccagaatgtaatacccaaaactgtatgtttaccatgccctatgcccagaaagagttatcatcacctcctaaacagtaccaaatgtgcacacatgcattaaggtattaaagcacagatcagaaatataccttatcctcaggttctttttcttcttcttcattctctggactctccttgtccttgtcgacctcagactgtggcacatcttcaggtttcttctcatcctctgcagttgcaggagcctcctcagtgttaacagcctccgcaacttccctaatcaaccatatagaagagttatattcaatcgtcggatcaatcaatcacatctacaaaataagccaacaatcgcaaaccaaattgcaaaggaccaatcttaactgtgcaaggccttcatcggtgacagttccccaattgccgcggccagacccctcacgcttcaactcatagccacggccagtgccgctgtggcgctcatacgccctgcgcggacgtccatagtcgtctccactctgcccatcactatagccaccgcggcgaccacctccacggtagggctggcgtggcccacggcccctctctgcctgtctcccctcaccgtcttcaccgcgagccaatccaccatcaccaaacccaccaccaccaccatagccaccctcaaagccgttggcatcaccctcaccgaaatctcgcctcggaccgcccctgcctcctcggccgccgcctcttccacgccctgggccaccacggccagccccatcgcgtggagcaccgtagttcctcgcttcccttactgtagatatatacataaaaaatcaaatcaaatctttgcgcctaacggaaaaacagccatggatccaacaatccggtaatttctccatcaatatgcgtacggtaatcgaatcgaatagagagcactgagaagtgagaagcgtgtcatactcaccggcttgcgcgggtggcgcgggcttggtgggcagcttggccggagcgggcgccggcgatgaggcgagcttgggcgacgcggccgccgccgcagccttcttctcggcggcggcgatgaggtgggaggggtcatcgttgtcgacgtcgacgaggagatcgaactggttcttggaccccatttctccgcgccgccacaccacttagctcctctctattcctcaatcccaaacaagaacacacagacctttcaagccaccatccccgacgaaatcgccgccatgagattgatgcaaggaaggggattagggtttggcacacaaaaccctagccgccaagagcaaagcctttggctctcgtctgcccggaggctgctgctctgctatacagtacggtcatacactaaattaattccattttcagagcacggcctcactaattatttccttttatttacgaaatgacgcatttgggcctaacagtttgcgctaattacgtccaaaattctggttaccaacaaagtgtcgtgagggtagttctgtcttatcccctttgtactggagaagtactgctctttatgggcctagtcggcttacataggcttaagtgcttattagttgggccttcggattaacgggccttcggcctaaatggacaatatgtgactgcatcatgattagcaagcttaatagcgattctgtttgttgatgcttaatcttacccatgcgtcattaagcaatgggattataagattataaaagattttttatgcatgcaccgtagattagcggcagccagcgttagtggatgaaagattagcagttagtgaccaattaggtagctgtccgaaatctccgcgcattcctgaagcaaagctgcaggacaggagagggaccctgaacctaaacaaaaacaattctatgattaaccatcttctctctgcttagtcatttatttaaccccaaattaattcggttctatcatgcatgcccgtctccatcatggactgacaggcactttaaatattgtccaaatcccttgcttcaacagtggatcaaagattcatagagagtgcatgtgtgtgttcaaagaaagataatgcaaagaattatgatggattgacctcactaaagtactatccctcctatactcagataattagtggttgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacgcgcgcgctcgctcgccttgcctggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccagtgcgtgcaaacggcgtggagtccggataagttacgcgcgacttatccggttcggttacgcgcagtagagatcgtgcgggcgccctgatcaagcgacccttctctatataaaccgacctgccgtcttcacgcaacatgcgaaaatcaatctagggtttgcctcctactctgtactgcgccgtcgctcgtaaactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatatcaacaatccaaaaaccttattataggcactgtgattttactatggctggttttgccgatgcactgaggccggataaattcaccggtgtgcattttaaaagatggcagatcagggtcactctgtggctgacatctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagcttgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgacctttnttgggggggcccaaaaaaccaatttgggagagatggaagcgggtatggtaatttacctactgttttttcagttaatcaatctactaattggtgggttgatactggggccaatgtacatgtttgtgctgacatctcattgttttcttcttatcaggtcgcacggggttccaccgttctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgagactaatgtttggcattcacgtttatgtcatattaattttggcttgatgtctcggctttccagcatgtgtttaattcctaagttttccattgtcaaaggttctaagtgccatagttgtgtgcaatcgaagcaacctcacaagcctcacaaggctgtcgaggagagaaacttggcaccactagaactcctacattcagatctctgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaagacttaggtctgatcgtggtggagagtttttctcaaacgagtttgacttattctgtgtggaacatggcattatacatgagaggacgcctccctattctcccgagtctaatgggattgctgaaaggaagaaccgcacactgactgacttggtgaatgccatgttggacaccgcgggattacctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgagataccggacatgcatgttggtacaattatggagtctcgtgatgctaccttctttgagagctttttcccaatgaaggatacacatagtggttcgaaccaaccctctgaaataattcccagtttaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtacacctctggggtgcaagtgggtgttc

SEQ ID NO: 83435 - DNA, 28639 bp, Oryza sativa
  unsure (1)..(28639): unsure at all n locations
aatgattaatctatgtacagcagttcatcatttgataaaaacatgattcggtggggtaactattagtagtggtattgatcaatttgattatagtagccaaaatatgatgtttatgttgttggaattaatgaatgggccttagcccactcgaagattaattctttggaaaatcataaaagcccacctcatgggatggcatgcatgtggagtttagtaccaccttgcttattctaggagagggggaccttattaaaagggaggatgccctcctagtcacttgaagcatgtgtggtggagagaagaggggaaacgcgcgcgctcgcctcgcctcgcctggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcagcacacgcaaaatcaatctagggtttgcctcctactctgtactgcgccgtcgctcgtagactactccatcccgctcgccggcgtgcaccagcgatcgggagagcaggtctccggaacctctgtctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcaccttggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctaaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgcttacgagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttaccccgacaaatttgtggccgggtgcattattgcaaaactaccttcatcttggaggagtttcggtactgcactcaaacacaagagacaggaatactccggtgaggggttgattgcgtctcttgatgttgaggagaaagctcgggaaaaagatgccgcgtctaaggacgatggtgggcaatccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgttcacagcgcaaggggatgaaagcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctaaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattcattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcctgagtctaatgggattgctaaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcacaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaagaaggctgtccgtagtgaaatggattccattatcgctaacgggacttgggaggtgacagagcgaccctatgggtgtaaacctgtggggtgcaagtgggtgttcaagaagaagcttaggctgacggtactattaaaagtacaaggctcggcttgttgctaagggctatactcagaaagaaggcgaagatttctttgacacttactcacctgttgctagattgaccacaaatcgtgtgctactttcctagcagccctcacatggtcttctcgttcatcaaatggacgttaagacagcttttcttaatggagagctggatgaggagatctatatggatcaacctgatgggtttgtagttgatggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactaggtatcctgcggtactagagggttatagtgattctaactggatctctgatgtggatgagatcaaagccactagtggatatgttttcacactgggtggtggtgctgtttcatggaggtcttgcaaacagacaattttgacaaggtcaaccatggaagcagagctaacggcactggatactgctactgttgaggcagaatggctgcgtgatctattaatggatctgcctgttgttgaaaaactggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcactaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcgtgagctgcaaggcaggttggctatgccttaatgagttctgttgactttaattagcaaagatgttgtcctgcagagcattcttgaaagaactcacctttgtgagcttgactgttggtcgcagtctatgaagattttgggtgaatcttctaggaagcttactaaagacctaggagtatgacttatacgctctacccgaggggtagtctacagacggtctagtaccagataagactttgagtgaaacttgcttgcacaagacttgcaattcaaggcgtagtccattgttcaagttgtgagtaagtgtagcttggaattctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggaccttattaaaagggaggatgccctcctagtcacttgaagcatgtgtggtggagagaagaggggaaacacacgcgcgcgctcgctcgcctcgcctcgcctggcctggcagggcagggcagggcagggcaggcggcgcgcgtgcactacgtacgcgttgaatggtccgaaaaattggctcctcacccttgcgcagatgcagcctccttttgcagttttggtttgctgcaaattcggatacgtttttgttttggaaccgttacgaaaaatacggtgcgtgcaaacggcgtggagtccggataagttacgcgcgacttatccggtttcggttacgcgcagtagagatcgtgcgggcgccctgatcaagcgacccttttctatataaaccgacttgcggttttcacgcagcacacgcaaaatcaatctagggtttgcctcctactctgtactgcgccgtcgctcgtagactactccatcccgctcgccggcgtgcaccagcgatcgggagagcaggtctccggaacctctgtctttgacgtcctgcaccgggagaaggcggcaataaggtttttgggaagcgcttcgcgcgactgctccctgttcgttcgcgacggctcgccttcttcttcgctcgcgtgtttcgtgccttcgtagacacctgcgaaaagtttcgaccaagcagccggtcttttcgtcaccttggtacgtgttcaatatgttgcgcatatttgatctgttcatgttatactgtgtagtttacatgtgtagatcttatgatgcgattatactagttttcatctgtaatgtcatgatttatttatggaatagattaaatcattatatgtatataatctcaacatatgtatgcatatctcctaagcatgttactaatatggtgttaatatgaaatttcatcaatttaaaactagcctcgcatatgattacaaatgcgctatcatagcccatctaggcctgttaagaacatgacagtccattaagtatgtgattagtggcaacagcccgcccattatgacggcccataacacgtactgagtattgtccattggactattgggcctagagacatccggcccatcacgcccaacgccccccaccccccaacccacgctccccttggaggcgcatccaccggcctccgccacggggagagcgcaccgggaggcggaacggcgccgcgcggtgggcataggttgccggcccgacgtggagaccgcgggcgagccgcccgactcgacggaggggacgtgcgcgactgactggtgactggtggtgggtgagaacatcgcttggtcacttcctcagatccattcgggtaaaccaaacccatttttcgcgatattttaatggctacgagcagcggaggggcgtggggatttgattgcggggtaggattctactcataatgatctagtaccactgccgattccgattgaaggaattggtgaattgattgaccatgattgtagcaggtgcgactttcactagtttaacttgtgtaaattgtgtggtcctttgatatgatcgattgttgttgctccatcctccagccatcatggatgttgtggtgatgtttcaccaattgacctaaataggatcctaaatcgccctgtgccttgttcaatcgaaagtcaatttactcaaagttgagtattatcaagggttaatacggcaacacaacttcctccattttctgtatataactaagaataactcctatgcatttagctttagcatttggatttccaaagtaaaatgtatctgtcatgtgtgtagccgacccatccactaaggttgtatggttcccctcttagaaaaggtgcttcaaatcttatgttgcataattgtattggcaaaacaagtcttttttaatataagggattttggctatagaattgcttgcatagccaaaatcccttatattatgggacggaggtagtattttgctaagtcagtatgggaactgcagcattagcacttaatacattgttgtactgcctatataggtcaagccagtatctttgtacaattggctgaagaaactggttttatcttaggatgaagtctaaggaaaatgggagcattcagaaggcaggaaaagttgatcactcccaaagaggcagaccaaactgggttcttgttgcaggaggagttttacttagcacactgtcagtcagacttgggtgcaaattaaagcaaatgttcgatgcaaagaagcaaaacagtatgcccaaaggtttaatgtgcccatttacagctgtaacattgaccgctttgtccatattctttatgtgtgctgctgactctgcaaaattgcagtaaaaagaaggcctggggcatgtgatctgcactcgaatctctaccggtttaatgaccaaacaagctgctactgttgtatgtcaggtgcctttctgtaacatagcctgttcttttgcctctgtcacgcttatcagtgaataatacaggttatttggtgtgtaattttcaagtgacactaaatttagagctaaggatatgtaactgtaatatggactatctaggattccaaaaatttcaggtcaatagttatccacagtagaatagcctgccctttaatcaccatatagaatccattatcctcggtggattaaattttttgagtggggagatttttatgaacataaaagcaatgctgtatggtcagcaatttttctcccaaaaaatatttgagagtacatactaatacgctagcttcataatccaaacatatactatgctatttgcagtgccagttgatacttgatacgaatatgtctatacttgaccatacatcaatctcagtatgttaagtttctgacttactacagttggtaacgtgatgcatatttttctataagaaactcagacctagaaccttctgaatgtttgctgagtttcaacaccaaatgatacaaagtctggcctaatatctaataaatttggcctgctttttatctgcacatatttgattgcttgtaagttgatatatcttttggttatgttcattcttcaatcttcagtgcatagtcctgtaaacaacacgcctttttatttgagggtagaatcaaaatagatgatacctgagtgttttctatgattgaatgggtagagtcaaatgtgttaattgttatcacctcatgttcaagttccttattgtgcaatggaatctacaaaggaagaaaaagattatgattattagactgttgcatttatgtcctatattccaattagtaactttggatgggtttaatatttgtccatatcacgattacatctttgtggtccatttgctattacttggagccttcgaccatgccagtattgcgcgcttacatactaagttgtataagacttttcataccttaatttggcttttgaattctatttatctttattcctttgtggtggaaatatttattgctggtttatcgtatgcagcggttgcagatggagtggaaatcaggcaggctcctgggagtcctctaccaaaatcaactgacctctcccctcttcttcttgtggagataccagggccagaatcaagcaaagagaacagtggtgtcatgtggacatcatcacctgatcggctcgaagatcctcgtaaaccatttcagtactcgaacagttctggctctccctgtttttcagaatcaggttctgacatctataacaagagagaggttatacagaagctgaggcagcagctgaagagacgtgatgagatgattgcggagatgcaagctcagattgttgatcttaagaactctcttgttgtccaggtgacgcagaccaccaatttgcagtctcagttggatgctgctagccgagagctttttgaatctgagagagagattcagcatctaaggaagatcattgcagaccattgtgttgcggaagcactctctcatgataagcctttgcaagctggacattggcaatcagatgctaccaatgggcatgctaatggctatgctgatagcagtgttgatgaccctgagctgcattatattggtattgagaaaaggaagggagaggtagagaaggtggaaatgctcaagcgggaggtctgtgatctgaaggaagttattgaaggaaaggatttcctgattcagagctacaaggagcagaagctagagctctgtgggaagatcagagaattgcaagaaaagctctctgcacaagttcccaacatcttgtaggatcttctgaaagtttttaattaagttagtcatggagcagaaggggtggagttctgcttcacattaggccacggattttctggagaaggtctcagcacatggaacatcttgctaggatctttgcaggatgtttggctatcttcatttctgtgttgttaggttgattcgctttcttcagtttttctcctttgttgcttgtgctgaaagggtccctcttttcccaattgataggcctaggtagctgaactaatgatgaacttgacacgtacgtgttgtacaggtttctgatttgcaagcaaagttatgcgatgtgcctccatttagctcggtatggttgaggggagtgtcgttttggaatgtaaagatgctcttgttttgctgtgtcttctgtttgacttagagaacctaaaaaaatcttacctgattgatatttattggaagtgcttggctcgtttttcatttcttgtaaagttgcacttacaaagataaggtaattcttttgcattgtgttgacttcattattcagaagattcacaagctggggttcccaagggtgatgggctatatatgctgagatgacaaagctttccttatccattttgtttcgtccttgtgattagtgtactgtaagaaatcattagaactagggtagtaattattatttttcattcctttggccatattgcacatcttgtttgacattgttctgaattgttgccagcaactgagcaatactagtagtagcattttctgtggcttagataagcactggagcacaataccgtactgtgccactttactgaagccattttggtggcactgaattttgtagcatgcaagagcaggactcctctagtttaatgccagtttgatgagcaccagaagaatggacacgaagaagatgggcaagctggacttcactcgtccgcaggatatatctgacgatcatcatgggaaagggcaggatacccatgttggtgcgagtactgcagccaaccacagccaaccagtgatactccctccgtcctataatataaggggattttaagttttttttcttgcaacgtttgatcacttgtcttatttaaatttttttgaaattattaattattttatttgtgacttactttattatctatagtactttaagcataacttttcgttttttatatttgtaaaaaaaaattaaataagatgagtggtcaaacgttgcaagcaaaaactgaaaattccttatattatgggttatgggaaggagggagtagtttttattcatgttcaaggcagctggctcaggtacacaactacatcgatcatgcctttgtagtatggtcttaatactatagtgttgattgaaatggtcagcttaatttctatccatgcaaatgcaatgcaacaagacaaccaaacaacctattgctagagctagcatacacttccaacaacagtacaagacaaccaaacagcctagtgttcattcttgagtaatgaaaatcatgaagcgaacagtagtgcccggaacccatgcatgtgaactggcctaatcagagatatcacgtcgccgcaggtcaaaagaaagtagccgtttgtcgaataattgacactacactattaaaatttaactttgactgcttgtgtttttttttcaaaaaaaaatacaaatacttgaaaatatgttgtaaattgtgtgccgtcgtaaatataatcatattcatatatacaatttctattaatcaatcatttaaaagtacatttatggtcaatgcatgtgagacgatcctaagtcaataatgtcatttattcaagaaaaaaaaaggagtagcagcagtaatatattgatgcaaacgccgggcattcggcgatggagatggcggtcaattcatcatgggcagccggccgctaaaaggtgatgagcaaaacgttacagcgtacgaactgtaattagacaagccaacaaaaacagttttggataagcattgcatggctccatcggagacgtccatccggccacgttttcagaccggccgaatggttggccgtctccatcagccatgcatatatccgtttccgtttcattccatccatactggaagaagaagatgatgcgtgttcatcaacatacttcctttgtcatttaaaaaaacctaggtgagaatatgagaatatgactccatataaaacaacccgattatttttttatggaggaaatatatattattgttgccttcgtttgaaggctttcccaacacacttctcttattttcactctcaaattgttaaacactgtattttttttaaaagaaaaagaattatatgcgaaagttactttaaaaaattcatatttatttttttaagaaaaaatagctaatacttaattaatcaatacaaatagactactccgtttaccgggggagttcctaattctatattccaactagatcatctatactttgaaggatttatccagccacgacggcgtaggtcgtcgcctctgtcgtcgacgacaaacggcacgccggctggccggctgccggtgagctagctagctagctaaccacccgagctaattaagcaagaagcaatctactcctactctcgtactgtagccattttgtcagtcagtcgtctcgtcacaggttgatggcatcagtggcacggcatatgacatgcagctactgtgcatgatgcatggagaaatcaatcaggcgcgcccactggtcgccggccgggcctcacgtgcctgatataaaagatatacttgttcttctgctctactcccttcgtccaaaaaaaagacaaatcatggtttccgtgtccaacgccatccgtcttatttgaaaaaatcataaaaaaaattaaaaagacaagtcacgcataaaatattaatcatgttttatcatctaccaacaacaatgaaaatatgaattataataaaatttcatataagacggacagttaaaatttgacatggaaactcagggtttgtctttttttttggacggagggaatatcatatgatagagaggagagggcatgcagggatggcgacgctgctggctggagacatgagaatgtgatgagcagtccagaaataattcacgatgcatatgcattcgacacggagggatgaggacgattcgatcgatcgatcgatcaaacaagctagctatatttagctaggcccggctgatcatcgatcggccacatatagtatatgacaacactgtgctgcatgcaaagctgcacccttgatcggctttcactgtatcacagcagcttcaattcgttcccagggcagcaaaatctcgacttctttttgaccatgctacagtatgcctacagtacatatgatacaagttgcatatggcaacttgcttattcctccaagttaacaggcagggccacttaattttcactcctcttcagtctgtcactctgtcttcttcttcctcctccgatccatccatttactattattatgggcctgtttagttccaaaaaatcacataaaatctttagacacatatatggagcattaaatatagataaaaagaaaaactaattgcacagtttgcatgtaaattgcgagacgaatcatttgagcctaattaggccatgattagccataagtgctacagtaatccacatgtgctaatgacggattaattagacaaaaaagattcgtctcgcggtttccaggcgagttatgaaattagtttttttattcatgtccgaaaaccccttccgacatccggtcaaatatccgatgtgatacccacaaaatttcatttcaccaactaaacatgccctatgtattgccttaggccctatttagtttaggggcgaaaagtttttgtgtgtcacattagatatatggacacccatttaaagtataaaacatagtctaataataaaaccgcgagacaaatttatgaagcataaccgcgagacaaatttatgaagcataattaatccgttattaacaaatatttactttagcacaacattatcaaatcatggtgcaattagatttaaaaaattcttctcacaattcacacgtaatccgtatgattagttttttttatctatattcaatattctataaatgtgtccaaacggttcaaagtgtgacaggctgaaatgttttttgtttaggaggccttattatctttctaccagcgcttctggctcactgtcactgcagcttggagcgacgcgcgtcaatgcatgcatgcatgcagtcttacgacgacctgacctgcatcaatttcagcacaactcctgcctgcctgctctagtgctgtagcacgagagatctatggagtccttgttgcagatagatgcaggacaggagagccaaggaattcagagaaattcagataaggcaggcaggggatcccatgaaaagggaaaattgttcgtctgcttctctctaaccctatcctcctcctgatcgtctattcgtctagctagctctgcagcatatgcagttgatcgatcagacttcaataccaagcagtagccatgattcatcgatcgatcgatacatatgcgtggagcacgtgcgatggagccccacctcacgtggctgaggagtgcacagcggccattgctaatgctacctctctccaagactcacgatgatgctctcaccacacctggccatgcatcaaaacgcggcgccttcaattcttcagttacggatacaccacagcagtaaaatctggttcagttcttctctgccgtcgctgttggtttctgaattattaatgctgattgatgatgtgttaattgccaatatatggcaccaggctaccctgcattgtcttgttcctcctgtacacatttggatggaaatctgaaaggaaaagagagatgaaatgaaagaaagaaaagcatttcagttaaaaaggaacatgtcatgtcccctattcctttgtgagtagtgatcattcttagatctaggaaaagtcgttcaggcaagcttccagctttcgataggaatcactttacaatgcacatgtcaaagagagatagatagatcagtccaatggaggagagtagttgccatgagcaagccttcaattttagtggttggggttcatgtatgtttgcccatattttcccaatgagatcgatcgaccgatggatgctagttgaaaagttgcactgttgtcttgttgcggcaatggcccataaatttctttatttattttggctcttttaatcaccattgcatcaaactgatcctacgtaccttcatcagcttaattgggtttaatatatttcagcaaagacattctaacaatgcagatactaaatccactaaatgaacaaccactgaactgcatgcagctcatggatgtttatctgtttcagtttttcttaggagtaatcattacgctagctcctgtctgattaattagtttaatttcttttggtcttgctgcaagacagagtatatatacatactaccatcctactagctgcagatatataaaatgcacacatatgcatgccacttctggttgatctcccctgaatgagctaatcctctaattgatgtttcattggatccccttccttgcacaactcctgagaccaaatcaactgacagtgacaactaaaggataacaataacaattctttgtgtttaggatcttgagggctcatggtaaataaataatcaattgacccttcatcttgaggcaagtgtattaagaaaactagagtagtacttgcaatccaatgcaatgcaaggcaatgctggtgtcacatgaggtcagcgaggaaggaagaacgaggctatatatctatctatctatctataaggtggttggagcatcacagatcacaaagtacaagcaggtcttgagttggaagcaatgtggatgggtgtatcctatgctaattatttatggcctttattagcttgtggctctctctcaaagttgtgatagcatctgagcagaataaatattgtgcagtcacaggtggagagtgatctgtattaagttggacaggtgtgcatttcatctacttttctccatcctctctctagggttcaaagaattgttcctcattaacatttatgttttggtgtcaaactcacatgcttcgctagctagctgctcctcctgctgacactgtccaatgcttaacttgcttgcattgacagcttctagtggtggggtgtgtgtatcttgattcttgagagtgtatagatttttccaggactaaactaggtcaaacagcctggcaagttttagtgtgttgttttttttatccaagctccttcattgttcttgcctgactgtgaattcaatgaacacacagttatagttttcctcaggactaaaaaccaggtcaaaccgcactcactgaattctgaacctgtagctttgatcagttcttcagtcatcatttatctgtcaactagtactaaattttcttttgcagcaccaaaaactgcaaatgccagagtttcatactgcaagaatcttataaagtgataatatgcaatgattaaggtaataaggggcttcatcttttgctctgaccaatgaagactgaacatattagtaacataaaacgcttcagcttgaatacactgaagactgaactttaacacaaaaagatactagaaaaacaatactgtgctcttagatcagtgaccagcaaacagagtccttgacaaacaaattatcaaactaaatctggtgtttagtatgtacacgtttacttgctttctcatggtttaataattaagaaataaaagagtatatacaacacatttggtcaagctagttttgattgaacagtgcaaaggaatctatctaattggacctggtttctggcaaaggggcacaagatgaggctgtagttacttatcctcctgcctggtgtctaattggacctgacaagcatcacatggcctcctgtgttcaaatccatttgttaaaagcctctcaaatcttgcaaacatgcatggattgtgccaaatactactaatccactcactagtcactagtatgttgcttgcactcaaactgaatcccaactgtgcaaaaactaatttattcataggggcaatcaaatcaaatacacacacagcttggcaatttagaaagcgcatgtttcttgttgaatcccatgaacctgaactggtcaatcaccaccagctgaggggctctcaactacttctaaatgttagaaaatgttaacaaacaaatgctgaaattagtactgtctgtttcttaccagttatcaataatacagttaacccgcaggcactatatatacatgacatgtatatatgcaaagtgaggtacatagtttaaacacacgagtcttagtttaatgagcagttaatcatctgtgtatggcaacattattgagatgcatggaaagcaagaaacttggcttcnagtgtctgcaggatggcacatgtagtaccagctagctaagcctgccttttttttttctgaaatattcctctagatctccaaatctgaaagtggtgttgttttcctgttaagaaagggcccttggctcttgccccttgagacatttgtgatctatcatctatctatctatctatctctgtactagtaattaagatttgattttaagagtagtagttagctaagagtaagatgattaggaaccagcatttgcatttcattgtcatcggtggtgatctgatgagactaaatgtaatgagccgagaagggaatgcgtgcacagtacaaccgacccaaaaccaaagaattaggttgtctcctgacgacaaaacacatgcttacaggagcatcagagaaggaatggctgctaattgaaccagtgggctccacaccctcccaggacctgcatgtttatctacattgggccttgttggcccattactttcaaagctacctccctccatctcaatctattgctacctggcgcctgccatatttctcagtttacatgaaagacgcgcatacatgattaaatgcatatccttcagttttatatatttgtaactttttcagagtaaagatcatgatattgataatgtgctggctttgtcagaaaagccaaggtattagttaatacatttgtaactattcactaaccccaactgccaagcgcccaatgcaaattcaactcgaccggatggatcattgctaatactgtgaaacgtgttctaatcaatgatcatcggctgaatgcagtgcatgttcaaccacctaaagcttgcatttcaagcagcttcagattaactactgcaatataatgtccactaccaacaactatataacatacgtatacgtacggtcttatcttctttaccggccgtatgcgtgtgaccatgcatgcatgaatgatatgatttagctgataaaatctgcatttgcaaaactgcaaaagagaaaaattcagagatgcatatggtgctgttagttcacatggagtacagagactttagagctaggatccaaacccccaattcgatcattgatagtgaccacttactcgttcgatcgatcggtcgatctacggcgatctatcattctatccagcgtcgatccatggatgcatctatctatctgtgtccatctcatgacaaggaaattcagctaagctagacgcatagtgtggtccgtgtactgccagttgatggcttcagcagcatacgagtgctagctagcaatcgtggccatgcaaattagcttcagaatcgttcgatcacaaattggaatgggagcaaattagcagagctgtctgaatctatgtggaattacatgctacactccaatttcaggaatgtgtcatctgctagatatgcttgttaggtagattattgctgctgctgctgatgatgatccatcaattaatggtaagtaattcagtgctggtttaagcagagatggatatgacaaaatggtgccagcaacaccctaatcagggtggaaacatgagcaaaacaagtgatatatatgcacatttatgtaggacaaaaaaacaaaagaaatgggctgtttctgctggctaggttggaccaaaaggatggaatggaataccccctccatccatgtttttctggggtgggcccacacccccacaggccaccactggcaactggccaactcgtgaagtcagaatacagatcacaacccaaaatcactcaataaattcaaagaaaaaatgttctttttcaaaaaaaaaaggaatgccaatagtttaaatttaagtatgaaaatcaccaaaaatgtccactaccagaacttttttttcctacaagcaccaaagaagagcatgagttgtcattttattttcttattaaaacaacaatatacttggtatttattatacatgcatatatatatatatatatgtataggaaaaataattacactcctagtattatattaatccctagtgactagtgacttgtagtgagcgagagtgagagtaggctttaacttggggcattaacctccctgctcttcttcttcttcttcttcttcttctttctttctattcctttccttcctcctcacttcttccttcttcttcctccttcactctcctctcccctccatccaacgctgcttcgtctttggagttggagttggagttggacaccacccaccggcacctagctaggcttctctaccatcatctgtgatctttcttgtcgagagagagagcaagcagttgcatgcctgattggtcagcgagtgagctgctggtggcggtggcggccgcgcttagtcagcggtggtgactgtcccggcgatgtcgggagctgaccggctaagcatccgcgccgcggcgctggcgctcgacgatgctgccgccgggagggacaagccggacaccaagcgtgacgtcttcgcggatcttggctcgccggtgtcgccgctgcggctgcggcctggcggcgccgcggccacgccgtcgtcgtcctcctcgtccgctggctcggccaagtcgcccgcgctgtgcaatgctggggcgggggtgggtaggggaggaggaggaggccgggggagccactcaggcgagctggtggcggaggggaacccgccgcggccgccagggcaccgccgctccggatctgggcctctgatattctccggcgggagcagcagcgccgggagcggaggaggaggaggaggctgcggcggcgggagcacggcgagctcgccgttgaccaatgcgctgcctaccggtaacatctgcccgtccgccggcgtcgcgagcgcggcgcctgcgccgccccgacgcgcccgtcccgacgtgcttggatccggcacggggcactatggccacggcagcatcatgagaggcggcggcggcatgactccccttagaagcagcattgacgccagtccgtaccacggcagctactcgaggtcgccggcgccgcagggcagcagcgggggtctccaggaggtgaccagggccgggaacgagtggtacaagaagggccattacggcgaggcgctgcggcactacgaccaggcggtggcgctgtgcccggacagcgccgcgtgccgcagcaaccgcgccgccgcgctcatcggcctcggccgcctcgccgaagcgctccgcgagtgcgaggaggccatccgccgtgacccggcgagcggccgcgcgcacagccgcctcgccgcgctctgcctccggtgagattctttcgcccttgcgcgttcgcagattcgtgtgctccacagccccaaacggattcacagatctcgccttgacatctccgatctttgatgctttcgtctttgcttatgcattagtgcctgacataacttgtgggtcaatagaacagggaattgttaccgatatatgctgctccgtatacctaccgtttctcttgtcttcttgtttgtttgatttgagatgatcagtagctttgcctttgctgatcatcaccagtaacaaatttacttgttttggaagtaaaagtttgatcttgaagttactgagaagtttttttttttttaaactgaagttggctagcaattgtgtggtgagactgggaggtctggaaatgtttgtatctttgcctctttggttggtatgctgaagttaatcaatgtgctcttaatatgattcgcatcaaaacaatgtagttgagagtgagtgcttacctgtattgtacattgtatttagaccgtagtacaggggagtcagtggtggtcctaatctattcagtgctaacgttcaatcaatttatgggcagtagctgtttgattttgtcactgaaaattgcaccatgacggctgcatgcaggtttggaatggttgagagggcaagggagcacttcatgttagctgggcaagtaaatcagtcagacccagctgagtttcagaggctccaagaggtggaaagacatctggggcgatgcatggatgcgaggaaaactggagactggaagagtgcgctaagggaagcagatgctgccattgccaatggagcggattcctctcagttggtaatatccccttccagcttatatctttgttgtcctgtaggcattgttgttttgtggccagtgttaaaactcagtcaatgaacatggaatcgaattatggttgcagcttcttgccttacggtctgaagcacttctccgtctcaacaaactagaggaggccgattcgactattacaagcttgtcaaaactggacattgcatcgctatcttcaatgtcaactaaactatcgggcatggttgctgattcatatgttcatgttgtcgaagcccaggtcaacatggcttttggaaggtgtgtatgattctcatcttgataattatgatttgttttcgtggtccgtagcaaaactagcactgaggtttattcctgcaggtttgacatagctgttaccatggctgagaaggctagggttattgatcctggaaatacagaagttggaaggattacaaacaacataagattagttgcacaagctcgaggacagggaaatgagctttttaaggcaggcaagtttgctgaggcatccttagcttatggtgaagggctcaaatatgagccctcaaatccagtactgtactgcaatcgagcagcttgttggtcaaagttaggtcggtggatgaaagctgttgaagattgcaatgaggccctcaaagtccatcctggttacacgaaggctctcttaagacgtgcagcatcctatgcaaaggtaagcgatacatgtatcattgtatttctgattatttgcgcattgtggtgttgatatctccctgttaacactcaattagcttgagcgctgggccgattgtgtgcgggactatgaggtgctacgcaaggagcttcctaacgacacggaggttgcggaagcattgttccatgcgcaagttgcactgaagacagcacgtggggaggaggtagcaaatatgaagtttggaggagaggttgagacaattaccagcatagagcaactccgagatgctatacattcacctggtgagcttttcttctacagatttttgctgctgtaccgcaaggtcctgtcatggtcttttgcatttactcattgaactatagccgttctagtattgtgggtaatcagaactatcactgttcttattgacacacttcactaggtttctacttactacatgataaaatttcaaaatcttgcatatcagcatgtatttaattgttttgaagttcacaaggcggcatgagcctgaacataatttatgtggtatttgttcaggagtatctgttgtttacttcatggcaacgatgaatcagcagtgtcaacagataaccccatccgtggactctctttgctccgagtgcccttcagtgaattttctgaaggtaatccacctaacatctctctctctctctctctacaatgtgcatcgcatttgatagaagtttcaaaggtgctaatacaatcccctctgtatcgaaactgtttaggtaaatgttgatgagagtcctatggtagcaagagcggagaatgtgcgcatagtcccgagcttcaagatatacaaggacggtgcaagaatgaaggagatgatctgccccagcttacacatcttgcgctattcagtcaagcattatgctgtctccagttcttgaggaggtcttactagtggcactcatattttttgatgcatataattccctgtcacctaccaacattttaccaacaaactattctctataatcagcctccacagcatttctccagctgcatagttactctccgctgagcataatgagctaaagcttgattcacgaagtagtttcctattggctatctttcctttgttacctgttgcatctattttctgatccttcatccttccaaccttattcttggatcatttaggttccttcatttgcttattcccacccatccatcgttcggccaacctgcattgtgcaattctttcatctcttacattctgttctgccacctcataatgcatttgacacatttttgctgcagcccataggccactcctcaagaaaaagaatgcttctgttctgacattgtttagatgcaggcatgcttgttgttagagaaagaaataagaggctgcagacagaattggtttttttcattacatgtacatataccatatagcaaaaacatgaaaccaattggaagatttgattctatggagggatggtggtgccactttgcagtggacagaagtacagggctagttgccaattgtagagagaagatagatgaagaaagacaatgtaattggtagggagataatgagggaggtggttgatgtctctttgcatatgcctctgctgggtctgtggtgctgatacatatatactacttgctgacatttttatgaataaaaatagcccaacattctttcttatttctactcagatatgcagtcttgcttccatttctgtgctgctgtgatgttgaagcatgtttctgtttctgtattagcaacaattttgtcaaaaccataggtgtgctgtaacttcagcagatgatttcataggtgtgctgcacactaactacttatagtcggtgagaaactgcaaaagtagcagatgatttcataattttgattgtctgatttagattgggcccacctgtcaggattgtgctaatgttgtttaggcagcaagtacctcctactgtagtataatactgctcctacagaaataggagtagctgcttttgcagcagatttcatgcacagcacagcagtaacaggaatctcttggagaaagaagcaccggccacgctcttgtttacttgtttttttgcatcatttgtggctgaagattgaagcacctgtcgtccagcaatgtgcttgtcgcaacttcccacgaacttggtagtgagtgtaagaaagaaagagaaaaggaaagctttatttttcctctgagaatcgaagaagatccagccatagatttcagagtggttttcgtcagttctgaaagccttgcacttttttcagtggattggctggtatactccagcctccaggtgtcgactgactgctgtgcaatgcaaatactagtactagcatgcaacaacgtgacgtgatttggtcgtcagagtctcgagagatgatagtccaatccaatgcaatgctgccatgtttttgggtgtgtttagttcacgtcaaaaatagaagtttggaccctgtttagttctaaagttttttttaaactttcaattttccatcatatcaaaccttttatacacacacaacttttctatcacatcgtaccaatttcaaccaaactttcaaacttcagtgtgaactaaacatagccttggttaaattggaacgatgtgatgaaaaagttagaagtttatgtgtgtaggaaaattttgatgtgatggaaaagttggaagttcaaagaaaaagtttggaactaaacagtgttggacacttggccatctccattgatgaaaccaatcaggattcttctgcacgctagaattgcagtcctatggcgatctgactgaaaccaatcaagctgtgggtgctttgcagtttgcacacacacatgttcaggtccacatgatgaacgagatgtagtgcaggttacttgatcactgggcagggtttggtaggagtagcagcaatgttgattgtagtaactagagattgtcttctggttcttgacttgatcactggaatgtgtcgtactgcagatactaatgcacaatgaatgtaatgttaatgttaaaaaagaaacaacagctactactactgcttggctgatgaagaggtagtaatgctggatctcttggtgtagaagtgaagcaagctgcttagcaatcttgtcggaatttctgcgtagagaccgggctcgtgtgaattcagatacagaagagtagttagcttagctgagtgagccatgtgagtgtgtcactgaccatttcatcgctgggttgtcgttgaagcctgcctgccattaacaagggtaccaacacatgttctgctcatcgacactcgttgacgcgtgtcccatttcattgcttgtttgtttggggtcgcccccctttttttatctccggggaaaagagaagttttttccctgatatcaggccgacatggcgacaatataactatgcactccaatctcaataagatggcgatcaaagtataagcaggctgcacaactgcagagattgggcaccgacacgccgccaagcacgcagacaagctaagcataacaccacaatttctgttccatttcagtcccttcaggtacacggcttctgttccatttcaaaactcgtttgtttcggttcatactctttccgtctcaaattacttgccgttacaggtttatcctaagtcaaacatatctttgactatatgagtttatagaaattgatagtcaaatattaaaatgtttaccttaggacaaaactagaacacaagtagttcgaaacagagggattacttgattttctgcaggtcactggctggaaactacactacctcatgggcactgtctttatttcactatactgctatctaccaaagtggaaatatctaaaagaatgaggtgaaatccctactgttacagatgtgagtgaaacccccttcacaaaatcatctaaagacactccagcgcttagcaaactagcactggagctcaactagttgttgcctatacagctatctaaaacaaaattttatcctggtagatatccaatgcatcgatgattttctgcaggagcagcttccggtgtagccgatatctgcatatcaacagaaaaaatgtgttaacaagcaagtggtacaaacaaacataaacttcatgggagcaatggctaaaacaacttgctagttcacatacttgattgcgatttcacgtgttcttctgatatgtccatcagaatctgcaacacattacagaccaatcatttgcatgtatttctcggaaggactatgaaaaaggctaaattaatacttgggatcctgatgggccttacctagaatctcctggtcttgttgaatagtggttgaaaaggactccagcatcgtatggcattcctcttgtaatgcctgagcagattttctttccaagcttggtatggcaggaacatcaccttctgaccatgtcggcagagttcttgctgctgccacgactcctccatcaacaaagttgttttctcctgaggtcaatgcagctgcaacacattggatagttcaaatcaaaggttccgaatcaaggcatgttgcagaatggttcgcaaggtcatgtgttcctagttcctaccattgtggtagagctcatcatgcaagccagcaatgttgaagaccgacaggaaggagtcaagatgaatcttggcatcactcgagaagtttataagctcccaaggattctgtagtgtttgttgtgtgcacacaaccatataagaagtcacattttttttaaaaaaaaaaatgacactgtagttgtttcaatgcatggtatcgtattaacatgcctagcaatctagcatagcagcacaacatatttgatgctagagttgtttcctttaagcagaaccataatctcgcagatatagttatacttatacccaacacaatattcctcaatgctaagtcctgccaagtgggaaaggacagatgtggcttgcaagaacaagcaagaattaaaatcaaacacatgatcataccgttggtgatgagaaaccatatctttccataaatgagctgttcactccactcatataatcaattgtcatctgtactgggtccatagaatgaaatgatcaaactggtttgaaattttggatggcatttaagtaaagttggcaactttccatgcaaataaggaatttttaattataatataacattaaactagtcgctctttgctcacaaggaagctaattgtactctaagctctaaacagtacctcatctccttttttgacagcatgcccagccttaatcatgacttcaaccatacgatctttgaaacgccaatgcaggaaacaattagcatcaggtgaatgattcagcatatctggagacaaataggcaagctataagttatgatgagactcagtatcagtaatcagaagctagaatatgctgattatcagaacagtatagttttgaatttcatgcctttgtgataattattaagtaattcaatgtaactatactgcctgactagaacgtctagaaggaataaagcgtagtattggtgtgaaaaatgacaatagatattagttagatccttattccaacagagtttaaccatacagaagtagtgctgatattagaaaatataatatcttggatcagttggtaactatgatttactgtgcaagtaacattagcgctataacattataaaaacctttatagcattcgccagctcaaaataaatggagcaaaagatccctcagaccgcagccttgacttagactgttagacatctgattatcatcgcaagctgaagaaactaagtgattttattcttaattttagtaatcggtgcttaatacacactgaaaataaaaataaagagcataaaggggaacagataagaaaacatgtaccagcatacggcactaggacatttgcatcttggaggaaggctcccattctcagtttcaaattgacagagcgagactgaacaatactcagtgcccatagaaatctttcatggtcaggggcaagacgctttagctttagagggattgttttatgctggacattacccatcaagctagtgttagatgtacccaagccagcgaagttgatcaaatagtacagaagtgtacccaatgtttttgccaaaaatcaattgctctcttctggttctttaacattttcgtggcaagatcttggtcttctagttccattagatcgtcctggcaagccaggcatgtaaattcattcaaactgtattgtcaggtttaagaagactacaattcattttgtttagatttacaatacctttggtgccaaaagcaagctagtgcattcatcaacactaggcaaaaaatcaccatatagctgccaaaagttgtcttctacatcaaatgcatagagaagaaggcaagctaaccttagatcccaatctgtctgcaagagggtacagattgcgttaggatgcagtctacatcacttatgaagctttgacaccgcatgaaggaagaaaacaggttgcaagtgtgatgagctactggcagtctgtaatcatcg

SEQ ID NO: 83436 - DNA, 3196 bp, Oryza sativa
ggattctgaaatttttatactcgggaaaaccacagtactcccattcttgaaattcaacttaactcatttaaatatctagagaatctagatagagaattacttatatggatgcggtcctccggacaatacatctcatcatgaaaacgaaatacattcaaatttgaacaaatatatactcgatgtatattatattatcctttactatcataatttccaataacgttaaaaatcatattagatggctgtggcaattcagatctagcaactaaattcttctctaaacagttcaattgacaaagattttcaaattgaatatagccccatgtatttgaagaagataacgatttaagctcttcattctctctaaaaatgtgaataacatgtttaaactcaatatatggtggttcaagcatagaattaacatgttcatttactagttgtggcatggatataagtgaagcatcacacatctcttcttcgtcgttacctaaaacaacaagcaaatttttttgtgataaagatattttagtaattgttttcactattggatactctaatatagcgtaagtagtggacatatttagcgcatcataactatgcataccttgagtaaatgtagcatcactatcattaccattatcattatcgattgtaacatgatatgctctatcgttaaccataaacctatttaaaataaattgtggcaatgcttttgctctgctttctcgatttgaaaatttagcactttttgcaccaaaattcttacattaacttcaattgtagaaggtgacataccaactgtggtttgtctcccatccaacattatctcgtgtcgatgagtgatataacctgccgttgttagtagaaaacagtaaacaatacataagaacaagggtgatggaactcgcaaatagaagtgtcttaccgtgctctaacaatgttcttaccagcaaaggtagggatggtacaaccgatgcctgataatgataccttgaggatgtgatctaacaattgcaaggttaaaactgggatgacaaaaaatatgtatgtgtagcttgggggcataatatatagtagcaaggaaaagcatttgtgctaatcagtaaatacaaagttgaataatagttgaaaatactatattgagctctagctcaagtaagcacccgacaacactaaatcctagaaacaactcaaagaacaactttgcactccccaaacatattaaaaagagaaatgttttcttttctttttcttttttattcttttcccttttttgccttttattggtgcggcttgttagcaccattttaccttttctctttttgatctttttttcaattattacttatcaatgaacttcgactagggactcaaaagtaaatatgaatattacagagactcaaatgtaaaagacaaaagttatatagtgactcaactacaatgtaccgtttatgtaaaccaaaatttggtcactgtaaaacataaagactatcatcataacctacgtcggatcgacactaaattgggccaaccaagtggagcaaggtaagccttgacgcgatggaggataacttctctaatctaatctaggtgcacaaacaagcacgataagacagacaaactctaacaatgtaactccaaaactaaccgacataaatttatgcaaactataaaaacaaaaaaccgacaacaacatgttcaattttccatggtcccgacaaaaacagattcttacaaaattggacctaaactcactaacatgaaatactaccgtcaaagtacagactaagcggcaaactcaaacctaaaaatacctgactcaaaacaaaaaattaaatctaaaactaaaccaacactcgacacgatgatgcaacctaaaattcaacaaaacaaaatctaaaagagcaataatttatgttcacaaatataacgcgtaaatctcaaatggaaaatatacaccttcgtttgatgaatacataaggtatccatgattatatttgagctagtgatgtcattatttacttttctagcattttaaaatgggtggaaacagtgagcgcaacttgaagagacaactgtaggctgttgagcgaaagaacagctaacattggcatttgagatacttcgcacagacctccaagctaaaatcattgctcatcaataggttatccctgcgctgagagatattcttgatctagtgctacttttcttaccgatgcctctcattcctatagcaatttcttcctaaactttctaatagcatggattcattgttgtacggttgatgcattgataatttgagatggtgagtgcatcagtgcttgagaggctcgaagctaagtacagcctgcggggttcctgggcacccggctaaaaaagaaaaattagtgcttaacacccttacttaccgtatgggcaccccccttctcccagcttagtgtaccccctacatcagaaaccagaccacaggagacacacgagcggcccataaacacagcatgagttatgttgcagtctgcagttatttatgagtacagctgtatgcacgcatgtctttgtcctttctttttgtccatgagttacattgcagtttgcagtctcctctatcttttcttctccttttctaattctttacaagttaatttgattcattggaagaactccggtgaaagataagttttgaattgtgtgataatagttgtcgttggagagaaaaaaatatatacatgctgtgatgcaatgtaaccatggtaggatagtatgtatagttactgtcttttattttatctaaatattgttgcatgactaaaaatgagatgtgcatttatggagaatttctttaaaaaaaactctggttaatactagaaatgcaaaaaaaagtaagcatattaggcatgataaagctcaaggatgattataattttccagacaaatcgaccatttattttattttttagttaagtatttcagaaattttatggtcaaaacatacaattttgactgaatgtattatcctagacactaaatattcatgactaaaataaaaggaagtattctactcgatattattaacctaactccattgttacttatgttgaaccattgatggtgataatacatgaaaacattataatttactataatatagcttgagaaaaaaatttgctactacagtgctgcaccaaccccccccccc

SEQ ID NO: 83437 - DNA, 10133 bp, Oryza sativa
cagcgaagttatctccctttgacctgcatttattcgcccgcactgccatcaagtcccaagtcctagccgacttcgtggtcgaatggacgccagcattcgcccctgaacccgagcctgtcgaacaaccttgggtgatgtactttgacagttcgtggtcgcacaagggggcgggcgccgcggcagtactcactttgccaggggctgcgccgattcggtacactgcaaggctacagttcgatacgaccaacaacacggcagaatacgaagttgtactgttgggcctaagaaaagcgaaagcattgggggttcggcacttgctgatccgaacagactccaagctggtggcaagtcatgttgacaaatcttttgaggcaaaagaagaaggaatgaagaggtatctggaggctgttcgatctatggaaaagtgtttcgccggcataacggtcgaacacttatctagatgccagaacgaggaagcagacgccctggtgaaatctgctgcttgtggaggctcacattcaccaggcatcttttttgaggtcttgtacgcaccaagtgtgcccacagagagcctgcacatcatggcaattgaccaggcagaactgggcgaagacccagaggactggcgaacaccgttcgtgaagtacctcaagaacggttggctcctggaggatgaagtagaagcgaagcgcctacagctcagagccgcaagatacaagctgatctcagggcagttgtatcgctccggggtgctccaatccttgcttcgctgcatctcctttgccgaaggcgaggaagtggcgaaagaaatacaccaggagctgtgcggtgcgcatcaagccgcaagaacggttgcctccaaagtgtttcgccagggggtatattggtccaccatgctaaaagtttgtgttgagcaagccaagaagtgcgaaacctgtcagcggcatggccgaagccaagcagcaccccagtatgagctgcaacctatcgcaccggtctggcctttcgccagatgggggttaaacatcattggccctttcccagtagcgtgaaatgggtacaagtttgcaattgtagcaatcgaatacttctcccgttggatcgaagccgaaccacttggtgcgatcacttcggcagcagtacagaaatttgtatggaagaacattgtttgccgtttcggagtgccgaaggaattcatcactgacaatggcaagcaattcgcctctgaagagttcagagagatgtgcgaggggctaaatctagaaatcaggttcgcttcggtcgtgcacccacagtcgaatggggcggccgagcgtacaaatggcaagatcctggaggcactcaagaaaaggcttgagggggcggcgaagggtaaatggccagacaaaatgctatctgttctttgggcccttcggacgatccgtacaaggccaaccaagttcagcccgttgatgcttctctatggtgacgaagcaatgaccccaacagagctaggggctactaatttgccaagggtgatgttctctagaggcgaagatgggcacgaggtgtcgctcgaactcctcgaaggggtaagagtcgaagcactagaacacatgcgcaagtacactacaagcacctcggcaacttacaataaaaaaagttcgaccgacggagctattgcctggccatctcatcctaaggaagaaggcgaacccagtggcggtcgggaaacttgaatcgaagtgggaggggccatacctcatcaagcacaggtccaggacgggctctttttgcttggtgacgctggaaggcaaagcgtttctatgtctagaagggtagcaccccattcgccaacttgtaaaaatgtacacactattgtataggcctttcggcacctctcgttaggtaagcccttcggcacaaaaatacaaaaaaagaggaaaataagaaaagaaaaaaaaattggatgtagggctattatccatcctggaggcctgaaccagtaaaaaattcttgtgtctttcgccttttctttacttgtgtgaatgataatttgtcgaaaaaccccaaggcaaacgccttatcagcgaaaacgccagggggcgaaacgaatcagccgaagcatcgctcgccgaacgttgaaaccacgacagcttgtttcggaaaataaataacagaacaccgttatactcgatttatgtgaaaacacaaatgcttctttcagcgcagaacaccacagatcaaaagcggaactcgaaagctgaaaagtcagcagacctatttcgctaatatacgcaagggggccgacatgtttcgacctaacgaacgcacgaaagttgactatgcgaacaatagcgaaaaggaaataaaacacatctttattaacttcaaaagatatcgaagaatacatgccatacaacatggtacaggtcaaagaaagtaacgggctttacagcctagcttacaaaaaaattacatcttcacccccaaaacaacctccactccctaaggtgtgatttggcgaacttggttcatcatcactactaatattatacactatcctaagaggagaagggagcgaaacacaaactaggccatagcggcgctgggcgatcgcttcttggcgatcagtccttcggtgatttcgccaaaagcgggccatgtcctcccgacgttccacatggacacggtcgtagtcatccaaggttcgcccggggtgcgcccgcatccagccgacaactttcaaaaccttgtaactattgccgtttattatcatctcacgacaagaatacttaatcttcagcaggcctttaatcgcgacgaatttctcattcttgttctgccaatcgccaaaaagaggccgaacacacacctttcggcgaaaaccctgctaatacaacataaaaaaggcaaatggcaaagtgcatggttaagagggggcgaagcacataaagtgggcgaaaaacgtcgcctctttttggtgtgcaaaaataatggaagcataaatatcaaagccgaagaaacaggataattggcgaaacttgattcatctattccatataccaaaaaggccgtttccggctacagtacaaaagggggaacactagccaaattcacaacgttcgccctccgtggccaacgcacagagtctaaaaatctaaaaagactgggcggagagcctcacacctctgggtgatcttggccgacatccgccccagcgcccgcatccgcaccaccttcttcggccgctggctcctcacgctactctgctgcctctgcctttgccaagtgttcgagcaggcgcgccttggcagtgaatcggccctccttttgccagaactgtttgcgccaggcacgaagtgcgggaaaaatgtccagagagctgacctcccaatcacccttcacaaacttggggaactcggcaacgtgctcggaccaattttgttgcagcaggcccatggtgacggccactgacagatgcgcgcagcaatcgctgtacgtagtggcgaaatcggagaccgcaccaccggcctgttcggtccactccaagaagtcgaaggcagaagtatcttcactagggattcctcgcaccttcgcccccatgtcagtaagagcgaggcaaagcgtgcgacacgcggtcttcgtggactcagtggctttcgccatctcccgcgtcaacctttgtgcgtctttttcagcagctgctttcgctttacgggcctcctggcgaagagcctccatcttcggctcggtgaggttgtagtattcagtcaaggcggcggaatgattttgttcttttttaagctcggcattcagacgcttgatctcggccttcgcctcgctccccttctctagctcaactcggagccgcttgttgttagcctttgtctccttgagggtgtcggcgaggctctccatttctaggctcttgcggcccagttcgtcgtctttagcttaaagacggtttttgaagccatcaagacaagcccgtacggtccgctcagtcgaacaatgagttgcaacaatctagttcaagaaaaaaaagagaaagggggagaagatgatgatcgtcaacattagttgtggaaaaacgatagttaaaaagaaagaaaaacaagtgacatacccggacagctaagctcttgatggcggaacagccttcgtcgaactcgttcaactcagtgaacaggctcaggctgccagtcggagaaacgagattacttaccccctcgacgaaggggataagatccgcccgagtctcgaaatcaccaggggcaaagtggggtgccgcaagagaatactccgaagccgacgtttcagcagccgttttcttccccttctggatggcgagcggcgacaccaccagtttgctcagagggcttccgaagagcctggctgcggccctcacaacccggtcagcaaaagctgaagttccagtggcaacgctacctcctgctccgcccgcatcgaccgtagcaccgggagcggtcaaaagacccaggctcgtagcaggcgaagttggagtctcgtccgaagactcgtcgtcgctaaaaacgcatgcgacattgacgggccctttctttttggaggtcttcttaactgaaccccccttcgccagcttggccgcttcaatcgaaaccagcgccttccctccctccaattcctttcggccgaggggggagctgttcgactccaccccagtttcgacatcgtaagggcttggagttggggtgtagccgcgcgtctcagtgcggttgtcggcgggctcgtcagcggccatttcggccgcgagctccgtctcccccttatcctccccttcctcttcgccatcatggtcgtcgacagtgtcttcatcgtcggcgtcagagtcggtggaggtaggggcctttctcttccgaggagccaatttgacttgtccgcgtgtccgcttcctggaggtcccttcatcgccatcggccttgaagggcttcgcacggggaggaagatcgccatcgtacacccgattcgcccggccggccgcctgccgcgtaagcagctggctgaattcaacgatcgacacatagccgatcatcttctgggcttcggtgtcagcctgagcaagagttaacactgcaaaaatgaaatgtgtcatcatattacgcgtcgagcaggacaaaagagcgaaatacacatacatataggaaagcagaggcttactgtttgccccctctggcatgacgagctttggcaagccattgacctcctcgtcttggttcacctcgacttgccacgactgggagagagggaagatccggagcatgcaaaactcttccaccaggttgcggcagctaaggcgggagcagagcttgcgaagcagggtgaactacgcttccatagcgccttcgacgacgactttgggcttcctgttcggcatgatcaccctgcgctgccattagagggctttcaccgactcggacccggcctcgaaggggatggagtggtagaaccacttcgacatccaatggcgatcccacttgaacatagcggcattgaccggccaaagatcggagcgctcagggcgaacattgaagttcacgctcccgaacgctgtcttcttcgtccccactggagtaaccaccgtcttctaatttacggtggcataaaaaacggtgccgaaaaactcggcgctcggttcgaacccagcggcccagcacgcccagtcgaagatggcgttctggacgagagccgatgggcttagttgggggagctccacctgaaaaaggcgaaggatctctggcaacaacacgttgcacggaaacagaaggcccacctcgaagaacatggcaaagaccaccgtccggttgtcaccgggcttcggcaccacagcctttcctgggggaaaggcctgcttctctgccaacacaccggaggtgaccagcttcgccaactcatcctcattcacaagcgaaccccccagataggcggtggtgtcatcatcgatcctgctgggatcagggcccgtcacggagggtaggttcagcttgcgaggggccatggcgaaaagtgtgggcggtggcggaaagaggaacgatcgaaaagtctagagactcaagagcgtcgtgaagtcagagggtggagaaagagagagctcgccatgaaactgacaggggtgcggcggtgaaaaaagggggggaatatattacccacccaggcgtcgattcgccttcccacccaatcgtaagccgccatgtgtcacaagtgtaggtgaaacggtaaattcccattcattgagccgcatagtgctaagcccacgaagggaagccgtcactgttcattgcggccaacaggaaaaaataaggacggtttcaccatttgcaaaaggcgaaagctaggaaaaattactaaccgtaaaaatacatatgcacaaagtgtatacatttcctgtaggactccagtataggtttcggcaggagtgtcggtcgaaagggggcgcctcatatcataccacatggtttgcacggtctcggccaaagctcccaactcacccttgcccgtgaggggcttgttggcggtatgtcatgagacccttcgattagacctaccaaaaccatgcaaccagcgaggatgcaggcttaagacgctaaggtcatctaggtgaagctacatggcgaagactatgaagtaaagatggcgaaggctgaagagtcgcgttggtatcccgcaagaccaaattcgtcttgggcgaagagtacatggcgaagggtgtataccgaaggaaggagacttcgccataacaagcccaacttcatggaggcccaaggggccatcccagccgctcaggcctgttcgccaattggcccattagaggcccatgtatccaaattacactatgtacccacatagacgttcctttcataagggcagccatgtaaattccctagtaaaacctaaaccctagtaggggaacctgtaataggattataaatagcctcctagggacatgtaaagtgaggatcccaagaaaaattctaaccaattagtacatttactgtttccaacactgttgagtaaccacgtccttcgacgtgcgcagttgttacttcgacaatagctaatttatacaatagttacctataaacatatactacactattaatacatggtcccacctatcatacacatattgcattttggagtccgtgctgcagctggctatatatctgtagcccgctgctcttatatatctctcctcctttatctcattgatatgtgtttatagttggattatagtctgctattgtacccgctcttatctacacattgaacgtgccagcagcgtcgtcgcttcgttatcccgtgcatcgccccgtgcaatgttgtcgcttcgttagcccacgcatggcctcgtgtcaccgtcgcttcgagtcgcgccatcgctcgtggcctcacgaatcacgtcgtgacgtcctggggacctgataacactgcatgatcatccgagccgtgatccaatctgcagaatccatcccgcccatggtcgatctgcgtcatgtcgctgttgacccatctctgtgatcgatctgcaagccatgacggacccgctgttgccctggcaatcatgtatactccctgttgtcttctcttccaagcaatacctatttcctgcacatgtcatcacctcttttgttcatagctacagtccatggcaacactggatttcgaccaaaacaatcccattgattgcgacctaaacaatcccgttgattgcgagatgatgaaggtgcaactcgattgcaaagaatctggttgtgttcggtcaattaattggaatgccactaatgtgttttctctttttctttttggtcctagatggagaaggacaagaagaatgtccttgagaagatgagtttaacaatgcacattcacctctcgctcctcaccatagtgaccgcgatccccacgacatcgcctcccactccgcctatgccgactgagaagccatctcttgctctggccatgtcgtcatccatgatccatcgcctccatgtctttcagtaggtgtgagaagaaacatcgcccgtgctgggttttggcataggaagctccgacgggaacaaaacgaagcgtgtgcgatacgaggctccatgcaagattttcggtgcctcccctcgtaatacacaaaatggatttttttttggtttttttttttttgctatacgacgattatttaggaacggaggaagtaaaagccttattccaaaagattattaaagtctagtagtattccatctattaaaggcgcaatgaatttttgaatgttgatttttttttcttttttgcagatggtaggcaaatatttcctactcccactcgcatatatcactactaaaaaaatgttttttttatgagaccccttgatttttgcaaacggaacataactagtgacgtctgcaagaatcgatggtcatttttgcatgcggccggtatgaaaaaatcgattttcccatacgggtctcttaagagaattgcatgcaaaaatgagctcatttttacatgcggctcacttaagcgcccttatgggaaaatcgatttttccatacaggctacttaaggagccgtatacgaaaataaaatttaaaaaatttgaaactggtttatctcactcatatgaacttccaattagatgattttttctaaatgtttctaaaatcatgctctatcatgttattgtgtttttattactattattttggacattttttcttgtgaatttgttatatcaattaaaattttgaatttcaaaacttcaaataatattttaaagcagtaaatgattttagctaaaaaagtcatctacaacaaagttgtataactcatcaagaactataacaaagtcgtataacaacaaaattgtataactcatcaagttataggacgtcccaaattatatgtattcagtagtaggcatcttttagagtagggatttacttagattatttttgaaattgcagttttgccgcttgttctgtttgtggaatcccaactttgttttttgaaagggatggaacctcatctttgagatattaatcattcatcggcaaattgagatgcaatctaccttgttcttacttatgttctttgattcacacgtagggattagccttcttagaaaggtcaacagggtttcagcacagttgataaccaaagaaaacgtggtgttgcgattgcagggttcggatcgtgttgatcggaagctgaatcatgtgtgccaagttttcgacaaatcgatagttacgcgacctagttccacatcattttattttggagctataggacattaggagaaaacaaaaggaaaaggaaggagcattaacaaaatgacattttatttttcacaaagctggatggacatatatcaaaatgatctccattattatgtaattaataacgcggaagcaagtttgtatgtcccaaacatactagtccttgcattaaaaatgaaattagacatgtggccgaactctaggatgcagtttacaagccacatctttttcttgacacccctgatcgaatccttgacgtggttctgtatgtgtcgtttttcttcctatatcctcccattcatatagcgatgcctaccactttagaagagaacttggggattgaaacatattgactaatcgcgtagggcaatatactgtgtacaacagatagaaaatgacgaaaatacacctgcacactattacatttaatatcttagcacttgaagcttgctgcgagttcattgtagtagcatactagcatggatgcgtcgagaatttgagatgcggtatatatagagtagttctgtacggaagaaaatcaaatcagatgatggcgttttaattctccacgcaacttttcagtgtgttcacaagaattaacagagaaaaatgataatcggtattgaagatcatatgattgagggaccagaaaatcctgtgtatttttgttgtgaagagcaaggcattgaagacaaccatatttttcatatattagatgtgcgttaattttcgaagataaccaacccaacaacacaaattaaggactattcatgcaaaatttatcttttttggtatattgatgtaaaattaccataaaattctgcttcagccctcgcatgggctgcagga

SEQ ID NO: 83438 - DNA, 8793 bp, Oryza sativa
ctgttggacatcccacggagagcaagtggttgaaatggaagaagatgaagtgaaagacgacaatattttggattttgctcagtacgctggatttgaaggaaatcaaacggatgaggaggaaagggatgctgatggtaacgacgttgcagatgatcttggtcagatgttgcaggacgccaaggaggactgtgaaagtgaaaagggggcccataaattggacaagatgttagaggaccacagaacgtcgttgtacccaggttgcgagcaggggcacaaaaaattggataccactctggagttcttgcaatggaagacaaaaaatggtgttagtgacaaggcatttggcgatttattgaaactcgtcaagaacattcttccggagggaaacaaattgcccgagacaacgtatgaggctaagaagatagtctgccctctaggactggaagttcagaagattcacgcatgtccgaatgattgtatcctatatcgcggtgaggagtacgaaaacctagaagcatgccttgtttgttaagcactaagatacaagatttgacgagatgatccagaagaagttgacgggcagctaacgaagaagagaattcctgctaaggtgatgtggtatttccctataatactacggctaaggcgtttgttcagtaacaaagggaatgctagaatgatgcgttagcacgctgaagagcgtcaataggatgggatgctgagacaccccgccgatggttcgcagtggcgaaacatcgacagaaaatttaaagactttggaaagaacgcacgaaacatacggtttggtttaagtacggatggcatgaatccttttggagagatgagcagcggccatagcacttggcccgttacgatgtgtatctacaacctccccccttggctatgcatgaagaggaagtacataatgatgccgattattactcaaggccccaagcaacctggtaacgacatcgatgtgtacctaagaccactagtcgaagatcttaaactgctgtggaagaaggaaggagtccctgtgtgggacgaggacaaacaggaggagtttaacccacgagcgctgttgttcgtaaccatcaacgattagcctgcacttaccaatctttccgggcagtccaacaaggggtacaaggcttgcactcactgtatggatgaaacagaaagtacgtatcttaagcactgtaggaaggttgtgtacatgcgtcatcatcgattccttgctgcaaaccacctggtacggaagaaaggcaagcactttgaacataaggcggaccaccgtacgaagcctaaacatcgcagcgggaaaacagtgtttgctatggtgaaagatcttaaagtagtgtttggaaaggggcctggaagccagcctatagagagcgaagatggtcacgcagcgatgtggaaaaagaactctatattttggaacttaccctattgggaattcttggacgtcagccatgccatcgacatgatgcaccttactaagaacctttgcgtaaaccttcttggcttcctaggtgtatatggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcatgaatgtaccgtttggatactccatgaatataaagcgaataataagcacaaaggagataaagttcacaaacctaaagtctcatgactgtcatgtgttgatgacacagctgctaccagttataataaggggtatccttcaagacaatgtccgagcaacaataacaaagctatgtgctttcatgaacgcaatttcgtagaaggtcatcgatctggatagattagaagcccttcagaatgatgtggtgcaatgtcttgttagccttgagttgataattccacattcatttttcaatataatgacgtgtctgctttgcaccttgtcaaagagatcggtattctcagccctgtgtacctacacaacatgtttcctttcgagaggtacatgggtgttctgaagaaatatgttcataaccgtgctcgtccagaggcaagcatcgccaaggggtatgaaacagaggaggtcattgaattctgcgtagaatttattgaagaccttcgcccaatcggtacccgaatcacgccatgaagagagactacggggaaaagggactctcggaaggaaagcaataatgacggtagacaacaatttatttcgtaaagcccatttcacggttctgcaacaatcttcattggtggctccttacattgaggagcacttggctctagttcgtgccagaaacatcggtaagtccgatgcatggattacacggcatcacattgatactttctccgcttggctgcgacaacatctcatgggtaacgagacgattaaccaacaaccagccttcctagcgaggggaccatctggctcgatcacgacaatccaaggatatgaaatcaatgggtacacattctacacgagagcctaagacctgaagagcacgaaccagaacagtcctgttcgtattgatgccatgggacacgatggtacaactggcacgtattatagtaccatcgaggacatatgggaacttgactatggacctctcaaggtccctctgttccggtgccaatgggttaggttgcctggtggaggcgtaacgattgatgacagtgggatgacaacggttgaccttaacaaggttggatactcggacgaaccttttgtccttgccaatgatgtaacgcaagttttttacgtcaaggacatgtctagcaaaggaaaaaggggcaaagggcctgacgagccgaagcaccacatggttctcccaagaaaaagaaaaatcgtcggagtagaggacaagactgacgaggattacgatcagtttgatgggcaaccccctttcacggtgacgattgaccctagcatcctcctatcaaatgacgacattccttactcacgtagcgatcacaagaaagaaacaatagtgaggagaaaatatgtgcggtcaaccgtcaccggcgatgtattgccgtaattgttgtgtacacgatgtaaactattttggatgtattgaatatccatacaaatcaattgttgtatggcatatgttaattatgtatgatcattacaatttttatcaaattgaaatcatctatatgctagttatatatgattattagaatttttaaaagttttaaatcatgcatgaggtatttacatatgtaattagaatttttaacaatttaatatcatgcatatgctaattatatatgattattagaatttttattaattttaaatcatgcatgtggtatttacatatgttaattagaatttttaacaatttaatatcatgcatatgctaattatatatgattattagaatttttaacaattttaaatcattcgtgtgcttattacatattatccacttagtttactacatacaacaataatttttcgaaggttttgtcattaatttttcgactttaaataattgtaatgcattatttactattttagaaacacatatgtaatgaaattcgaaattcagtgctattatctttagtcccagttcttaaccctaaccgggtttaaaaagaatttggaaatagcgggaagatatctttgctcccggatgttctcaccaaccgggactaaagatctaggggtataaatattcccggtacgtcctcgtcttctccaccaacacttagaagtttttcctccaatcgatctcggcttctccttcgccgccactgcctagggaaaccccgcaccaacgccgccatcatctctcaccgtcgtctcgcggtcctcgtcgcctccaccgccgacgcatctcttgggtgagagccgcgctgcctctctctctcgatctcgatctctctctctctcgaaaccgccgctgcctatagctcattgccgacgctgccgcacgcggccgaccccgaccccgactccgcctcccgccgattccgaccccgacttcgacgcggctgccaccgctgacgacataacgtccacgcaactgccacggcgacgatgcgacacgccctgccacgccgccttgagctcgccacgccgtcgcgccacaccgccgcgacgccacgccgccgccgcggcatgccgccgggtcgcccgacgccgccggaacgcgcgccccgacaccgccgcgacacgccgccaccgcgccgccacgccgccgctccgctgccgccactgccgcgcgccccgacattgccgaacgtgaacgaatgtgaacgaacgtgattgaaacgtgaacgaacacgaacgaacgtgaacgaaacgtgaacgaacacttaacgaacgtgaacaaaacgtgaacgaatgtgaacgaaacgtgaacgaacgcgaacgaacgtgaacgaaacgcgaacgaacgtgaatgcacttgtactaaaagtgtgagaacgaacgcgagcatatatgattattatacgattattaaacttagcatataatatgattatatatatatagttgaaaacgtgaaatacaatatatgttcctttgcatttagactaatacattttcctggtaatgttgtagagaagacgtcgtcgtcgtccctcaagctgaagttgtagctagccatcgaaggaattcgcgcaggcaagtgatgtaaagaagtgattgttagagatttaatataagattattagagttttaatataagattattagattattagcatatgtgagtgttagattattagacttagcatatgtgagtgttagagattcgtgatagacttagcatattgtattagacttagcaaatgtgagtgtcagagattattatattattagacttagcaaatgtgagggttagagattattagattattagattgttagacttagcatatatatattattattacaattttaatataagattagtagcgatttaatataagactgttagacttagcatatatgattattacaattttaatataagattagtagcgatttaatataagattgttagacttagcatatatgattattacaattttaatataagattagtagagatttaatataagattgttagacttagcatatatgattattacaattttaatataagattagtagagatttaatataaaattgttcgacttagcatacatgattattacaattttaatataagtttagtaaagatttaatataagatcgttagacttagcatatatgattattacaattttaatataagattactagcgatttaatataagattagtagagttttaatattacgcttagcaaatatgacaaatagacttagcaaatatttcttgtatgaacagatggctgatcgcgatgaggaacatatactgtacgatacaatcgcagagggaagcagccagtattggaacgaagaagaggggaacgaggatccaaaccagtacttgaacgaggagaggaacatggagagggatgcggaggggaacgaggaggggaacgaggaggaggaggctagtggaagtcatccctccgctggacagaagagggcacgcggacaacgaggtgccatgaagaagatagagggtcggcacatcataactgaggtggacgaagacggccgaccaagtgccccggcagaagcagccaagaattttgtatgccacagcggttgggttgtgagggataacgtgcctgtcagcatggtgtactggcgcagaacaagggcacgagggggtaatgacagctttgtctcggaatcagagaaagagatgctgtggaccacaatgctcgagacgttcacgctccctgcgggtacggagaacatagtgaaacagtggactcttaagaaaatggctaaacagttccagagcttcaagggagatctctacaagaaatacatcctgaagggactaataccgaacttcgacgtattcccaaagctaagagattattgggacgagtttgttgcttagaagacagggcaacaagggcaagcgatgatggttagaaacaaagaaaatgccaccaagaagaagtaccatcaccacttggggtgaggcggctatagcatcgcaatgccgaagtgggaggagatggaggcaagattgattgagaggggtatcgaaccggccaccgctaaatggccggatcgatcgaagttctggtactatactcacggtggaacgcttaacccagttgatggctcccttgtcttcagcgatcagatacgagggaaaggcgtgattccctggaagattggattcaaggaggacatccacacgtacaggagtcggatgaggagcaagagagataccgaggtgaagattgcaaatcttcagaacagggtatcgagttacgagctcagcatgcaagaggaggtggcaaggaagatggatgaatgcatggccgcacatcggtcccaggatccccagccgtacattcctcctgcaatggtcagcccattaggcaatcatagtagttgcgcctcaacggggtaggtaggatcacagagcatggacgccatgcaaacccaggacgaaaccacttgccccgttgatgagatcacgcaacggacaccatgtgagctacatattcccttcaagaacttatcaatcaaggtatgctcatagttttatgatttttgacttgtacattccgcaagttgctgcttaggttgattactaatagataacctctcatcacatgaaggtggcgtcgggaatggccatcccaacgaacatttcagggacttaccactgcaggccgattccagcaggatactcgagggtcgaagttgaactggtggaagccgcgtacaaggacctcgagttggactacctaggaggagacggtgagacgcatctatgaaacacaagccatgccattatactatggcgcaagcggtacatcatcctccttgggcgacaagcgacgtctcgtgcaccatctcctctggctccgccatctcctcctgcaccatctcctccggttcctccgccaagtcctcctgcaaaatctcctccggctcatccgccacctcctcctgcaccatctcctccggctcctccgcctcctccacctccaccgtgtcctcctgcacctcccaagacaaggtctcgccaagctccaccgtctacccgcacaagggcaacgaagaaggcgaaagttgacgccaccaaaaacaaggagccgtcgtacgattacagttaagaggagcttgatgcttatgtggcaggagaagtgaagaggcaactcaagcctcggagtcctgaaaagaagatacctattgacccgagcgtgaagaacttcttcaagggaatgcccacaacaaataaggaggcgttaaagatatcggactatgaccgaacacttcagaaagcctatcacaagaagtccaaaccagtcccttagcttggagaacaaccaaaccaagaggtcaagccgttggtgaccggcgaagattttggcataacggtgtaactgtggatcagctgattggaggcacaccaatcccgaaggcggaagtagcatacaagtttgagctcggtaaaccgcttgtcacgcctgagcagcagcagtccctaccgacacagatgtacaaattccatgaatggtacatggaaatgagcgccaagggtagagagatgttcggagcgaggattagaaactccgacttcttgcaaggaggagatgttctctggatccatttcaaggatgtcttcgatctgtaccatctagacgccctcgtcgtctctcttctgagcgcatggatttcgtaagtatctttgagttcgatttgtttcgttcaataactagctccttgcatatatgtaaacaataataatttcattttttcgttgtagaatggagattcaaagggcccgacggcggggggcttacgatactaggttcatcgaccctcgaaaaatcaacaccgaaatgatcgacaagtacgagaaagtcacagaggacaatctcgtccatctcctaacgccgcagcatttcaagacgttcatactactgccgtacaatccagagtgagtttttattgtcgttcgaacaaatttcattcccatacatatagcatgtacattttcatatatatctcatctcacgcatattccagattccactggtcctgttattctttgacttggacgcatgcagagtcactgtgtatgactcaatgaataaagaggagaagatttttgacaaggtcttccaaccgatagacaggtaatataatgccatctattccaaagtcgcggggattctattgctattatgttgatctcgggtaataattaattaatcatagcttgtagctgcatatgtagggcttgggatcgattccgtcaattggtccgcgggacttggaaagaaaaacttggacggaggtttcattttccagtgagtacatgcatgatccaaaattatattgaattgaatctctaattacagttaatataaagagtatattaaatctcccatcatttctcatgtagtgtgcaaagcaggacaagggaactaacttatgcggctactacgtatgcgagtatgccaactgcctatcaaaccaaatatgcaccagacaagagctcgatgtacgtatacataaaccattcaaaatttcattgcgtatcgatttgttaagttgtttattaatttcatatattgatatttcattatttttcgaat

SEQ ID NO: 83439 - DNA, 2564 bp, Oryza sativa
caggactaaagataattggagcctgaccctacccaccaatttctttaaaccggcactaaaaataatctttagtcccgattgtatgagtgggtatcgtagtacttagattaggatcaccggcgactggctcgccatcccactgcccatgagttcggcatgcggatcgagctctgtattaatttagtgatgggtcttcgacgatgcatagtagatattttgcctcacctccggccacaaagggagtagatcttttctagtagtccattgaatagttgtgctatactaataaaaaaaagagagacatttaactatttgtcattcttaagatgtgatgataacagatttaccactcgatgtctaacatatgggccgcatgtgtctatgacatgtggacccagtgacaaatctgttatcactacttataaaagtggtaaatagttaattattccttaaaaaaaaagaaggcaaggaaagagtagcggaacgcggaagagaataaatgggctgaagagaacacaaccagcctgcaggtttcgatgcaaagaaagacgtaggtgattcagcccgctttacgggcctatccaccaggatttggttgggcggcctagcgtgactacagcccatgcaagggaagcacgattgccaccgccgatctccatcgcaagttacggcctgtgcaacactgagttggcgctaggattaaggccgagcgagatcggatatcacatgaaatggaccgtactttctccactaaggagaaggagagaactctatgcgggccggcgtagcaaaatgcgtggcttgcccacaacttttctggggagtaagtccactttgactaccttaattaattagtggtcgaatctgattcgtatctctaaatcagaataccggatatctcgaccccaactattaaaaccaatgtaatttaactcacatcagcgaaattgcattggttttaaatagttagggttcatgtatactaatcaaattatgtcactaaataagggagtcaaagtgaacttattcctatttactagagaaatctatggttgatctgaagagggcccagaaaaccgatgggccaacttttaggcccagtagagctgggaggaactcgtctactgcacgagaaggattttcccccttctattcccctttatctttgctggcctagacttttttctatcgtattgggctttttgaggggcttttagggcttttcatctagatcaggacaaattcaataggtgggaatgggataccaacctgggctcctaatcggcgactggtcgtgcgggggcgtgggcgtgggcgcgcgaccagcaccactcccacctacaatcctagtactacttgtcccgtagtacactagtactactcctaattgctgatgctgcctcctatactactactactcctaactactccgtactgctgatgcctcctacactattactgcctacgaggagtcggggcgtggctcgcccgcgcggcgcgcctagtagtactacagtagcactactattagtagtacctaataaaaaatatattttttatatgtatatatttttttatgtgtaaaaaatatatacaaactttatatacgatatatacaaattttgtatacaacgtgtacaaactttatatacggtatgtacaaactttgtatacgcacgtattaaaaaatcgaaaaaacccaaaaaacatcatgtatacaaactttgtatacatattaaacccgaaaaaccaaaagaaccaaagaaaaaccgaaaagaaaaaaaaacagaagaaccagcggaaaaccaaagaacaacaaaaaaaccggacacacgtaagtcctccagccgcctagcccgccgcgccccccgcgcgcgtggccgcgccgcgcgggggagtaggggcgcgactagtcgccgattaggcgtttcggataacaaccgcttggatctcagcacacacatgtgtattctatatttttttaagttgatttaaatttaatatttttaaagtttatacggataaagtttatacacctaaaatttatatagtatgttataaactcaacccgaatttggattaaattcagataaaaaatgttccaatgtatttatttacatgtataatgtttacgcacacagatatttttatattttttttctttcaaaccttttttttttgaatttgttatcaaaaccaatcaaaatgcatacatgcgtaggaagaagagaagaaaaccgcagtgtcctggtgggtgaggccaagttgactgtgtgcggtgacgcggtcactcatgcataagagcatctccgagagaatggctaagtgactctccaagccaaattttagccatagcagagaaaaaatagcctccaacagcatctccatcccactggctaagctatatggttagcccaatacttccccccactggcttaatctagccagccacaaccacattccttaggcttgccaaatgctttccccggtacctctttgatgcaaggcgaggagtaacaacgttgccttccgtcgcaaaaacgcggtccctttgagtagccttt

SEQ ID NO: 83440 - DNA, 26622 bp, Oryza sativa
cgcgggttatgacccttgtgaagacgtgagacccctttgttttacaccgactggctggtttttttcttctgcatcacgtagaatcggattcatttttttccttttttttcaccctttattttattttgacggacagcgaaaacatctttttaagtagtagagatagagatagagatatacctggagaccacctgaatttcgtttcaaacgtgaaacaactcagccatcccgaaggtttagagtacaactagtataatgaaaaattgtctcttcttcttcctcctcatcccggcgaacgatcagcctgattcgaccgtgagcgcgaggatcgccttgcctaaatagatttgtctcatcgattcttcttctttgattcaggtgttcttctcttgctcatctccgccttgcatgtactacgtagattgattccagattaattacttggattatattgttgtgggcaatatgtaggcactagctagtgtcatctcctgtccgattaatccatacatggctgtcgttgcaacttttttatattcatcaatgatcaattcttagtttgcattaaagaggatatatgcatcagtccatgcacctccatagaacagaacatagcaactttagttttcagatagagaaactattaaactctcgaggatacgttaccctctctgcagatatagatatatccctgtcccatattgtagttagtatatggacatactatcatcctctcaacattgtacttgtggttgctagctttgcacaggctaattaatctatctctgctctaattaagcatggcaaacaatcaggagcggccaaaatgcagctgcgtccagtccagctgcacccagctgtaagtacatacattaccgtctattgtgacgttagttagttagttaattagctaattgctcttactgctcaccgtctacttcttattttgccgtgcctaatttatctgcagatattgccggtgtttccgctcgcgttacttttgttcagacaactgcaattgttctggctgctacaacattaaatattacgaggatgcgatagaggagatttccgacatgatccagatgaaaaacccgaatgcatttgatcccaggattattgttagtgttcaagatgcaacggcagctgatccccagagctctactagtgctatttcagacccaaaaaacacctccgatgcaatgccggtaatatacctgtttctaatttcttattggagcaccaaacttaactgattccatgctattctagtctagctatttaattaattttgatgatgcatggttttaagtggcttgagaactcacgcatattcagtaaaatttcacggcaatgaacaacggaagcatgccaaagggtgcagctgcaggaagtccaagtgcaacaaactctactgtgaatgcttcaaggtgtgtatatactagtacttcgttttttacataaaacctatatttattagtattatgattagatggctgccttttatttccctcttcaagaacagtgtggggtgcactgcaaaatgcaagtgcctagagtgcagtaacagcttcggagtaaaaaatagtgagtgttcttctaaactgttatttccttgtctttcagatcagaagtgtgcgctcaattcgtttggaggccctgaagaatctcattttgctcttcacccgtgtcaatggttttgtcttgcctgtgttttttatctgacctattttatacaaaacaggtgaatcaagcaacaaaccagatccagatgataagagtgctactgacggcctgacacatgaagaaacaactacggaaaacatcacgctacctggggaaacctggaactctgatccaaacaaacgcccaagatattttgtaagtttttcgccctttaacttctttaatatagtttaccaatagaaactgtaaacttaattacaatgtgttaaacttgtcataacctgttcaaactgaaactctgacgatatgctcttttgttcagtgacaaactgacaacaactttcatatcatgatgatttaccgtcctccaggcagtgatcactttctgccaaaaaaaacgcaactgtaaacacaaccaggtttcagtatcgaggggtatctatacattaattcttctctagtatgaggtttttaagtcatgcaaaagtttgttcggctttagtagtatgtaagaatatatatataaacatgattgcaaggacacttgtacataatatacaaggcagctgccttgccttctttagaaaaaaaaaacagacaaacaaaaatgattgcaaggaaaggagcctcaactgcattattggcacttggtgacatatgctcaaaatccttaataagtaacagagcacaatcaagccttggcctccacatagttaacaccattccattccacgtactgttgcgactgtgtagtgcacaagtttacttccataaagctttattcggttaatccccgtatgggagagattgagggggattaattccacacctcaataggtgtgaaattattcatctccaaattctcctcaatccccttgtgagtgggattaaccgaactagtccttagcgggatctgtcgaggccaagccttgagctgagccacttgccaacgtcgtccatctcttcagggatggtatagtggcctagcctgcatcataagaaactttgtcaatctttgctaaaagaattctgttttgtactctgctgtgcaaatgcatgaatatgtacccattgtaggatttgaaatgcagatataagaaccccgaggatcgcagagtgtcagatgacctctcagcattcctgtaggatacaacctcatccgctgcaacaacacacagaattgagaacagactgacgcatgatgcattgactggtaatgactagttatactgtttctggagggaaggctacatgaatcgacagctttgttacctcttccatggctaagtaagataggcaaggaggcagctcttcttgcagctatgtgtgagctctccatcttgcccctcagggtcctaaaattacagtgcattagcaacactaggattcaggaacaagtgacactagtaagtagcaagtgtttgacagattaatttctgcctaggatggcaaactggcacctggagcaagggagccatccactcaagctgatgaccgcgctaagtgtgattgggtaggggatgccacttgcgaatttgccatgagcatagcacgcagctgagtagagggaagcagcagcacccatgctgaaaccaccaatcccaagcttcactgcactcgcaaagtgtggaaatcagtggaatgagtgtcacaggagtgagtggtcaccagcatacatctgaagaacatatcatagttagtgctagttttgtatatatactggctcgcatttgatcacctaattaacatatgcatttaccggtgccactaataaggatcactttgaaaaattaaaagaaaaagaatctggtaagaccataatatatgttacattgatgtggtcctggaactagtaccatcaggcggctctgacgacagcaagtttgcaatgtgcgcagctgaagcatccagtccttcaatgtcgtcacggccatccactgaagtatcctccacatcaaaccctatttcagttccatacaaaagctaataagtcagagagaaatggcagtacccctaagttttcaaacttcagagagatggtagcatagtagtcctgaatacagggtattctgccaagttccaatggagaagaagaagcttacatgcagtgcaagggaatccaccaaatgctgtgacaggctgggttgctgcggtggggcaaatccacttgatctacaccatcataagcttcaaggtgaataaaccatggtgcaacaaaaatagactgctagttgctactgaacatgataagctacactgatctggagatagaccggtggagagagaccggtgtgtgttaataggggaataaggaacggtgtgtgtatgtatctatcatctgtgtatgtgtgtctgaagtacaagcatcgacacttacatttggcaatgaaagagaatccaggagttgggaccagctgaaaacagaatgaacaaaacagagaaaaggaaacggatcagtgcagaaaagcattgtggatgcaactagtataggtattctgtttcatattctctgagaacttatgattaacacatcatatatgtataaacaacaggcgtcgtctaaaagtatcagtgaagatataagaacatctggaactacaaattggaatccatcagatcagactaaagagagaacatttacagtactggacagaatttttacagcaagttgagcaactagcctgaatttcttagcttatcttaagagaataaacaattatcttatcaacaaaaaacgtaacatgtaagtagctgagttgctgatctttttagttactggagacaatagggaaatgaatgaaaaagaacaggaaatgaacatctgccgcagagcttaacttggcaaatgtgtactgaactcttaaaagaaattgtgacacatgcatcataccaaactgaaaggcggccaagcttactttttaccttctttgctcccggagttgatactggccattaaaaactctatttaatggagccaagatactctaatttagtggcttatcataaattatgctgttctttagatgctttgtgcagacatggaataggaaattaggaatctttcataagctaccttacatttatgcaattttaatatgccattagcccacatcaattagaagtatttgacattcctctccatttctgaatggaaagtgagatgcattatctatgtccttggtggcgcagaaggttgtcaggtgtgcagaaggacaagagaaacatttactccctccgtcccaaaataagtgcagttttgcactattcacgttcaacgtttcaccgttcgtcttatttgaaaattttttatgattagtattttacttgctattagatgataaaacatgaatagtactttatgtgtgactaaatatttttaaataagacggacggtcaaatgttgggcacggatatccacggctgcacttattttgggacggaggtagtacttttgagtaaagcaatactaggaatatatgcatgcacggacacagaaaggacaacacttcagtcatttctggcagaaagatgcaaagggactgattaaagcgttgcatctacattgccatgatctagtcccataaaccataaaccattggttgaaaagtgtagtgtatttgcacttctattaaatttgaagaagatagtattgcttgaaaggggagcatctgagtaagcaagaaaagtttgtggaacaggcaaatctatatcaaaccagcagcatacagctagtaccttgcaccattgtcacctaggccatgaagccacacaatggtggcttggtgccttccctttggcctcaccacataggtcctcccgtactcaactctctgaccaccccgtccacctgaatcaccatttaaatcgtgctcagaattgttcttttgcagctatatagattattataatgggcaaataagttttcgagaaaaaaatgtataatggagtagacagattaccagaagaactgcttccatagtaactcatgatgttttctgcagcaagtctgtactgatgctactcagctatagtactatactactatttctgtatgatgtgcactgaacgtccgaacgtatggaagggtatgaagagcacagccccagttggcatgtatttatagtgaaggttatctgaagagggaatattatatgtgtgtgtgtgtgtgtgttggacactcctttgaatctgcatctcaggacagtgcggttttccgcagcaaagctgtcataggaggagcatctggagtctggaatactcaagggatggtagggtaaaaaagattgaagccctttgctctagagtgaagaatcctgtacaatgcttacagccttgcacacagagatacacacacagtgacagtgacggtgacgatgaaagtgatgcctaaacatatcatgcaagcaaactaaggccaaggaggaaccatataatacataaatgctgtttcatgtcccttttttcccttattttttgtctgccaagcatatatccgcttgtaggatggagtactaatgcccactgcattctgcccacaaattgttgcaactccatatgggaaaactttaaataaaatggcaaggaataagcataacggaacaaattgtccagtcattgagctttcttttcacatcatacttaccagttactgctagatggaacttcagatgttcttgctggaagtacaatttcaaaaagacggagtacaaattctgattttggtatttcaagtttttttatgcagatgacaaagcagaaagaatttttttttcctggaatgtgcaaaagaactgtgcgccttgcattaattttaggagaaagcaaagcaaaaggaattgtatgccacaacttgttttggcataccatcaagatatagtgaagagtccagaaaggatgattacattggtagaaatatctatcaagtgtcgacaccaaatcaacatggatatgggaaccaaatcagacacaagtgcaattacacttgcagattgcctcataaacgtggtgcaatcttcatgaaggtacagatgcttgcaacagaaacatgacatattgttgctacaattacgtcaactgttaactgtagccattcaattagttaaagggtcatatcaaactagacagtagtttgccataacatttagctgttgttgactttatgcaacacaagttttaattttcttttagactggaaattgtctcaaccttgatgcaataattctagtgaaatttatcctgtttacactgttgactatgcgaatgttactaaataaataggacaactacagcctttttttttacctttgatgagctagctttatcttaccctagatttgcttgccaagaaaggtggacaactttaccaatatgcctcagaaatggagctgagttgatccaccctcaacaataaagattaaagatgaaccaaaagtcaaataaaaactgaccttgaatgaaattttggtaattcggtagcagaatgatgcaaaaggtctgcatatcttctttcagagaaaaaaaggttcacatctggtttttccatgtgttagcccactacacacaggaaggatcatattctgttctcctttttattttctaatgattggtacaggtaatgtggggggcagcccaagccagaatatgtgatttatatgtcattcttgtctctcttagcaccagaggtttgagtctacagtgagcaagaatgaggatgggacattagccacctgatctcactttttctcacactggaaattatagactatgattttgttgtgccctagtactataagcctgcatattcctccctacgcacatcattaattttctttattgcacatgttcctgtgaagagttaagttttctgtgaagtcagaaaaatattctaaaaaggccatggagaagatattggatttgtcattactaaaacatataattaaggaagatatgaccacaggaaaagatatattcttctttaaatgttctctattctgtccatggttaaccaagttcttattcatcagtattctcattccagtccatttctgctgctaaaaggatgaaacacaagggcagtgacaatatgataaattgatatatgcctgtagtgatgtagtataatgcgattaccgatacacaaggaattcttgtgattgcaattccttgcaagcaaattgctgattgcagatgccgcctgaatcagctcccaccagagccaaatcactgaataaaacaggaaaaatattacctttggccaaaccactgaatagtggatacaacaggcaaaatattactcacagtaataagaagtctacatcaaggcttaacagaagtcaacttccaggatgcaagagggaatgttgcaacatgaaagatccacggccaccattagacgaggaattatgccttataaagtactggggcattatgcatgcttctaattacattgcttgatcgcccagaaattcttcagtaaaatctcctctcatttctatttcatactttattgagagaatcctttctactcatactgttgatagttcatgagctaatactttcttctagagtgttttcctatatacatgctctcctattctcttttaacttttagacttataaaaattactttgggcgagagaaaatataagaaaggcaaagtgaagttgacatcactaagtgcagaatttatcctattatcactttatcaaccttaggcaatccaaaacaaagcgaatatttattttcctatgtgtttgaagttgtgcgataggacatatataatcagttgatggtaggaaaaatgagttataagttgcatcatgtctataggcttaaagaatcgaacctgaacttttcgacatatgatctcccatagatcaaccggaatttcttttgattgcccagccattttctatttctaatgtggtagccagtaatcatagtatttgttctcatcaggaaaaggaaaagagaaagctatggtgattagttcggcgatcgatcgattgcaaaagtatttccttaaatcaatgatactaaaaatttttgtttcacactaatataaaattttaaatattggtgactaaatcatatattggaaaccatgaaatgtcaacaaatgtcaagtaaaaagagtatctatcaaaattcaaggtgttacaaagcatactaaaggttaatatatagtagaagaaccagatcattattgcctagatgtggcctataaatgtagagtaactagtttgtaaatgtcaatgcataccttcaaaattcaaacagtggaaggctcggaaagaacatccaacagtctataatgtggggtctggtttatctagctttcacatagacaaaaaggcatcggacataaccagaccatctctagttttttttttctagtacattcaacactaaaacgcagagagtctagagtctaatagaagtgaatatggatatttagtcggcgcgcaaaaggaaacagcaatgaacaaataaagcatagccatctttaaaagaagaaagaaatggcaaagctaaacaaaagtacacgagtaaagtatctgggaagtaaacatagctagcattgcgcttgatttgggacaatcaatttagcaggacatttaacagtgattgctatataagtagactttgtttctctttttccatctagttaagatcaaaagactgcctgctgacccaacgcaatcaggagcctttgaggagtcgcaactcacaactaagcagaagcatcaggattctctctgacacagagtattaatggtctaaaaatactacgtaacaatatagcaaccacaaggataaagaagctgtgcacaggcttccgcaggcagtcagtccgcccagttgattcagtccatagctcaggttcacaatcaccttctgcctgccaaatcaagaaacgatctcagtacatggaattgtaaaactgacaaacaagaatacatggaggcagcatcgagacattaagccctagtatccaagggaaaaggaaagtgttcagctaacaagaactacaatgtatttctttatgagcttgcaagtgaaaggctgatgatatccaccactgaagactacttaggatttagtcataacaatgttacctcttttcctgactttcaactataaagcccacctatatctaaacatgccaattaagcatgcaaatcataagattcttatattattgaaagggaacactccaaaacacacaattgaacaaactgaatcatataatcttccctcagttgtgcatgtgactttcctctggtaaatgtggtacggtgtgagccagaccgtaggaatttacatcacaaaacaaatgaaaatataacatataagtaaaattgaagaagtttcgaggtggatatacactatcagtctatcaccatgaatcagtttctgtacttgccccaaaaacaattcacacagcaataaagagaagtgatacattgacagttttattttatcagaaaaaaatgaaggtgttaaaatagtaactaaagtaaatcaattgaactacttaagtcaagcaggtggaacatacctgtaactagttaattttagggcttaagtagtactgcggatctctgaagaacctgacaattgtctctgccttatccgtggaaaggtcagtgttttctagaataaatttcttggatgcttttgcaattgcttcaatagacccaatagcttgggcaagcttgaaaatcaagtgtgacatcaatatcagcatggcattatatgaacagtaaaatgttatctcatgttaagcatgaggattgaccatatatatctactgggtaggctataggagaaaaggaataaatgctaacagattagtacataaatatatcaggaatagaaaacgatcaattctcatcatgaaaagttccaaaaggtcagcactttgcatggagaaggtccaataactgtgtttaagctcagttataccctgaattagctgtggagtaatgctaagcttatcctttagaacgatttagtagaatgagtacacaaagatggtacttatatatgcaaacaatgtctctaatacattttccctaaagaaagaactatcaattaagtatgcggacttataattaacatttttatgcaagcaagcaaaagaccatctggtcatacataaggctaaaataattgagtgcataccgcattggcgtcatgattgtcaataccaggaatagaggtgagcacacgtagaaaggaatcagtgcactgaactgcttgctcccgctacagacaagcaggaaatcattaggctccatttcaattatagaccaagaaatagagcactgtgtatctggaaacatgtgaaagcacctcattcttcagtcttgagataatgtcttgctgcttgcatactgaataagaaaggagtgtcgatcaatgtcagcttacaattcagaatttgaataggactgagagaattgctaaatgaagtttgagatttacctccaagtgcatgagctatcttcacgattttctcgaaccccatctccggatcagtaacaggcacaaacgtaggaaagccaagcttcataccataccttgaataagaaatacatgaaaatcaatagctcaactaaaatattctggcattaacattatgataggtgcatacttgtgatatgatcgattaaatgattcgttttgctcttttgtaggaacagcaacaacaacatatagatgttttaactgcctcttcagcatattcaccctgaaaaggcatatcgaaactgaagtcattatcatagtcgttagggtggattggaataggagtctcgcacctgctaaagacagcaccttcattttgacaatcccagtttgtctcaaagataaatgcaacagatagctccccattgttgaatataaagtcctgggaaacacttgctcaggttacagaaaggcgccacagaaacagttgtgtgacgttgaagcaggaagaggtgcttacaggagatattgacaggaagtttaggcggtatgagtttgcagctaagaatgcagcaataaagttgatgaggcttggctgttgtttatccctccatgaagtgctcattgcgcatactccacgacctgcaggacggtgcccaaaaccccaaatagagtaaccaaaaatgtgctcagtgtaggataagctaaaagcagcctgctgcttctttgcttcaggcttcctgtactggtctaacattggagattccatatgaaagaattctagagtgcaaactgaatttctaagtgctcctgagtcctaacatactgaaattgaacagcagagtactgcagactgattggtttaaatgaaataggacatgaacatgaacatgccattagcaagtaagacgtgtccacaagtagcaacaggctggtgcttccggaaacaagcagccattcctagaactagaagtaagaaatgccgaaattgaacaggtgaacactgcaaagtgacggccttagctccttaagtaggagatgaacatggccacgcgcccatgccatataagcaagtaaaacatatccacaagcagcactagcctgatgcttccagagaggcagccattcctagaactagtaggattgagaaatgtaactcgtaccgtactgaactcatgattttgcgacattgcgggcttgattgatccagtatggggcgatgccctagcgcgtgcgtgagagggggagagagagagagcgagaggcgagggagtggatgacctggagcagcgggttcgggcggcggcggtgggaggcaggtccagccggtggagtgggtggagcgctccatcggatcggaggaggacggcgagacgaggcggcgccgcgacggggatcgagcggaagagccagccaactcgccgccggtttgccgtcgactcggctagtgcggtttcgcggcggcttttgctcgcgctgggcctcaagtgctagactgctacttcttccttgaggcctcgttttgttatgggccaaagcccggcacttcggcaaggatgggccagatgtttgaacccagggatttggtccgtttgaaaggaaatgaaaatgggccaaatttcctggatttgaacaaaactcttttcttgtgtgtgcgctggatttttcatcttttttgtccttttagaaaacttattttacagatatcttttttttaaaaaaaaacttattttagaaatggaccatttttcatggcatcaatgaattggcgtcatctctattgtccccggtgaaaactaagtcactaatataaagggaaaaggcgccaatgtataataagtttttcaaaaggtgaaaaatcgggagggggtgtaattgctgaatggctgttaaattattggcgcatttcatcaagtagtaagtatatattatattccccttatgtaagtattgcgtcatgtttgaacattgtttaatcgtgcttttccggtatttctgggcactgacagaaccatatggcgttgctttatatttctcttcttttcttttcggactgaaaggatatcactgagtttgaagcctgatcgtgtcgtgtaattctgcactgtacctcaatttggcgagttaattctagtattgatcatctgtaagctaacggttgggcaaatgaagagcagcacgcaccgtgaaaaatgatgatgcagctacatggtagtatctcttttgagcttcacgccgtggagactagttataattcagctccaatgatgctgcccccgcgaggcacatggcgaattcgcccaacggccggccaaacaacaccatcagtaaaatctttttttaagaggctcgctagctagcggcagctaacaaaatgatcaaccacaaagcgaagcgactgaagaagtcttcttaagtttcagtttcagtttcagggcgtccagttgcgtgcgtgctactgaaacaaccacgagttcagaccacggtttacatcaccagtttaccactaaattttgagccccatcaatatcacgatttttgataaattttgatcggttttcgataaatttcaactgaatttcgatcaaatctattgtttaacctttaaaatttcaatcgaaacttaatttcgagtcgtgtcaaaacatcgaaatttcacgaaattcgaccggttttcatcggaactgtgaacctgattcagacttgagagttcagacatcgacacggctggctactgaatgatagtatatagtagtagtagtacttacatatccgtggcgaatgcgatcgattgaaaactgaatttgagaggccattattcagagagaaaaaaaaaagggtgagcagcagcatttgctcctatcctaatcggtcaccatgattgcccgatggagcgggcatcatgacatgagccggcttcagtactccgaaaaggatatcagggtaaaggactgattaaaaagcgacaacgtacacaagcatgcatgtccaagtagtagtagtattagtttgaactagagaaagagcaagcaaagcgccgtcggggcggggcatcgtgttcgcagttgcaaatgttcagtgagatggggaggtatatgatgcatgtccattcgatccattgcttgtgatccacgtacaaatcgaatccgaggtgctcgcaattcgttcgtaaggcctcatcaattcggatcctcatgatcgaacgcaatgcgattccgagtgtcgatggcatgatgatactttgcttcctccttccgcgctccaattcgccttattactccctccgtcccacaatataagggattttgagtttttacttgcaacgtttgattattcgtcttattcaattttttattataaatataaaaaataaaaagttgtgtttaaagtactgtagatgataaagtacgtcataaataaaataaataataattttaaaaaaaattgaataagacgattggtcaaacgttgcaagcaaaaactcaaaatgcctaatattatgggacgaagggagtagcatttagcagtaattcctctctatgtctgtgtcggcggcggcgagtggtgactgctgagcccctaatccactgtaaactatcactagcaaaggacgctaatgtcagtcgatcacactgtttgaccagaaaataggagtactcagctttctttctgcatgctctgtttcttcgaggtttatgtcagtcgaagattcttcactgctactgctctcggtttctagtgtacagtagcagaagttccacgttaaaattgaaagtttaaagaaattagaacgatgcgacggaaaaattgaaaggttgtatgtgtaggaaagttcgatgtgatggaaagttggaaatttgaagaaaaaaaaattggaatctaaacaatgcctggattatttgaaactctcgaagggacgttcactcattgtttatatcattgtatgtcacttaaatagctatgaaaaaaatataaattaatatgtgatagatcacatgaacatttcataaatatacaagttactcattccgtctgtaaatataagggattttttgttggatatagtagtagtagtatatcatatgaatgaatgtggacaattcaatcaaaatctcttatatttagggacggaaggagtataatttaacttctatatgttacagtgaaaaaaaacaaattttattataaatatacgtttaactaacttagtttaatatgtttccttttacaacttacgaaagtgaattttaagttacatgggaagtgtataaatgtaaatatatcttgttatttcttaaaaaaaatcttgagagtttaaaattcctactacgtagaagtagacagcagtggaggccagaaagagaagatctgggccgtttattttaggcgatacggacggaagcaggacgtgtcccatctggcacggcacggtacaatcctccaattcccattcccattcccattcccaatcccaagcataaataaaaccaaaactccctcttcatattcccacccatgactccgactccgacactgacccatgcccatggccgcgctccgcctcctgcttctcgcgctcgccgtcgcctgctgcgccgttgccgagccgccgcagcaggagcgctcggctctgcgtgccttcctcgccggcacgccgcacgagcgggcgctcgcctggaacgcctccacgcccgcctgcgcctgggtgggcgtcacctgcgatgccgccaacgccaccgtcgtcgcgctccgcctccccggcgtcggcctcatcggccgcgtcccgcagggcactctcggcgcgctccgcggcctccgggtgctctccctccgatccaaccgcctcttcggcgacgtccccggcgacctcttctccctccccgacctccgctccctcttcctccagggcaacctcttctccggctccgtcccgcccgacgtcgccaagctcacggcgctccagcacctcgcgctctcgcacaacaacctcaccggcgccatccccttcgcgctcaacggcctcgccaacctccgctcgctccgcctggacggcaaccgcttctccggcagcctcccgagcttgactctcccgctcctcgaggacttcaacgtctcctacaaccagctcaacggctccatccccgcctcgctcgcgcgcttcccgcctgagtcctttgccggcaacctccagctctgcggcaagcccctgagccgcccatgcgagcccttcttcccgtctcctgctggcgcgccgacgccgacggatggacgaggcagcggaggcggttccgtgccagtgtccgagaagaagaagaagaagctgtccggcgcggcggtcgcggccattgccgtgggcggcggggcggcggcactgctggccctggtgctactcgtggtctgcaccgcggcctcccggcgccgcgcggcgaacggcgaggtcgggaaaacagcggcggcgaggggcctgacgccgccgtcgacggcgtcgggggagctgggcgaggtgacgtcgtcgacgtcgaaggagatcgctctggcggcggcggcggcgacggcggagaggagccggctggtgttcgtggggaagggggcggcgtacagcttcgacctggaggagctcctgcgggcgtcggcggaggtgctggggaaggggagcgtggggacgtcgtacaaggcggtgctggaggagggcgccacggtggtggtgaagcgcctcaaggaggtggcggcgtcgcggcgagaattctcggcgcacctcgactcgctgggcaaggtggaccaccgcaacctcctccccgtccgaggctactacttctccaaggacgagaagctcctcgtctgcgactacctccccgccggcagcctctccgccacgctccacggtcagtcgctctaaccactcctccattcgaccggaattcgcgcggtttttgcttgcaagtacgcgcccaactccagtccaactaaaacgctaggaattgtcgctgcatatgcattgcagtatagtacgataaacagtgtgggtgtcatgctgtaaagcgaaagccattggggcacacctacacacacgacacactgactatgagtacgatacacgcaatgctaatctcatcaagcgagtgtcgtctgtgatttcaatttcgatcggagatgctgttgcgatatcaactacgaacaggtgaaaactgtagctactgaattcgtcggccaagtgcgtgctagtacttcagaatgcagtccagcaattgagcaaaattatcaagtacatttccacgcatgaaacattctctgtgttggcgattactgtttggagctacatattcagttattactactactttaacggtacagctactttggtacggggtttttctttagaatgtttcatggcatggaggtacgtatgtttgctctaacaaaagcaacagtacggcacatagtacatatcactgtagagtgtaggttaagcattgttttagacaacatcgtcgtttgatttgcatcaacatcactgcaaacttcctcagtagtaaaccttcagtctaattcaggaggtggttggtaggaggtgtaaggtgaattttgggtcaagctgtagataattagtcacagtgcaatccaatgattcgagatgctacaactacgagtagtcagcaaggggcatgtacaagagatgtggactctagcttctttccagcggcgcatgggcttgaggttccaaacctaggaaagtgattgagagggtagcgtttgcatttgaccagcgttcttcagattccaaatggcttatgtccaaatcatccgaaagggattgaaagataaatgtaaggttcagtacccatcttctgctatccatgatgccgccctgaattttaaaattttctgaacgactggccatgctagtttgtttctttcgattttatgcaagtagtagcaaaatttaattactgctgttcatcagttaccagagggcaactttgctttattttgggtatcactcaaatgtcaattgcctgtcacaagcgaagcatttagtaccaaatccttaattctgagatttctctgattgcttagttgttatattctttttcaataagtcaaggttttttattaactgtaaacgtcacatgttctgtcatacgcgtatgctaattactacctactacagcttatccagcatgttgatctttcatacaagcaacgtatgtagcatgcataatctgtgtgttttacatcacaattgttatatttagaagtccacgaacacgtacggcatagttttttgcttcttaatttcgaaagagaatccattatttctctaacttttttttttgctgggctttctctaaccaatctctcattctctctaccaactcgaccaacctgagtacaggttttgtattctggtttcaataatagaagatgcttgccttcttgctgtccagtagtagtgcctaccaaaaaaaatcaggtttactactctgtagtgtatgcaccaatggaaacaaaattggaggcgcgattctgtatcactaataattcagccgatagagacaggctcatgcgatctttatcccgtttaagaactgtcttttcatcacttcacttgtaaaactagcatgtagaaatcacagaaatgataaaaattttcatgcaaaactaattgtagcataattgtaaattgtacttgtttatgttcataatgaaaagtgtgcgcgtccgtattgtgttaaaacaacactcccttcttcccacaatataagatgctcactcatttcaagatttcagatttaaaacattttgaccaacatttaatacaacatttagttttactgtgcattgctttgctgctctgtgttttgtggctggaaatggctgacagtgaattgacctcagggagccggggcaccgggaggaggacgatggactgggacgcgcggatgcgcgccgcgctgtcggccgcgcgcggcgtggcgcacttgcacgccgcgcacagcctcgcccacggcaacctcaagtcgtccaacctcctgctccgcccggaccccgacgccaccgcgctctccgactactgcctccaccagctcttcgccccgctgtcggcgcgccccaacgccggcgggtaccgggcgccggagctggtggacgcgcggcggccgacgttcaagtccgacgtgtactcgctgggggtgctgttcctggagctcctcaccggcaagtcacccgggaacgcgtccgtggacggcgacggagcggtggacctcccgcggtgggtgcagtcggtggtgcgggaggagtggaccgcggaggtgttcgacgtggagctggtgcggctcggcgggagcgcggaggaggagatggtggcgctgctgcaggtggccatggcgtgcgtcgccaccgcgccggacgcccgcccggacaccgccgacgtggtcaagatgatagaggagatcggcagcggccacgggcggacaacgacggaggagagcgaggaccggtcgagggggacgccgccggcaggcacgacgccgtgaacactctactctctctactggtgtcgtaatgcagcagcacatgtcagggtaaattgatgcatgaacagcttcgttcgttcgttcgtggcgaagttctctcactctgtttttttttttgtcctccatttcttcagtttatagcctctcttgacttgatctagtaattcttccattgtttcgtcgatcaaatgagttgttactacctgttcgttcctcttcagccaagtgtaatttttcagtccgtatctactaccaccattgtagctcttcgtatatgcatcttcattttgatgctgtgaagtatatgtaggagtatgacacatgaataaacagaaaacctgtgaagttctgtaccatttgacaaagctgggcgctacctgaatctgaagacccaagaaaaagacaaacatgcattgaggctcatgctgtatcgcaaaaaaatcaggaaaaaaacaatccatctcatccagaaagaaaaaaacgtgccctcagccttgttgacacgaagtactagtagtacgtacagtaggttgtttgattggagtcagcacgtcagaatgtgggatgtcatcttgctgaagaatctgcatttttgcagctgtggatgtcccagcagaagtaacatcgtcaggttagatttacaggtgctctgctccaaccctcgctatccgggccagaagggggaggctgcggcctgcgggcgagtaggccgtagtgaattgggcttttgtaagttgggcctttgcggtgcgcgcgcgagtgggccgcggccttttgacttgttcctccaactccaactccaactaaatcggtggaacctttcgtcgcgcgggcgcggcggcatgcgcgcgctaatcttcatctcctcgtgaatcaccactgcagctgcagctaatagtagtaaattccatccatggccgtcgcctacactagtgaccaccggcaccaccaccaccaccacgacgtcgtgggcaggctgagcagcctcgtcgccttgtgcggccgcggcctctcgcgcgtcagccgccgcctcctcctcctcgaccgccgctgctacggtggcgggaggtccgcgccggccaagcaggacggcggcggcggcgaggccatctggcagcggacgatcctgatgggggagcggtgccagccactggacttcgacggcgccgtccactacgacagcttcggccgccgcatggccgccccgcgatccgcctcctccctctcctcctgctgctcctccgatagcctcggcgccgccacctccgaggcaagctacatcacctccacctccacttgtgacgatggcgtactctgaatgtatcaccatgccatgcatctagctctagcttcatgcgtttaattgccttcaattagtatttttgtcaccgatgatatattctgcattagttgctttatacatgtgcatgcaccgtacccttcagtttaattagcctccctcatgcattacaagagcgaggccgccccagctcatccaaagcttaacaacctactccctcgatccatttctaaatatttaacgtagttgatttttttaaatatgtttgatcgttcgtcttattaaaaaatttaagtaattattatttttttttcttatcatttggttcatcgttaaatatacttatatgtatgtatatagttttacatattttatataagtttttgaataagacgaacagtcaaacatgtgtatcgatctcattgcatttgggggccttttgctcacatatacctgcctcttgcatagttggatatgtacacacacaaagaagctgcctgcatgcacgggcgaattcagtgggtccaaacagaagagcagctgcattgcctgcatccatgatccatatccatccaacagatcgattataacccgtcacagttacatgcacgcgcgcgtggtgcgtgcagatccaagcatgcgtacgttgtgatactgcatgtgtgatgtgcatatatgctgcatggtttgtgttagcttcgatcttgtggttctttgcatggcaagatatatagcatatgtagctacacagcggaggagtcgccgtccttgggcagctcgagggcgcccttgttcttggccgtcgacccgtcgtagtagcagaagtagaggatcaactgcgccgcgcccagcagcgtccccatgccgttcggtatctatttatttattaattatgatacattaatatatagtactattagctagaattactctatgattataataacaactatactacttactgatcctagtaattatttatgagataattgaaagcatatatatatatatgcatgcataatatgtataccgtgatgaggatgtcaaagcggatgaacgcgtatattgtccagcatatgccgttgatgaagctcaccagcgacaacgtgaagggcatgtactccacgctctttgtcgcgatcacttgtttctacattcattccatgtagtaattacatcattttgccacacacatataaatcaaataattaatcatcagatcagattcatgcaaaaaattaataatcgacagatatatatacacataccatgatggtgagcggcgcggcgtacatgagggtgccgaagaagacgcagagggtgccaacgatgagcgagcgcttgtcgtaggtgtgggcgccgaggagcacgccggcggcgacggcggcgaggaagacgagctccacggtgaggacgccgagcatcctgcaccgcttgggcttgggggcgtaggcgaagtagatggcgaggtaggcgatctcgatgaggagtccggtgccgttgatggtgacgacgaggatgctgttggggtggatgaagggtaggccgtagaacacccacagcgcgcagttgaggaacgtcgccaggtacggatccggcacgaactcctccacgtccttctttttcacgatcgtcacgaacgtcgagaatggcgacaagaacaacccgaacgatatcaagttacctagtacaattaatcaattattagtcaattactaagtggtcgggcaatatatatatatatatatatatatatatatatatatatatatatatatatatatatatatatatatatatatatatatatatatatatatgaagcatctacaagcaggttcaattcgagacgacgtaccgatgattccaacgacattgcggacggcgtcagggttcatcaccatcttgcctgctcctctttgctgctacttttcgatattttctcaggcgaatagatgggagtatgtattagtacagtggcagctagcgagagcgtgtagctgatagcaactaatcaaccagcaagagattaattaactgtcaggccagcaactgtaacctgatcaaatagttaacttagcagctagctagctagtgtgctgctaagttaaaattgggggttaaattaaatatataaaatgcgtggattttatttccactgattaaaatggcggcctctgccctccaattcctccccccttaatcttacgagagtcggaataatggagaggcagagcacggattcagattggccatggccgcccttatatacacgacctatggctaaaaaaaaacacatacaattaacctgattaattaaagtggtgctagctagcttgaggtgcagagacaatctagctagttttggcttaattacgtggggccaaaaaatggacaagccagggtggagagcttactggagctccgaaatgcatgcacagccgtctgctcagttttactcttttccgtcacaaaataaattaattttgccatgtctatagcattttccaaaataatcatccaaaacagtctggatagtagactgtaaaaccagaaattgacaaaaccaagtctattactcgctcattaccgcctctctaagaggatctaggacgccataagcacatgatcgcagctacataacaaaccaatagagttgacgaactgtacaacaatgtagcagtggtgggtgaaaaccacctccgtgcaaaacatgccaaagaaagtactcaagtcgatgattatcctagtctcctgggagttgtgaaaggagattaactcttttccctcttttgttagggccgactctaactctcaaatgatgtacatatttgaggatctcctaactctatcaatataaaagataattcttttgccttctttttcaaacaaataaatcaaaataaatatgtttgtaccactcaagttctctaccgctcgtctcaactaactacaaccattttacatttaatttttcacttactttcttttatcaaccaaacatcaatttgtacctagcttttaatatccgtatatagcttcaagatacttatattttaaaatggagggaactgtactcacaaattaataattattggtcatttgactgacacgtggcacgcaattggcgttagataggcatccgtaccgatccgatccgaattattaaccgtacacttgcgggattgcaggagagcatgcgatttgcatggcaagtgaagtgattgatgatggttcgaggttttgcttgcattggcatgccgatagcatgaataacgttcgatccatcaaacaatacaccaagcattttgaaagcacgggctttcttcttagccgattcagcccaacgcgttggtgcggttagttagtttcagttgggctgatttccaaattctgatgggccgatcgagttggacccgatgaatagtaagtttacctcgtgtccctcaactttacaccaagtttgtttgacatccattatcctcaataccagaaatattcacccctaaactatactccctccgtccctaaatatttggggccattgactttttaaagcatgtttgactgttcgtatacataaatgtttaaaacttttgtgaaatatgtaaaactatacgtatacataaatgtatatttaagaagaaaaggaattaataattacttaaattttttttgaataagatgaatggtcaaacatgtttaaaagagtcaacgggacggagagagtatacaaaaccggataatctgatttcgttgacgtggcaccctaccagccacattagcacggcccaccccctctccctctccccagcaattggactcggatcgccgcctcataaccgcatccgactcatgagagcgttgcagcgttatatatgtaggatggacgttacgatcgatgtgatacgtgtatccaaatagcggtagcgaattgaaggaagatatatcgatcggttgaaagtgatgatggacgatgtgatgagcgagatcctgctccgtctgccgtccaagtcggtggtccggtaccgcgccgtctgccggagttggcggcggatcacaagctgcccctacttcctggccgcccgagatgctggtgggatcctgcgacggcctcctggtgctggagcaggaccacggcctgtacggatgctggtacactgtagcatttggacggctaggttcgtgtgtgtagaggagagggatgatgtgatggtggtgtgcgagtccgcccatgacaagaaacttaatacccaacatgctgctggcctttaccatctccgtgacaacaagtttttggagcccgcacttgatcttggggaatgctccctctcagagtttcggttcaaggaaaagcctcgtccgacatgccttcttcgacttgccccgctctcccgacttcaaattcatacccttcgatctaccccccccaccaatttccccttttctcacatataattataggccctatttagatcccctggcaaaattctacacgctgtcagatcggatatttggacacatgcatggagtattaaatatagacgaaaaaataactaattacacagattgcgtgtaaattgcgagacaaatcttttaagtctaattgcgccatgatttgacaatatggtgctacagtaaacatttgctaataccggattaattaggcttaataaattcgtgtcgcggtttacaggcggattcattattagactacgtttaatactttaaatgtgtgtccgtatattcgatgtgacacatcaaaacttgacacctctggatctaatcacagccatatatcatgatgcaacactgtaaatatatatatattgatgatgaatggaatgcctggagataagggatgtggggctctgttttcgtctgtttcacaagctatatgaaaacttagaggcatctgctttttatttttctgaaataatttatgtgtcacaatacatcacgccatgtacattcactagatctatagaggggggggggggggggtgtatgtacagatttacaaagttacagggtttggagaactagcccaaaaggatcaatttacagggctttggccaagtccgctacccaggttgagaagatagagagttactacaggagagcgggaggttgcagagctctctgcctaggcagaacctctccctagggctggttatgctgtgtcctgcttctccatgaaaatttctgcttccctccagatatcctcaaatagctgttgtgccgtgcacattttgtgttgaaagatccttgcaaatctatagccttctgcagggctgcatataactacatgttcaattatgagcttgattccctgagccaggctgagaaaaactcggtggaccgttctccaaagcgcgttttttcctgtaaaagacatctataatgtcgaaatagctggaaccaataaggaattctaatcattctgtcaaaggatccttaccttctctgaaaatggttctgtttcatttttccagtgtcaccatgggactcacaacctccttttgcttcctcacgaccttgcttcggcaactcaattgatgtctgaattggaatatcgcaacaagggaaaaaaagacacatgcaacagttgtgaatatctggggctgcagg

SEQ ID NO: 83441 - DNA, 517 bp, Oryza sativa
cctaaaagccaacgcgaaatgcaataatttagcgcgcgacgcagccttgtaacacatcgaaatcagaagtaggtgcaggagaaggagaatgggggggttaacagttgcgggtacctgtcggcgccgctcatccgtcgtgacgtaccctgcatcacattcacagtcacagacaaaccaaatcaaacaaaattatccggcggcagttcgaaattacagaaccacagagcaatcgaacaacaagtcgatgcccagatccagcggaagcggcactgatccgagcacgagggggcactgcattcccctcccccaaaaccctccccactaaaatggttccagaaaggcgagagggttacgaaccggattgagagcggtcgaagaggaaggcgaggggaacgagcagcgagcagaggaagagcgccagcacggccacgcgtggccccctccgcctcttcgccggcggcggcggcggcggcagcagccgtcgccttcatcgccacctcgccccactactgacact

SEQ ID NO: 83442 - DNA, 4642 bp, Oryza sativa
gtaatgcagggtacgtcacgacggatgagcggcgccgacaggtacccgcaactgttaacccccccattctccttctcctgcacctacttctgatttcgatgtgttacaaggctgcgtcgcgcgctaaattattgcatttcgcgttggcttttaggaggttgttttgcctgagttccatcacgtggagaaggcggatggtgacggtactgtcaatggactgaatcaggttcgcatttgcaaatcctgttcgatgatggtgactgctttgtaaatgttgtttgcttctgaaacctcaattggtgccaatgcatcgtaaggtgctcgcattatctactcctatgatgtaataaatgagtggccaggacgactgatacttgtctaatccttgctacctgcaacttagaggtgaattttaagtctagcgtgttagctttccgaggacaacactgtatccttgttggttattgcctctcaagggaaatacttaaacatttttttcatgaattatgaaaaaatagtttgcaaaaatgtatgaaaaattagaattagtatttgtagcagttggtgaattgccaatgttgtgtggttgcatctgcaacactaacacattctttttccccccttcaggatgcaccaaagaagacgcccaaagttaacagcggagggctgcagaagcataagcaaactgatcgacacacctcccgtattagcactaaaccaaaaggtactcttcagttcattttctgcagctaaggtttttagatgtgactaaaatgttgccaatgctagcatgtcattcatgaattatagatttataggctatacgaagtaatctggtaaacttaacaggaaatctagcatttcgggttacacaaagaacagtgatagtaacatgaagattatatatttatatatggacataatttcaactgcatggtccttcatcctaaatattatatgtgaactcaagttttcttcagtcccacgctcttgcttctcaccatttcccaatactttactttacatactagatgcaaatgttgtttagaaacaatgttgtcattgtgatactaacaatatgttcactgctgctctttgtttaagaagtctatatgctgtattccagttattcctgattggtcttttattctgtatgatatttatagtattctttttcatatctatacacagttcttccctcaccaaaagttgacccatcagaggctgtgaaggagtcaactcaaggcacaagagtatgctttctagcattcgaatttgtactttattttgctacttttgtgacacgttcagtcattaaaatggaattctaaggtcctgcagtaacagtagtagtaagtattatgatgctagaagttatcaaatgctatattttcaggtcaaacacatatttgtagatagtatgcaataacgccaaaaattacctttccttttagtcgtactgatgtaataacatgccattattctaataatatgatgctgaaaaatactgtgtccctgtatgtttgaaggacaatattttaggacaatgctgaaaatatactgtgtcccagtatctttcaaggacaaaattttaggacaatgctaaatatactgcatcctagtatctctcgaggatagcttcattctcatagagcgctctatttttcttcctgagaatttttttttcaacaagaggtactaacgagcatgcattgctttcaggaggttagcaaagttagaaagagactagacaaaggcacaaacacagatgaagtggaaaatgagaaggcttgtcaacttgaatttggtagctactgtctctggtccagagaacacaaagtagtcatgaaggactccattgtgaaaaggctaaaagaccaactatttgtggcacgctcatattatccaagcattgcgaagcttgaaggacaggaggaacttactgtgctaatgaagcaaaacatacaagaccatgagagggttcttagtgtatcgactgttgatgctgatctaccgtccttgtaagaattaaaattctggtgcttactcttctggtctttcacagttcatttcattgtcatcttaaagttgcagttatatgttactgaaactggatctggatatcttgcaaattacaatgccatttaaactctttatctcttaaggggaaatagttttttttttttgagaaaaatgtgcattcatctgaaaatagtatagaatcaaccgatgaataattttcccatcatcaatatataagtctactttcataattttaatgatatttatcaattgatttcagtatcaacaagaagatggagcagatggagcaaacaatagctagagcaaaatcttgcactgtagattgtcgaaatgttgacaggaaacttcgtcagatacttgacatgactgaggatgaagctcactttcatatgaagcagagtgcattcctctacaaccttggtgctcagacgttgcctaagagtcatcactgtctatctatgaggttgacattagagtatttcacatcctcttcactgggttcaaatgattcttctgctcgcaaatttagtgctgcacatggtaggcactatgtcatactatctaagaacatccttgctgcttcggttgttatcaactcaacagtgaacagttcaaaggtatgtggatggtttttattctttacagtgtttagtttttgcattatattcgaggtgggtgttgcttatattcatgttggtcttttcgcaggacccaaaaaaaatcatttttcatatcttaactgatgctcaaaatttctatgccatgaaatactggtttgacaaaaagtcatacagagaggcagctatccatgtcgtgaactatgaggatattatcaaggagaagttaacaaagtttaatgtgcggcacctgtatctgtccgaggagttccgtgttcttgttaggagtactgagcaacctgctgggaagacaagaatggaatacctatcattatttagtcactcacatttcttcattccagaaatatttaaggatctaaataaggtggttgtgttggatgatgatgtggttgttcaacgtgatctttctttcttgtggtctcttgatatgggggacaaggtaaatggtgctatcgaattttgtggtttaagactgggtcaagtgagaaatctcttgggtagtacaacagttgataccaagtcatgtgcatggatgtctggaataaatgttataaatttggataaatggaggaagcacaaagttacagagaactacctgctgcttctgaaaaaggttggtatagttctggtctatttattttcttgcgatagcatatgataagaaaagggcacaacaaagggtgatctggaaagataatgtagtgctacttgtgtttttccagtctcagtctgaaaattatttgtcccactgttttttatgcacctcatggttactattatattgcacgtattaatctgactctgttgtgttgcagttcttgacgaaggatgagacatctctgcgagcagcagcctttcctctaagtttgttatctttccaacacctcatttatccccttgatgagaggttgattctatctggacttggatatgattatgcaattgatgaagacgttgcacggagttctgcagcattgcactacaatggcaatatgaaaccttggcttgaattaggtataccaagctacaggagatactggaagaggttcctaactcgagacgataaattcatggatgagtgcaacataattccctgacaaactgacacaattgaacctgggaatcagaccaaccgatagcagtgtgcatcaacgagtctcacccttatgtggcgtactgactggatgctatagctcccaaaagcttttattgtgcactacgactacaaatacagctgtggaacaggagaagggttgctatcgttggtcataaatgtcggcagaagagtggacaaagcatgttctattcattaattgacaggattgattaactattttttttgcgatgggattagtctcaaatatggggactacatgctttgcaggtattgatgatatgaatgagtcttcaagtaaaggtgggtgtcagcctcattgtccagatactcgttctcttggaagaaggcactgtccagattgttagatagggtattcaacgagcttcgggctcatggctgtgtttcacgccccatcgattcatgacggtttttcccttcctcttctgccaataagggtaaatatatgtaatcctgatagtcattgttttttggttcttagttgttgtacatggattatttatcgaattcttcacacggaaagtctgctattggaagctttcgacacctctgtgattaacctctactgtacatttcgacttgttcttcctcacttggtgattcattcattataattgaaatttggatatgaatattataaattgtactccgtccgtcctaaaatataagagattttagatggatgagacatatcttaatactacgaatatgaatagattttgtccagatttttagtattaggatattttacatatatttaaaatctcttatattttgggacagtgagagtattatcatgggggagaaatgcagctacaatcattga

SEQ ID NO: 83443 - DNA, 1257 bp, Oryza sativa
ttacacatgagatagcctcacagatccgtcttgccattacaaagcttggatcacatgaaaagttgaagccaatcaaagatgaacttccagaaaatgtaacccttcctccatgcatgattagactactgttgttaatatctaatagatctgttgcatcaacaaacaactgcttcttatgcactgccaagttagatattagttcatccaaagcgttcccaaggcctaatttacctggcaaaatgcaacatgatacttgcaggtaacttatgagatgatccagacattcttggcaattgagggacttggattgtcggatcaagtttttggtactgttcctactgatgggatccagtccaagacatcagaggcaccaaagaccacctccaatggaggtgaagttggcgcagatgtttgtgatgcaagccctttgacaaggagaggccaaactgatgggtcattgatttgtggtgatgagccagcaagtaaactacaaaagatagacgggcaaggtgtaaattctactgccgcaatcggtgccacagaggatgcaatactagaactggttgaaggacgcaatggggtaagacatcttttttttctgaattttcttcgattggaattcatgttgttcctcgttgatgatcttagttgttgcaggtttcgttggaggatgttgtcaagcacttcaatgggtcgaaaagagaatgtgtcgtcgagatgttggacaatctggaaggcaattttctggtgtacaagaagaatggctgctacatgattatgtgaaattaaagatctgaaggaatgttaccagttggttgtcaatgctagtaaccccatatctaggaacatatacggtctcaaatgatgtatatataaaatttagtggtaatgagtgtaggcttctttccctctttatccgtatgaaaaattcacctgttcatcactaacaactgatctttagttcattcagttttttctgcttgttcagagtttagaaactagtgccgtttggccttgaaggatcatcatatccagtgaccctgattcgttgtagaagaatcagagtctgctcctagcctcaaatatgatcaagtttttttcttttttgtttctagttggttttcagtgaagactagtgtcagacacagcctggctgcgatggagcatggacttcccggtgcgatacgttcagttttgggcggaatatggatagctatcaatggcagcgatcctaatttcggcccagctaggatcgtt

SEQ ID NO: 83444 - DNA, 19632 bp, Oryza sativa
ttggaaaagaagtaaattgcatcaatatgtaataattacagatttcccattccaaacatgtgtagcttgcatctttcagtggtaagatttacatgaggcccggttttactatctctctagggggaaccagaaaccaggcatttagattagagtactaagcaagtcatggttctcaatgactctgtgccaatgtcaagaacatgaacatgaaattgacacatggtaaaaaattccaccctcaaaggatggcgcccattaaagtctgaagacaagaaaacatgccctaaaaaattgtgggcagaaagtaatggggaagaaggaaaaagaataggaaaatgatacggtcagcacacaaaagccaaaagcataaccaaagcagggagaaaagatgagggcaagaacaaagctgaacccatcataagttcataaccccacaaagatgagcatatcacatcatgtatttactgtttgctacttgcttagatgaaatactagtaaactagcctagatgagcctagcatcaggcatagaatgcttacactggcaacgcagtagtactggccgaaccgaactaatttatcatgcaacagctttctgcattcttaggagcaaaatggagcaactttctgggcgccaaatgcggcatttgagcaacttgattagagaagccactaggcaaatttgaaacgaaaagaggaagcaataaaggcaaaaccgaagctaatggaagattgaatatgggaaggtggcaacgactgatagatttctagtaggagttatgtgggaaactgctgcacatggcaatgtgggtgcagatttactacattgtttactgactacaagatctggagcagtacatgatttcttcatctgcacttaaagagaacccaatttattaatcacggacgacaaatgaataatgtgcagtgctccaaagtccaaagcccaagctcagaggtcagcatccagttgtttgcaaggatccacacatttctaacttgtactagcatccaaccccaaatgaaaactcagcattcagaccggaattccaggaagccaggcgcccagacttatgtataccgtatagatcaagtaactcaattctgaactcttttttttttttttgcggggaaactcaattctgaactagagcaggaacatcgtaaagagaaattacaacattattattgcctctggttaccttgctagatccgccacgcaagcaagtatgcaacgagaacaagagctggagctcaagaaaagatccagtctctgaacatttcgagctaggaaaaacagcaagattgaaacaaaaaagagtaaatttaatggaataatattgcggataagtctcctctattatttgtccgttccgtagcacagacaaaggaaataggagttctagcttctaggacggaaaagaatgttatccatcaaattcacctgaaacggcggcgtgcagtgtaactgagcagtgagcatcaatcagctagaaataggacgaatgttgcaagaattcctagaaggaaaattaagtaaaattgggtttcgacgaagtaaatgaatgaagaaaacctggaaggacgagcaaagaatcgatctttccaccccaaaaatggtacggtcccgctcataattactcgcacgaagcgtacagctgaaactcgaaatgtaagggcataatccgaaacggtcgccgctaaaaaaaaaaaaacgtttcccccctgaaaaataccttgtcaatctgaagaagaactcgtaacaacgcgacctgaaactgaaagaactctacgggagcagggcggcaaccaaaccagaatagcaggagatgaatgcgaaggaggagcgtcggggtacctccacggcggcggcggctcgtcgccggtctgtacagcacagcacagcccacggaatcccgtgaaatgcgcgcctgcagttgcggtcgctagggcggcgctcccgcttccctcggcacggcagtagctggggtagttgatccaacccacacacacccctcccttcgcggtcgcagcagagtagtgtggtaaaaagcgagagaccgagaccgagagcgtgtgtgaagtgtgaagagagaggacttcgcttgcggccagcacaggagagagagacggaaaggaggcgcatttatggcgaggaatgaaacaaggccagcaacgcagtagtatggatccaccactgtactctcttgcttacaaatcactctcccctcttttgtagcagtagcagtagtagtactactgataaatgcaagtgtaaatgctgttttgttttgttttccccttctttttcgattctactttatggttgtgtttagttaacactgaagtttaaaagtttagttaaaattgatacaatatgataaaaatattgtgtgggtatgaaaggtttgatgtgatggaaatttgaaagtttgaaaaaaaaaacttggaactaaacagggcctatgtaatactgacaaatggaaatggaaatggaaaaaaataaatttaagggtttgttttttactccaacttcataattttctaatcattttcatgcgtatgttttccgaactattaaataatatattttaaaaaaatctataaaaaattgctttagaaattatattaatcaatttttcattttttaaactgatacttaattaattatttgttttcagtgctttgttttatgcgctgaactcaacaaggctgtcgtaagaagaactacgcttagttttgatgggttatttgacttttctggtaatattcgacagtataaatgaataaatttatttacaaagttgaaatctttgtttaataaatgtgttttataaactttatatataaattctttaaaaaaatatacgttttagtagacttggaaagagtgcccgtgattaaaatggggcctttgagtaactttgcatttcaagaatgaaaaacagcccggtacaagtacataaagtcgagaaatgattgaaattggtggtggggtttttttttctataagtgggcaaaagtattactagtataccattggcaaaaaaaaaacgcaagtatcaaataggattatgatttgtatatcgttcaatctacaccatcgatgtcatccgagatccgactgctacagctatcattggagagtagtatctgagaataaacacagatgaacaaacatctctggacttgatctattctctcccgtgtagcagattgcaacggttagagtaattgcgaaatagcaatgcatgtcgtgcaacgtacagatgcctctagtaatgagatggtccctgcaataagtaagggctccttatggacaaagtaaaaaaactaaaaatagaggattgttttattgaaatcccacgaaaaaattttctagttgtgtatttggaacaaaagaataggtatttaagattcctactaaaatcctatgtaatggctttatttatggaaatttttaggatttctggacctcgtgagaaactttcgttatatctatatttctccctgaattatatgcttttcctatgaagcatccaaacaataagttctaacaattcatgtgttttagaatatccaaagattcatctaaacatgccatttcgattcctttgtttttctgttactatgtttttcatctactagttcctttggagaatgggaggcatgctcacttatgcaattttgttcaactgtcgttgcaggatcttgctggagcggtgccttagaaaagaaacatgacaaggatctactgagttgtcactgtctcaacccgacaataatagaggtacagtgtcagtacggtagaccgaatttcagttcaacaaagcattacttgttcttaaaaaaaagaaacaaagcattactgctactacctccgtcccaaatccgcggttttgcactttttatattcaatgtttaaccatccgttttattttttaaaaatatgaatggtatttttattattattggatgataaaatatgaatagtacgttatgggtgactgttttttaaaattcgttatcatatttttttaaaataagatggacgattgaactttgacacgggaacccacaactgctcttagggtgtctttagttcacactaaaattgaaaaattggctgaaattggaaacagaaaaaagtcataaatttatgtgtatagaaaagttttgatgtgatggaaaagtttaaagtttgaaaaaaaaagcttgcactaaacacggtgttaaattgggagggaggcaggagtactagtatatatactataactcctcctgtcccattttaaacgtagctatgaattttcgtattcaactttaatcgtccgccttatttattttttaaaaaaaactaaaaaaacataagttacacataaattactatttatttcatcatctaacaacaataaaatattaaccataaaaaattaaaataaaacagaaaattaaaattggatgggaaaacttattgttgtgcttaaaatgggacggtggagtactatgttacagatgtgttggttggctccatcagtgtgttgtcatctcttcacggtttttgtcaattcgtaaaaattattctatttttattctttttcctaatattggctgtattagtatgctcttaggagagtttgcaacaggttcaaaatattcaggttatgacacaagcacccacctaaccatgttctatatctactttgactaaatgccaatgcgtttttttattccatacacatgcctttcactcgcgtgaacggtagtcaaatttgatactagcacacgggtgtgagaattttgttaagaataaatgttttaacgctactgctatctagtatttcctctcacagcgaggtcagttgggtttaaccacttttccgttcaaaaaaaagggtttaaccactttgaaaagtttctgtcaatttgaaagaaatatttttatttttttcctattattggttgtattagcatgctctggtgagggtttgtaatttgggttcaagttttttcggaaccctccaccccctacccccaaaaaagtcatttattttccattttgtgaatttcgctaaatttatttaaatttgattttttttccttcaaattttaaagaatgcattctaaaaatttgatccggtggatttgtgcgtaccgaaatagtatatcatggctatgagaaacaacataatgattgtgtgcactgagaagggaatttcggatgtcatgaaaaagtatatatattctcacgtttttagcaaacgaacctaagtactctctctatttcatattataagtcatttgactttttttagtcaaagttttttagattaattaaatttataaaaaatagcaacatgtacaatatcaaattagtttcattaaatctaacattaaatatattttaatagtatgtttattttattaaaaatattattatattttttacaaactcggtcaaaccaataaaatgtttgactatgaaaaaaattaaacgacttataatatgaaatggatggagtaattcactattttttattcaggttatgacacaagcacccactaaccatgtttgtcttctatatctactttgactaaatgccattacgttttatattccatacacatgcctttcactcgcgtgaacggcagtcaaattcgagcagcacacaggtatgagaattttgctgtgaagaaatgtttcaccagtactattatctatttcctctcacggcgtggtcaatgggtttaaccactttgacagagaaatggcttggactagcttcttggacaagatgtgcttaatcacgaatcttgttttattgcaagccatgtcgcttttgtcctgtcctggaggtgatggaaacgatttttgatccaattatcgcaaggtgacgtcgaattcaggttgccgtcattgctgtgactgaaaaataacaaaacatgtctgatgtccctgcaatcctgcatagacttttcagagaaaaagaacttgcgttaggaaacaaagaggaaattgatgtgtattgtgcttgactgttcttctggaatctgcaccgaaaaaagcagtttaacgctgtatggttggaagcagaagttgagccaacaggcaacagccagccagtgattggatcaatgcagaaatgcagcagtgggcagtataggcacatgcaattggcgtctgctgacagtgtggaatcttctgcttctgcagccagggtctactacttactaatccagagtttgttatactactattaggtttgtgtttatctcagctttgtttatcatttccatgattccatcgtcagggttcagttcattgtggggcagctacctaagctagcagtttcatcagaagatcagcagaagaaaacaagtcacaggctgctacaagccaagaacctgcaggtataaggccattggaagatgtggtcaacacaaggctaacaatattattatcccaattggccactgttttgtagctggttcagtgtcaatgcagccaaaagcatgcttgcaagaaacagcatacggcctccatcttgaaagacacttatctctcaaaaggaattattaatatgtagcatataatatctgcagctgcaagcgtagtgccgatacgtatgctgcttgcattgtcatcttgcagctgtttggcatgtaggtcgatccgtatgctcatattttgtgatatactgatatgtgctgctcatgtgatgcagtggaccactggtacatgctaggtacgtatgtacgtgtattatgtcgtctgtagtacataacatgacagttattcagttaaccatcattatttttaccaggcctaatcgcacggaatagtaccacaagagcagagccagccaccgagtgagagtggtccgacgaccagtaattaatttttggctttgttagttaggctgtgtttagtttcacgttaaaattataagtttaaaaaaattaaaataatgtgatggaaaaattaaaagtttgtgtacgtagaaaagttcgatgtgacgaaaaagctgaaagttcgaagaaaaaaatttaaaatctaaacagggccttagtttcagtagcggtggagtaggtactgcgggctgcatcactagtgttgaacgataatactgtaagtacggagtattattcaatctgcaacaggatgttgttgtgttgctggtagaatcacatcgcccattattgcactgtcagtaatgcgtttcatccacactacagtgaaaacgggaaggaggtgaggtaaaaagatgggacgtgctacgctgaggctccacttctgttacgatctcgtcgaaatgtgataaaagggcgcgtgcgggccggatctagattggacgccgttgcgctgcggcaagccggcaacgggccgtgtgcgtggcctggcctaacaagtgaaagcagtagaatcaggcctgctggtaccagatggatgggctcacatcacattaggcttgctcgcttgtatctacttcctccattcaatcatttcctacatttatattgatgttaataaatatagatatatatatatatataatgttagaatgacttacattataaaacggagggagtacattgcaagcagtagaaattgtgaaattgtgtgcgtttgctgctgtgcaggcgtgcagccgcaacgatctctccctttaaaaagaagggatttgcagaaaagaaaacaagagaatattctatcctttttttcctccaaaacctttaactttctgaccgtttgatcgcttcaataattttgcaaaggaggagacaggagtcgagctccaagtcccagccctagtaggtacaggcatatcgcagtagccaactggccacacgcttagttatgttcgatcacgtaccacttacagtatatataaattatagtgcattcgaactatattaatgtgattacactttagttaaactataattatgtttgaaatttgaaagtttttcataaaaaaattatcgaaagttgcgtagatactccctgcaagaagaagaaaaaagaggggaaaaaaaggcagcctgcgtgccattgtaaagcttggagaccaaaaactggagctgttggatcatgtctcaggccggcccctacccaactttttgtcatcaaccaacttttttccttcctcacaatcaatgaatcaaagccacctgcaatttccctgttaattactccctccattgctcctttatgctcgcccggcgagccgggggatgcttcttttgctaccttgtctgcatgctgttcctggatatcacggcagcaatatatgcacagatgttcttcttccccaacactggcatcccgtccgttcagctaattgttcctcacaaaatgtcttctctgtgtggctgccatcctctgaagattctgattaaacaagtcgttctcgtcatggcaatctctgtacacatgcctacgtctcaaggcagcaacagccaacaacctaacaacagtgctcttcctttacctcctcgatggaccagtgaccaccaacaaacaacttggatcgatccattctgcctagctagattgctagctatagctactagcttttggtccctgcactgcatctgcatgcatgatctatgtcatctgtgtttaatttgaaataacagccatgatcgatctccacgaccataatgtatcggatctaggaggcgcattatcgctgacacaaacaccatatggacatcgatcaattgattaacaaactccccgcctgtctgccggccagtatgccattgcaagtgtagcttggatagtggcttcttctgttcatggttcagttcattcttatttagttttcaagatttgctccggtccataaaaaaatatctcgaggtaccgatacctcacggtactaaattgttcccgatcattggatttagctggacaagatgtgtattgttagatccaacgaacgaaaatgacttagtaccgtgaggtactagtacctcgtggtattttttattgtaccggagcagatcttttgttttcctatttgctgctcagtggtagcacctccagtaagcaccaccgaatctcttttttttcccagtggaaaactaatgcagggtttgacctctagctagccatagctgctgcactcctgtcacaaaaaccaaagttttcccatcgatcttgggccagttgacgacgcatgcagcagggtttatcttatcgtttgggccggggttatcgccactccgcggtagcgcgataaccgtgataatcgtgcgataatcgtctaaaatcgcacaaaaatcacatccaaaaatttgaattcaaaactcgtcggtttcgcggtttcaccacgataatcgcacggtttaccgcgataaccgcgatattcgcattgttatcgcgggctgtgtagctgaaatcatgtaaatgtaaaataaataggataaaaaaaaaatcaaaaatacggttaaatatgtgtagaaaactagaaattgagaataattggaagaatatgtaggatacttaaggcccaatatcctcttattttttcaatttgtaaaccatttttggttttaccctcaaatttgaatttagcttactctatttcaaaaaaattcttcaccattggcaattacaaatcaagaactatatccatgaattttttcagtttttttttatttttttccggaattttgaatttggtcaaaattcatccaaacatatcgccggtttcccctatcgtacccctgtgataagcgcgataaccgtgataatcgcgcgattatcgtgcgataagtgaaaccctggcatgcaggatcagacacaatctcatgtctgcatcgatcgttctcattgttggatcattcatgcggattagtacatgtgtgcttacacaatttacacgcccgatacgatacatgcatcagcgacgagcagcagacaggaagacagcggcaaaaagggagaggtgacttttgctccattcctagtacgttgcacgaagcttcatccccctttgctcgatcgaactagccatctaggcgaaaaatgtcaacttgcaaatcttaacacggcgactacaaagccttctacttcctttaagctcgtattgctgctgctaggatggtccaatgggcacccactccactctagtagccattgctttaatttatcagagcaaattaatggaccctgcatacatcagctgcacacatcctccctcttctatcaagcattttcttatggacaaatatactaatcccatgctcaaatgatgtatttttgggaatgaactagttggttggtgtatgtaactgtaatcgatcttctggttaattaatttcagtttaaagtttctccagggtgaactgaagaggcgtatgtacagcatgcgcagttgctgactggggctgcatgcctcagtcgattgagtccacgtttgtcacgtacgtaatgcgaagtgcaaagcgcaaatggcgcatgcagtggcaaacacacgcatcaggacggcgtgggtgaggtggattcactcagtagctgggacctaatccaaaagaaaacgaggccgatttaatctggacgatatctttgcgctaattcgtcgctgagatcatgcacacgctttgtttaatccagcagcatcgctcgctttctgcacagggaattgtcgaccaaaaggcagcacgggattaaagcgcgcgtacgtacgtgcgcgcgcgtcgcccataaaatccatgcattgcaacctctcgatctctctccatctcgctgtctgcgagcgacgacatggccgctctcgccgtgctgctgctggtggttgcggcggtggagggcggcccggcgtggtcgttctggccgccggcggccggcgacgagccgtactgcctcagctggcgggtgatggtggaggccaacaacgccaagaactggcccaccgtgccgccgccgtgcgtcggctacgtctggagatacatggcgtgggggcagtacgcccgcgacgtggccggcgtcgccgaccagatcgccgcctacgccggccagctcgccgccggcgacgacggcctcgacgcctgggtgttcgacgtcgacgacacgtgcctgtccaacctcttctactaccaggcaaagcaattcgggtacagagattgtgagattgtcatcactgatcactgatcagactagctaacatacgtgtaatctattactccatcctgtttgagttcacaacgttttgacttttgtcagagttaaaatgtttttaactttaattaaatttgtagagaaaagtagtaacattttcaacctaaaaaattttattataaaaatatattcaattattgatttgataaaaactaatttagtattataaatattatatatttgtctataaatttaatcaaacttaaaataatttaattttgaataaagtgaaaacgtcttataagctgaaaccgagggagtaactgttaattactccaattgcttgatgatcgatcgatgtggatgcagggcgtatgatccggtggcgttcaagaagtgggcgagcaaggcgatctgcccgggggtacctggcatggcgcagctgttccagatgctcagaggcagaggattcagagtcttcatcctctccggccgagaccagcagactctcgcctccagcaccgccgccaacctcgccgcggccggcttcgccggctacgaccggctcatcatgaggtagacacaataatatactccctccgtttcaaaatgtttgtcaccgttgactttttagctcatgtttaaccattcatcttattaaaaaaaaattgtgaaatatgtaaaactatatgtgtacatgaaaatatatttaagaatgaatcaaatgatattaaaagaataaataattacttaaatttttttaataaaatgaatgaccaaacacgtgctaaaaaatcaacggtgtctaacattttgaaacggataaagtataaaaacatcatcagaaaacataattgggcctaaattaatacatacccatattgggcctaacttagtagtactggatcgaacggcccaaaagaataaaaaaattaaggcccatgttccatatttggcaaacgggggtaagcgtcagtcaccaatcagccagcctaaaaggggacagacatttccatggtgtgtgtacgtcgcactgtacgagatcgatcgtgccagtttctcgtcctcatggccacgacacatttcgtgcaagatcatgataatggaataagaaaacagggagctggataattagcatatattctcaactgcagacaactagtactagaagatatagctgattgctaatttgctttcgacggcacagtgcgtcaaaggatatttttttgtaagtacatcgaatttgtgtggactgcaatctggagtagctcgcagtttcgatgatttgcacgtacgtgtgccaatctcatcagctgtaggtagcctctcaccgtctgcatgcttaataaattttaaagttgattttaagagttaattttgttagtctattttcagtattgacttttaaaccaaatacataattttagtggtttcgtttattttgagcatgataacttgaacaatcaggatattacgttcaaaattaaatctattatatgcagaagcgcggagtaccggggaatgagcgcggtggtgttcaagtcggcgatgagaatgcagctgatggaggaggggtacaggatacgcggcaatgtgggtgaccagtggagcgatctgcagggtgacttcgtcggcgaccgtgtcttcaaagtgcccaacccaatgtactttgttccatgataatatgatactctaatcgcccatcaaacatgtgttcgcacatacgcacttcgttacacggagtatatatgtaactatttcttttttagacagaaaaaaaaggttgagtaaattacttaacaggtctagcttgtatacgtagctgctgcactatcaatctatcactacttgtgtacgcatgcaagatgcatggcaatagccagacaggaagaagcagagtcatctttcttctctgaaaccactcgcacagaaaccagtgttatctctcgcggaatcctcgatccttctcctagatcatcacacttttcaagtaaacaaacaaccacgtgttgtgttgataaccaaattttacactggagacaagttatagcaagctttaaccaaaatgaaacaatatcagaacttttcagcgaagaccagtctaaccgtcattacgtgaccgatcagatcgaacaatgcactgcgatcagaccgcatgtatccagacgatcagaccttcagcatagagtccgagtctaatttagatacttctcgtgtttccttgttttagatcgagatttcataattgattcatgagcataattggatatgggaaagaccctaaaaacaagtttcgccactcctataaatataaggggaccaagactgattgaaacaacaactaataatcgtcaaatcaatttagtatctaacccaggtatattctatatctctccccttcttgctatctatcccaagtctattattctcaaatcccccaattgtttgtcatatattgtctctacgacgttagatgacatcgtaactaggctgccgagtctagaacaaaccgacgtgtgtttaccctaacaagatccctcccaggtgttcgttcggtgacttctacacacttgctacggcggcgcatctccgggtgccgctgcgggttgcacataacgtgctcaaggtgcagcagcacaattctacgttcgacacagttcgtaaaaaacaataacatagaaacatgctttatctctaccaaggtttacgattccgacaggccctttcgtttcgggcactggcgaaattcggaatttcgcgaaattcggtagaaaaccggtaaattccaaataaatttcataaactaaaatttgaatacaaattccctgagtttgccgacaagttttagcgaaattctgatcaaaatcatcgaaatttcaatcagtaatttgtaatagaggtaatttgctgaaatttttttctttcctgatgtaaatttcagtaaatacacataatacatctttttttcaaaaaaattatatcccaataggttctatgaatatcatagtatttataagatttttttttatcaattcaaatttgaatttgaatgaaactcctcgaaatctcagacggtttctactttcgagcctcgtcgaaacatcgaaatttcgtgaaatccgaccggatttcgttagaatcgtaaaccctattctctactacttttaaaagcagagtcattatcctcctccaaaaccatcacactttctcaagtaaagcaaaataaatgtggctaaaaaacatcggtacaaatccgatgatttctttaccgcggactcgtccttttccaatcctcccgaaccatcatattttctcaaagaaaaagaaaacaacatttctttttttgcattaagaaaaaacaaccatgccttgaaaaaccacctatgcaaaaaccggtgatcgattaaaaaacgatgttcccactcgaaaattgactaaaagaattgggtagaaaaaatcaaagccataaaaccgttcgttttcgtcttaactattgtaattcatgtacatgatgctggttaaaaagtactagaataacgttttcagatgcggtccaatttgtaccaattggggggaaaatcaatatctatcttctgattagatgttctaactaacgaatcaacacacatagcttcactagaacgcaacgcgataagttatttatttttttcagtacgtaattatacttactgtcagtaaatttttcaagttaaaggccacaattatacttacccttcgacatgcggatttacaaatgaagctcccagttagctaatccgccacgtacgaacacactccctatgtaaacacgcccaaaaaaatattgatagcctagcatatatctagttatctataaccagtgatggatccagagaaaatagtggagctaactgaataaactagataaaacataaacctctatttccctagatatatgacaaataattttagaggagcctcagtgggagctcttatgttcctaacatcggtagtggggactcgagatcccttaaacctatggtagatccgctcctgtctataccaactgaagaatatcatctgtaacgattcgagcacatgttacaatgtaacagctatatacgtgacatatcatctataacggatgaagattgggatgctcatccgtaacggccgtctataccactcattacagatgagtgagtccgtaacggttctccgtaacccgttacagatgacctgacacatggttgagaatctgtgtgctagtggtacgtactttccaagtcgacccgaggtgggcccgggcgtgatatttgtctcttccccgcggcgaaacggccggcctcgccgcacgtacgtttactcccagcctcccaaagttggcatttcatcgatcgaactctagctgtacctcctgcctgccctgccctgccctgccctgcactgctcgatcgtacacacagtttcattccatctccaccagctaaaagcaagccagccagccaagctctgtcttccatcttgcatacatcaacgtcagaaaaatcatcagatcgagatatcgacatggtggtggtggtggcggcggccatggcggcggcgagcttgtgctgcggcgtggcggcgtacctctactacgtcctgtggctggcgccggagaggctccgcgcccacctgagaagacaagggatcggcggcccaaccccgtccttcccttacggcaacctcgccgacatgaggagccacgccgccgccgccgccggcggcaaggctaccggagaaggacgacaagaaggcgacatcgtgcacgactaccggcaggccgtcttccccttctacgagaattggagaaaacaatacggtacgcacgtgtatatcgatcaacgatcatatatccctgctagctgctgtttgattggttgcatgctactactgctctgcccatgctgtgtgatcttcgtcttcctgcctctacataaaacagaactcaccctgtttagaacaagaaaagaataataacagaattgctaggtttcttgcgacatttttttttttgaaagaaaacttttgattttggaccgttagaactgctataagattcatgtaggaaagttataatgtgattgtacctttgctatatttgattttttttaaaaaaaaattgcgccagatttttaagatagtttttttaggggaaaaggagatatattactcatatatggcgtcaacacgcgctaaatgcatgatgaaattacaactgtttcctagccaaacatttgacaaggattcacatctagctttatttgctaacaaatgactgatcccattttggctgccatggatcttcattagcttaatctccctgctcccagaaaggagatagttaggtcatgtgtgtgtaaggaagaagaatctgcccggtggtaaaggagtaatcaacggctgtaatcaatcgatttaattactaataatcattagtattaatcatttccaactttcggtaatgaatggatttaaatatatatagtgaagatttggttctttctacaaagtaaatagtggagtactactactatatatgaaaagtttcagagtacgtatactatacgtccgttcattaatagagcaacaaaagcatatgcatgctgataggaaagtttatctatccctcgtttttgcatgctgactgtaaatactgcatatatgtaaagtcaaatttattttttaatctatgcaagtagaatttaaacatgcatttaagtataacgatactactatatctatattattaaatattttcttatgacttactaagtgatatgcaccaaacaaggagccgtctcctttagggtagttgtcgatttcgagcattcatatcaattgaaaaagttattacaaaaattaaaaaaaaacaagtcactcataaagtgttattcatgttttatcatctaataacaacaaaaatattaatcataaaaagaattaaataaaacggacggtcaaacgttgaaaaaaaacccacaactatatttagaatgagacagaggaagtaattgataccagtagtgcaatatagggcatgtttagatcccctagcaaaattttacatcctatcacatcgaatgtttgtacaaatgcattgagtattaaatataaacgaaaaaataactaattgcacagattacgtataaattgcgagacgaatctttaaagcctaattgcgccatgatttgacaacgtggtgctacaatatacatttgctaatgacggattaattaggcttaacaaattcgtctcgcggtttacagacggattatatcatttattttgttattagactacgtttaatactttaaatgcatccatatatccgatgtgacatatcaaaactttatcccatatatctaaacacagccatagcattattgagccgtcagaatcatgggcagtctctgtggtgttttgtactgtgtctgggtttgcttcatttaattgcaccgagttccatcgacgagctagcgatagagagatttgccatggtatgtcattaccacgggaaagttgtgtccttttcaggaatcgtagcttgccagcgttgcacgcacagccagccactgtacgactgtctagatagccggccgattgcacgacgtgatcgatcgaaatatattttcctcgtcgattgatagcgaagttcatgtaactagcaaacagcagcacgatctcagctcacatgaaccagcaaattataaacatgcccccagtttggagcaaattaaacggctccaggcatacgtgcggtgtactcctgttcataaatgacctgcgcgcactgcagctagctagtgcaggtgtgtgactctttgatgtggatttgatccgtcctcccgatccgctagcgtcaatggaggagctacccagctttcatgtcagctagtgtagttttgtcatgttgtgaacattcgtccaagtagactaatggtatattactaccttcatttcatattacaaatcgctttaatttttttctagtctaatttctttttagttctttcagtaaagggaacgaagaatatagcgtgtactttcaatttccaagcacatgtttagataaaagggatagtttgaaagctttgtaaccgactggtgcatcttaattttgctcttggtgttaggcccggtattcacgtattcagtagggaacatggtgttcctgcacgtgagccggccggacatagtccgggagctgagcctgtgcgtgtcgctggacctcggcaagagctcgtacatgaaggccacgcaccagcctctcttcggcgagggcatcctcaagtccaacggcaacgcctgggctcaccagagaaagctcattgcccccgagttcttccccgacaaggtcaaggtcggtgtatcttctcaaggatagtaaaatcactggctcgttaattaatcttccaaacaacatctgcaagcttagtttgcaaatgatcgatcgatctgatgtattttcactaacaaattagtgtctcttaatatgcaaatgtgatcatgtagggtatggtcgatctgatggtggactcggcacaggtcctagtcagttcatgggaagacaggattgacagaagtggcgggaatgcactggacctgatgattgacgatgacatcagggcatactctgctgatgtgatctccaggacatgcttcggtagcagctacgtgaaaggcaagcagatcttcgacatgatcagggagctgcagaagacggtgtccaccaagaagcagaacctgctcgccgagatgaccgggctcagcttcctcttcccgaaggcgagcggccgcgcggcgtggcggctcaacgggcgtgtccgcgccctgatactcgacctcgtcggagagaacggggaggaggacggtggcaacctcctcagcgcgatgctccggagcgccagaggcggcggcggtggcggcggcgaggtcgccgccgcggccgaggacttcgttgtggacaactgcaagaacatctacttcgccgggtacgagagcacggcggtcaccgccgcgtggtgcttgatgctgctcgcgcttcaccctgagtggcaggaccgggtgcgagacgaggtgcaggcggcgtgctgcggcggcggcggacggtcgccggacttcccggcactgcagaagatgaagaacgtacgccgccgacacgcatcaaattgttggcattgaagctcgccgaagctgatatgatcgtgctgtttaatttgcagctgacgatggtgatccaggagacgctgcggctgtacccggcgggcgcggtggtgtcgcggcaggcgctgcgggagctcaccctcggcggcgtgcgcgtgccgaggggcgtcaacatctacgtcccggtctcgacgctgcacctggacgcggagctgtgggggggcggcgcctgcgcggcggaattcgacccggcgcggttcgccgacgcccggccgccgctgcacgcgtacctgccgttcggcgccggcgcgcgcacct

SEQ ID NO: 83445 - DNA, 13980 bp, Oryza sativa
caacaatattttgggaccctaaacagttttaattcaaaaacttttcaactacaaagttgtaggtcacatcgagggctacaattttgatataaagtttgtcttcattagagttcacatgaaaaagttatgaattattttttatataaagtttttagaccgtcatgtttagggaccggggtgacataattgaataagttggaggatctaaacgagtgatctgcaagtttagagaccgggatgacacaatcgaataagtttgaggacctgaacggtcgatttgcgagtttagggaccgggatgacacaacggtacaagtttagagaccggtgatggactttactctatacaataacttttcctggcggaaaagccatcaccccaagccatatgattaaaattgttctttggtggatacgtgaccttgatgatttttttttgaaagttcaaaccttgaaaatcttaaatccgagcacaatcccattttgacaggttgattcataaatcatcaaaattctttacaagtgtgcagaagttttatatcatgcatttcctattgaattctgtgatcgtccgttctcatccatataccatctgtttaatctctctcgagtaatctctacctgaaaaaattaaacatgaagcacatcattaaatgagaaaaatatgctcttctaatgacccatgaattttctagagagacccttaaattatttgaaaaaagatatttaatcagaaaaaaaggataagaaaaaaatatgagcagaggtaaaaaaaggcaacctgttttttccaatcggtcctaagtgtgatgaatagaagcacaagagtctggactagtgttccaagaagcatgccgatccaaataccctgcaaaaagaatgaacataagtgagggacacaacttaaatccagattaactagtgaaattctatcatacaaaaattccttacctttgcttgaaatcctagcacatagcctagtattgcaccaagagggataccaataaagtagtacgatgtaacattaacataggcaactacactctgccaacccgatccgatagcgacacctatagataaattagaaaattagtaatttcattgttaaattttgaattactttgatatacttgtccttcaaatggaataacatacctgagagcactggttgaacactattcaacaaaatagagaaagctagaaggggagcaagatcagcgacttcatctgctactgccttactttcagtaaatatgtatgcaaggcttccacggaagaaaaggaagagcacaaacaacacaaatcctatcaagaaagaagtggtgaccacattgaaaatggcaaacttagctcttcttgcactcccggctccaagttcatttgccacccgcactctaaaaatatacatgcattaagtatatgtcaaatttatggttcatgttgcatcagttagatgaaccacatagtgagtgacagctgagatcgtgaagttaccctattgcagacaaaaatccgatagaaatcatcatctcccaaccattgatattaaggctacaaagtttgcaagtgaaaacaacaatgttcaataagcaaccttttcaattactagaggagaaacacaaaacaatacaatgatatacatgatacaacatgatctggttgttgttttctaaactaatacacaacagattagagtggaatatattaccatatagaaagagcatcaagagcaacctctgcattcttcatataaccagtgaggagcaccaatatggtgttgtaccacaattctaaactgaaaaggtaaaagaaaaatgagaataaattaatgagcttctaattatttgtataaaagaacttgattaacagttagcatctaaaatattaactttctatttgccatcatcaatttttttgtcgaaaatttcatatatacacataaacgtaaccatgttacttaccaaagcatcactccagacgataatgaaagcttcataatagcaccaagatcagtaaaagcagaggatgagaaccctgtccatgttagagggcaaccaccaaagaagacaaaagcgagttggccaaacacagggatccaaaaggagatgaccatggatcccatgaccccagcaagaccaagttggaacttgactgttaggagccatgacaagaagaggtgaatcccaagattgaggaaggcaaggtaagtgacaatcatgttcttgctctgcgcttgtaggtacatttggagcgtgaatgcccatatgtaagagaacattacggggatgtaccatagagagatggtgccagcgacggcagagatctcaggatcttgaccgagagcaatcaggagtggagttgtgaagatatagaccgggagaaggatgactgcacaacagaagagaactagccatgagcgttgtagatagatgcccaacatgtgatattgcttggcgccatatgattgtccacacaacgtttctaatgcgctcgccatgccaagctgcaatttacaacaatgtgcatatacagttaatttgtagtatatactgtttttatatgcatattttatatgcatatcaatagatgacttatagtgcaaattaatatttagtaaaaagaagttttcataggagtgacttgtagtatggtctggttatgttttatttgtatattccgttcaaaaaatctaggtaaagacttttgctattgttgcacagctagtagacagaggtagtacaaactactttaattacagaagaaaaaaatatatatatcagaagatccaacaagaatacacatgaaaaaagacccggcaaaaagaatacatgaggtagatgctatatactccttccgtccctaaatatttaatgccgttgacttttttaaacatgtttgaccattcgtcttgtttaaaaacatttgtgaatattattaaaaaatttgagtagtagtagtatatttaacaatgaatcaaatgagaggaaaataattaataattacttattttttaaaataacataaacggtcaaacatatttaaaaaagtcaacggcgtcaagtatttagagacggagggagtactaattaatgtctggagagaaagccgtgcaagggaaggatggctaggtcaagagtctacttcaaagttttactagtaatttaaaaatccaaggaggcaaggtctcacatgattaattttcttcctgcagtatgtactatatccatttttttttaaaaaaaaatcgagcctatagcttcttagctatagtacaacaatgctggacaagatcgaacactctgttttgaacctataaagacagcaactgaacatccattgtttgtctcaattaatcgatgggcaaattaaagcacaacaaaaaacttccagcgcgcgcggcgctgttagtctctgaatcggcacaattaagtcaaaacttaacgtcatcaaagtcagcttttagaaataaaaaacagctagttgccgaaaacacgaaacaggtaaaaagaaagatcaatttgaattgttacaacgtagtaataataatttaaacccaaaactgtgtaatgataactctgtaataataagtaaaaagggaatcagcggcatgacttaccaggatgccattgctgaagcgcatgaggacggtggagacgagggcgtaggcggcgagctcggtggcgccgatgtgtccgatgaacgcctggctgatgacggtgacgccgaaggaggagaagcgggcgcagatggaaggacccgccaccacccacagcttcttgttctcctccaccactcgccgcctcaccgatccaacctcatcctcctctgcatcatcatcttcctgatgcttgtaggtagccggcttaggctccaacagaggaaccgtcagcttctcatcatcacccggcttctccattttgctaattaattagtggcggcttgtagtttgcagcaatggagatggagtggtggtgtttcagattcagtagcaatggcgctgctggaggaaagggaagcatcaaggatgctcaagtatggagctactgatgatatatataaagggagtcgaatggaagtacaggattgcacctgtggttgctgcatgaagccgtgggttggtaacttggtatggcggagggcagaatcgggaattaacaggacttaattaatcgatgattattaattaatagtgactctagtctagttgatcagatcaatgtatatatccatatacatgttgagaattaattagcaatagtaggtggagtaagaaggaagggtgagattcgatctggggttttgtgtacattgtactatgtggcaatgagggcaagaacgtgtactgtatatagctttgcagcctgtagttgtagactgtaaagacgcgaggtatacatacgcgtacgcggtacggcggcttatgttgcgaatgcggggcgtcgggagatgccacgtagagatgccaggtacccgttcctccagggcaccaccaggcaccagcaggctgcatcgtgattcgtgaagcacaggaggccacgcacggcggaggtaggcggccggagtagtagctggccagccgccgtcagatcagcttcgtcaacaaaatataatggatgcttgtccggcctgcaatcggccactgcatgcctgatgcatgcatcgtgcaggtcagccactggccgccgcaccagtcgaccacgtgccgcagagccgaccacactgagcaggtgtgcgcttgaccagccacgccacccaacggtcgtacccagcaggatgccatgctagagcaggcccaacgaccacgcctactcgacagccgcgcgccctcgacggtgcatcgttgtgtgcaaaccctaactgcgcgttgattgtgccatggccgccttacggtgtaagtggctaccacttattttgacatgtaagtggattcgtgggttaaccacttatatccttagagtcgcccatgtcacgatcaagcagcgccgccgtgctacagagtacagagtgatggaccatgccagcatgtcgggtcaccgaactgccttatagataagtggtcgcatcgccatgtactggccatgccgttgtgagcgtcggccatggaacgaggaaagaaggaaaggaagaagaaagatacaaaagtaatgaaaatggaaaaagggaaaggaatcatgtgatttttgcataatgggcctgagctttctggaacatatgagcacagctccctgtattgagatttttggtgcgcacgtaaaaccttaaatttaggataacaccatttctaaccctctaccgcatagaatcttctaaagtggcccttgtatttttcaaaattcattgcaaatttgtattttagcgtcaaaattaatgattatgtattttgaatttgaatttcgttttgcaattgaggtattttactactgttatttaagattttgaacttctcttatgcccataatatgataaacataagattgtaaactccaaaattttgccaaaaacttaaaatctaatatttcacaaattttgtccaaattttggaagtttttgtcccaggtattttggtcatttggataaattgtacagtactaacggaggttaactgaacgacaatgataaatcgtagaacttgagcaaaagtcgatggcatattgtaaaacgtgataaattcagtggtaaatagggtttacgattccgagatagccttccgtttcgggctctgatggaatgacggttttcgcgaaatccggtggaaagccgatagattccgaacaaatttcataaaccaaaatttgaatgcaaattctctgaatttgccgataaactcgcaaaaaccggtcggctttggcaaaatttcgagcgaaatcatcgaaatttcaatcggtagctagaaaaagaagtaaattgaaagtgttttcctttttttattcgttattttattatttcctactgtatatttcagtaaatacacggaatacatcaattttttcgtaaatttatatcccaataggttctataaatatcatactatttataagattttacttgattttttttccttttttttcaattcaaatttgaatttgaatgaaactcactaaaatctcagacggcttctactttcgagcctcgtcgaaaatcgaccgattttcatcgaaattgtgaaccttggtggtaaatcgtagacccatggtaaacttattggtatataatggattcccgcacaagtcaatgacgatgtgtgtgtcagcaagtctggtactgtacactagctctagttggtggtgctcgcggctcaggaagcggccacgaacaacgtccatccaccgtccaaccatgcacgcacgctactcatggacgttgccaggttcagtagcgctttcatatcagactagatttactatttttgatttgactccaaattattctatcaagctagcaactgcttttgactagcccgcaagaaattacacgggaaaattccctagctaggtactgtttagattccaactttttctttaaacttttaacttttccgtcacattaaacttttctacacacaaactttcaacttttccgtcgcatcgtttcaatttcttcaaactttcaatcttagcgtggaactaaacatagcccaggaaatcgtctccattttctgtcggaattaattcacgcccaggaaacgcattcaagtggatgctttcacctgccattgctttgcttattcacttccctccagcttaattacgagtagcttacagtacagtcatcgctgttactctgaattataaaatatgtaaaactcataatggtcaagcatttgctacaatagtttcgatgacccggtaaaaatggataatttatgaccatatatatataaggttccttcaataacatcacgggtttttccatggtgtgacacttggggaaaaacatcattccaagccatttataggttcattgaaggatgatgtcaccttgaaggatcttaaactctgagggcaatcccattagaacaagctgattcatagatcaccataattcattacaagtgtgcagaagttttagatcatggattttcacccggattctgttgtctcccattctcatccatagaccagcggtttaatctctgtcgagcaatctctacctagaaaaaggaacatgaaacacatcattaaatgagaaaaaaaaatctagagagacccacatgctatgtgggttaagagatttaataaaaaaagataagtaaaattgtgagcaattaacatacctgtttttcccaatcagttctaagagtgataaatagaagcacaatagtctggactagtgtaccaagaagcataccaatccaaatgccctatagaaacaacaaatggaattgagaaacaaaatttaagtcccaaattgactaatgaaattttatcaatcggttcctcacctttacttgaaatcctagcacatagcctagtattacaccaatagggataccgaacaagtaatatgatgtaacattaacataggcaactacactttgccaacccgatccaacagcgacacctatagatgattataaaatattataattccaatgtgcaatttcaaattatattgatatatttgctattcttttaaatggaataccatacctgagagcactggttgaatactattcaacaaattggagaaggctagcaagggagaaagctctgcaactgcatctgctactaccgtactttcagtaaatatgtatacaagccttccacgaaagataaggaagagcacaaacaacataaatcctatcgagaaagaagtggtgaccacattgaaaatggcaaacttagcccttcttgcacttccagctccaagttcatttgccacccgcactctaaaaatgtacatgtataggtatgtcaaatgaaatttatgtgacatgaatgattgatcaaatgaaccacttagcatgtaacaagtaagatcactaagttacccttttgcagacaaaaaccctatagaaatcatcatctcccaaccattgatattaaggctacacatggaaaaacaataacgctaaataagcaagtttttcaactgctaaaggaacaacaaagaacaatacagcaatgtacccacaaacatgatcccataaaaggggcaattgcaaatttaccactactttgaatcgttattgcaaaactgccactagaaaattgcaaaaatgccattagaactgtcattcgagtggcatccttgcaatattgaaaaaaccggtggcaaatttgcaaatgccccatcttttattgtctaaaccattatgcaacaattgaaagtggaatatattaccatattgaaagagcatcaagagcaatctctgcattcttcatataaccagtgaggagaaccaaaattgtgttgtaccacaattccacactgaaaggcaaatgagaaagaaaaaagaataaaccacatgagcaattaattagctctaaacaatatgttggtcaacatttagcatctaacatattgcatatctgaaatttcatatgtatgcataaacacaattgttacttaccaaagcatcactccagaagacagtgaaagcttgacaatagcaccgagttcagtaaaagcagcaaatgagaatcctgtccatgttagagggcaaccaccaaagaagacaaaagcaagctgaccaaatactagaatctagtaggcaatgaccatggagcccatgaccccagcaaggccaaggtagaactggaccgttaaaagccatgatagaaaaaggtgaagcccaagattgagcatggcaagataagtgacaatcatgttcttgctctgtgcttgtaggtacatttggagcgtgaagttcccaacattggatatcataacagggatgtaccacaatgaaatagtgccagccatagcagcgatcttaggatcctggccaagaaaaattaggagtggagtggtgaagaggtatatcgggaggaggaggactgcacaacacaagagaactatccatgaacgttgtagatagatgcccaacatgtggtattgcttggcgccatatgattgcccacacaatgtttccaatgcacttgccatgcctagctgcagtttacaacaatgtgcatttaaggtgagcaatttataatgtgtttttatgcatatatagaagataagattacatctagaaattaattgttagtaaaagtctaaaatataaagaggtcgtcattacttgtagtaaggtatcttttgataccaaagtatgtgattgagagcattgatagggagagaaagcactgcttatggagatagtcagatatgatcaactccaaaaacaattcctggctgcttggcataaggtgcagactaagttaaaggagaagaggaggccattaacttgacaatccaaaattaggcaccactcatgaaacacttgaacaaattttataacaataaggacttgccttaggtaaaactgatttagaacaagtattatgtctacctagtgcctaatttaactatcccaaaagagtcctggtggaaggatgtttgtaaaacaagcatccactttagaggaattcctagatgtatcttacatatgggaattcctgctccttctaggaagatatgtggtctcactagccacctccatgcaatgtatatctaaggctatattcctttgcttctaataaggaggcctctgtcaaagtgtttgtatctactgatatggatgataattttaatctgccatcatctcggaaaacatatgatgagctttctcgatagtcaaacaaactcctaaacttggaattggatcacactgctgataagtggaagtatatatggggaaacatgaactatgcctctcagaaattctactctctgatctttaattacatccgtgtagcctccacattttatttggttatggaagagtaagtgcacttcaaaagttaaagtttttggattgctacttcttatgaatagattgaacacacgatatatgcgagatcataaaaaattgctccaccaaagtatgacctagtatgtgtgttatgcaatcaaggggtcattgaaacaatgcaacatttgtttcacacgtccattttcatcttcatgttgagcttcaattggatttagttggaataccgtgatgggaacttaaattatgatggttaaggctaaaaaccaatatgtgggttacagcttcatcgataaattcttaacttctgtctagtgtatttggaagataagaaataacttcatcttgagcagaaacctcccaccttttcttccgggagacatctgtttaagactgagctcctccttttaatatttggactaaatgaggagataaagatcaataaaaatatattactgtagggcctccctccctgctgtgcttccttaaaaaatatctagatatataaaaacttggcagtctgctattgttccagagctagctaacacagatatcttacgagcttatttgtacttgaagtcatgaagagcacacaagtatataattaatgcataaagacaatgccctgattaagaggggggtggctgaactaagaaagtgatgctttgaattagtcggatggcccctttctaaacaaaaaatacacaggtctcacataatttagtttttacagtacgaattgtgtcttttttaaaaaagaaaatttttttatgtgcctctgaatattttggatcccttccgtgaccttaaatgttgcctcatctctctgacatgtctgatatttttttccccattaatacactttccattactttgaccgttagatttttttttctaacatgactatatgtccacactatccatttctcatagactcgcacttatgtacactttaaaatataaatctcaacgtgaaaaaaaatgcagtaaaaatcaaattgggcagagtttgagagttatttgatggaaaatttggaaaacaaagtttagattagtttaaacacaaaatgtaattaaatagtattaagtgtagtgggtagagaggatagttacaaggatgccgccgctgaagcgcatgaggacggtggagacgagagcgtatccggcgagctcggtggcgccgacgtggccgatgaaggcttggctgatgacggtgacgccgaaggtggagaagcgcgcgcagatggaaggacccgccaccacccacagcttcttgctctccaccaacacccgccgccccaacgacccaacctcctcttcatcttcttcttgcttgttgttgctgccttcgccatgagcatgcttaggctccagcagaggaaccgtcctgcagtcatcatgttcatcacccggcctctccatttctcctagcagcttctgctaactttaattgtgcagcaatggagcgaattaatgggaataattgtacttgagtggcagaggagctatcagaattgatgaagggaagcaggttaggaaggctctcagctaccgttttaaaggagatcgatcaagtagctgagcttgatggctggaacagagagttgagtgaggagttgggtgggtaggtagtgagggcagggtgggaaagtagtagtaacagtgactcgttaatcatcgattcaggaatcagcattccagacaaaaggaaagaagaatatatacgcgagtgtgaaatggaatctggggctgtgtgtgtagtgtaaatggctcaatgcgtgtggcaaggagggaaaagcacgtctagtactgctgcagcctgcaatttgatgaaaaagatcagtagcatatatacacgtacagaacagagataggattgtgctacgtacgtcagggcggggcttgcatgcggcataggcagcggcagcggctacacatatacacatcatgtcaccggccggtctgttcacggcagctatagttgccggacgtacgtgtggctgaccggcatccccgcttggcgctcctcaactcgtcgtggtcaccaaaaccaaaagtagacttcctcgtaagtccaacgatccagggccggtcctaacatttgaaaagtcataggcgaacttaacattatgggcgccctaaggagttaagatttttttttacttctaatatatatactctataaagcacatatatcagcacaaatatcatagagtaacacaaataaatatttttaacatggtaaataataaatcaagcagtttgcaagttgtaatagagcaatttattctcaataaataatattgatagtataatttacaactaaaagaaacaccgtacaaacaaattagtatgaatttcttaacacccgaaatagtgaaattgcaaagtaaattgatagaggcatagcagaatagagcgagtcgttgattgacttataggtttgtgatcatgatataccttcagcatgaagaaaagaggagcgaatgggcgatggccgatgacgatcacagcctcacaggatgagacggccgggcagggcagggagcagccaccaggcagcgtcgcaacgatgccgccttggtggcttggctgatgggcgacgggccgacgtacggtgagtcggcgcctagaggcactcgcagcggcgtctcgcggactagggcatgggcaagacggcgacgaagcgaagcgacccggtcacgtggctcggcctaggcgtctggcctgcggctgggcctgttgaggggagggggggtggtaagtgatgggcccccctccggcctgggaacgatgccagccaatatgcaactgggaattcatgttgagaaaaaggagatctcgctgcaaggacggcgcggcgttccatcattacatgctatgcatggcgtcctcttgttctgatcaggatcagttaggttgttaatgccctacagttcaggtaatacccacacaagaattgggtttgaaagtaacactagaaaagaaaagaaaagaaaagaacaaaataaggggaaggccggccgggggattaaataagaattgattttttttctttttcccttttacatgcgcaatgctgcgtgcgtgtcacaccgccctttgtacgtattttggttatcaaatctgcattctttttgttgtaggacttggtgatttaattaaattttgaatatgcatgcatggagctctaatgtataggtctcacaataatctctatagaaaatcccttgtatacccctgcaattttagctaatcctttttatgcctctgaatttttgcttactttcttgtatgcacccaaaatttgatttcgatccttgaccgtataatttctataaaatgacaattttgcccttttgatgaacatagaaatttatgaattacattattgaaaatgtaaaagtttgtcatatgagactattatagttatgagtttgttgtgcgatacattatttatgacaaaaattatttttagataatgaaacaaaaaatatgtatttattttattttttaaaaagtcataaaaaaataggagcatccatataaagataggactacaaattctcacgatagatttttatgaatgctcccgatgaaaaaaaatccattgtcctattgaaatttcaaataaaaaatttaatttattaaatttgttttattttcaaattttatgtcaaaatttcttgcactaattatttttgtttcattagtttcataaaatgcacatattgtgcactcgaacaaagcttatattcaaacctaaatcttcaagggcataaaagacatttgcaatcaaacttaatagtgaaatgaaggaaaatataatgggaagggcatggaagaaatcaaattaaaatttcaggggtatagaagggatcagataaatttcaaggatgtgaaagggattgagtgagtttttaagggtatacagggaatttactctaatctctatggagtgtcacatgccatcttctttcgtcaaccaaccaatcgtcctaccgaattggctcatcatgtgtcacccctcccgttccttgtcaaatt

SEQ ID NO: 83446 - DNA, 3853 bp, Oryza sativa
ctctgaacaaaatggaaacagcaagttggtagcactggcaccacaatacagtaactgatattggaagcagatttcatcaagaaagagagaagcttaaaacttttgcagttctgacttttcctagatgcatgcatgacattgcacgaaactgacacaagaaagaagaggccatggaccatggagcatgcatgcagagcatacacggctggcaaatgacgttgccagctgatgaatgccaccctagctagcaatgctatgctgactcatcattcaggtcaagagagagagagagagagattaattagagttaattaatcagtagtcctacctggcaacgcctctgtacttggagacacccctggagaaaccgctgctccggcggcggagggaggccaggtactcctccctcgacacaccctccatctccgacctctccttctcatattcctccagctgcaataattcgcattatcttcagtaataattcagattacacaagtcgcaattgtctagtggtaagttggcaaacttactgggaaattgagcactgtctcaggaccccagtacttaagagctgcaaggtcatatgcacgagcagctgcctcttcactatcataagcccctaaacatcattaaacattgcactaatgttcagaaacagaccaaacaccaaaacattaagtagttatgtaacaactagttgctatatgcctatattcttagggataaactgttttcatattgagacaaaccaaggatgtgacagatcaaacaaaggaaatctaagattatacaagaacaggaagcaacatgcagcatgaatctgacaaaacaggtgtgtatagacaactagcttgtgggacttacccaaatagactaatgagaggagcatcaagcagcagcagatcaaggtcacatgcgcatcacaagggcaaggtcccccaaagataacagcaaaaaagaaaggagataaaaaaagcttaatcagaatgtcagccttaaaaaattcgctccactttatagtaataagctttgtactaatggccgatgtatcaagatccttggcagtatacagaagtacaccaaggaccttgtatgtttccctttttctttcattatagtacattatactgtaaaaatactcgtatttaactttctttagtattttcagagaaaattcaggttaaaaatccttaaaaaaaatcaggcaactaatgcatgttgcgatcaatgtaccttgcctccctttcttcttgttctgaagtgaagtggagcaattcttgtcccacagatgggcctcaaatctgccagtccaccgatgcctgtttatacatacagatacatgcatgcaacaaatgattccaccgtatattgaatttattgatgattgataaataagcagcattaagcattagtgtttgctttacaggaggaagaaaaactgaaggagttgaccaccccagcagtaaatgtagaccaaccaactccctacttcccagctaataataattgactcactccaaggggaggagcagcaagaaaaaaagattaaaaatgggaattatgagatcaagaaatggatccgatcgatcatgctcgccaacctccaaaagatgaggcatgaaaaggggagcagactcaccacccagaaaacgataaaaataattcatgatctctgacatgcaagtgaaatgttcagaaacagattggaaagaagcggctgataatttcgggagcctgaaatgatggaaacgatgcggaattttgggctgaaaatcagccattgattagctagcggcaatgcaggatgaattcgcgactgaaatcaagaggggatcagaaagaacagcagaactgggatcagagggatggaagcaactgaccatgcagagacgcatacctggtgactcccctgtagatagaactcctcttgccgccgccgccgccgccaccgccattggaagaaggatcaaccacctccttgctctccttcttgggcctcttggccttgccggtgctcttgtccgtcctcggcctcgccctcctcttgcagggcatcgacatgggcgaagaggaatcctcggaggaagaggaggaaggagacgacggcgaggatgatgcagatggagaagatgatgcgggatcaggagacgatctcttcgccatgatctctcgcgttggtgcaggtgcaggtgaggtgacgaggaggaggagaggcaacgaagtggagccccggaggttttgtaatttatagcggaggggggaacgaaagtaagtgcagtgcagagatgggttttttgggttgctaatcaccatcatcagcattaactgaagatgacacctctgttttttttgtatttttgtgcgtcagggcctcaagctggccaccatacgactctacgagaataggagtcaattttgatacacttattcattattcttttattttatttcagagatttcctctgtttttaatatattattattattgatataagtgtgcattgcattgtgcacaagtagtggtcgtattcagatttctttttctttctttatttttgcagatttcggtacacgtgcagacgctcatatacacacgtgtatactcaccttctataaatacatacgctatctctatgaacacctttaaagattaggcaaggagattgtcgtttctgaattgacataatttacatgggaagtacaccgataataatatcttgagatttgcgaagatacagaccaaatttacatagcatggcagatgacgcactggcaaattaactcaagatgacaccttgttttttgtatttttgcgcgtcagggctctgctggacaccgaagattagcaatcaattttgctgcacttattttaatttgtttctttttgagagatttcctctgttttaattatattattaatgagtatgaaaggtacaaacctgagatagtttctggaaggacacaatttccacggagactacaccgagtcactggcaatatttgcgatgttgaactgccatttgcccaagctacacttcatttttacatagcagggtacactaggaagtaaacaagctcataaatgactgcaaattaaacgttactggagatgatttttttttgtctatattgaaccgtaagtcttactgcaagagctttcacctctgattcagatcagtgacagacttgcagtgagttaattctacagaaagaggacaaagcaacttaaactaaaaatggacggacggacggacgccgctgggtcagggtccttagactgaagaaacaaacgaaggtgcatagcatagcagctacacaaggagacgaatagcatcgggacgtgaaaaagaaacaacacatgtaacatgtaacactgaaaaatcaaagacattagtgccatgtgtccaaatggcagagctctgcagccatgcaaaatatgcaattcctcattcagaggaaagcatcctactagccatgcaaccacaacacctgtccccaacattcagagcaacctactgtgtctgtgtgcagtcagtcaattactgtacacaacaagcatctactgtagctccgatgcaacgaccccctttcgatgaagaatcatcaaacaaacagtgcatccttcaattagaaaattcagcaattactcatgctgtattactggagtactacagatcatgtgaaacatgtgtgttgtgttgtaccgtggatgacggtttgatggctgaccgtgatgacctcaatatttgagtaaattagtcatcccaattaagctcccatgcctgactgccaaattatttgttttgtagtagatcatactcaccaaaatggtttatcacgagtctgtttt

SEQ ID NO: 83447 - DNA, 3531 bp, Oryza sativa
  unsure (1)..(3531): unsure at all n locations
cgcggatganattctgctcggtacccaaataaaataaaatgttaaaaataggcaagacccaaggtaagtctcctggaaaaaaatggggtcctcccctcttatctccctcctactcctctctctcactcagcgagtacagagagagattgccaccgccactccactacaagtgtactcctccgtccaaaaaaaaactaaacctagaaggggatgtgacattttctagtacaacgaatctggacaaagggctatccaaattcattatattaggagatgtcacatccttgcctagattgtgtttttttgggacagagggagtacacaagaaggggagtataggggagggcctccatggatcatctccgagtggtacatggccctccgttttatgctactgctaggagcatgcctcctagggtgtaacctccgccacttggaagccaaccccagctcgccaaccgtcaccagaggcatgccatcgaaccatgctgccagttggaatagagagggccaaggagggttggctcagtccggaggaagagtcactcaagttcgacggggtgatggcaagcgtggtgctcgagctcgagcgagatgttgccaaggacttaaaggctcggggagctgaggcaccttgtcatgatgtcgatggtgcaactcgacagaaggagtagcgcggggacagagcaactgcttggaggtggccatcaagtcaagggagtatagtatggtgtccagttcccactagcaccgttgtcaccctctcctccatcacatccaaagatgtcgttgttgtcctggttaaccaccgttcgagacttcgagctcaactaccaaaccgaacctcatcacttccctatctttgagaagatgccaccaccacacaggctgccttcacagtttggcgagggaaccgagagaaaaaagagtgggaagggaggagagatgtagtcacttacatgtggaccctatatttattttgttaatttctttgatcaacgaaaagccaccatagttgagggagtcttgcatcagctttaatagtggaagggatcgccaattttttcgggttttacggttatgtgatacaaatcaaatcagatttgcccaataattgagcgagtaaaaacgaactttttcctactttttgcatcacgcctgatgatgcgtttgtgatattgtgggcctcaaccaggtgcaagcactcccgtcctgagtccatcgacgcatataattttggcccggaactccaattccatcacatacaatatcggcccagtatgtttgtgggcttccggcccaaatcgccttgggctgtagcctgcgggtactcaggtctctgggggagtcaagggtttaacccgtcctgcgacgcggagcaccggccgccgctcgccgacgcaagacaacgacgatgccgagcttccctccgcccggcgccgtcaccatctgcgagatcaaccgcgacctaggtgtgctatctccactccctgctccccctctctctgctgtctccaagctcattccaagtctgtgcgttgcagttgcggcggatgcggtgtccgacgatcgagccaaggatgcctacggggatgtcctcgtcagtacactcccatcttccccattcttcctccgcctcgcataatttcgtctttcttttttcattcacaacactaattttattaggcctctaattgaaacttcaatttggggtttccagggaatggtcttcagcccgattcctttccagccggatgcgattgttgcccacccacgagcctcctgctgccactgaagctgctgagcctgctgagattgtccccagaacaagtttagcttccaccatagctgagtccttcaaacaaatgatcttcccttcatgcgatgtgagttgggtcttcatcatatcttactggctccatgtctccattgcttgtgttcatggttatattgcttttctgtcatacattgacccattctttttgttcacccaaaatctacccacaagcatatttttgtgtggaaagtgctcaggatagattttgtaaaaactgtacttacgacaaaccttttgtttttgcagccaaatctgctacaagaaattgatacccagaaagtaagttggaatccgcacaagcattgcttggcatttgtatctgggaagaaccaagttacagttcatgactttgaggagccaggtgagatctgctgaactttcttatgttgtattaataagatagatatgatgaactgaagcatgatggctatatgaacatttatccttgtatttaatgaactgaagtatgtttctcaactcagctaaagccaacaactaatcatttgtattctctgaacagataataaagaatcctacattctaacaagtgaccatcaaaaggatgttaaagctgttgaatggaggccaaatagtggaaagatgattgcagttgggtgcaagtatgtcctactgccaccatatactagagcactattaaagatttgttttgatattcttttcatgtcataatacctggtggcacaatctactattaggttaacttattattattattattattattattattattattattattattattattattattttcaggggagggatatgcctctggtcagcatcatatcctcgcaacgttgcatctgtgaaatctggtgtcacctcttcttcctttggtgcctttcctaaaggttctggtggtcaatggatactcgtggacattctccgtggttcttctgctgagctagttagcgcactttgttggaaacctgatggaagatatcctttataagttttcagtgtagcatttaatcattggtatcattgatttccatctctgttatttgaaaaataaagaaatgtaacctaaaccaaataatatgtcttcatttgcaaacacaaaaattaccagtgactctagacaattttccttgacacatatctccacatacttggtgtccgcctcttgtaatagcccatcattcacaatttgggacgtttctcaaggtatataaatgtcatcagaatgcagatacctagttccatcttacacagaactgcatactaatatctgtggattttcttccatttcagggttgggaatgcctataagacgtggattaagtagtatatcattagtgcagtggtcacctagtggagattaccttttaactgctaagctgtatgaacttcaactttagttattttcattactcatagcatttgaggatttatatagtttactttttttaattagtgatggaacttttcacttatgggaaacaaatacatggacgtcagaaccatggtcttcatctaatggatatgtatctgtaagtagtattcattcttaaataagtactgttcaacatttaacattgttatttaccatgtcacaaggaatggattcttaataagtcatgaaatgaaagggcaaatgctttgcatgttatgggcgattgggttgtgttttancgggacgaagcgcanatgcattcaaagccgcg

SEQ ID NO: 83448 - DNA, 8183 bp, Oryza sativa
ccgcctccgcttgtcgcaaccgcggcctctgccggtcgccccgccgcgggcccgccaccgcccgccccgttgctcattgaagcccgtcccgcacgcccatcgccgcagcatcagaggcaagtccatgaggaggaggaaggtttatgtatgagtggggaaaatggggtggaagaggaggaagaaggttatagagactgacatatgggtcctatttgttataaacttgtaatggagagggtagatagagaggctgttgaagcgagcaacgactttgacttgctaaatcaaatgggtagctggctatatgtatatttgaagagtctattttagagaggctgttggaaatgctctaaggcggacccagcctccgggccacggccatttggtggacggctgcatgggactgggagtcgcggctatactctccgctagggataaaaacagtcacggaaattatcgactaatagtgctacccaaacaaatcatacgtatgactcaaatcatgagacaagtcaccttgttccgattacatctatgtggactcatgtctttcatagcttagttatagtcgtacagtaggtcattatgctcgtattagttatataattaatttctattttttttagcgtgatgtttcatcgaataagttaaactagtaaatattagtctattagtagccgatggagaatagttttttaaaaaagattctaccgttttcatcccacttaccgcgtgcgtaactcgtgttcgacgtgccgcatgctaaaccatatgccaaaattttcttgctcaaatttgtttcaaagaattttctagctcaaactgatcgaagcaatttgttggccgactgcacgagcgaactcaaactgctctgctcttgggccgactcactccatccagcgtcctcatcaatgtctgcatctgtccgccgactaaggtctctctctctctcgtccgtttcctgacagcaacataaccgtacaattattgcgaggaatcagacggcgggggacgcaacgacgcaaggcagtttcgggaagaaaaaacccccgcagcccaccgaatgcaacgtaggagttcgctccagtacaaacctgtatggtttctgcatctctggaggcattccattggaaggccagccaagcttcagtgtttccatggaccacggctcatcgttccggtgtgatgtgccatcgacccttctgttgctgacagatagtctgacttcagttgcctggtaaatttaacagtaattgcaactgcctaaaagaagaggttaacagtaattacaggttcgcagggaacaccggtggttactgacagtgaaatgtacgttcctcggatgtatatttaactgacaattcatcaacggcggcgagcttgattatcgggactgacaatgttgatcaatgatcacagtatcagaatcgaacatgctggaaacgtgatattcgcatccaaatcgcgatacttctcatctatgaacgattgatgaaatgagagcagcatcgtaatctccacagtgagcattcatttgctgtccgaggtgctcgaggacaaagcattggcaagttgtgttcatcatgctttaacagttagccatgcattgtggttcagcggagagacttctcaaattattgttgtggggttaggttaggagcaggaatcctctgctcataagaaaagatcaacaaaacaaccaaatcatatggggccggtgagaagtgatgtatgaagaaaatcacaaacaaatgaagagaagatataacatacttaaatttttctcaccaacatgcaagattccggggagccctggtatagaatatacgagcaagcttaattttataataacagatgttgctatcaacttcaactacaatactttgccctttattcaagcagtaatacaaatatcacagatcaaataaaacttttactgctatgcgcttcttttcatttagatcataactagcctagacacccgcacacctgagaagaaaaactaatatcactacatgcctattttttattttcctccaaggaaaattgattccaccaattacctaaaactaaatgtaaatcataggtccttgcttgagtgactttggaggaaaaaaacaaacctagtacgttgcagatcatagcaactccaaacgaacaacttgattacttgttccgattctcctcctcttctacttaccttttccccctctcctcctcttctatttaccttttttccccatccagacgaacaacttgactacttgttcagattctcctcctcttctatttaccttttccctctaaacttgtccgggttcatcacatctactgattatatttgaatagttcatcaaggtaaacgaagtttagaactacagaaatgcatgaatctgggcctcatgtgtccgggttcatcacatctactgattatatttgaatagttcatcaaggtaaacgaagtttagaactacagaaatgcatgaatctgggcctcatgtgtccgggttcatcacatctactgattatatttgaatagttcatcaaggtaaacgaagttttgaactacagaaatgcatgaatctgggcctcatgtgtcttgttctgtagcagctgcatcctctagtatgcgtctagtactctagttcagcatcatgttaaattgtatatttgtgtagctgtatgcatagttctgcatcctctagtatgcgtctagtactctagttcagtatcctgttaattgtatatttgtgtagctgttgtatgcatagttcagcatcctggtaattgtatatttgtgtagctgtatgcatgtaccaatacataaaagtctaccacttaagcccgtttgatatatgcaaaacctgtgattttttacttcaacttgaaaaagtagagagtgaaaggagaattttgcagaggacaaaactctcaattacatctgggccacagcctatgtttgctagtgcactctctcactaaagcgtgttatgaaataaaaagcattagcttttagaaaatgagtgatgctacccacctagcaagctttctaatgatatcttctcggctacagatcaaaggtgcgatgtatttaatcatagtgcagatcaaaggaggttagctcgagatattacttggaattcaattttcagcacaaagaagtggactgagacctacaaaactgaaccctgtctgcttgcaacttagtcagctgaacaaattttgatcgattttttttttataatatgcatctttttgcgtcatgataaatgaaaaatgtcagtattacagttctccatgagcaaaaacagtaacatccagaaacaaactcaacatttttttcaaataaatcctcatttgaagatagcatcgatattaatattaacaatacatgaggaatgaaaatgaataacaagaggaacaaaagctgcagaaatacataaacgattggaagtcgactcaaattgcaaaaaacttgcccttgtcaaagttttttagcacgttggctgctgctgctgcttcggttgctcaccctgccaagcccagactatgtccttcaaagctggtctcatctcttggttcaagaccttacggtattcaagtgtatcaccatttgtcttctttagctccacaagatgaaagtttggggtaacctcgaatatctctgcatcaatgcccataacacctttccttccaggcttggagccttccatcttcaacagtccaccatctttctttgtgagcttcaaccgcaagcccttggcaatatcctcaatcttagatatgattgttgaagctgtactggtggatgtgaatttggactctttcttatcagactcctcaaacataccagagaggtcaagtccagttgacaaagaaattatatcaaaagcattcaagttggacggcttcttctccaatgttggagcgctattgaaggagtcaaaatctgtgctcatatcaacaggaattgcatcctttggttgtagattatatctgagcagctttgcatcgagacccttcctaaaccaaggattttccatgattttgtccattgagatccttgtacttgggttaggatcaagtatcctgagcaagagccttcgaacatcggtattaaaccaacttggacatttgaattctgctttcccaatcttcttatacatatccatcaagttcttatcatggaaaggtagatagccggccaatagcacaaagagtatcactccacaagaccatatgtcagccttagcaccgtcatagcctcttctgttgatcacttctggagcaacataagcaggtgtgccacaggttgtgtggagcagcccatcctgtcttttgcaatcagcaagagcacttaggccaaaatctgaaaccttcagattgctgttctcatcaagaagaagattttctggcttcaaatcacggtgataaacacccctgctgtggcaaaagtcaacagcgcaaatcagttgttggaagtacttccttgctgcatcttcctttagtcttcctctctgaactttgttgaacaactctccacctttgacgtgctccagcacaaaatatatcttagtcttggtagccatgacctcatataactgcacaatgtttggatgcctcaccaacttcatcacagaaatctcacgtttgatctgatccatgagcccgcctttcaaaaccttctctttatcaatcatcttgatagcaacactctcagaagtctcggtgttacgggcatggtaaaccttggcaaaggttccttgcccgagtaatttccccatctcatactttttcatcaacatatttcctctctgctccgccatcacgccaaagaaagcagtaatcccaaagctcaaagtgtggtaaccaggagcctagaaatgataggtgacttcaaccgtctccaccaagatggtgatctaagaagatggttgagttgccacgtcgaaccccatagtgcgagagcacatggagcaagcgctgtatatactcttgtgttccaatgtcatgaagagttgtggaaggagaaatatggcttgctaccctgccaattccctcacaaggtagctctctagcatgcaagcacatctttctgcattccctaaggtgtttccttcttattggaagtctagtaattctgccaaaagaagaagatgcaataaggtcagtcatggacaactactagttggaatcaactaacataaaactcaattgagaagttctaggtaaaaggattaatctactgcacagcacatatgcatgaaaacaagacatgccagttaagactgtttctacgcttttcaaccagaacttgttttaaaagaaagtaacaggaaacacaatacagttacacagttttctgtactacataaagctaccctgaattaaaaggttggatccgaaagcttcgctcaacaaccaggctagcagataacaagaggctaattataattcccacgctatgcatctccagtagaaaggagattatttttttctttttttacccttccaagtatgtatgacagattaagttttcgcatgaatcgcatcaaccacaacacctcgcgttgcagaacaaatacagatctagaaacgagcactcaaccagtgtactggagactcgacctgagaatctgaaacccacccctcgctaacccaagatgatgtttttcacatacagacgaatcaacaaaccatagatccatatagattatcaacaaccagagataaggagaaccgtaccagatcccgacgtctgacgacgcgaagaacacccaacgccgccgccgccgccggtagaccgaaattctcacgacaggagactcaccctcgccgcagtcgcgagaaggagtgagaagaaggaagagcggtggtagtggaattggcttcgccttggtgcgtgcggagatcgagatcgagatcgagatctgttcgagcacggcgcagcaattcgttcaggcgtcaaagacggctcctttttatagccaagcccaagtgccgtaggatattcgcttccgtttcttctttttttcttttttttttcactgcgaagcgaaacctcctggagcgcccgcctgccgttggtgcggcgggtaaaaaaggccggtttactgtccctgattagtggggcccaccaataattggtgggctgccttggctggctttgcctacgtcgcgtaggggcaatttgtttgctgttttcttctgtttgttccagcttccagggccgtccgttttgctactagtggaatgatgatgataggcggcataggccgacatggagatctgtgtgccaccaaaccaaaactaccttctccaatctcccttgctctgatttctctccatggttccaggtatatttgcccaacagatttaactggagcaaaattataagtccacttagtgattctgagcttacacaccattacagaggatgattatgtatgttactctctttgtttcgagatacttgtcactattgaatatcactatttcaatttttggtcgcttaataatttaaatggtttagactacgatgaacgaaagattactacttatatttcaggcgtaatacaccttcattttgataatatggtaagtatagattttctcttaaaaacggcggacgatcaaagttgaaatgtaaatagtgcctgctaataaatatttacgaacagagacgaaaatcaattacagtgtacatgtcaaactgaaaactttggaattgtacacagtatagtagtactctctccgtttcgaaatgtttgacaccgttgattttttagcacatgtttaaccgttcgtcttattcaaaaacttttgtgaaatatgtaaaattatatgtcttcataaaaatatatttaacaatgaatcaaatgatagaaaaagaattaataattacttaaattttttaaataagacgaatgatcaaatatatgctaaaaagtcaactgcgataaatattttaaaacagaggaagtattatataagaacagttatacagatacaacattgatattatcgcttagcttagctccttcttggctcacgtcaggatcaaccgcaaaataagcgtaaggagagaaatgtgatttggtctaccggttagtcttaggcatgtgctggttagctagatctttgccgatgccagtgaagtgtgtggaaaccaagaggaagtaaccaaaacacggcaggtttcgcccgctgtaaacactccacgtagtcaagtagaagctagcacgtcatggtcggcgacaattaaacagtagaaaatgtagtaaacgttttggtttaattttctctactaatactttgttttcttctactccctccgttttaaaatatttgacaccgttgactttttaagtatgtatttgaccattcgtcttattcaaaaaatttaagtaattatttattatttttatatatttgatttattgttaaatatattttaatgtacacatatagttttacatatttcacaaactttttaataaaacgaacggttaaacatgtgttaaaaagttaacggtgtcaaacattttaaaatggagggagtatatacgagtccagaaagtaaaatctgctactactagctagttgatcagtttgtccatctctttgtcagctgagaaactagtaactaatactggcaatttttgacaaaactgcacagtgacaatgctataaaacgtatacatatatagcacgtgcatacaacattttgtatggcaacttttatagtatcctcacccacaataataatacactttattttagtatcaataatagtaccattcttaattagccatatattataacaatattatctaatatatatgaacattgataaaatatcaaatcgcaccacctggccggccgggccagctagattaattaattaggttgcttctgatagccagtttttgatcaatttcctcttaggatgaagaaatccaattaaccagacatgtcaggtcactggtcgagaaacatctttggtcggtccaccaaattccacaatagtctcggttctattaaaaaccggttagtaacaccaaccggttaaaaaaatttgatctttagtcccggttagtaacaccaaccggttaccaaccatctttagtcccggttcaaaaagtcaccgggtcgaattcaggccctaattatctttagtcccg

SEQ ID NO: 83449 - DNA, 550 bp, Oryza sativa
ttgctaataagaattcaggttatgcattggactgttgttaagctgaggtaattgttcgttgatgatattgaagactttgaaccgtatgacaaaataccctttctgatcaatcaaccaagtgcatgtatgttacggttgcaacgagccaataattaccgagagacgattctatcagaaatgcagatgtgcataaaatttgcatctgaacaatccactcaaccataaacgaaaactttagattcagttgtagtatcgatcatgtggtctatacccctaaattttaaatcttaatatgcacaacaaaaaagacaggagaagcctacagcaatttacatggatgaagctggctctatgcacagcgcacagcctagagtggagtttcagtgatcaactgttcaaaattacatgatgttctctctgtttctcatggaaaattggcatgacgtggattagcggcaaaacagggtgttcatcaggaaatcctcaagagagaccaaccttgtagttctcagatccagcagatgattttaatcctcagaagatcagattt

SEQ ID NO: 83450 - DNA, 868 bp, Oryza sativa
acatccactatccttggcaatgggtggttgcttcatgtgaacatatatgtggactgtgggcctgtggcttgctagtgccaaattggttgttgaagaagggccgttgacccctagtcaatgacagtgaattgtactcccctgcctgtcctgcaggtgctataaattctgaacctcaagaactagaccaaagcaacaaagcgaggtgcagtttcagtgagggaggaaaaaaagagtgagaagaaagtcgagatcatgtccctttggaaggtgctcctgatggtaatcgcgctcatctgcgccctgcatactacttcaggtaaacgagttaataagttttttttactattgtaaatttataattaatgtctactaccttagttataaaataaatttagaatatcttaaattgatgtctaaaatataatttattctgagacggatatagtataatctctattattagagaatagagagaatagactgaggaatttaattgtataatttgatgcagggagacctcccgtcgtgggatatcctgctcctcgtcccaacggtagctcgggcacacgatgctacgaaggctgcaaccctccaggtagagatggcaacagggatccataacagagaccctctgctaccctccaggtagagatggcaacagagatccataaccagagactctataggtttttattttattaggagtcatatatgatctaattcttgtatctatggatttatcaacagaaaaaaaatccttacatgttggatagatgggtattagttctttagccactcgtaccccttacctatgggtaaaaaatacctatatgcttagcgtgatagtttacttactttgaacgttcat

SEQ ID NO: 83451 - DNA, 19172 bp, Oryza sativa
aagctacgatgttggctgccgaaattgagcagacaaaggcaagcattgcaaccgctgaggtgaggtgtcttgcagccaagaagatggaagatgcagcaagagcagcagaagctcttgcacttgctgagatcaaggccctacttagcggtgaagcttcagctggagatctccagggtactgatggagtgaacttgtccttggaaaagtattttgagcttgcttcaaaagctcaagagtgtgacgtcagctcgaggaagaagattgaagcggcaatgttgcaggtggaagaagccaaccgatcaaaatccaactcgctcaacaagctggaggaagctaaattggaatttgagaaatgcaaaattgcactgcaggatgctctgaagagggcacacgctgccaatcgggggaagctcgcagtggaagagtctgttcgtagatggctatctgagagtggctacaagaggcactcatttcatgattcttccaagttaaaaaatgcagcagatatcactgacgtttcaaagagcttcttgaagccaacactgtcaattgggcagatattgaatctgaagctaatgggacctgatgggtatgacaaaagcgtttgggatgatacaactgaagcttcaaatgtttcacttggtcagatcctgaaccggaggaatgctgttttctgtaacagtgatataacttctcagaagatattgtcaggaaaaaggaagaaatttgccttcacagggctttcagttttgttggcaaaacaagccaagaggcaagagcaagagaaatagaggatcagattagagcctatctgcccaaggtttacctaagcctgaaacagtaggtgatgaatgttgtgaccactatttccatgttcatgtatgttagttggttctggccctgcgtcctctgaatctgttattgccctctcacacatgatttctctaggatgactggttgcggattaggaacgtaaaactgacggtattgcagtcctttctataaatttgcaactatgcttaacatgagtgaggccacaagatgagctgttagtactttcccatgcttgattttaaccgttcatattgtgtgcaattattaatccctaataattactataagtctaaactttaacttatttattacccaccaaatataggtattgctaattattcttgctcatgattgttacctacaagtgtccgtagaaacgtgcgaagttacacatagttggaaccacaaagttttatcacgtactgcgtgcttttgaagtatagcgaaatgcatttcttgtggcccttaatagtacttgtgttcagaattaatagatataaagacttgaagtcgagcaaaaatcataccgtcgatatgtccgagtggttaaggagacagacttgaaatctgttgggctacgcccgcgcaggttcgaaccctgctgtcgacgcatgattttttgtccctcaactagctaatttaactcggtcttcagacgtgacaattcgatccgaaaaaacaataaaacccgtggatccgaaaaaacaataaaacctgtggaacccacatgtcagtctcacacagaaaataataaaaaaatggtgggcctcacatgttagtccaacttacccctcctcttgttgctgctcactcccccatctcccctcttttcatctctctctcctctcctctcctcagacgacggagaggcagcggcacgcggtggcagtgcggtcggacagtggggcctatgcggaggagctcggacgagcgacgacggcgccggtgcagcggggcgcggctgagcggcggctcgacgcgagcgtggccgtgcggcggcgccggccccggcgcgggtacagcgcgggtcgcggcctcaacggtgcgcaagggcaacggtgccgatgcggaggagctcggcctagcgacggcggcgccgatgcggtggggcgcggttggaaagaacaacacggaatcaatcgacaccaaatttttatcgtatttcttttatgctgtttttccttctctacgttttgctcctcccgatctactgcaggcagctgtcatcgtcatcgtcgtctctccggccggctggtggtgacgctgcctcgaagcagctgctggctgctgcgtagatgcacacgcagcagcgttgctgcatgagttagacgcagcagcaggtgaatttttgtgttgctttcctgggataaattttggtggcaacattttcttcttctttcctcggttctcttcttcttcctatggcgccggtcgccgtggagtggcgctcgcggctgctcgggcggcgcggctcctccggccatgcgccccaccgcatcggcgctgtcgtcgctcggccgagctcctccgcatcggcaccactgcccttccgcacccccgagggcgcgacccgcgctgtgcccgcgccggggccggcgccgccgcacggccacgctcgcgcggagcatccactcagtcgcgccccgccgcatcggcgccgctgtcactcggccgagctcctccgcataggcaccgttgtccggccacatcgccgctgcctctccgtcgcctgatgacagaggagaggagaggagagagagatgaagagaggggagatgggggagagaggatgaaaaagaggggtgagttggactgacatgtggggcccatgtgtgtcccaccatttttttattattttctgtgtgagactgacatgtgggtcctatgggttttattattttttctggatcgaattgccacgtaagcgccacgtcagtgccacgtcagatgaagactaagtcaaattagccacgtaggcgccacgtcagccaaaaccgccctcaaaatatcgagggacctaatctgcaccggttttaatagttgagggacccgttgtgtgtggttttccggatgagggacggaaatcggattcgttgacaagttaagggacctcagatgaacttattccttttttttatatcatttttaccgaatttactgggtcttgtgttgccaaatggaaaccttttttccttaatgggctgggccttgtgttgacatatgggccatttttctcctaaatagactgggcccagtggacatataggccctttttcctaatggactgggtcttgtgttgactaatgggcccttttcgtgatacaccgggccttgtgtggacatagggccgtttcagcaactcgttacttactatcctctatcggttctctattgcaaaaatttcttcttgcttgctgctttgttcatgcaacacccatgtccccgaattcgccctactgcagaagcttggattggagccaatttttccctgccaatattttggcactaccaaatttaatacagcactagcgtaaaatttgactagtgagagaaaaatgggtagcaaaccaaacacccatgtagctccgatccaaaaaagccataaacatgatgacgtgcccttttcatactacagtagcaagaacaaatgaacaattccacggcgtaaaccatttactgtctgtctgtccgtagggttatgattcccaaattacgtgcttgggttgggttagaccaagcatcgctgcctgcaagcagcagcttttcttcaaggctgaactgctggaatcagatcagaagttttccgagttcacgtgcaatccaatgcgtctgaaggtgaatcacgttgtttgcgtggatggaaaaaatatgttgctccgccttatcgtagacggacgtgctgtctgtccaggttcaatacacttgcctataaagtataaactccattctctcatgtgcaattcgaaataaactagtgatagtagtactgaataaacaagtcgtcgacactgcagcattatagtactgtactacatttctgaaccggaaacggctggtatactcgattgtaggaaccaaatcgaccaatacattccatgctctcaaatgggatggatatatcaaccttcgtctttctgctcgagcagttgaaccgaacgcgagccaccaccggttcttgagaaatatcaggcctgaacatcgacccaagtccccgacatgaatacatgattgatgattgagtatgggtcactttactgaagatacgcaatgcggtggctgtttacagttcagctccggccagcttatcaatgatggcagagcaaatttctattactttctccgttttatattataagattttctagtattacccacattaatatatatgttaataaatctagatatatatattaacatttatataaatagataatactaaatagtcttataatctgaaacggaataggtacattacatatatgccgtttcaagaagtatatgaaagcaaagcccgtaccatgccatattgccatacacctagacgaacagtccatcaccatggttaatcaaggagcacgcatcagcgaaaagcagcacacgtatgatatgggtggtgcgcattagcgtcaagtatgatgaggatggagcatcaatgaaagcatcggcatgatgtaacgccacggagacatatgcgacgtggacgtgtcgagagtagcacgaacgcagacgctgttcctgattggatatttctttttattagtgtactagaactactatcttgccaatacttgaaaactataataaactccaaataattgcgatgatgttgaaaaatatagtactaataaactccaaattataattgcgatgatgcactagtaacatcacttacacgtggggtcgtacgttctccattattggagctggaagaattctctgggcagctgcaaacgtaaccaaactctctttgggctggtggtggtgggatcagaactcacgtacaacactgctggcccaataagcaaagatgccacatgcacgggatttttccggtggatgcccaagcatattccgagcagaaactgccggcttgcggcaaccagaaactctccggatccagccaggaaaacgaaggaattttactacttcgtccgaaattatagacggacaaatcccatactggaaggagtacgacacgctaagctcgtagcgagaaatctgcgggcaatcgagccgtggaatcgtggttttgccgtgtgcgcggcgcgccgcaccgtacgcgcatgcgtacgtggtccaggaaccaggagagcggtcgcccacacgtacggcgctcacatggatcgagccgcgcgtacgggggaacagcgactagcctccctccctcccacccacggcgcggcggcacacggcccatccgcatccgcgttcgcgctacgttgtcgtacacgaatcatcgtgtggttgggacttgcttgggcgcggttgggtcacgtttcaggcttcaaacagttgagtttgagagatacggtacgagaagattttttttttcacttattcctttttcacgaacacacaaaaggtttacacgttaatatattagaagaaaaagagtttttattaaataatgcaatcaatcagactggcttatgccaatgaaagagagaaaaagaaaaacaaaaaccgaagccaggaaaagattactaccgcggttaaacgcaactcctaatagcgggaaggggcagagccacgctacactcccaacaaattcccaaaagcggcaacgccagctagaggccacatattaccctccgaaaggatggactacagcaccgagatcgaagagagcgcggagttgaaaaccctagagtttcattccttccatagctaccaagagaacaggagaaccagggagtcaaaattggcgtagagatgctcaggcaagcaggccctggaggaagaccaccagtcctggagctagctgccacgggagggggagagagcaattcagccaggagtgataacacatggagccagacttgccgagtgaacacacaatcgagaaggatgtggttcgccgtctcaagctcctgatcgcaaaaggggcaggccaagtggccatcgatgccacacttctggaggaggttgccgtccagtagcgctactgaaatgcaaaaaaaaaagaacatgtatttagcaggaccctttgcatgtcagaggagatcaacacatgcaaaaaagtgttggccatagaagaacgcctggtacaccgaacgcaccgagtagcgctggtcactcatccaacgccacacaagacgatccccgatgcccgacaagagctgtatgtgaagcaccacatcccaaataagaagaaactaggagatgacatggacagtgagggcgccgcggatgtcagaaacccaggaattgttcgccaaacaggccaaaagcaactgtgcgtgagcctcaaaggcgttggggcacgccgaagaggagatctcgaaccaaggaggccaccgagcggtcgtcgatccattgttcaaaccaaaaagagtattgactcgccatctcccggcatgaagaaggtggacgcctcgaacatgtcgaaaatggtctgctcggctggggccttcaggccatcccagtagggatgctctgaacgctgaagccagagccaacgaatacacaggggcacagggcaaaccctgccatcctaagatcatgaattcccaaaccactaaaagctttgggacgacagtcattcgtccagaacactcggcactgcccccatgagccgagtccatacccgtccacaagaaggcgcgacgcttcttatcaatggccttaataacctggactggaaggcaggatcaccatagacacatggactgaattggaggagagaaccgactggaccagcatagagcaaccaaccagagtggtgagtcgtcccttctatggtggaagtcgatggaagactttatccacaaacggttgcagggcccgtctttggcaacttgcgaacggacagcggaatgctgaggtaggtgcaaggaaaataaaaaatcgagcaaggaaagcaaggctgaaccagttccaggtccttagccgagcaacagatcggagtaaccaagcatttggcaaagttggtgcgtagcccggacgctgcactaaagacggaaaggatgctctggatgaactcaagattaaggcattgatgcggtacaagattaacatgtacttagtagtgatagactgatgagtaggtacttttttttaatgtaaatttaataactcttagtatctagatactatgagatactaaatttaatactaaattttggttcctcataatatcttcccaagaattgtaaaattactctagactgctagcctcacatagtagcaggctgcaagaaataggccacaccgaacgggacttcacggttgtactgcatctgtgactgtgacgatggcgaggcttaatttcgtggatctcgaaccttcttaatcttgttttctcgcatgacaaacaaacgaaaacaggtggagctactgaatcattagccttttgttaccaaaacagaaaaaaaaaactgaatcattagcctttttctatggtggcgagacacgtacggccggcccgtgcgacgtgccaagggctaaactgtggccgtgacgcggtgcacggtagaaaaaaaaattgcaccgtagtaggagtaacaattatcaccaaacaatattagcaagtacgctttgcgaatgcctttgttggtatgatcacgacgtcgcgacgttgataacatagagtaaggggccatgacgtatttcgatttgacataaacgacaatacaaaattgttttcaacttttttagtgaaacagacagctgattccaccctctaattgggtgtcattttccagcgggcggcggtcgatctgctagatttgatcaatcgtggattcatcagtgaattcgtggaaaaactggggtaatttgtgaggtcaaaagagagctaaacggtacagtaatatctcaggaaaccaccaggaaagatcgatgacgttgatgcttcatagatagggtaattaattagcagctgtatattgggaggactttggtcctttttggctgcatgcttggaagaagaagaagaaacaacgtgtacaatgcgcaaaaacagtgacagttaaattgttggtccattatttatttatttcctggacatatggacttggtacagttccttaactcggacaaaacacatggaaattccaagccgccgaaatacactggagagtttagttgatactagatcgaacatgatgtttttcttctcgatcggcggctactaattattttctcaaagaaatgttcgtagtacatacgaagtagactatagagtacgttttactagttagagtacttggaagagaaggtgcaagacgtgcacagtacgtgtagggaggatgaagcaacagtccaaaccgccagggcgacggtagcacgccatatacttgtttttttgagagaagaactatgtatatatgagtacttgtccatgttgccagcaacgtatcagttgtggaccacaattatcatttgataagcttgttcaattctcattacaacagctggaaccttacatgatcaaacaaagcagccagctactgtacgctcctctgtttgaccgaaatcaccatctgaagctggaaatctgcatttgccaatgccataagcttgcattcccaattcgtcgagcttgccggccggtttcatgcatctgccaattgctcatccacgcaattgccgaatgcatgtgacactctgcccggcttgagcaaatatcggggagagaattaaacactctagctactagattgggccaaaagacgtttttagtgtgaactattttctggttccgctttgcacaaccaaatcaccttgtcatggtcatccctgtttcgttttcagagactccgacccattgagagacgaacaagtacactccatacccttcatgatagtttcacaacacccattgtacagctagagaccgataaagatcactagctagtacaatgaatctagatagaagatactttctaatacaacgaatctgaacatatacagattaattatttttaagataaaagaagtgagtagaacttcggtagaaacaaggtactcgtgttcatataataatataaacgatcacgtttttactgtctttcgtaaaagaaaagaaaaggaaaacagaagaggcattgaaaaggaaagggtggatttgtgctgcatgctgttttcccgtggtgaaaatggaaccgtgcaacaggtgggaatcctccgcgtcgttggacgcatacgtacgtgatgctcccctttgcgtccgtctgctccacgagttgtatctctatcgatcctctctttctcgagttgtgcgatgcagatatcggacggatggatatatctgtgacggtacgcgactgtagatctatatatatctagattttcgctttgagatgtttgtgtcacttgtgtgacgtatacgggcttcgaaacgttttaaactcgactatacgaaaggacttcgatctttatggtgctggaaagtatttttgccagcaatgcaaagacgccttgcttaaatgtttgttttaaaattgcacttgttccaactggagcttaaatgttcgcttaagtgaaacaaacattgctgttctacatcaataacaccttccaaatggtactatttcgggcatcaatttattcctactcgatcagtgctacccaaccagtccactacaataatttatttaagtgtttttcttttcaaaagaacaatttaattagaggcgtttttttcctaaaaaaagaacaattcataatcgtttcttctctgcaccaaacacgcacgacagcacacatgattttaattttaatttgaaaatcagaacagtacacataatcataagacgtaactatacagctagtggtaccactccatctaagagagatactatccacttatactttaaatgcaattttctcttaaaatactcatccgatatacgatccgattgcaccgttgtgttcgtaacaattaattctttataacaagatcttacatgattatattttgatgaaaaattataaattacttttatcatatatctaaattacttcttagacatataaaaataaattcaataaagcctaaaagtaatttacatatattatagaagtaacttataataaaaagaaagtaactctaatgaatgccttttttcattggacgtgaagtcatatttttatccctacaacgaatttacttctaatgtcgtgacaaagttacttctgttttgtttttaagttacttttataatatatgtgcattacttttagactttattgaatttacttttatatgtctaagaagtaatttagttaaatctaaaagtaacttatatacatgataaaagtaacttatatatataataaaagtaatttataaatataaatatttttttatcataatataatcatgtaagatcttgttatgaaaatttaattgtaacaaacacaatggcgtaattggattgtagatcggataaataatttgagagaaaactttgtttgaagaggaaaaatacatgcatgtctattaaaaaaatgcatgcatgtagtacgagtacgatgtagtagactccacgtcttctccatatttaggcgtcgctggttaaggcaaaaacgggaggcctctctaaatagattttatgataatcatataatagcaacgcaatcacaccgtatacgaacaccactaaacataatccctccgtcccataatatagcaacgggtactaggttgctatattatgggagagagtaataaacattgataagtacgtgttgtgatgacgtgaactttctcggttgctaccattgccaatgtgccgtcgggcccacccggcagtgtcaccgagagagtcccgtctcctcccgcagcgaccaaccgcgagacggataaataccgccacgcgctcgcacccaaatcttctccaactcaaaacgagcccccaaatcccagagaggagtcgcgagcttttcatcaatcctctgattttcccccaggtttccccacccgcaaagagcctcaaaattccccctcctctgtcgcgaccgatcgcgacgacggcgccggacgagcagacaccggcgccacgatgccgccctccaccggctccgtcccacccgccgcatcaacgccggcggctggggacgaggccaccgccgccgggagggtactcctcggcaggtacgagctcggcggcctcctcggccgcggcgcctccgccaaggtgtacctcgcccgcgacctcctcaccggccgcgacgtcgccatcaagtccttccccaacccccgccacggcggcggcctccgcggcggcgaggaggatgtcctcctccgccccgcgcccatcgagcgggaggcggccattctccccaggctgcgccaccgccacgtgatgcgcctccgcgagattctggccacgcgcaagaaggtccacttcgtcctcgacctcgccgccggcggcgagctcttctccctgctcgacgcgtccggccgcatgacggaggacctcgcgcggcactacttccggcagctcatctccgccgtccggtactgccactcccgtggcgtgtaccaccgcgacatcaagccggagaacctcctcctcgacgacgcgggcgacctcaaggtggccgacttcggcctcggcgccgtcgccgacggggccctccaccacaccctttgcggcaccccggcctacgtggcgccggagatcctgtcgaggaaggggtacaacccagcgaaggtggacatctggtcctgcggcgtcgtcctcttcgtgctcgccgcggggtacctccccttcaacgacgccagcctcgtcaacatgtaccgcaagatctacgccggcaagttccggtgcccggcctggttctcgccggagctccggtgcctggtccgccgcatcctggaccccaacccggcgacccgcattgacacggaggagatcatcacccacccgtggttccgccaggacgcgagccacttcgcgatggcgcagctgatgcagcacggccacgacgaggaggccaaattcaagaccgagttcaaggaggacgacatggcccgggacatgacggcgttcgacatactcgcatgctcccctggctccgacctctccggcctcttcggcgccgagccggggaaggagcgggtgttcgtcggcgagccggcggcggcggtgctatcccgagtggaggaggccgggaagaaggaagggtacatggtaacgagagaagggaagaagggcaccgggccggtgtacgtgaaaggcgagaacggcggcattgtggccaaggtctgcgtgttcaagatcgccgacgcggtgtccgtcgtcgaggtggtgaaaggctacggcgccgaggccgcccggttctggaaggccaggctcgagccggcgatgaagcctccggcagccatctgagctgccgacgagagggtgagctggttcgttgccgcgtgcttgcaaattgcaatcgagatttgttcttgtgttgttcagtgtaaccgtgtgagtgatgtctcccgtcggcgaattgtttgggtttttttgggatgtatttgttcatggacggcgtcatggaggtggtatgtaagcacgatttggtgatgtctgggctggaaaataagaggcaaaaaattccctgctatgatgagcggacaagaatacaagatactgaagttcgtcgactcgtcggcgtcagatgacacaggatggacgaaaatcttgcctctcttgtggacgagagctgccgttcgacttttcctccctcgatcgattgcccgataaaacagtcgaccagttcttagtttacacagcttctcatggaacgatgccaattggttcgctgaaaattgttggaagccagagtcagctatgcaagtggcgttaaaaaaaaaacagagtcagctatacaagttgctgctggtgcgaacccgtcgcggatgggcagagagagaggctggcactgcgcttttgtggcggttctcgctatcatcgtgtcgtgcgtacctcgaacgcgtcatcggaacaccgttcagaggctactgtctactccctccatctataaaaaaaaaaaaagacaaaccgtggttttcgtgtctaacgtttgaccgtccgtcttatttaaaaaatttatgaaaaaaaattaaaaagacaagtcatgcataaaatattaattatgttttattatctaacaacaataaaaatacaaattataaaaaaattttatataagacggacagttgaagttggacacgaaaatctaggatttacctttttttcttggactgaggaagtactaggcgccacttgcaaaagggaacattatcccctacctaacgttgttctttctccaggcttcagcagccatccgttcgtttgggctcctttagaacgtataagaaattaagaaaaaaaaatggaaaaatagaaaaaaaaacacagtaattaaatgtcatgctatatgaaatctgacataaactcaaaataaagacatttgtcaaattagtcgtttggatacttcacaggaagaagaaaaggcattagagtagtcttagacttctcaaaaggaattcaaactatgaggtttgagatcatgtttaaaattgttcatagtaggagctgggggatgataagagggccggcgagtcgatgtgtgcattatcgggtagcttcgagatctgatctgatatgatatctccatggatgatgatactagcacggggtgacctggactgtagcgataggccacacctactgtttggccgtgctctaggcgctgatcaccagagtacatgttggtacagttgccatgtgacctggtcgttggattggccctgcgtgagagcagtataataggggctataaaaagatttataaaaagattgaatgctgaggtagatgaaagaagagagaaaagatgaaaaacgagctataaacctaacacagatttagacatagaaaaaaaatatataagacaaacaagtaaagagctaaccactatatttgcatgcaagagactgcatgcagccatgaacctgaccaccgcccggcccggtcccgttggccccatgccccggcgcaaccggacgccgacgcttttcctgcgctttattgcggtggtccgccgccaccctcgccgtcggcctcagctcccggaggcgttgccgtgcacgggttcgtgtgacggcgatcgcctggcggcatgacaagttcaaaatgtaatgtacatgccgatccaagttcagataactgtaaaaggacgccaatcggtttcaattcgcaagcgcgtaaaagttcagtgtccagtcggattgatggcgagaataataatgcgtggtgttctaatttcctctctgatggcgaagcctgtggccgagataacctcttcgaagaggtgtagttatccagcagggccttatttatggccaagtgataaattctacgtacatttctatgaatggatgtcagttcacgattgtactatcaattgaaatccgacgtctcactaatcctgaaatgtaacaaccaataatgttagtaaggaggatcacggtgataaaagaagtgctccaaatcattctcacatcaaaatggtacaaagcgatcaactggaatcgtcaaaacttgtggatgtcacaaaactactgatcaacgaaatggcacacttagctactgatgaatagtgagcgaatacaacgctagagtagatgccacgaattttcacaggctccttgtttcaagccaatactcctatagtctgtcatcaacacatctccacgttgttacctgggttgatgccgtcagagggagcttcatgatggtgcagagttggagctcggctgcttgggactgtagtaccacagagggcggaaggtggagggacgagacgaacggacgagccggcgtccccgacccttcatttcatgttatataatgtctgtagcatcaaatatattatcacatgagaaaaatctgatatggcaagagagttaacgaggggagaggtaaaaagatgaagaaaaaatttcttatgcaagaaaccatttctacacaagaattaagaatgaaaacaagaggataggtagataaaaaaaaaagataaaggagatgattagatgataatttaatttgaagacaccatccattggattcgtagtttctatgcatggtgtctatataacatggtaaatatgaaaaatactttatagtttctgggttggggatggcctaagagagaggggaggaagtaaggctagacccaaaaaaaaagcgctcgtcggtagctagcttactcagctcgtggctagtttcggacatgtttggcggagtttaaaattctgaaaaattgcttgctggtatccagattctgagaatatgaaaaaatgcttctagtttatttttagattctacaactataatttctcagaatctggcttaaaaaactgactgtttgggggatcttttgaatttggagaatctacagctaccaaagcttctcaaacaggcccttagttcaaactcgttttgatttgttaatgacttgagctaaggttctagttcgttaggtgtaatgaggtagctcctgacctgcttgcaagcaaaaagagccaaggcaagcaacaggttaacaaacacaacattctaacaaagaaattaaaacacatctctaaccctaggattccaatcctagtacatactatctccgtttcgaaatgtttaacgccgttgactttttagtacatgtttgaccgttcgtcttattcaaaaaatttaagtagttattaattcttttcctatcatttgattcattgttaaatatatttttatgtaggcatataattttacatatttcacaaaagtttttgaataagacgaacggtcaaacatgtgctaaaaagtcaacggtgtcaaatattttgaaacggagggagcatgttatcttcacctatgacatgtggctttctcgagtctcagactcatccttccgtccacttatcgtcttgcgttgctttgttcgatcatagaactgtatatttaaattgattatatggaagttttggttgattgtatagaagtatggaaataatgatacttttattaattcgtatattagtttgctacttagactgtatgcaaatatttgtatacttaagttgatgttgttctgaatgtgttggttcgtgagcttaacaagccagcctaagcaggcaaacaatccgatccgagttagtttttagctcgataggataacaagccaagctaacttgttatcttaaaatgagccaagtcaaagcaggctctatgtacagccctaaggacaagggatgagcggatggttgaccgattttagctacgacgcacatactaagtttggctagctagataaccagccggttatagtttcactttttgttatgtactgtaggtaaaatttggtatggctagtcatatagctggcctgttagagatactatgcatttggtctagataatctctactgcgagtaattattcagcaagctttcgatgtagatcataggacccttttgaatcgtatgaatgaaaaaaatagagaaatagaaaaaatatataggatttttataggaatacaagtgtaaatagagaattgcaaaatacaggaaaaaaaacatcaatgaccatttgattggaccacaggttgaacctcttgctaacttttcttcaaaatctatatagtattactcatttcatagggatttcaaatgataggatagatccaattctttgtttcaaaggctttcataagaatttctttcgtagaattaaaatccttcaaatttcctccgtttttcttacaatacaaagggcccgtaaaggtcagttcgcagttatcagcctgaaagctgacgcctcactaatcctgaattctgtcgaatcggataaagaacaatcccaataatgttcatggggatcacaaaggcaaaagtgctcggaatcactcgcacatcagaatacagtaataacgcgaccaactgcaatcaccaaaacttgtggctgcaaacaaaactagtgaccaatagatcgaactgcaaacttcgctaccgatgagtacttaacttaacgagtactacaacgctaggagctgatctatcgatgccacgaactttcacgggccccttgattcaagaaagcactcctataattgtagcaatcgtactacgatatattgtcgtataaccattagtccttatcaaatctctgccacctcacctctcataataggagcaaacgacgaaccatgaaaacgttgctcgcatgcctccaattattggtgctccacatgctctgaactggttaaaataacagcacatcggttcacggaagcgatgctgctgacgagcccggggattctctttaggtggtgttaggatctggcgatttaattttagtccatgtatttagatactaatttagagtattaaatatagactacttacaaaatatattacataaataaaagctaattcgtgagacaaatttttcaaacctaattaatacataattagagaatgtttactgtagcatcacataggctaattatggattaattaggcttaatagattcgtctcgtaaattagtccaagattatggatgggttttattaatagtctacgtttaatatttataattaatatccaaacatccgatgtgatagggacttaaaagttttagtcccatctaaacaaggtcttaatttggatagatgcacactaacactttactgatctggacagtacgtgtgcattattcagttatatactctacatattttgagggtttggagaacttgtggccatgtgacgaagtgtgtgacacggggagatgtaactcgtcagctaccatggctaatgagtggccaatatttttatccaaagagagaataaattgaagttccttgttttttcctcactagctttgctggtgtaggggtaggagtattaaccaaacttgtgggttgtctgtacatgacttgatgtatttgattagggttgattaggcacaacgatggtgatggacatttgggtgtgaaccgtcgactgcctgaaaatgcgctaagccggcataatcatagcgaaagaaatgctagactgttgacgtcgctattggcaatatgtagacaaggccttttagtccataaattaacccattttgcttgtggaattcaagctctaattcttttggttttttggctagtaaatggtggcacatactattctgaccgggtacgacgtgacaacagccaattagcctaacctttaaacgcttttgtgttccgacaatgcggtatgcaggctgtcaggtctcaaagtcgtatggtggttcgtgagtccccatctttgttcccagaagcaagataggtaatgctgcatattttcaaaataagagataggtaacagtacgtattttgaaaagttggcaaacaaatttgcagcagtagaaaattagcatgggaaaacgagatcaactgtcaagagtgacgaatacgaattcaaattgatactccctccggttttataattctcgatattttagacaatggtcttcaaaatatagggtctgttcactttgatattattttcaactatacctttttttttaagttgctaaaattttggttacgtttagtttgttaacaaattttagtaagtgcatatgaaatcttgccaaaatttgacaaccttgccaaaattttgacaatattaccaaaatttggtaatgccaaaatttggtaaggttgaaaatggtagcaaagtgaacaagcccatatatttaaccttaattttctattttaatatatacagtaaataaatgcatgtttacatttattatagtacgttgaaagataaatatatatatatatatatggtgttatagttaaacaaaataattataaaattattgatagtgaagttataaaaagtttgaccacaaccttatccaaaatgtaaagaatgtaaccggagggagtacaacttctagttttcactccatggtatactaaggcgaatacgagttctaaagagaagtcagggaagctggctactctatcgctctccattagcatatttctcaaactcctaaacgttatatcaataaactctctcagttgtatgtagactgtttttttacatatgacagattgtatgtaagatgactaga

SEQ ID NO: 83452 - DNA, 614 bp, Oryza sativa
ggcatgtagctagctagggtttcaacaatgaaggccatccaagactatcttgctcgctccaactccaagtccaaggtccctcctcctctccgcccctacacattctgaattctcgcgcctccctgtattcattctagttcgatacagctagtagaaaattcatcagctttgctcaattgctcaataagattataagaaaatttatgtttctccttccttttagactaggcgtaatatacatatatgatcagtcccttaactcttgaaaccgggtaaaaacatgtacctccaacctgtttaacaggggttttacccaaactggagatgggacctgcttgatcatcgtttgtcgtgtgggcccaccatttatcctcaatgacaagtggacctcacctcctatgctgctcaaaaccatgtcaaacggggacaagatttatcctgttttgagagtgtgagctatgagttgtatctagtttttcaattaagggatgactagaaaaaatgcccgtgcgttgcaacgggaaaagactattttaatcttattattattatatgttttaagtcaggtgaaattcactgtagaaattcgcttgaatatatgtattttacaaaaa

SEQ ID NO: 83453 - DNA, 515 bp, Oryza sativa
cggttgtcagccattttgtagtcatgaaactgctccatgatatacagatcattgctagcatcagtagcaccgaatttagtattcagtgcatcccacaactccttagcgtcggtcatatgcatatacacctcgaccagacgatcggccaagaacgctaagaatgcatcccacaaagagagtagtggtttcctcgaattgcttctgctgttcagcagtaagaactccttcaggtttgccagtactcacctagaagcatttcatagctgtcagccacagagtgaccctgatctgccatctcttaaaatgcacaccggtgaatttatccggcctcagtgcatcggcaaaaccagccatagtaaaatcacagtgcctatgataaggtttttggattgttgagattatagacatataatgatttaatctattccataaataaatcatgacattacagatgaaaactagcacgaacgcatcattagatctacacatgtaactacacagtagggctgcaggaa

SEQ ID NO: 83454 - DNA, 616 bp, Oryza sativa
tttctaaggattaaataatgcttgtgctcatttttagttggttaaaattatttctagggctctgaaaattccactaaaaatcttgttagcatatttcgacatgtagaactcaagaaaaattccacatgccaatcccgattattatttgcattaatttattagggtttctctcttgcttttacaccgatatttcctctaggtaatttataaattcaattttggcttgggaaagaacttcagggtgtgacaccgagttccttacgacaatccgtcttgaccatccaaccggggctaaatatggaggagtaccctccccaggaaattaacttaggactatatacacacgcggaggaatacccgtactgagctgtcaccatcaacggcctacctcgcttccgtagcatataaccctaaataaagatatccagtaatctaaacaccacgcataaatcaccaaatactactctaatatcatcatcatgatatagagtcatcgtaaatatgattagtatgcccacaccattgcatctcccagataagctatcatcataatgaatataacatggatatataataaagttggtattcatactcggaaagtagttctataccaaag

SEQ ID NO: 83455 - DNA, 576 bp, Oryza sativa
ttttcataccacgactagcagtactaattttaattattattcatcacctgttaatactattagtcatgctactccacatatccctaatgcttacaatgatcctaatagaggatattctcatgacaccgggtatggccaatatattatattgcgccgcaacaaccacctcttaggccaccaaatacaccaccaaatctatataggcctaaaaatatggaggagttaattagtatcattattaggaacatatttgggattgaaacgaaggatcgtgctagggagtaccaaaagtcgtatcctgatttttatgacatgatcccacatcctcgtggttatagaattcctgaatttaccaagtttagtggtgaggatagtaggaccacataggagcatgtagatcaattcttagcgcaatgtggtgagactagtaatatggatacatgtaaattgtgcttgtttcctttatctttgtctggtactgcttttacatggtttacttctttaccagcaaattctatttttacctaggctcaattagaataaaaatttcatgattatttttgcactgggtaccga

SEQ ID NO: 83456 - DNA, 1297 bp, Oryza sativa
aaaaatatttgtaactgtaatcagcccgcttttactttcttatgaattatatcatttttaactggaataatgtgttaattttctgaacgttcaacgctgctcgcaagcatttccccaaagccccccttgccgatcaattacattttatatttgttgaaacttccacacaaatttcgtgagctataacatcgtaaaaagtttgaaaaggaagtctaatcaacctctttgttaagaggacattaccatgtaactctgcagcggaaaaaaaaaactagatatatccatgagctccattgcaggagggcaagcagataatgaagtacatgaggaatataccttaggagttatcatcaactcctcatataatggatccatgagctccattgcaggagggcaagcagataatgaagtacatgaggaatataccttaggagttatcatctgctcctcatataatggattttgacattttacttaggagtcgtattgtttgaccacttctcttatttaaaaaaatatggaaaaaaaataaaaagttgtgcttaaagtactctggataataaagtaagttataaataaaataaataataattttaaaaaattttaaataagacgagtgcttaaacagtgcaagtaatcttttatattagagacggagggagtactatcaataacgtgtgctaaaaaagaaaaggtagcggaagcatatactccaccaaataggctgctcgtattggcacctcatcaaatacaaaatacagagcataaaaccgggggaaaaatagtaagaccgtaacaaattccaagttctacagttattttaattttcaaaacttatactgtaattccaagttgcaggtcacaagctgagcaaaatattgtgaccgagttgctggaaggagtacgcgcctaccctagcagattctgatacctttgataggatataaaccggcttattagaaaaataaattgcgggcaaaacttttatacatgtgtacttagcgatttaaaaaccaataataaaaaataaactgcaataacaaactctaatataccaactctaaaattaaatatttaaattcaaaatttgatagctgcttataagctgaaagacaaacgatagaaacatgccgattcttttctccgcattagattggcttctccttcgacagagataactaaatatggatatgtaaaatgagaaaaaaataccacatacactaataaagttttaattattccaaacacaaaaatttgatttatccaatatgggtaccgagctcgaattcgccctata

SEQ ID NO: 83457 - DNA, 552 bp, Oryza sativa
gcagttcaagctcaagctcggtaacgtttctcaacacactgtaattaaccgtaactaaaatttttttaaaattggttttcccctttaaaaacgtgtaaatttccctttccttgtgtcatcaatgtattatatatgacgtgcagtcgtctgaggacgacgggatgggagggaggaggaagaagggaatcaaggagaagatcaaggagaagctccccggcggcaacaagggcggccagcagcagccgacggccactgcggcgaccggcggatatggtgccggcacgggacacaccgccgccgctggtacaaccaccgacgccggcgggacggcgtatacaccgacgacgcagccgacgcacgagaagaagggtatgatggagaagatcaaggagaagctccccggtggtggccatcactgagccctttttgaggttcagtttagctccagctttggagtggccgtacactgttcagaataaccaatactccgatgtatggatgaataaaaacgagtggttgcatgcttcaatgggtaccgagctcgaattcgcc

SEQ ID NO: 83458 - DNA, 591 bp, Oryza sativa
ccgaatgaaatccctcttcttcctacttgtaacgcttcgagcttcaccaggccccccccggggaaaaggggggcccttttttccccgggggaaaccccccccaaaaaaaggggcctttggggggggggccctttaaaaaaggttcgtgttgcggcttggcacatcccagccgtccgatcgagccacccctcccttacaaaaccccacccaggccactaggtttcgcctcttctacctcttctcccacctgcgccgccgccactcactcccaaaccctaaccccggaggagagggaggagcagccatggccgtgggcaagaacaagaggatctccaagggcaggaagggcagcaagaagaagacgtaagctgcttgcgcgcgggcggtgtgggcgccacacctctcgtcctctctgagctgcttgttcttgcttggggtttttgggggattctgatttgggacttcttctctttttctctctccgtgtgggtgcagcgtcgatcccttttccaagaaggattggtacgacatcaaggcgccgaccgtgttctccgtccgcaacatcggcaagaccctcgtctccaggaccca

SEQ ID NO: 83459 - DNA, 1648 bp, Oryza sativa
accatgctcttagagcaagtttaatagtataaccaactactacctccaatttatctatagccattctaatagctcgttcatacaatagctacatactatactattaatacacggtcccacctgtcgtgtcttgaagtccgtgctacagctggctataaatctgtagcccgctgcccttctctcttctcatttatcttcttaaaatatgtttgtagctggcttatagcatgctattgtacctgctcttagctagtcactcagttagagagacaggagggggagagaaatggccctggcggcacggtggcgtgctgatgtacgaaccatatataggtgtagtagactaagcacaaggttcaaattaaatttgaattagttaccccggtaaaagcttgttaaaagtacctacagaaaatcagcgtaagtctaagggtaaatcaatggagaaaaaaaaacagcatatataaatcgtgcaggatttcgcatgaacagagtgtcaggcacgcgcatcagaaaccatatcgacaatgacgagctagccgacgacagcgattgcctggctgccaactaggatatatataatgtaacaagaaaattaattaattgggtgagatcgatacgtgaaacatgctgattaattatcttttaatttggtccacttgtagtaagtttgttgtgaaaaccaatgatttctaattatcaggggaaagtgaatatattaacattgcccgtggaactcgaatcttgcaaaatatttggcagggaaagccaatcagatgctaaattcaacccacaccaagctaccatgttgtttatgtacacttggctgcagatgatagtgatatactataggctgattgtatccagacatcttatactttttcagtaaagctgggcgtcagccttttgttctaaaattagggttgaaagtgattcgaataatttccatccgaccggaccttttttcggattcggatagtttcggtcggatatatctgaaaatttttgaattcggatttttttttcggatatgaaaacgaatatgatataggtgatatccgtcagatattatccgatattttccgtcggatatccgacttacacataaggctgccataatccataagccagcccaacccagaggagtcaaatcaaagttcttgaaaaaaatgaatttcgaattgaattttatgatactgaatgaactcatatgaaaaagttgtcaaaaacaaagttgtagaactcattaagatctaccaattttattttggtcatttctccatccgagtttcattgaactatataaaatttgaattttaaaatataagaaattcaaataattcttcgggtagtaaatgatttcaaatggaaaaattgtcaaaaacaaagttgtataacttaccaagatctataacttttattttggtcattttcctatatgactttgtttgaacagtttgaatttgaatttgaaaatatgacaacttcaaacaatattttcaaatactaaatgatttcaactgaaaaagtcatcaataacaaagttgtataaatcatcaagatctataacttttattttggtcatttcttcatccgataaagtgacagtaacattgttcacaaaatttacatatctctcatttggttt

SEQ ID NO: 83460 - DNA, 1455 bp, Oryza sativa
atgaagaaatgaccaaaataaaagttctatgtcttgatgagttctacaacttttatgttttatttactgcttcaaaatatcatttgaagttttgaaattcaaatttttaattgataaaacaaagtcacaagaaaaaatggccaaaataatagtagtaaaaacacaataacatgatagagcatgattttagaaacatttaggaaaaagaatcatccaatttggagttcttatgagtgagataaactagtttcaaatttttaaaatttattttcgcatacggctcattaacgtctgtatttttccatgcggtctcttaagtggtccgcatgcaaaaatgggctcattttggcatcttaaggagtagtatgcgaaaataccaatgcggcaagttgtggtccgtttgcaaaaatcatagggtcttgtacacaaaaatcgtttgtgtagtattgaggggtttttatatttcgattaatattcatcaccgtattcgcttcgcttcgtattcactccatatttgtattcgataatattcgatttcgttttcatatttgggtttccgattccgattttgattccgaaaaaattatgaaaacgaatataatagagctagtttccgaccgtattcgatccgttttcatccctatctaaaatatagtataggctgataaaataagatgggtcgtaactgtcgacgtttgatagtcacgactagggaatttgaatagtatgggatcgttggtaccagggtatatgcgagattgaggtaaaagagatgcagacagtgatttttatacaggttcgagccccttatctgataggtaatagccctacatcctgttggccgaagccggtgctgctctttattcatctggatcacacaaatacaataattgggataatctatctatccatcgtcgacttggcggctatataaccaactcgtagtcgatgacagggtaatcttcctcctcgaatctgtactcggcgagaacagagatggcgctagatacctcttgccggcccatgtaggtgccggatagggcatggctaggctaatctctgatgttgatatacaacggcgtattggcttgtattggcttgtggctttgtagattgtggtgggtgtgtcccctctcctcctagggggcttgtatttatacccacaggtgaccccttgtccaagtagaactagggagataaatatggatacgatctgagtagtgagtagtccttgtcgtttctatgtagaactcttcttctccttccttatccggaactccttctatatacgaggttttttttccgtataagacatggcatgtggtgggccttgccgagcttagtcgattactattgggtatccataaccctgacagtaaaaacttcttaacaatgcatgcaaaaatgtattcttgagtaattaaaggtctatatttaaagaatatgacaaaatta

SEQ ID NO: 83461 - DNA, 2202 bp, Oryza sativa
  unsure (1)..(2202): unsure at all n locations
ttccgggtgaaaaatgttgagggatcgaacaaactccccgaaatcaataacaccattgcgcttaagatcaaagagatcaaatatctgcttgaaatgagaagactctgtcagtctttcacacatctggaattgttctataatttaacggaaaccataaaattgtgcttaattagctcagaaaagcttttgcagtgagacagcaaaatactcagaaattcaaaaaaggcaaaccgacccgatcggcgaaaaggttcttcttgttgctgttcctgaagagtgctagctggaactcctcctgttcaagaaaatggcagttcagaattgacaaaataccagaatttcaataccaaatggtcacttttgtcaaaaagatggcctccattaaaaatgaaattcaagagagttaaccttgtgaataagcccatctttgaatatggaatggcttatcttcttgaacagctcatacagggcctccacctacctcacagaaactacaagacgtaaatacacaggagaaagcataattaatcactctccattcctgaactgaagaatggtgtaattcagtgagttcttacatgtggtctcttttgccgggatagcaggatcctcatgctctgcggctcgtttgaactgctttgatgatatgcagcccatacaaaccacacctttatcttgttgttaagaaacggctttcctgcataaagtgataacagtcacctcaaagaacaggataaagaggctgctaacaaaaaaaagtgaagtgacatgaaaaagttaagtgaaacattaaaaacacaagaaacacagccaaacaacaagacctcctttggaacagaggaattagactaaatcggatgaaaatcccataaaaattcctgcgttccaaaggagccctgaatcgacaaacacagaagaattaatctcacctagggaagaaacagaggtgcctttgaacttctggacatcaagaagaagaagttgatgagcaaaatagagggggggggggggggggggggantntnnnnnnntngtgtgnnnnaaatacntncaagcttattggagatacaatggacatagaagaagaagatggcacatatatttatatatgcacatgcatagcaagcatctgggctccacagtgtggcacagccccagctgtgccgaccgtgtgtagcaagagttgacttgaaatggttccctgttacacgatctgcaacattaaattattactactgttttatattgctcaagttcagcatctgtcattgctgaaaaataatcagcaatggcgggaatagattaatactagtagtttacagtgtgtatctagcctagatgtagcaatatatacttgttgagtaatggaccataagaacgacggttttgttcttagttaagtgatgttaactaggccgtaccaaagatacatgcatccaaaacgggcgtattgtgattgatgtttaacgaaaaatgtcaacgtcgccttgtagctatcaagcgtggttttttttatatatatggaaggagggatccaaaggtgacgcatgctcttccgcttaacaagggatggagcgcctgttcatcaaggacctaattttggcgttattttctcccgtctaccgggaggtactagtactgggaggtacaaaatcaaatctgaccatctatcgtgagagggtacaattgagaaacacagaagagaagcgaaaccatctccggtgtcgcgccaccgctttctcatctgtttaaagggttcgctcttctcatctgttcagaagaattcggtaaaattgtaaagaaattgaatggcacaatttcctgagtgccttgtagttgcagacagcagcagaatgtatagtaagcagaactaagtgttcactgttcagggcttcagacaggcgcttaggcagccatagtgtagtggtgcaagcgcgcgtttataagaaatgtgtgtatgcacgcgtatatgagtgcctacattatattatttaaataataataataaacgtctggaacagatatcgttcaccattatgttacatttagggggacatatatgtgaaaacaagctagggggacatatatgtggaaacgagttaagtgttggaaactcatgaaaatcatacctaaaagttttgtaaattcataaaaaaaactaggaataggtgtagatatgaaatacattctcattaaatctca

SEQ ID NO: 83462 - DNA, 638 bp, Oryza sativa
atgccaaaagggggagaatagcgtgttttatgttttgtgggttgggtctagtagtagtgaggttagtcacctcatatttaataggttaaggaggattgggctatatttggtatgggtatgggctattactctatattgtgtcattttgaagcactttttgccattttggatctaaacactagtagcaaaacttggcaatttggcatttggcatttgctagtacatagtagcaaattatgccaaaaagtgctttgggaccactccctctctctttctctctctcactttagtgctagaatgtgaagcatctaggcccccggtgttaattttggtaattaatgacaagcactaattgtggactaaccgttgtctttgagctatacattttaagttaggtccacgtcatatgcacgcatggatgattatcgatggattaaaattgacggcgcaaagcaaagggaaagaagacggtaaaactagcgctttaatttagaattgatcgaggtgtagggcgatcaaatttgctagtttaattttagtttcgccgtactattaagaggggtaatgacctagcaaagagatgattttaattgccacattaggtcattgcattttcatttgtgctcgctttttcatta

SEQ ID NO: 83463 - DNA, 4682 bp, Oryza sativa
tctcttgtgtatcaagccttcaggctaggggtgtaagtggctaacccgcgaaacccacttataggcgaaaataagccgcgaacccgtttattttgacctataagtgggttcgcggctgacccacttacagccctacttcaggcacatgaggatcaatcatttcatagtgtgactatttgtagttatctgtatggccgtaaataatggcctctatattgttctgtattggagtatctctctactatttttttctctgaagaagagcattcttttacctatttttggttttcataatttaatgtgatgcataatttgattctgttcttttttagataaaggaggctaatttgattctgttcttgcaattgtggatgcactgcagggaatgcatgtgtcgctgagccagcaggtgcagcaggttgaggacacatatgagcagctctctctggctctcggggaggcagcaacaactgaccttttcagaaagtccgtgttctttttctcaatcgggagcaacgacttcatccactattacctgcgcaatgtgtctggcgtccagatgcgttacctcccatgggagttcaaccagcttcttgtcaatgcaatgaggcaggaaatcaaggtgtggttattgttctccagtttattctctctgtgcaacatttcttgcctccttatgattccagttttagttttttgatcagtgtgttgcatattgcccaaaggctgtagtatcgtgcttagcagtggccaatgttgtgagtatgaatttgatccgtaatttacggcccgtaaatattctgtgcttgaaaggtatctgctctcagttccaccacccagatgtgaatagttctttgtactcctggttaggaatatgtttgagaaaaggaggagtgtggacctctggggactgcagatacatgaattatggaaaactagctatgaacattaatttttatgtttcaagggctagaaaattttcaaatgtttatagagaaacctgatatagtacactttttctgtaggttaaagttttcaaatggtggatgagtttaaaaccgtgtacagttttggactgaagcttctttgagttactgaaatcctcaggctgtacagtttttctgtagttatgaattaggttaaaaggataggagggtatttcatctgtacatttgtaatatgggaaagttaactgataaatacatggaattgattaactcaatggatatttatatcgttggctgttagcagttctgtggtgttatgtactttacattctccgtctaccgtaccttaatttcagatttgaggtagtacgttgcaacgttgctcaacaaggacatacttgttttttatatgttcattttgaattcttaacattttgatcagataaggcggccccaaatctgatagggactgatgtaaagtcgatactgaatattgtcttggactgaatactgtgtttgagtcccttagttcttggtctgcgcatacttccagagtggattgtactttgtactgcctcccatttggaagtgcaagctaaatgcgtgttacttttgctcaacttgtaggacaccatgcacactaccaatatgcccatgatcttaccatgatacaaacataattctcacatcatgcataaatgcataatgcacaatttgattttctccctaatttatcccctttccttttttgaacggataattttaatttgcaaaagaattggtaaaaatggccccaaatttctattcagtaaatctttggcagagcatgcgatgcacattgattgaggctgcatgcgccatgagtttatttgtactgtccaacatttgagagcagaaatttctgttaccattgtactcatccaagttgacttgagatgttgctttcttgtttcttaaccttagtaaatcagttacaatgatgcatttttttattatttagccatatgcagttcttgtcagattagattattaagctatttatatctatatataagagttctgtacttcctgcagaatttgtacaatatcaatgttcggaaggtcgtcatgatgggcctccctcctgttggctgcgcacctcactttctctgggagtacggcagtcaagacggggaatgcatcgactacatcaataacgtcgtgattcagttcaactatgccctgagatacatgtctagtgaattcatccgccagcacccaggctctatgatcagttactgtgatacttttgaggggtctgtggacatactgaagaatcgtgaccgctacggtgagcagatgtatcattgttactactgtcagattgcctttctggccttagggaagaactcacattacgatggaatcacattgtgcaggttttctgaccaccactgatgcctgctgtgggctggggaagtatgggggcctgttcatgtgtgttcttccacagatggcgtgcagcgacgcgtcgagccatgtctggtgggacgagttccaccccacggatgctgtgaaccgaatcctggctgataatgtgtggtctggtgagcataccaagatgtgctatcctgtggatttgcagcagatggtaaaactcaagtagaactgaaccaacccttaaactccattgtagttacttgctcagcttttgtgattttctgaccaaaaaatgaaaaacttaacaaggcggcacggagaagtgtatatcttgagagctagtaaaattttttcgtagatacagatttgtgtagaaataccatgttcatatgtgggcactgcactgtaaaggatctgtatggccaaactgcatgaggtgcttggtaggtgaacataaaacattgctgagaactcacctggtgtgcttaactccccaattctcacatgttttgtttaacttctgatacggttatagatttatggtgaaatgttattatgtgttgcagttttctgcttttctggtgaatccatatgggcaacatcaaaggtatttccaagaacacaagttttatggtactctggtactagctatgttctgttatcaactgatttatcctcttatagatcaaaacactgcttccactgcctcctactgcactaatcaacaagcagtaacatcttgtcctgctttacacggtcagtttacaaaatacagccttgcccataacagagagacaaattacaacctccatatcaacatgccccttaattacaatcaactcctcagctgaccaccttgtagcttgtttagattctgatttgcaatcctatccttccaagtgctgacagctggagctctctctgttgctgcaactagagaaactctgaattccaaagctctgtatctgaagtcctgatgctttagcaagctgagctatctctcttcccatggtttggccatactcataagagaaaaatataaggaagagcatggagagtagctgagtagccatggatgctacaactcttcatcatcaactccagagttgagaacaaaactggggaatgccattgttatgtccctgaacacgaaaatcgacaaggcaatacatcagaatttcatttatagttgaaagcaatgtaaaaggtaactacggtgaagagaaacctgaaaaattgtagatggtacttacttcaggtatgggagggtcatgttcttcagcaaagcagggtttttacttgcgaacgccttccattcatccgggtcgatcttcccgtcgctgtttaagtctgcttgcttgaacgtctgtcaaaaagtagcataaattcaaacttcagttatatggggaagaaataaattgagactagtattacatcttcatgtgctttacctgatccacaatctgctcaacagcgtcatcagaaaggagcagatctgattcattcagaatggcgagcaccatttcgtacaactgcttgattcataagggaaaaaaaaagaggtttcagtaactttaggattttctctgtcaaaatgaaaatgcagtacaaatattgttccgaaacaatactttgtatctccagttttccacgctcagcctctggatgttttaggatttaaacaagtctttaacagggttcaatacatatattcttcaccatttatacaaccattatttatgcatgttttctttgatatcgccaagaaaactggtgtaccatcgccatcagtactgaaggctagctatgcatggaaattacattatgttttgttatttctacaaaatatagccaattagtcatattctttagataatggaagctttattgaacccagccaattacacatcaaggtgttcaatggaaagaattaaggatattgtttagtaactcaatatacctcttcacgttcgatgtatccagttcctctcagatcatacaatctaaatgcaactgcaagagggaatactgtcagatgccaaaccaagaagtgatatatgaataaaatgaagattgatatgacatgaacagaagacaaaatttgactgcaaacaactccaggatgttgaaaagcaaatcatgacaaaagatgaagatgatcttggcttataccagaatactctgaccaactaactgacttatttctgcttctatcttttaaaaatccttgattaccagcaagtattgttttgaggtagttttaatattagcgactaagctatttcttaagacaactgagaaaagagggctgcagga

SEQ ID NO: 83464 - DNA, 9174 bp, Oryza sativa
acgacccactcaaataagccgattgcaccagggcatctaaaagctgtcttatggatatcttcttcagccataaagatctgattatatcctgcgttcccatccatgaaactcaaaattttattccctgatgcagcatcaaccagctgatcggctactggcattgggtattcgtcctttggtgtagctttattcagatctcgaaaatcaatgcacaccctgaccttgccattctttttaataactggaactatactagaaacccattcagcatatcggcaaggacggataaaaccagcatcatacaatcgtttaatttcagctttgacaggttcaagcatgtcggctttacatctcctcagaggttgctggcgtggtctaacccctggtttgataggtagccgatgttcaacaatcgattggctgagtccaagcatctcataatactctcaagcaaagcaatctctaaactcttttaagagctctatcagcttggttctaaactctggagataagttcttgctaataaaggtcggccttggccgatcgcttggacctatgtatatttcttccaaaacatcggccgacatgaaaccttgaccttgcttgtcatcgagatcatctactgtatccttggtgtagacatttgaaccctccacgacgcccttaaaataatagcttgggttctccatcttcaattggctgtatatcagaaccggacacttttagaaaatctccatcccagacttttccagataaagaatcaaggccatccatctcccaaagggctaaatcggcactggcaacattaactgacctgtcgactgacacgatctctatcttgtcgccttgccattgaatcaaacattgatgcatagttgaaggaatgcaacaattggcgtgaatccaatctcttccaagcaacaagctgtaagaacccttcccatcgatgacaaaaaacgtagtaggaatagtcttactgccgactgtcagctccacatttagaacacctttggtttccgatggattaccaccaaagtctttgagcaccatatttgtcttgatgagatcctcggcatttctacccaacttcctgaacgtggcataaggcatcaaatttaccgcggccctaccatcgaccatcatcttagacatcggcttcccattgacgtagccgtttatatacaatggtttaagatgccgattctctgtcccctcgggtttctcgaacactgcctgttctggtgacagaaccaacttagccaattcctcttccacctcgtcggcatcggcttgatcgatcccgaattcggctagcaaggtaaagaccatgttaattggtgccactacgacactcttcccttttgccaacctctttgcctcatcggctgcaacatcatcggctacaggaacctgattcttaacacgccactcctgtcttggctttgctttcctcagccgatggttaatttcttgttcaacctcctggaggcgctccctgttcttcaatctttgaacccttctcttctgattcttcatgaaaataccagaaggacaccattgattcttcctgattacctcgtcctcttggccacgatcttgattcaccggacccaatctttgtttaacagaaactcttgcctgcctcagccgattacccctattatatgactggcttgagctctcgacgatatcactgcacccagggcagttttcgatagatggcaacctcatcccttcattccagtagaatctaaagaactcacatccccaatgaggatcaaaaccatcatcgtattcttcataatgcttctcctgctgcttgtcatacttcctctgatatttgttgataatcttagccgaattcacctgaaaaccctttgcacggaccctatcggttgtttggccagctgtatgcaccatattaacatgaaaaggattaccatcgaccttcatcggctttttggaatcatcgaacataatcttgcccccctcaatggccacctgaatctgctgtctaaaaaccttgcaatcgttagtagaatgagatccagaattatgccatttgcaatatctcttccaggactttttacccattggcatggtatgacctttttactcctcacccattcggctgcagctatttcagaatcgtcctcctcatcatccgacccatacatgtatggacaaacatgattaaccttcttagagcttttcctgacttccgctgacctatgctcatgcaaggttaccttctgtatcagatgtgacaagctatcaaagttttcagacgagaatttctccctgattggagcaatcataccctgaaaggccaatcggctaactgggcatcagttaaactcaagctgaagcatttgttcctcatctctctgaacctctgaatatactcgtgcacgggttcatcatgccgctgcttaatcgctatcaagtaagataatttcatctcatgaaccccactgtagaaatagctgtggaattgcttctccaaatcggcccaactattgatcgacccatatggcaaagaggaaaaccaagtaaaagccgatccagataaagataacttgaataacctaaccttcagagcgtctacagccgatgcttcaccatactgagccaagaatcggctaatatgctcataagttgacacaccatcttgtcccgaaaacttggagaagtccggaactttgaaccgattgggaagaggaactctctcaaaccactcagggtaaggctgccgatacaagcttccagtctcttttggtttaagcccaaactgttccctcattacgtcagcaattacatcggcccaccgtcgctgctgagctgccccttgtgactgttgctgcatgggctcgaactgaccgtagtgagatgtgaactgaggttgagccaatccccctggctgatattgggcttgcggggaaggaggctgatattgataactcaagttacccccttggtaattatgaaggtttggctggatattgcgcaccaagtgctcaggaacaacctaaggcattactgtgccgtccggctgtacgtggtgaaccaaatgttctgggatgacttggtttacaaattgttgtataggctgacctctaggcgctgcgaacccggccgatgcgcttacagacccctgttgctgaatcggctgaatgatttgctgccttaacgtagtctgttggatcggttgcagaggctgctgccttggtgatgtttgctgaactggttacacgacctgttgctggattggttgcataacctgctgaattgggggtgtctgctgaatcggctgctgcggtactggatcaaccgcatgttgaggcggcaaaaacatggcagcaacctgatcttgggttggccgattcgcaacctgcccactatgctgtggatgctccctcgttaacaaccgagggttcatcggctggcctggcgccatagctgatgtagcaggtaggggagttgatgttggcgccgtcggctgagttgtgggtgcaacggagggaactgcatgaatagatggctgaacatcggtgagcccacatcgataatttgggaagacacctccttgcaaataaactgggcctgcagcctgatgctcagctattgaaccatcggctattgtcttcatcatgtttgataaggtaatgactaatacgccggactgattgatcaaagcatgatgcacggcgtaatcaacccgatcttggaagttattgaaaaaatcctgtgccacatcattattctgattaagacttcctccctgcggcccctgagcaccatcatcttgaactccatgcaccccgtcaccttgtactccatggactccttgagaattgtcaccttgatttcctagagagccgtcagtagcacctttgatacactacaccataacctagtattcatggcacttaactgccggcagtaaaataaagttagtgacgaactatttgccgagaatatatcaagtgccggaaataatcttgaacgtcatcttatctgccgggaattaaaaaaataggacagcaaattaagtgccggcaatgaacaaatataaataggtcaattgatctgccatagataatttaagagaacacattatctgccgggaattctgttaccgggaaaccaattttacagtgaactgtttgaggaaattttggcgggctaaaaatattggcaggccgagcaaagctccaaggcgtggaaattttcgtgggcccaacatcccgtcgcacatgattcctcatcgcatcgcactcccactctcgtcgcaccgcacccgattcctcatccacgatgtctccacacgcaccgccacacgctgcacgccgccgtcgactccaccggccggccaccactgttgttgcctcctccccacctccgacttgacccacacgccactgtcgactccgcccgccggcttccgctgtcggcatatcgctgcccaacgcctccctattgccgccgcagccgcactctctccctgacgagctccattcctctatgcggccactgattcctcctcctatgcccgacgcctccgcaccaaaccctcgactccacacatttagacaggggcgtagccaagaggtagtcccggtgggctcggaactacccagaattcggcccagagacctcacctcccaaaaaaattaggcccaaaagcctgtttagcccaaaagcctgtttagcccaaacagcccagaaatattagggttggaaggattccagtccaccaccaccaggcgcgcctccaccctccacttctccacgccgccactgtccagggccgcgcgtcgagcctccccgtcgtccgcgccggcgctgcgccatcccagccgtccactctgtccccgctttcctcgccggcgccgctccgtcccagcggtccgcgccgtcgtccgcgctggagccatcgacgcccatgggcggtgggtccgtcttccgcgtcggcgccgctccaagccgccaagcgggggccggcgacgaagcgacgctgcgacggcaactcctcctgtcctccatactccagtcctcctcgcctcctcgggtcaccgcttcgccggactctggccgccggttgcgggttgccggcttggtggcttggcgcggcttgccgcagcgccgccgctcgcctcctgcttaattggctgctccacgtctccactgatccggcgctccaccatttagctcaggtaacgaacagatcaacaaaacactagaacagctgcctaaatcaatttgtaattagagatcagtgaatatgtgaataagaataactgaatatgcaatttataaattcttactaatgtgtgctattatttgtaggattggtaaaacatgaagaggaacggagatcaaggaatcggctcggatatccacttgttcaggtaaaaaatctcccggttataccagatccatgatttgtttcttctgaaatgagtgaatgtatgcatgtatgtatggattgtttcatgtgttaaattataagtgaatgaatggacaaaataaacaaggagaaaatagagaaacgagaaattatctacctgcttggctgtgactgttagttcatatgccttgtcagtctgtcactcttcttcctagtagtaccatgatacacatgatacacttattattatcgtcctgctcacaaaaattgcagagttcatcatcaaggatagacaattagaggccttggatagcattgcaatgtcaatgttgcatatgcagcagcactgtgcaaaccaactttttttttatgtggaggaatcttgccactgagcctgtttggtcagttatattgttgacatgtgtgagaaacagctatattgttgagcctgtttgatcaaatatttattttaagtgacattataatctatttccaagtttgaactatttggctttatggtgcagtttagtcgtccactaccgattttgctgcaatcaacctagatatcatccaaggtgtacgttgctttgctgagcatctaccgaacagaggtcccgaacaacaaatgtacaacagttagtttcctcccgcttgccatgagtactatgctaaaatgctgaaatgttatatcctcatgttatatttgtcttgcgcaatgtttttttatcttttccccatgggtacactggtgagtacttgtacttcacgcatagaaaacaccactcaaacacaaactaatttaagtggcctctaaaatttgattgtcaataccagctatggataggtgatggatgtaccttcctaggcacaatttaaccggacaatgaaattgaacatgtagaccaatgtcctgatttaggtggtggcacagacattactattgatccagcatatgtttctcctgctagatcaggtatagatggaatagtagttgttaatgcaaatgaaaagatagccatttcaccctcttctcagacgcaatcttttatttttctgttttttttttacagaattgctaggtttttgttagaactgctattagaaaaattgagtcacttggtgaggaagtggaaaagttgactgaattacttgctaattctcgagatggacgacaatgtcaatccctaagtcatgtcaaattctgcaacaacttaaatgaggcaaataatgcgatgtatacagttctattctaaatgatcagtgcttgtttccgtttcattacttttggccaacaatttgtattggttgaacaggagagtgcaaatggctagctttttgttagagctactgatgctatcctggacatgaagagttgcatgttgaaggtggtcgcttgttggttgaattatttaatgtacagaagtacagatcggtggaccatcgtcatacaagagtcttggaaacttttgctaattaaatagacttcttttgtatgaatgcaaagacaatgtactcgtatatatgtacactgatgcaagtgtttgcccactctgctgtgctggatataactacttttgatcttgtggaatcttaaagtcagtatgtttttttcatgcaacttaaagtcattatgttaaacctgagttgttgaatgcagtggcgaagccaccgtaggggccaggagggccaacacccccctaacccctatgtgacctcccctcccctctcttctcccatggataattagcccttataatctagccattaattacatcattagttgcagatgagactagctatatagaataactgcctagctatatatatataggacttatgaaatgacttagttaactgatttatcattttaaaaatgattgcaagactccaattaaaataatggaacaaactgtttaaattggcaaattatgatctatgggttctcattctctcttctagctaatcgctataacatgtatgatgtcgagttaacgatcatacatcaacgctacaatatcactgttcattaaaccttaagtgagttaccacatctcgtagatggcaccccccatctctaaatcctggcttcgccactggttgaatgcacgttgaaagtctatggagtcttgaattgctggatgtgtgttgaatgtctatggagtttgtactgattctgtgggctgatttggtaccgatctgaatttgtgtacattggacccgttgtactgatttggtccgaaacaaccaagtgccggtaaaactactaactgtcagactatatgccagggatgctctaagcatcaagggcagttaattgccacggatacaactatatgccgggaatactctagtgattctagggcagttaattgccaggaaaaaaaatatctgccgggaattctcttttgctacaggactttatagggcggtttttaagtgccgggaatagttttcccggcagatgaattgccattcaatgcacttatctagggcagttgcaatgaagggaatactaggtcatggtgtagtgatactaggttgcgccgagccgtctggagcttgtttcctatctccatccttaaaagagctgatccaaggatcatcagcaatcacctttattttgtatttctgaacaagtgttcccttgcgggtctacatgaatgagttcaagaactgatcccgtgcttgttgcaacattgtttcaaactctttcttctgctcgggcgtgaatttttccggatcgatcggcacgatgttttcttcattgacgtcagtcaatcctaacttcagcatcttttacttaacagagcctgggctagatggtggtggtggttgtttttcggctatgaggaagaactgtcggctgacttcttactggtcccaccgggcgtgccaaaagcgtgttaacagaaaacacgaggcctgagagatctgcttaactccagtgcaggtccaaagctcgcctttgggtgtactagcgtgacagttgatttgatcctgtaatcaacaagaaatagaagcaaagaaactgcggttaaatctataaatgatagccgatcggctagatgccgatgacatatcatttatccctgagccgatgtcatatatgaatcgatcggcaattgtaaatagataataaagaactaaatctattcaatcggctgtagatatttccaatatacagttcttatatcgatatatatttaaatcaagtgattgagatagatcggtcaccatgccgagacagtataaatcacttaggtcgaaatatatattaataacaggtctatatatgttatagcatagctgatcagatagacctagcatgtatcggataatactccgatactactctatatcaggatattaaaataggtataatatatcaaacaaaggcctaatatatttaaatatagcaatatcttgacgtaaaggacagatttaatatgtcaattaagcatataaagcaaatatagttaaatcagataagatcggctgaaactccgatgctaccctaatcggcaaccagaagacaggttagagattgatcttctaagcacgacttaataaatcaaactcaactgatgcagcattaagtatgaagagaagaacaatatctagacaatcaagccgctggaagtttcatagagtggtaaatatcttatataatctgaatcaacgtcagaatctaacctaatcggctaccttcctcgatagatgttagccgattgtaggttagacagcgatattgccagagattatgt

SEQ ID NO: 83465 - DNA, 5507 bp, Oryza sativa
tgataactcgacgaatcatataaacaagattagagtatcatgaggatggaagcactaatctcaagaacgcaagccgtcataacaagttttacctcttgttgaagatcgaaaccgatgcagctcaacccgaaagcaagaactcgtcgaaacaaaactaaatcaaaagggtggtgatgtgccgaaattgtattgaacgtgtgttaaaagttacataggactcgggtctatttatacccgagaattacaagatacgtccataacggacacgactactatctctaacaaactctaagataccataagtctttgcggcagacttttgcccaaacgtatctctaaggaaattatataaaacatcctaattaatagatacaattgcctcctcagaactctatccatgtacggcaaccaccttgaagcacctcaatcgaacccgacatcacacattaagttgtattgtcgggatcggctacgtctgcttacctagcccgactcagactcagccgatcttatcgtagccgatctggactccagccgattcctgccttgttttcgaactcaatctccgcctccgactttgcttcgatctaatcttctttcccaatgccgatgttaccaaatttggttgttaacaagctcacaccgaaaccttccatatatagaggaaggctatataaaaaggagagggtgctcatattgtacacttgtgcttgacttgtgcttgaggatgatagaatgatgaatgagaagagagtctcacccctatatcttgtgtctccacttttatagaattatgggacccttttggattatttcgtgtagcaggagggttgcgtaatacgttatcagcacgacgttctaccggagaccaagcaagaagaagggtgagaactcgcacatccatttagcatctcgccgattcaatcacgaaaacgaattcctctcctcgttcgcattccgttcttgtttttctggagaaatctgctaccgccgacttggagtcgccggcgaaagccgattagcaatatcccggaaaagctagctggctgagcgcgtccctccgcgccatgccgcacacggataccccggcgacaggccgcgtcgtcctggacgcacgccggccaccgcgcccccatagctgcactcgcgccatcactggcagccgttcgcgctcgccatcaatggccatcgcctcactgcaacgagggcacgcagcaagcccatgccggacgcgtgcgccatggcaactaacagcaaaataggagaggagaacaaaggaaacaagacaaagaagaagaacaagaaaaagacgccaatggagacgtcggccactgcatgggccacgccactacaccgaactccacggcgtcacgaccggtcgtcgctcagccgcgcctgcacagaggccgccgctagcagcacccacgccgacgtccgccgccgctcggccgcacctcgcgccaacccggccgcgcccaccgccggccgaaccgccgcctggccgcgccatacacggccgcgtcaccgccgcacggccccgcgccgcgccgccttgcacggccgcgcgccaccgccgccgccgtacagccgaaccccgcgggcgaccgcaccgccgtgcgccgagccgccccgccgggcgaccccggcgcgccaccctgcagcgcccggtcaccgcgctacgctgccacctcgcctggctgcgtcgtcgacatccgccgccgctcggccgcacctcgcgccaacccggccgcgcccgccgctggccgaaccgccgcctggccgcgccgctgacgtccgccgccgctcggccgcacctcgcgccaacctagccgcgccagccgccggccgaaccgccgcctggctgccgtgcacccgtgctaccgcgcctggtgccgccgccgctcttcctcagcccggccgcgtgctcgcgccaccactctcccgggcgccgcgtcgcgccgccccgatgtcggccgccgtgctgttggacgtcgccccacctccaaacggccggccgtcgccgggccaccggctctgcgccgccgccgccgcgtcgtcatgtatggcaggcgacgcaatcgggggagtcaacgggaaaggataaggaaagtgggagaaaagaaggaaagagaagaagaaaaggaaagaaaaaaaagaaaaaaaaaaaaggaaagaatcctatgattttgcaaaaatgcccttgtttttttggaaattaagtgcatgttcctctgtattggaatctttgcattttaaaccctgaattttccagaaaacacataaataaccctctgcatttgggatatttgtttgaatagcattcggaatttgcaaatatcaccaaaatcatattctcgcataaaagagccacgggacattgaatttcgacccgactttgtatttcaggtacctttattgctgatgtttatgattatgaaatttaattatcgcatttacgattattgattatttgtgatgcttttattacttttaattaatatcattgcgataaaatgtatagaattgcatagtatatactagaattatttgcgggaattttgtgtaccattatattgcaacacttgtgcattttaccagcatttaatttgcgcatatttttttttgaataacgaaagatgactggtatcgcggattagaaaattcgctgaatctagaatatctctgacatatttgttttccaatgtcgaaattacagtagagcaagaagccctatggtaccgttaatccaatcgcgctataggcattgacttgatgagtttgatctagcatttcaaactctcgccagtgcctcgaagccactctcatgaatgagtaggctagaagaataagcgcgttagcatttagaagattatggtacataccctacctctcgtagagcaagaactatgagcaagaatgggtatttttcgactatgattcactgagcagatgacacaaagagtacggtaatacggtgcaccgaatactgcgaaaactcttgatgttctacccgaacatgacaaaagtcgcacgcaagcatcactggtgcacatacaagaagtatgcctaactagttgataaatggaattgcgtaatgttcatgacagtactcactagaagagcattgtcttccaaaaccaactagcacagttgataacgaattcaacacgagcagctagcccagtacacttacctcaacgaaagaagaggaaaggggggagtagaacataggtggtcaaggtgaaacaatctagaactatgaacattaaaagaaaaggacaatcctaatagcacactcatcatgaattgagggggagagcttctagcctatttgcattgatatggacgaagaatctcctatgctatatcggatcggccctaaaattgatgtcaggatagtaaataattgccatagctatcgagcaagaagctcgctatgaagttaattgaatccgaagtaccgggatacctcgttgaatcaatatacttcgtcatcacttgttgcaatctttgaatagagcattgcatcgaaaaatggtccttgcccaagtagagcacacattttccctgcaatagagaattattttcggtataaaattgcatatttaaggcatttactattttgttgctcttttctagcacatagttataatgctttgaattatgtgtagcgcccaaacataagagaaaaagaatgaattgtggtccgcataaccacaaataacactttaagagaaagaggtattttccagacccatagaactgaaaatattatgattgttgctggcagcaacaactaaatttgtcggcctagaatgcgccacagtcatattacctatggaacaattgtgcactttatagaagcatctattgtccgtcaaccccgttgaactctctaaaaagtgtgatcatttgggctacacccttttagcaatggattttcagccatttctggtcttagaattataagaataaatattacaactcgtatgatcatggcacatatatgcataattttcctaaatcatgaagatttgtgtgccaagtatgcaccgacaggaaattagtgcataaaccacatatagttctagcatccctgaactggattgtgaggaatatctgcggctcccatttggtactatatggataaatgcgcttccaaagcagcaaacatccagtgtctcttagacaccgtgtctctgccaagactgatccagcaagatcacgtgaacaacaattgaactcactaaatcatctttagaagtccgcgaggacaatgctagcattgcatttgatgattggtgaattggtagcacgaagtaccaaatatccgcatgaacgaaccaagtataagctatgaattgcaatatatgctatatcattgttgtaatacccgtagtagaaaaggacatgtagtccccaaagctgcggattctgaaagaaaattcagaccatcggcataaacatccatcctgcaactaatgctattgcatctgtttggtttatgtgcatatcccactaatgcgtttcaaaaggctctctccgaaggtcgggaactttttatggagatagttatgaagcctaaaatccttgacaaataagaattatttccagtcatttagggggggagaatgaacccctagataggaaatgtcaggaaatatgacagcagaaagggactaatgcatgttacaccacactagtgaatgtagtttgcatagagaattaaaactgccaaattactttgtaaatacttttgtgatttcgaaaagtttgactaagttgcatgaatgaaatgcaccggaggagggtgataccgaagaaagtaaaggtacccctcgtcttgtctagaggcctcgaacaaaaagaattggacaagaaacttcggctcctcacacccctaaagtaaccggagacgtctggtgaaaacagggcaagagggactatcatactcaaagtcaaaaggtaccccaccgaatagaaggggagtgtcacaccctgaagtttcccccccttttcttgctttaaaaattggttaaataaattgcccaaagaaattatcttaattaacctagagctaaatccctaattaataaatgcatttaataatcgaattcggcgtggtggaatttttcttgagttccccatgctccaatacattaacatgatttttagtggaattttcagagccttggaaataattttaaccaattaaaattgagcaagtgcaatatttttaatcccaggaaaatcctttttctccttttcttttcttttccctcctttttctttgttgggccgtcggcccgtccctctcccgcggcccctcctccttgtgggccggcccaagccgcccctccctcctctctcgggacgccgacaggtgggccccacttgtccgtcgtctcctacctccggccgttggagccggagctccaaccgccgctgccgccgaaatcgccacgccgccgctgtttcccgccttctccgctccacgtcgtgcctcc

SEQ ID NO: 83466 - DNA, 909 bp, Oryza sativa
gcccgcgccgtccgatcggcctcgggccgatccggaccgtcggtcccgtggaccggcggtggaccacccgcgtggtcccggtccacggtagactggccaccttgtgctgctgccagtggggcccacttgcccgagccccctctccctccccttgtgcgctgacaagcggggcccacctgtcggcgcagccgcccccccttggatgacgtctgccctgggatttattgcgcaataaattgattaaggactttttctttattagtaaaaacactatttatcttctaaaattcataagtaattcatccgagcttcgtttaagtccattcaagtctcaataaattcataaaaatgtaaagaatccattaaaaatagttttgtttcctgttgcagtagtcttatagcatgttttgcttgtgtgctttgtttgtcgcgtagatttcggccgtttcgtcgatccgcggtttctcgaagacgttgctgaggtctcatcagtgtgagagcaaggcaagtcatgctttacatttaatcatattgtacccaatttacaaacactctgcatttctattaaatgttgcactcttttacaatgtcatgtgggatgggtcctattactcagccatatatcgttttccatatgccattgataactggggtatcaaaatgattagatgttggtttaggaaatgcttagccatgcttagttcaactagtacacaaaaggggatcacattattacatagactctgactatgagcatagttctggattcgtgccaccgcaatggtgttagttaattaaaatacaccgaatggtgggttgtgggtgcatggttttgctggtcgcactcatggcaattaaggaccggttcacgggaaacccttggagacttaccgtgcttaccacaagcag

SEQ ID NO: 83467 - DNA, 3523 bp, Oryza sativa
atgcctatcaaaaatagatttttcagatttgaaaatatgactatcaaaagtagatggagggagtattttggaatggagggagtattagtaaatagaatatgatcttgttggattgagtaatatgcaatcataactccccaatgtacttttgaagaacagtgagagattgattaaaaaaaagaacattgagagaagatttgcctcattttccacgcgcatgcttcccgaactactaaacggttttataaaacaaattatataaaaaagttgcgttaaaaaattatacaaatcatcttttctagttcaaaataattaatactcaattaaccatatgctaaagattcaccttacgtattttcactccacgtagtcagcacataccacatttgaactcttctggtcctaattctacctcagttttttaaatagatgatgactttgattgttaacacatatttaacatttattttattaaaaaatttacataattattatttattctgctgtaagttgttttgtcactaaaaatttttttggggcatattttaagtatgatttatatcttatgcatttacataaaattttttaaataagataaatagtcgaatgtgtgtaaaaaaaataacggcgtcgtatataaaaaaaatagagaagcacatattttgtgcattgacttaaacattcttaaatgcaccaacccatggacaaacacgtactccctaccaaacacatgtatgttcctgcttccaaaattaatggcatcatttgattttattaaaaaaaactttatataccaccttcatcccaaattagtgatccttttgactttttgcttgctacgtttgaccatttgtcttatttaataaattagtgcaaatataaaaaaaaggataagttatacttaaagtacttttgatataaagcaagttacaaacaaaataaataataatttcataattttttgaataagacgaatggtcaaacgttacagacaacaactcaaatcgacaagtattttgggacggatatagtataaaagtttattgaaaagatgaataaatccattttcaaatttacaatggtttactttttcaatcaaatcacacaagatagtgtgaggtttcatattgatataggataaaaaagttacaagatcatagctatgggagatcatgactatcatcaggaaaaataaaacaacaagccatatcacacgcctacaacaaagcgaaccctctaaggaaacaaacaaaagcgtcgtgttttatctacactcaacgccatccacgtccttttgttgtagagggagagggcgatagagaaatggatccattctccctcacatgaacccaccaacatggtcattttgtggcggtcagaagcgtcgccgcaagaggacaaatcgtctgcataagagattggtagaaaatggaaatggaaaagcatcgccgctgtcaacctggaagcagaccaggatgtcgcccaaaaacatccttccctcgcatgctgtcgtgccccagtcatatgtgacggttgccaccatccgaacaccttcgacgtgtggccatcgtaccaatgctccaataccggtcgaccattgagatgatcaatggcccacacgcggaactctggtaagtcgtcgacgtgtcggccatcatctccccacatcatacttaattaatgaagtgttttttgtgccaatcataaccatctttcatttatttttttcacatactttcttttctcaatcaataacgatcatctttaatttaatttttactctccttttatttttttaataacttcagaagtgatttgcgacagaggtggtaacatttaaacaaacaagtacacccaacataaaagctttcgttgtactttgtagaataaggctgtgtttagttagttggccaaatttttttttgacgtatacggacacatatttaaagtattaaacatagagtaataacaaaacaaattacagattctgcctgtaaactgcgagatgaatttattaagtctaattaatccgtcattagcaattttttactgtagcaccacattgtctatatcatgacgcaattaggctcaaaagatttgtctcgcaatttacatgcaaactgggcaattagttttttttcatccacatttaatgctccatgcatgtctccaaacatttgatgtgacgtttttggctaaaattttttggaatttaaacacagcctaagtgaataacttcattacttccctgctggatgtaatgagtgcacctggttgttcggactgcgatgctactaaggctaagtttgagatgataggaaaagaggagattgagaagatacgcaaaacgcggtgagctattatcttatgattagttgagtattaactattttaaatttcaaaaatagattaatatgtttttaaagcaacttttctatataattttttttgcaaaataaatatcatttagtagtttgggaagcgtgcgcgcagaaaacgaggtgttttctactcaatctcacagcaatctctcctatcaaacgaagccttatactagcaacttctcctttaccatcacattacctttcctaactgaaaattttgattccttctattgtaaaaaagagtggtttctgatccaaaatttacataaatactccctttgtgccaaaaaaaaaaaggccaatcctacctacattcgtagctaggaattcgttttttttttacagaatagtagatattactacttcaacttttaagagatatttatattagaactttcagaaataggggataaatttattaggactagataaaattaagagtaattgtattagaatttgataaagtataggatattgggataatttatttttcttttatatttgtcagtgacatgggaccgggagtatcatgacttagagacttgaggcagacacgatcgcccacgtggcctaaccccctcgggggggtcgggcccgagggtgatacggccgcccttctctttgtctccccgaggggtcggaccgctaccgcctcggccctgagggccgaggcgccccgaccccttgtgggttttgcgccgcgtatatggggtaggtgagcatagcggggctcacctaaccacatttattgcggtttggacgagcgcgtcacgccgcatggaacgcagtgcaacgcgctcgtttatccggtctgtgaccggtcacagaccggtcagatcgtgggttaggtggcgataggcggtctgacgcacgcctcgccccatcccgtcaggacgagagcctccaagcactcgtccctagccggaaccggcgtgttagctcctggagatggcacgttggttccggtcagatatatgccaggctttatcctaaccattacaggcaagatattgtatgaagaagggtgaacatgcagattgttaaactgacacgtggtggacaagaatgaccgatttgtgatcggtctgacaatggtcatgtcgtcagcagacagccatgttcccacgtcgcgcctgctt

SEQ ID NO: 83468 - DNA, 16128 bp, Oryza sativa
gaccttgcccacttagaaaaagggggaaaaaagaggagaacgatcctagaacgagaggggggctggctcggactttgtagcttcttcatacacagatccaccaaaacacaggagtagggtattacgcttctcagcggcccgaacctgtatacatcgcccgtgtcttgtgtgtttccattctcgcgaactttccacagaccaagagcttagaacctcacacagggcccccggccgaactggcaaaggggggcctgcgcggtctcccggtgaggagccccacgctccgtcatctggcgcgccaagtagggggttctgcgtgtgttcttctaagctctcgcactctttcgtgtgcgccaagcttttcctgttcagcccaatggccgaacaagcaaaggcgcacaacctctctccgagcgttagcggcgacgatggggagccaaacccacgccgtcgagctcgtactccaccgccccctccacgccaaagtcctaggcgggaggaggcgctcgagagggtcgaaggatccgcgacttcgacatccacgggtgatggggaagggcggcgagatggggagcgtcgcctcctcgtctacggcgacggcagcacgccccagggcgcgctccaagctgcgggcgcactcctacgtcacccgcccattgtccttgacccggagtctccagcccaacgttggctggacgacgtggccaacttggtcatgacggcacggcagcgcctaggtgctggtgggcggtcctccgccaccaagacctctggcgctgctaccaccggctccgtatcgtcaaggcggagggcgcggcgagcggcggctgttgctcgccattcggccgccactccttcgtcagcgcctccgacccaggaagatctgcgtggggggccggatgcccacatcgatatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccatgaactttcaaggcacatatccgtgcccaggtgaagaagcggacttacatgcagtacagcgaatggatgatgagtcacttcgctcgtacattcagcggttctgtcaagtccataacaccataccatgcatccctgcacacgcggtgatctacgcgttcaggggggggtgtgcggcacaaccgcatgctcgaaaagatcgcctccaaagagccccagactaccgcggagctttttcagcttgcggactgagtggctcgtaaggaggaggcatggacctggaacccctccggttccggtgtggcagcttcggccgcccccggatccgctgctcagacagggcggcgtgacaggaggaggaagaagaggtcagcccataccgacgacgagggtcatgtcctcgccgtcgagggcgcttcgcgggccacccgaaaagggaggcctgcgggcgacaaaaagaaggaggccggcgctcccagcagggagcgcccaaccggcaagtggtgcatcgtccacaacacttcccttcacgacctcgcggactgccgcgcagtcaaaagtttggctaagcggacgaggaagtgggaggaggagaggaggcaggagcgccgagagggcaagtccccggcggttccttccggcaatcggcgaagtgaggccaaacagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgcgttgcccggggaggacagatcgcaatggtggtttcccccactgtttgcaacgtgaagctggggcgtgtcctcattgatggaggagcagccctcaacatcctttcccccgcagcctttgacgccatcaaggccccggggatggtgctccggccgtcccagccgattatcggtgtgacgccgggtcacacttggccgctaggtcatatcgacctcccggtcaccttcggtggatccgccaacttccgcacggagcgggtgaactttgatgtggcggacctcagtctgccctacaacgcggtcctagggaggcccgcgttggtgaagttcatggcggcagtccactacgcctacctccagatgaagatgccgggccccggtggccccatctctgtccatggcgacctcaaagtcgcgcttgcttgtatggagcagcgcgcggaccacctcgccgccgcgtccaagcccgagggtggcgacgagaggcttggcacctccgcccccgccgccccgaggcagcggatagtcacatgtgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcgccgtgcggtcgggcgcaaggccggtctggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacacttaccccctgcctcgcatagatcagattgtcgactccacagcggggtgcgaccttttgtgttttctagatgcatactcgggttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataagactgaaccccgataaatgcgtgttcggtgtacctgcgggcaagctcctcgggtttttagtctctgcccgaggcatcgaggccaaccccgagaagatacgagctatagagcagatgcgccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacagtcctcattccgcgcacccccaccctgtgctggcttggctcgggagagagcagggaggagaggcccccgagccgaacggtggcccaaggcccccgacgaccggagcaggccctctgcccgcttgtcagacggtgccaggtgcccccgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgacgacgccaggagcccccgacccccaggacggccccgaggccactgtgggaaggccgcccctgtcgtcctccgaccccgaggtcgtcggcacagaagacgagtgcaccccgcgaggccgcttggacaaagagcgccccagggacgtggcccctagcgaagaggatcggccccaccgaaaggtgcagcggcccgtctactttgttagtgaggccctccgggacgccaagacccgataccctcaggcccagaagatgctttacgctattctgatggcttcgagcaaactgcgtcattatttccaggcgcatcgggtcacggtggttacgtcttaccccctcggccaaatcttgcataatcgagagggtactggacgggtggtgaaatgggcaatcgaactttctgagtttgatttgcactttgaactacgccacgctatcaagagccaggccctcgccgattttgtggcagagtggaccccagcccccgagcccgtctcagtccccgaggccagctcgggcccctcgcagctgcctcacaccgcccactgggtgatgcagttcgacggttccctgtctcttcagggcgccggtgcgggggtcacgttgacctcgccgagcggagacgtcctcagatatttggttcgccttgactttcgggccaccaataatatggcagagtacgaaggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggcgtatggagcgccattttgacgggatagagcttcggcacgtgcccagacgggataacacggttgccgacgagctctcacggctcgcttcctcgcgagcccagaccccaccgggcgcctttgaagaaaggcttgcccagccttcggcgcgacccgacccctcaggggagacggacgcgcctgacaggcccccgaggcctgtcggagtccaggcctcgggacccgaggggagcgctcccagctcccttagattgattgcttggatcgttgagatccaagcatacctcacagataagactctacccgagtaccgcgaagggagtgaacgcgtccagcgcatctccaaacgctacgtgctggtagaagggaccctctatcggcgcgcggctaacggaatcctcctgaagtgcattcctcgggaacaaggcgtcgagtttcttgccgatatccatgaaggcgaatgcggatcccactccgcctttcgacaaggtttctattggccgacagctctcaatgatgcggtcgacctggtccggcgatgcagggcgtgtcaattccacgccaagcaaatccatcagccggcccaggccctgcagatcataccactttcatggccatttgctgtctgggggctcgatatcctgggaccgtttaggcaggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattacttcgaagacatgggcatcaagctctgcttcgcctcacctgcccaccccagaagcaacggccaagtggagcgcgccaatgcggaaatcctcagaggccttaaaaccaagaccttcaacatcctaaagaagcacggcgattcgtggatcgaggagttgccaacggtgctctggtcgaaccgaaccacgccaagccgagcaaccggggaaacgcctttcttcctcgtctacggcgcggaagcggttctcccatccgagctcaccctaaggtcccctcgggccaccatgtactgcgaggctgatcaagatcagcttcgcagagatgacctcgactacttggaagagcgaaggcggcgcgcggccctccgagccacgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcatcgcttctacccctaaagggggatcgggtgtcaggtttcgggctcaggccaaccccgcacccccctcgggcgtgcagggttggccgggggctaccacatatgcatattcttatatctcttgtatctgtatttcaataaaaacattttcaatttcctaaaggctgtatctgtgctgttgtttccttttgaaggatcttgacttgaaataagtcactcgtgttcaatcctgccctcgggggctcgggtcggctaaaatcgccaaacggggcccagaaccgagccgtgccccggggcgtagtgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggaccgcggcacagacatcctcgtgtcatacacacaacaaatagaattgacacaaaaaatttcctctttatttgattgcagattaaattagtctatacaagaagggggcccgaaggcctcggaagaagaaaagaagaaactatttaaagattggcgggggcctgggggctcactccgatgcacccgggtcgccagcctcgtcgccactgtcgcccacaccgccgtcatcgccctcctcgtcggagttgagggcgaacgcgagccgaggggccgaaccctcgaagctgtggacgatatggtcggcggcatcccggacctgcgcgcgcgcgccgtcctcggtcccgggagggaactcgtccagcgccgtccatggggagaagtcggggtccctggcctggtaactcgccagtacgagctccaccgctcctcgggcgaggtccctcgaggatgacttaatcgtcccctcgagctcctcggggagccgctggagagtcccggccatctccgagaagcgctgggcgaggcccccctggttggcggcgtacttcacagtccgcccgccccagagacccgcctgccgcccggcgcggactagacgggagacggcgtcccgaagcatgccgggccctacctcgcctgccaagcggagggcctcgacctccccggcggacgagtctagcgcgccctgcagatcggcgatggtgtgttcggcagctgcgaggcgggcggttaagtcgctttcgcccgcggccgccccgccgctgcgcgccctcgcgtccagctccttctcccgcgcctcgagctcagcggcccgctggttcagcgcggccctctcggcgcgggcaccttccagattacggcgcgcctgctcctcccgcactgcctcacggagggacaggctgtccgccagacgttgcgccgcggcctcggcctcctcgagagctcgctcccgctcggtgagcgcgtcctcgcggaggcggagcgcggactcctcttcggcgcaggcggcctcgtgcgccgccagcgttgcctcccggatggcaacggcggcctcgcggtccaccaggtccctctccacgacgccggcgcgctcttccagcgccatggcacgagcctcgagggcctcttcgcgccgccgagacgccgcctcggtctccgccgcccgccgttctcgggcagtggcagcatcaaggaccccccgggcggcgtcgagctttttccctagctccgcctcccagctcccgtattgaaggcggagggtgtcctgcgcctcgttcatcacagtggtggcgatgagggcagccccccgctcctcctccacctccttggcgatctcccccagcaccttccgacgggcttcgagctctgagacgtgccggcggtgtgccttgcggcccacctccaccatggcctccaccgagcgacgcccctctttgacacgtgcccatgcggcgtcgagctccacccgctctgcttgcaaggcctccatctgggcacttaacccgtccaacaccgtggtgttagcgacggccaaggcctgcagaagaggttctgcgctcagtggagcaacggaaggcgtggggaagagccgcctcgaagaggatgccgcgcggcttggcccgccgatggacgtgccggactcggggatgtcccccggacctggtttgtcctgagcgtcgcacgagtgagtgggcccaagcgatgcgcccgcggcctcgtcgcgagctgcttcggaagtcgtcgtcgcctcggcctggcgaagtctggcctcctcccgagcggcttcttcagcttggcgagctcggacggccacctgagcagcttcctcggcttctcgaaggcaatccgcggcctcttgccggtcagtttcacgggtcgcctcggaggatgtcgtcgcctcggcctggcgaagtctggcctcctcccgagcggcttcttcagcttggcgagctcggacggccacctgagcagcttcctcggcttctcgaaggcgatccgcggcctcttgccggtcagtttcacgggtcgcctcggaggatgtcgtcgcctcggcctggcgaagtctggcctcctcccgagcggcttcttcagcttggcgagctcggacggccacctgggcggcctcctcggcttaccgtaggcgatccgcggcttctcgccggtcagattcccgcctccgagcctttgtggtcgccgggtcctcggcctcagactggccggacttggaatggcgggagggacgcgacgggatctcgctgaaacagaagaaagaccagaagacaaacaagatggatgagtgaaaactcgcgttgagggaatgaatacggccacgatgggcgtgggacgaacctgcgagggggtcggttaaacgaccaccttggaggggaaataaggtttccccgggatggttctgtcccccccatcttgcggggccgtttcttcttccgctcccctcgggctgcgacgtcggcgtggccccctccgggcgcctgctgctggcacgcgccgccccgccccctcggggaggagatgggggaggggttccttcctgcttcctcttcccccgggcgtcggcagggcggccgctccccgggcccccgtcgcggggcccagaagcacgaccccctcccggggtagatcgttcccccctgcggctcccgcccgcgccatcgtggcctcgaggagcccgctcctccgacgccctgaccgcctgcatgatggtcaggatggaggcacggtctggatcgctgcagagggggaggactccttgagaaatgagggatgcctccacggagctgagattcagcacccgttggaccactatcttgaagtcctcaggagcccagtcccatctgaccccctggtgggtcctcatacagtcctcggacccggtgtactcccaggcgccccgggcgcgccgctggagtggcgcgatccggcgacgaagatagtcgccgaacaccatggcccctgtgagcccctgggatcgcaggcccgccaggcggtcgaggacggcgtcgtagccatctcccagatctaccggcgcccgccagttggaggcctgcgctggaggctggctcggaagtcggaggcgcgcttcgtcggcgaggggggtatagaaccagtcgctcttccagtcatcccacttcttgcggaggacgcagggaatgtagtggttcagcaccggcccccgcggctggaagtagcaaccaccaaccaccgacggcggcgacaccggctgtacagtgaagaaccaccgaaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacggaccgccccgggtagcgtggcgccgggcatccctcgcccagcgagactatctcccggccggtggcagattccggcatgaagcggcgcggcagctcggcctgtctctcgctcacgatgcgggaaggcggcagcacgctaccatcaagcggagcggagccccgtgccatgacgccggaagaagagatgtttgagagcgagcgcgtgtggcgaaggtagggcacaggaaacaaggagttagggcgcaagcggcgaagacaaggggaataatagtgagaggaaggaagcaaatctcttcctcggcgactttatacccttgccaacgctgtgcccggctcctcgtttctcgcgcccactatcttgccccctcgtttctcgcgcccacgcttccactaatcccattcgcccgtttgcggtgcatgaggtggatatgcggctgtggcagtctagatggaacatctcgtgcgcgcgttaattacgctcgccgaccgaagcgccatcatcatatctccaggaaaaacgaaccggcttgtcccgatttttagaccggccccacctgtcaccaggccttaggaagtggcgtcacgcccgaccgcttccctcgaggagggcgatcgccctggcataacgccgggggctactgtcggtgacatgggaccaggagtatcatgacttagagacttgaggcagacacgatcgcccacgtggcctaaccccctcgggggggtcgggcccgagggtgatacggccgcccttctctttgtctccccgaggggtcggaccgctaccgcctcggccccgagggccgaggcgccccgaccccttgtgggttttgcgccgcgtatatggggtaggtgagcatagcggggctcacctaaccacatttattacggtttggacgagcgcgtcacgccgcatgtaacgcagtgcagcgcgctcgtttattcggtctgtgaccggtcacagaccggtcagatcgtgggttaggtggcgacaggcggtctgacgcacgccttgccccatcccgtcaggacgagagcctccaagcactcgtccctagccggaaccggcgtgttagctcctggagatggcacgttggttccggtcagatatatgccaggcttcatcctaaccattacaggcaagatattgtatgaagaagggtgaacatgcagattgttaaactgacacgtggtggacaagaatgaccgatttgtgatcggtctgacaatggtcatgtcagcagacagccatgttcccacgtcgcgtctgcttccggcggaagtggaggtaggtatgggccgtcccatcagaaggtcattcggacggcagccatacaaatctccgtccattaatgaagagaagtcaagtaagaaagagagggagagatggtgcatgtggtatccccttgagatataaaaggaggaccttgcccacttagaaaaagggggaaaaaagaggagaacgatcctagaacgagaggggggctggctcggactttgtagcttcttcatacacagatccaccaaaacacaggagtagggtattacgcttctcagcggcccgaacctgtatacatcgcccgtgtcttgtgtgtttccattctcgcgaactttccacagaccaagagcttagaacctcacacagggcccccggccgaactggcaaaggggggcctgcgcggtctcccggtgaggagccccacgctccgtcaatattagtattatgaaatggataacaaataaagttattctataacagggaagtaacttttagcaacaaagacaatgttcttttgaatgaaaaaagggggcaattttcgtcattctttttttaatattcgagttttacattatggctatcagtgatgaatgcagtcaaataatgcgtcctggtaaatgaaaaaaaaatggcagaaacggtcggctttactcctagcattcacaagatttactcaacataatgaaccaatcctttcaaaggtcaaagtgacattcgaagcgattcgttatgagtaacggcaacatgcaagggaatgctcttactaagtatatgttcatgaaagagatatcacaaagataaaaccacccaaaagtttcaccattcccccgcaaaaaaaaaaaagaaaaagtttcaccattccagtatgattcagtgaattgtatcacattgttaatcacatttttgagtaacaatggaaattgacgacaaattcgcaaactgcattcttaatttgttatcttttcatcgctacaggcctacagcaaaaaaacaccttcaattcaagtagcctgccatttcgtcgaacaccttgcacctcattccttctcgccaagatcgccgcggcgcaccggtggccaaaccatcatctcgacggggaagatgtcgccgagcggcctcgactcatcggtgttgcgccacatcctctcaaacctccacgtcgcgaggtcgagggatacgacccagtcggccatgacgaagaacagcgcgccggtgccctcgcagaatccaccgaagctcacgagcttgcagccgcgcagctggtccgagattttcgccgagagcttgattcgggagaggtcaccgacggtggccgggttcatcagcgcgcgcaggtccaccgccggctgctccacccatttccccggcgactcgagaacccacttcgcaagaacgagctgctcccgcagcgcgaagaagcagagacggccgtcgtgtgtcttgccgatccagtggttcccggcgtacaggagcatcccggtgttcggcaatggcaccgccgagagcgtcatcttggtcgcgtcgactgccattacgtatttgtcttcttcgctctggagcttgtagaccacgtcgccgatgacgaccgtcgggccttggtgtgggttcatggacttcttgagcgctccggtggccgcctcccatgcggaggcggcggaagagtacactagaatgtcgaagtgggcagcagcgccgaagaggacgacggcgacgcggaacgccgcgccggcgccaggtaggagcgcgcagcaggcgaccttgtgtccggcgacgaagcgggaggggagggacacggacgtcttcctcagcgggtcgcagacgaggagcttgagctctctcgccgacccggcgccgagctcgcggagcaggaggcgccggccacggcagtcgacgaggagggcgccgcacgcgggcgacaccgagagcgccccgtggtcgaggccgaggccgacgccggctgcagggacgaaagggggaagcgcggacggcgcgtagttgcggaagaacccgaagtacggaggcggcgcggggagcccgccggcgccggagacgagcagccgccaacggcggcacaccgccgcggcgcggacgatgtccgccagcggcgacagcctcttgaacacctcgagcagcatgtcgtcgggcactgccgacgcccccatcccctccacctccacccgcgccgcggaaccggacccacctggcggcgactgagaccgggcccgcgccgatgccttcccgccgcgaccgcgcatctcctcctccccctccatccgcggccgcgtgcgccgcgccgaatcgaactcccccggcggcgactgcgaccgggcgcgcacgcgcgcgcggcggacgaccacggccgacggcatagccggaccaccgacaacaactacctccacaacgcgtcggagattggcaatggcgcggggagagacaaaggagaactcggggaggcgcgttcttaagggaggcgagaaggcgcggcagcgaaaattttgggggggcgggggggggggggtgcgtttgagatttcggccgcggcgaggcggcgcgagggagaaacgggggcggcctactatttttgttggtgatttggtttgccttttcggcttcccctcgcgcgcgtactatggagggtttctttccgtgtatttgccccaacttttcgcgacctgccgcgcgaggggtggcttggctcgcgtagcgtcggttcgttttgggcgatttttgggcggggcgggtggtggacgcgagtttggggggcaaaacgaggcgaaatcagcgggaaacggggtttatttttcgcgttttaggcgttgcgccgcggggaggtttgaaatggtttcgaatcgagtttgggggcaaaacgaggcgaaatcagcgggaaacggggtttaggccctgtttagttggcaaaaaaaaaaatattgatcttgcgtgtcacattgaatatacgaacacatgtttaaaatattaaacgtagtctaataacaaaataaattacatattccgtctgtaaactgtgagacgaatttatcaagtctaattaatctattagcaaatgtttactgtagcactgtattgttaaatcgtggcgtaattaggcttaaaagatttgtcttgtaatttacacaaaatctatgtaattgctttttttctatatttaatattacatatttaatatttaatatgatagcgtgaaaagtttttacgtgggaactgtcttattttcgcgttttcggcgttgcgctggcgggggaggtttgaaatggtttcgaattctcgtggggtttcgcttctactgcagacatggcagatggggcccccgttgttggtggtgaccatccaggcgtagagggtgtgtggcaccgcggggaggtgcatcgtgcacctggttggttcaggagacgtgtgtttctacttgggaaatccgatagatcgttttgatagtgagatgggctcgaggcctacgcgcgctacaccctcagcacgggttttcgaggacggcaatcctcctagaggatacggcgtcgtgtctagaagcatctagtcggacccaaaccattactataccaactgtatcggtcgaaaaaaaaattacgtcatcgttcttatcaggttacgctacttttttttatttctcgtgaacacactttttaacaggttaaatgttatgttttaacacgcttttcaactggttaaatgttatgttttgagcaaaaattttaaattattatatatgaatttggacaggtattcagctctatccgtcatgtccagaagcatctagtaggactgaaaccatcatgtcaattgtcttactctctgtctaaaaaccctttattttcctatcgttgttcttatcagcttacgctactttttattttatttttcgtgagcgagcacgcttcttaaatggttcaacggtttgtgcaaatactttctattatttttttgtaaaagaaaaatagttcacttttagacatgaatgtatacaactctttcggtcatgtctagaaacatctagcaccatcaaaatcatcatgttaattgtcttacttcatacgacagaagtactttatttttttgtcatctttcttatcagtttaagctatttttttatttttgtaagcaggtttctcaaaccgttaaatagtctttcttataaatactttctattgtcttcgttaaaaaataattcacttatatatataaatctgaatagctatacggctctatgagacgtctccagaagcatctagtctcacagaaaacatcatgtcaattgtcttactccctaccgccaaaaaacattattttttatcatcattcttatcaacttatgctactttgttttattttacgtgagtacgcttattaaactgttaaatggcatgtttcatgcaaatactttatatcatcttcgtataaaaataattta

SEQ ID NO: 83469 - DNA, 8464 bp, Oryza sativa
caaagcaggcttgttctatttttagaagacgtaatagccagattcaaacaaaaacacaagaactcagtgcaaaaaaaggaatgaccatctgactagtgtattagccagattataccatacacaaggaagtccatgggtcaatactacatgaaatgtttaacagagccttctaatccaaaatactaaaccttcagctccactatattacaacatgtgtctgaggctcttagcaatttagattgatttgagaaacttcagagtaccataaaccacagatcacttaatactgagtatggcagtaaaatatatctgtaccatgaaatgagtatattaacagatgaacagaagtatgcagctagagacttaaacaaatacctattgagaccaaggactgtatagtgatgtgacatagaatacaccctaggtcctgcaggagtatatgtccgcctatttttatgttccgagtgtgatgtatctgtctgccagtaccagtcgtcccgtgggacataattatatccacctggagggccattctccctccaagcttcataacttctcctaaacttgttcctctctctgttgaaaacactttgcatgtgtcttattctttgctgcaaaaaagcaaataaaaagtgaacatactgaagggaaatgggaaaaggacctgagaagatgttgaattgagacatttaagggatgaaataggaatcatttgttcctcgtgaatgtgtataactttaattaaaacatagctcacgataatttctaaaccttaacagcagcagttacaatgtataggcagcattcatataatgtccgacttccaaattcaaagtccaaagataaatgaatgtcttggaatataaagaagttaaaaggattatgcattatttaaaacttacaactctctcttgttcctcctcatattcctgttgcatacgttggtaatatcttctcctagcatcctcactgaaacttccacggttagagctgttacttgcattcctccaagatgttgtctgcatcttattgaacttttgaaagggagacataaaaggaacatataagtaaatgatggaaagaatcaaaatacagacaagtataagcatacagcggagacataggatgataaatcagtcatctgttattggctagcttcctgactacacagcatttttgttgggataacaatataaccaaagggattccgacatatagcagggagactgagaaataatcaaataataattgaatgcaatagcaagaaaagagtttgttcctacgcaaatccattgttggagtagaactgacgagggagagaggattgacaggaatcttaccctactggtctatcataataatgctcgtctatggggtagacacattaaatttgttattgccgaactgtactacatttgagcaaacaatctattactcccaaacatccaaaaatgtaagtcatattcaatactattatgaaagcatttggcaagacaaattcaatactatttattaaagctaacctatatatttttccatgtattaatggtcgaactctcattttgggactgagggagtaactaccgactattagatgtaaaaaaaaccctatatggtgttttaacctaaaaagaatgttccaccccacaacacagatcatgtctctatactgtacaaggctcaaaccataaagttttgggggcttcgcttcaattcattctgcttgaatagaacaatcctgattagataaggagctggaacaggacatttagtttgggatgtctacatttctctactacttaaaaagtggagatgcccatctcctcccctccgcacccccaccgagaggagcgtgccccatacatacccccccccccaccccctccacgcgcgtaacgcagccacaatccaaacccattgccaatcatatgggccaatgaatcaatgtccgcatggacatattattagttcaaagaaaagcaacagtttgcatttgaccaatcaacaaacagatagatgctaacttggatacctgactgtagacccaatcaacacttctgcgaacttgagcaacctgaaaattacatggtaagaagaaacagaaaggtcaagcacaggtgatctttgcaacttgtaagtcgtaacaatagcttacaacaagggtttgtttccagcaaaaacaataaccgtatatcacagttgaacggagatgcgaaaggatttccaataatagcaacaatccttagcaacccacctcgcaaacatgaggatgggagtaagtacctgcctagcacaaggtttacccatctgcagtgctcgtgcaatcttaagatagcatttaggaccttggggctttggtcagcaaagagacatatgaagccaagagcattactactaataacaggtttaaagagccacatgcttcgttgccacaaggagctgcataagaaccactaaatccttgcagaggctaggaatgttctcagtgcagttgtatcaccttgatataattgaccgggttcaataaaaacttgcattatctttaaaaagaagcactgaaggtgccactaccttgggcatgaaacgatgcaaacagcctaattggagcatttgacgccgaattgcagatacaggagcaaatttcatcaaagcaacaactaaatggaaacagtcatgtcatcacggaaggcgtgaaactaaacaagaaagctagtaagctgggcacttgaaacaggactgtattcgtattgaatcaatcaaccaggtcatcgactatcaatcaacacaaaagtaacagactaacagagaagaggggatgctctgctcaccgcgaaggtggcggtggtggcgccgatgaggccgaagatgaggatcccccacgccttggacggccgccgctcctgctccgtccgccctccgccgccaccgcggccggcgcggtcgtcctcccgcgaggccatctccctctcccaccacggtgctcgcggccccttatctcacgcgattcgagctcgacggctaggcgcgtgggaggccaagctcatgcttcccctcggccgaattccccccgcccctacgtctccgcttcgattcccctcgcgtggcgtccgctgcggttggttggttggtcggtcggagcggcgccgcgcggggtgaggaggatgattcggagttggattgctgggcggcgcggcgcggcgaggaggggaggggaggtggaggtggagccgcgcgtggaggcaggaggcggccggggacgggagggaaccgcgggtcgtcgtgcgtcggggaggcgccaaccgagtggccgaccgtggccgtggccgtggcgtggcacggggtgaaaaaatcgtggcgtttcttcggtaaggttcgatcggcggcacggtgacgacgtcgggatatctattctgtagactgtagcatagagatcggacggatatgtgtcgtgatagcgaagccgtaagcgaaactagtttctattcaaaatgtgctcgaaggtcgcgtgtatgaattctacctcatcacttatacaatatggaaacgcaagtactattcgtagataagctctagatgtaactaaatcttactttgtctgtttcaaaatataagtatttttagaatagtgtcaagtcaaactttctaaattttaactacttcatccatttcacaatataaaactttttagcattaacatctaaataaatttgggcaatgctagaaagtcttatattgtgaaacggacggagggagtactaatagcaaaaaatttaaaaagattaatcatgtatcattaaacgaaccatcataatatataactctttttatttaaaacatcttacttttgtagatttgtagatactgttagtcaaagtagcataaaaaaaccatatcgataaacaaatgtttatattttggagcggagggagtagtagagggacagcaataaaaacttttttgtaatcattgtattttgagtaagatcttccagatcttctacttaagaaagcccacctggttttagatgattatattaatttttagatatcataagtaaatatatatcctgacatcactgtacttcaagaaaacatgattttaaatagaccatattcaccatttgatagcttttagaaacttcctagctctattaatttatggccgtccaagttaaacggtactttcaaacacaagaatttctcttcacaatatattttgtttggaaagtagaatcttattgggtttacgatgagttcactctataacccaaccactaataactattttatatgatttgttttagtcagtttaagctgtcgtctttctcgttcggattcatcgaaaaaaacaaggagaacgttgtgactgacaaatgacaagcaggtaaaacatgaagcaaatggtgagcccttccttgttgcatccgtcttctactcctctaatgtatcatattgctcacaagtaaaaaaaaacgtcgaatacattcacaattaccatcgattatcactatagcgctccatttctcgtgcgacaagcacaatgagaaggacgatgacgatggtggttgtggcacctggcctgacatgatgctctttgtttcgatcaacaaggacgacaaggagaatgacaatggcggcggcaacaataacgaaaaaatgatgcttttttctaacttgctgcttattccttacggacagacgagatgaaattggggacggaaaaaaaattgtgcttacatatatacaaatgatttagatgggtttatagcctaacccaatccagcgcgtaaaaactagctagtcaagcggtttggttcattgggatacccaggttgtacgtgaacacctctgcataaaagatcattcctaaaatatttctaccgttggcctctctacatggagaaaattgttagtgtgccatcttcaaatatgggtttcaccggaatgttgtcttgcattttgattttgctaaattaccaatttcaaatagacattgcacgttagagtgccatttgccatataaatagactgaaatgtcctcgttctctgtttctctttcaactccgatggccttgctacactggcttgaaccgtcatcgtcacgtgctgctgaaaagggacatggacgagtacactacacctagccagcccaccgctggcaccccatcgtttaattgtgcaccgccaagctgtgcagtccggcttttctatcagcacgacgtgaaggccgccatgacgcacggagtgccaaagagagacatgtgcggggagttcgcaggatgacgacagatgtattatggagatggctttgattaggcggcacaactaggaagtgatgtgggttgagctgatgaagtggagcgcagtgcatcgtcggtgagagtgatggtggtcatggcattcggtggtgctgccgacaaacacattgacgtgtttaaaggaaaggagaagtgatgttcaagtgaacttttgtttataatagtattcgtatagacaatgtttaaaatgataatttaacgatatataacaatagacggcacaactatgaggaaacccttgttgaaagatggcaagatagcaattctatcctccaccttttgctgccgctctcgccataccgactcgtgtcgcacggtcgcgcagtcgcaccgtcgcggttcgtcccacgatccctcgtggactcgatccaaccgctctcctccatcagtgcccgagtgctagaccggtgggacccaacgccacaccaccggccgccgccgccgcgccgccattcgcgatgctccgcgccgccgtctcccgcctgcgcgcgcacctccacccccaccctcacgcccaccaccaccacggcctaccctccgtgacgcccgctccgctccgctccctctccacccgctggggcaagcgctcctccccgaccgcgtcgccgcccgccgactccgacgacgagggctccccgcgcggcctctccctgctcccccgcgaccctgagcgcccgccgcggctgctggtggtgcagccgcgcctccgcccgggctcgctcctcgactccaagctcgccgaggccctcaacctcgccaactccctcgaggagccgcgcgacggcttctacaaggaaggtctcgccgccaagggcgccccgccccacctcgtcgcccagaacccctcatcccgcggccgctcccatgtcggtatgtggcaatcttttgttcatttccagcggttaactcaagcgggagtgtatttaatcgtaattgtatttcgaaggtttaggtcttttctgcatgccggcatgcgatatgcagcgatttttatttaaattctggcacacctggggtttgttgtgataagattattagacgagcacttttagcattgtatgaatgaagggcgaattgtaaggcttgaatctgattgtttgaattttacttataagattattagattagcacttttagcattttatgaatgaagggcgaattgtaaggcttgaatctgattgtttgaattttacttataagattattaggttagcacttttagcattgtatgaatgaagagcgaattgtaaggctttaatctgattgtttgaattttacttatagactgagctttttggatggcacatactagagggctgtgcatacagagttgggtgagatttgctcatgagtactcatataggcgcattactctacctattcttctgtcttgagaaaacgggaaataaggctggctagattggcttgaggttatttctaattgcatctgttaaggttagggtatgcttagtgatgcaatacattctatagatctgccagttatttttactggaaatggtataaaataagtcatgtttctttggaagaccctcattggcatttctatgttgctctgaagatgtggttgtagtacattttcttagtggtgaagttgatttgtacctttgagtctttaatcctttcaaaatgtcaaaattattttctcctgaggtgctaaccactttcttgctaaatatgcgtagttttttgtttgcaatgtttgaacttcataacccagactgaattttctagagttcgatcaataagcaaataggtgaagtcttgagcttcactggttgacacttccagctgtgctatcaagtaactttatttgttagaactttttgccagcatttgtatagttctatacttctgttcacctaggagagtctttcgtcggcttttcttggattataggatttaaccttatgtgacaacttgtcatacagataaattttttggacctggaactgtggataatgttaagtgctacctgaggacatcggaatcagaggtgcactctttatttgtttcttgtacataaacatgactacggtgtaacttcatttgtagttttacaccccggatgatccattatatattccatttgtgttgtgatcgcacttgcttatgctttcttttctattgcacggtcaattccgacatgtatgatatatgaaggaaaatattccagtatgccttaagcgccatttatctggtattcctttgaatctaacaggaaggagtagatgcagtttttgttaatgcaattctcactggaatccaacaaaggaacttggaggcaagtgctcctgcttattttttgttagattttgtcgaagtttcaattattgtgccgcattctgaatttctgagcctcctgtcctttttgttcatgatgatatcttattttgcaggttgcctggggtaagccggttttagatcgtgttgggcttataattgagatatttaatgctcacgctgaaacaaaagaagcaaaattacaggtccattccattttgatatctgaccaaaatgtcactcttgtcagatcttttgagtgcatgtatatggttctctttgatgcataatattcatggaaatatgctgtgacatttggatatttgtttaattgctctattgttttgcttggcacagtcagagttagcagctctcatgtacatgaagactagacttgtccgtgtccgtggtccaggtggacgattaacttttggttcgagtggtgaagctgaagttgtaagtgctcgagggtatgtctgctcttaatcatagtcagcggtggtaaaatattgtttgatgaatgatgagcaaaatttaatgtggatgccatctttggtacaatgatattgtaatgtcaaggatgaactttaacctgtgctggtccacattttgaaacatggtaaacttgcatgttcttgtagttgatttcaacctgcaagatttcaacatttaaattgtacttatacacttatgtagtgacatcaacattgctctttgtttatatcgtttagaattatgaactcattttttatcatgcacaactggataatcatgcatattcctggtacggttgtaactgcagaagatgaaattcccactataagaaaatgatcactgggctgcagg

SEQ ID NO: 83470 - DNA, 5405 bp, Oryza sativa
acttgtctcagctgacatgatagtggcatttcctctgatggtttaattacctcctttctgatcctggatggaagcctaccgcctgttccagctttctttatgctttcaactacctcttttttacatcccctttgttgtgctaaactcttttgctctttctgattcaagagttttcatgccttttcttactagcaaagaaatggaaacattatgtttgtgattatttatttttgttttaccatatcacttatcaaatatccaagctaactaaaaatccttcagctagctatccagaaatcataccctgttaatttgtatggatgttgaggattttgcattgtgccgtccccaattttcctacgatggaacaactctctaaccgtgtttttcaataattcttacgtgatctttgattccaccaatcaaatatttcatattttatgttctttcctattgtatatgaatgtattaagtggctttttgggaatatctggttataaagggaatggccaaagaccatccggttcatgaaagaaattgaaatttttctcatttcctttttcaagagaagatagccccaaaaatctagtagggatttgttgttctagatctgcagaccgaatttgttgtttggtatatttaccatgtttgctgtgtgtgatatgtagctgagtatctaacgtcaggaatttacttgctgcagaatgcttttagaacaaaagcaatggaggttcaccctgatcaaaatcaagataatagaggtggctaacaactccatgctttttttttcttgattcgtcatatatatgtatcgtgttgttatgtatccacgaataccatgaacatcttatgttgtgcagaggctgcagaagagaggtttaaggaggttgtcaaatcatacgaagcaataaaactggagagaaaaaatgatgcaagttgaatgtgaatatgtagcttcactggagctcattgggaagattgaaaggatcaatgaagacagtatcagcaggccttgcaatcaagtggatgatctgttaggttcggctgtatctgttgatagcctgtaagcacaagtttttatttgcgagtttttttttttgggagcacacggccctgatgtagactaggatattgtcgacaaaggtgcaaaaggaaattgctcatttgtgcttagccactaatttggggtgcaaaatctggactgcgggtgagcatttttgttgtgtacacctgctggtttattttttattagtagaaagtagagtgaagatctgatagaaaataataagtagcccataatattatagcagaaaaacaatgtttattacgacttactcagttactctgttgtgcattagagctgtggttagctcaaaccggtgctgcctatcatctatatgcgttaaatgatgcatggatatgaattcggtttgttacagctgaccctgttgattctgcacagcagatcgcagtatcagactgaaattgtgagtgcaatctagccataaaccaacatgtcactttcgaaatgacaccgtatgatcatactctgatacgtggagagtactccctccgtcctataaaaaatgaatcttcccataaaaaatgaatctgatttatagtaatagaatatattaaatctggtactaagttgttcctataatcatgttgccacgaaaaagaaaaataaaaaatgaaccaaaaagaaaagaaaaatgaaccgggcaagcattctgggcttgcgcagttgcgccacactgccacagtccagcccaccatgcggcgcctcctctccgctccgctgcgccgccgcctatgcacggcggccgtggccgcggcggcgcccgacccggccctcgcctcctccgcggagctcgcgtaccgcctcctccgccgccaccactccgaccccaagaggctcaccgccgcgctctccggctcgggcctcgacccgacctcgccgcgcctcctcgacgccgtcctccgccgctgcggcgccgcctccgcgctcgcgctccacttcttccactggtgctccccgtcgctgccgccgccggggccgctcccttcctccctcgcgctcctcgccaagtccttctcccgcgcctcctccgcgccgtccccttccctcctcgcgccgctccccgcccagctcctctccccgtccctcctctcccccgtcctccgccgcctcccgcccccgcgcctcctccccttcgcgctctcactcctctccgcgcgccccaaccacgaccacccctcgctcttcctctccctcctcgagtccctcgccaagaccggccatgtcgccgtcgccgagcagctcgtcgaggagctccagcccaggctcccgctctcgctccgccactacaccgcgctgctctacgggtggtgccgcatgggcaagctcgacgaggccaagcacgtgctcgcccgcatgaaggccgcggaggtcgccccggacgtcgtcgtcttcaacaccctcctcgccggcttcgtcgccgacgggcggttcgaggacgcgttcgagctggcccgggagatggagcggcgtggctgcccgccgaacgccgtgtcgtacaccaccctgatgcaggggcttggcgccagggggagggttgatgaggcaatgcgggtgtttgtggaaatgcgcaggaaggggtgtgcaccggattccgtcacctatggcactctggttactgcgttctgcaaggctggtaggatatcacagggatatgagttcttggacgtcatggcaagggagggtctgcgggtggacgccggcgtgtacctcgggttcttcgtcgcgcacgagaagaaggagcagcttgaggagtgcttggagttgatggagaggatgagggagtgcaggtgcccgccagacctcagcatctacaatgtggtgatcaggttggcctgcaaactcggggagacgaagcaggctgtggcattgtggaacgagatggagaccaacgagcttagtcccggggttgacacatttgctatcatggtgactggcctcgttggccaaggcgtgctggttgaggcctgcggttatttcaaggacatggttgggaggggactctttgttgcaccccagtatggggtgctgaaggacctcctcaattcattggtcagagatcagaaacttgagcttgcaaaggatgtttggggatgcattatgaccaaaggctgtgagctcaattttggcgcatggacaatctggattcatgcactgtacgcaaagaaacacgtcaaggaggcctgcatgtattgcttggacatgcttgacgctggtctgatgccgcagcccgacacatttgcaaagctgatgaagggactgaagaagctctacaacaggcagattgctgctgagatcactgagaaggtgaggaagatggcggaggagagacatgttagcttcaagatgtataagaggcgtggggtgagggatcttgaagagaagcctaaggcaaagagaaagaaagggcagaaaaggagtcgcttgaggcaggctggtcagaatcaatccaataggcatgctgacaaaactgacctttttgatgattttgatgatgaataatttcatgcaaggactagtttttgccttctgatagttgctctatatagtttcgacttattactctagatcattctgtgtgaggtttaatattttttttcttggggaatcactggatctagattgtaaagttgctaatccaaacaagtcaataaacatgtcacaaaaaaatatattgttttttttttcatatgcaactagagcgaactgtaaaatcttacacgtgcagagaaataggtagtctgtaatgatctactttatgtctcttaagttgttgcatgcagtatgattgtgatcataagtatatctcattgtaatttcaatttgtgataactggtaggttgatgtatacgtagcagtatttcttttcccaagtttgatgggcattgaatttctctggtttcattatatattgtagtttaaagtatcacgaatagtattactttaagttacatttgtttaagtatttcttaattgaattcctcccttaagaaatacggagtactgcactaaagtaatgttctttgttctagggtggtgaggagccgaagaaacatggtttggttttctattgttcgtttggttaagccaacaaaaaccagatcgggtgttttgactatgtgtacctgcggaaaacgttggctagaagaagaaaatgactgtttgcctgaaaattgggatgaatacatacatttgtcgtgtagtaagaccccccttaaaacgcacgatagaaaaacacaataggttcccggcgaaaaaaaaacacaataggaaaaaaacgtaataattgaagtattatgtttttccaatcctatgaaaattgagaaaaaaatatatataaaaagatgagtaaattacacccgcggtacatgaacttgtgtggtgggtgcaaatagatacaacaacttacaaattgctcactttgatacaataacttggctagttggtgtgaaccgggccaaaatgatccacacaagtaaaattgctctaaattagtgcacactaatgacataacaacatatacatataactgtgatttggagatcttatttcgaatccaaataaaaatgtgcaaaagtttatttttcatgtccatggtacaatatttgtttcattttttggaaaaatttgatcatctatataactcgtctaatgtttatttatctgttcaagaccaagacaatttttatatgtactattaactactaaaagaaaattttaattttcatgttcatgttctgacactttcatcgaaagtgtattttaacaatcaggtatttttaattattttgctttttcgttggtctagatcttaaaagtatcatgcgactaataatatgtgtcagtaaaaaattttgatgtgtaacaataattacacactagtacgtatcatattacatcaattttacttgtgtggattagtttggcccatctttgtatgaactagccaagttattgtaccggaataagcaatttacaagttattgtacctaattgcacccaccatacaagtttgtgtatcgtgaacgcaatttactctaaaaagatggactctttgattgcatcacaggaaacattcaacaatcaacgaagaaaagtttcacaagagatctaacctcttatttattttcatatggaattgaccataggaatggaatcctatggaatcaaaggactctagaaaaaaatccttcaaaattactttgctaatcctccatttcaaagggtccctaaattaccatttggacaagatttttaacaaagtttcactttgaagtctttgcgctattctaaattctatattttatataataaagctaaaagt

SEQ ID NO: 83471 - DNA, 1534 bp, Oryza sativa
gggccttgggcgtggcagcgccactttcgtaggctccttcctcgggccgtggcaggggtgcgggggggcgtgggcgacgacgtcttctcttgctagttgctactgatccgtgctcgtaatcgtacgtactgcccgtttggtcgggtacatgtacatgtactagtacgtgacatcttgcaatccctaaaagacttttttttttggaagaaccaaaagatagtgaactgcatgagtggaatcctataggatagttaacttgaatctgcaaacatcttaccaccaatcgggagattcagagtttcattatatgcagatgttgttgccctttctgtcacccctacatacttaaatcttttcgcttctgtaagtgggatgcacatttatttgcaacactcaaaagtttctgtaatttgctgatggatataatatcactattataggacatcctttaaaattaataatttgcctgagaacattttcggttcgattggagagaaaaattctttaaaaagacaagaatgcccctatgaccaaaatcttttaacctatagtgctggagtgaagatgaaatatgatgcatattctaatctatttgaaaattttatctctctaacagatcgaaagtgtcctataacatattactatttgtttatgtcttttagccatcacacgtttttacaatattcactagtaaattacataatctttgagtgacctatagcaaaaattgtctttaaaaaaaagagagatatacccaatctcctgcaatgaactaaatgtagaggcacgctttacaaattttcctggaaaggtatcaacattgtcatgcaaatatctagtacattatcaaccactgactataaaggtatcaacattgtcattgcctctgactataaaaagctgaaaaaacgattatcaaccactttttgacaagtttggcttcaaattagctggatggttaggtcgcttcttcacatcgtctagcagaaagacgctagtaaaatcagttcttaatgtcccgcctctctgataccgggtccacttacatctggcagcttttataggttataaactgctctcacaaactaacacaaatcttttctgcacactttgtcctcactcgtgcgcacttgggaagaatttcctgatcggtcgcccatcccaaatctgctccaagctaagcatgcttaaccttagagttctttcgagatcggcttccggaaaagaagttgcaacttgttgatatgagtattctattaatcctattaatccctgggccgggatgtcacagcaagagaataggctggattagaggatcctttctttggagaagtgatgacccacaaaatgtcagtggaggccacttcttgattaattggttccaatggaaagatcccgaaaaaccatgagtttatgaatattccctgtgataaaatagacaaaactttttaatgcctgcaccttgatcaccgcaagagatggagagaaaattaaattatggaatgattactaactgcagaacggggtgcaggaa

SEQ ID NO: 83472 - DNA, 2872 bp, Oryza sativa
  unsure (1)..(2872): unsure at all n locations
ctgcaccccgcagattctgaacagtgctcgtctctataccatcatgtattacatacttggttgtggaggacacctcggctaatggattgttgaggatatctcggctaatggggaaaatatgcgatggaaacaacatatgcagtggaaacctgaaaactaccgtcggatcgaaaaatggacgtctgagattcttccacgttatcccgactaaaaattttactcgcagatatactcatgtagtaattttttttatcatgcgtctattttttatctaacaatcgttttcaggtttccactgtatattttcccaagctaatgagtaatgaaagttagggtttgattaaaaaaataaacaaataaatctcattaaccgaaaattgcaacatactccctccgtcttaaaatataaacatttttggttataaatctggagaactatgtgtctatatttatatatagataaaaattgatatattttgggacaaatgtagtatgtaaataccgcgatgggtctatgtgcgtgctacgtgtgcaacttgtctctctagaactgaaaactgctaaatcgaaacaagctggggctactgggctttacacctcaggaatgaatcgaactgtcgtggccccataggcccatagcacccatgggccggggccttcacttcattttctctaccatagtatcgccgcaagagaaaatcacgcgacggcgacagagaaacagcaaaatcacgcattacgcaccaggagaagaacgaattctcatcgagctcgattgctcgtagtagtactaataacagccctaaatcgcgacgtgcgcggcgcgggggcgcaagacaaagcatacacaaggacgtgcagggagtaggggaacccgtcacctgagcctgtccagagtatacgcgcgcgcggccgggtacaccaccctgcacgcccccgcggaacacggcgaaaccccccgtgttccctcgctgcctctcccggccggccggcgatggatagggcagcngncacccccccccccccccgccccccggcgcagccccggaggatgcagcactgcacgttgggtgtccaagtactctctccattctaaaatacgattactttaatctaaaatggattaagactctgttgagtttgtgattcaaattcaatcgcacacgtaagctgtcattcggtgttgtaatctcacctgatataatgaagatatttgctggctgatgcccgtggttttttctctcttacttaagaaaaatattccatattaaatctcgtgtcttctattattaatctattattttttatcatttatttacctatcgttttctatcagactcatcgtataattatgaagctggacattgacggcttctggccgatcgacgtgcgagcggtcgccgcatttacgcgcgcggtacgacaaattctctcgcattcaaagcaccgcggcggcgcggcgcttgcgatctgagtttatcaaactacggcgtgtggtggtggccgtcgacttgatccgtcggtccgcgtcagactacggatgcagcagtgggtgcctaccgcctttagcttcctgcgtaacctcgcatgggatggcaccccacccacccatgctgcagcgccccaaagcccacatgggccaccatgatcgcttgtagggaatgatactgccggccggtgtgatgcgtttacctgcgtatgcatggcatgccccagtcgcacatgagatagcaatagacttcttctcccagaaaaaagaatatcagagagaagattgcggtactagatatgtgtattcatgtttagaaatgtacactttatttggacgaacacacacatacacactttatctttatgagcatatgaaaaatccgaccaacataactttaaggaaatcactatggtgtcgatgactacattacttattattgaaaattaacggtattaaatgtgtacactctcagttccaaaataaaagaattaagtattagatgaaatattttatgatacaatgaattcagacatcctctatcacgattcattatactagaacacatcacatctaatattagattgattttttttgggacggagtgagtacattcatgtcttcaatgctccatacatttgaaaaaaatttagaaatatacgtattttctgtagaatttgcaagaaaataccgaacgcgtgaagatttgcaaaaatataccgccgtcgcggtttcgttgagcgagaccgcggtcttacacgattgaggcgcgagaacgagagcagtatcgctcgttcagtcagcgaggacggagcgcacgcggtggcctaggcggtgctatgatatcgctttgccgaatagcgagagcgcacggtgtcgcactctaaaagtgcgagagcgagccggtgggcccccgcaaatgttgcgactgcgacccacgtggtctcacgctacaggaacacgagagcggtgggccccctgactgcgatggcgcggtctcgcgctagaggaacgcgagagcggtcaggtgagccccactgcgcgcctaagggcaagtgctatggtagatgtgactaccaccttcaaatttatctattttatttactcatgaactaagaggcaactcatacaatgtatcacctctaatacacaaataccaatttctctaatactctcacatatttcttgaaatttgtgtggatgttgcctcttaatttagaggtagcttatcttctctctcctcacttctctcctccacctcatcactcaatctaatgtggcactcttaggggtaacatatgggagactatagtacttgccttaatggtgttaaggttaagttaattacatagaaaacttcgtataaaaataaattaatcacgc

SEQ ID NO: 83473 - DNA, 2142 bp, Oryza sativa
cgatggtatatttatgctaatcgaacaacatccagtatatttctgaaagaaagatcaatgaacagtatattttcaaattttattcccatacatttaacgaacattcaaaacgcaagaggtaggcataatccatctctctcccggtctcaactggactcgatcgacgacgcaggttttgactcggcatccctgtgttgtgaggggccatgttggcaactaggcattcatgggccacaatgtcttcggtcggttttgcaagttaacgatgcctttaaatgggtcaacgagaggggggccatgtctcggtcgcgaaactgattccgcgagatgaaggttcagtacccgtcccggacgagagcgagtgagcgacgacgcccaagaaccaacaccggtggctcgtacaaattattacaactggtaaggtggcacgtataattgcctcagctaattatccctccatttacttttgatagtcatattttatattggcacatagatcaaagataagtaattccatttatcatccatttaaacatgctaatagtcattcctcgtaaacaaacgattcattaatatttacatttctcgataccatgtagccaatcttgtgtggagaaatagagagtcacgcattaaatttaagaaaatcattaaaatgatagattgttggattgaaatatgcctatcaaaaataatttttttagatttaaaaatatgactatcaaaagtagatggagggagtaccaatacgaaattatctaaattattttacacgtaaatttatttgaattttattaaatagtaatctcgttgtcttagtattttttgaaaaaaaatatcgaatttgatcatgatcaggttttcaattttatactttctccatccaaaagtcttttactattttactatttgcttttttttccaagatgagttgagtgtatttgtattgtgcatgcgttaaagcttttgaatccacgtgactgtttgttaaacatgcatgaaagtagccttcttttgcatgaggtaatccatctgttgcactgttttttcatgaacgcgcataagacaaagtttaatagtatagcccattattagctctaatttatctatagccaatctaatagccaattcatataatagttgcttactatactattaatatatggtcccacctgtcatacacacattgcgtcttggagtccgtgttgcagctggctacagatttatagcctgctgctcttctctcttatcttttatctcattaaaatatgtttacagctagctaatagcctactattatacctgctctaagatcgtgcataagggtttttagcacatactccctccattccaaattgatctacatatttcatagctacaccaagaccaagaaaagctaataactctctcatactatatttactctagcaacaaactcaatgcatgcaccatccccaatattttctagccaatagcaaatcaagatattgcatgtgggttataaatacttgtgtgcatggatgcatgcatcaatgtccatttactccaatgcacaaataacgaatagactctaataaatgaacacaaatatgtagatcatttaagaataacctcaaaaaaaaactagatgtagatcaatttggaatggagggagtaccatgtttaaagagagaagactttaatgctccttaataaatatgaaatggatggagatgggagggtgggtaggggtaacatggaaaaagaattaaatgcaaaatggttgatgagacaagtagtaatatgaatagtgctaaaattccttatattgtgaatcatgatttaaatcctataaatttttatattttaaaatggaagaaggatagataaatagatagatggagaaaaaaaatctttactagagatatgtataagcttgaaatatattttcatcaaatcttaaaatcttaaattcaaagtcaactttatttaagagcaacaaaatgataaatttatagtgaatagtaagagggaactattcatatgaaattgatttttttctcttaaatgaaattatgttggacttcagatttggtatcgacaaatttatagaacttttaaatatgcgtgttttttccttatttaatacttggggtgcaggaa

SEQ ID NO: 83474 - DNA, 678 bp, Oryza sativa
gactcgacggcaaagctcaagctccccgacaactaagccagcaactgtccctttgggtgcacgatgaggcaagtcataccaccgatgcctgaattgtaggtaactgtccaggaactcatgcagggaagtattctgtgccactgggaaaaggtaacgataagcattaggaaaccattggtaaagttcaaatgcacgcggatttattcataagttaaattctaggagtgaaacaatggataatcacagatctaggcgtgtcctcaactcaagcttttatgttgactcatctactcgctcaattattgttcaggcttagtttgcataagaaaaaatgccaaattcctctgattgtagggtagttattcctgtcaatctgaagttcctgtcaatctgaagggactaggattaattccttcccattaaaactatttcaaaggatcataggtcatgatagtgataagaatatgattgcataggctttgctttgcttatgcaactactagccacttcaactgcaaatgtagtaataaatttaactgcacgcattttatcttgcgcttaaaagtgcaaactgacatttgaacaagcatacactagaattttacacataatccgtagccttagataatcacagagaccgaagcatcagaagatgcattcaacaaacacaattgaagc

SEQ ID NO: 83475 - DNA, 672 bp, Oryza sativa
ccgatctactgtccacatacccataaatgtgtcagagcgtcaggtcggttcttggatggcataataaacgcgtggaattagcgagattgcgacgtatatacagtagtcatactagtagcacggccgatccacaggatcgagctgcaggcataggctgccacagtgccacggtatcgtcagtcatgctgcactgttgatagtacaagtagtagtactcctggccaccgacatttctgcactgtccctttctgggactaatgcaaatgggaattgtggaattggcatctactagctggtatttcgtgtaggcagaaataatgcatattgctcctaaccacctctttagtactccggagtacatcggatgaaccaacaaaactaggattcttttgaatcacacgaattttgtaaaaaagaaagacttggaaagaaaatcacatttcaaaatgggttcagtcagtcagatgaccgttttagattgatgccaaaacataccctataaatttatcggtagctcagatcataaatgtgatagtttggtttgatgtcaactactcctatttggtaatgcctatgctttatttgacacaatttttaggtggtgtttgaatctagggacttaactttagtctctatatttagatcctaatttagagtattaaatatagacta

SEQ ID NO: 83476 - DNA, 664 bp, Oryza sativa
ttttttaactgcctccaagaagacagtgcgtgtagtgtagcactgtgaaaacctctgatgaaagtggagtacaagagctgctgtgttttgtgtggtctggatctttgaagtttttgaccaagggggtgtttgggaactagggactaaatttagtccctctcaaaaaaacataagtccctcaaacataagtccctaccacagggagggacttatgtttttttagagggactaaagtttagccccaatttagtccctccaactaaacaccacgcaaagaaacaactccccatgaatgatctgaatctgattcagatggctgtggatgaccaacccttgcactggattcctctagcccctggtgactcgtcgtgggcggtagcaactggcattgcggtcaaaacccaaaagcgctgcacaagcatgacatgagaaagagagagacatggtaaaattttttttttcatgtactgatctgttgtgttgggctgtcttgtgcctggcagcaaggtaaaaaaatgggttcaccgcggttcacaggggcatggctactggtggccgacgctgttggaattttatagtgggcagtaacatgcccagtcactggcttgactggtcagcagcattttgtattggcactgtgaagtggtgcagtagtgatggaagc

SEQ ID NO: 83477 - DNA, 659 bp, Oryza sativa
tgggctcgcggcggccatctcccgagctcctggcgcgggtggacgcaaaggcggtggccgaccggagcggcgccggcgtcgaggcgcatggcggcggatccggcgtcgccaccaccggatctggcgcgctcgcagctggatccggtcacggaggcgcgggcacggcgtcggcgaggcgtgggcgctggcggccgcgacaggcggtggcatacgcgacggtggcgcaggcacgggcggccgggcggcggcgtcaggcgtgacggcggagcaagcacgggcagcagcggcaggctcggaggcgcagctgctgtggccggtggctcgatgcctggcggcgacggcagcggtgcccccagatccgtgcctctcggctggatctggaggatgggagcagtcggcgacggcgacgacggtgtggcgacggcagcggcggtagttggccgatggcagttggcgacggcggtggcggctgtggtggctgccgtgtcatctggcaacggcggcggaagacatggcgtcgggctgctagctgttcggtggtggagggcgacggcggagcagcgatttgcagaggcggcggttggcgtcggtggcagcggcgacggcggttatgactctggaggcagtggcgacgtcggcggcggggaaggagtcggggg

SEQ ID NO: 83478 - DNA, 688 bp, Oryza sativa
ggcgactgacgcgtacacgccccgccttgtgatcatgagccgccgatgacacgcgccgcccggctgggcgcccaaccaggaaacgacgagagatcaccgagcgcgcggcggcacgtcgttttcggcgcggatacgcggtcgcgggggcggatgctgttgccgttaactgctggggggccgggtgtcccgtactcccgtggcgcggagccgagcgagcgcccgagcgcgcgtacgtcggcatcagattcgtgcatgcgcggcgcttgcctcgctcgcctcacatgtcctttcgcgagtggtagcccgtagctagggagggcgcgatatactcctatcgaacagtagaggccgtaggcatgtcgtcgtgacaaggaggacgtacgatgcggtttgttttcgactactgttcaacggtgcatttctggtgatcgatctagtcacatctatgctcatccacttacagacaggatcgcttttcagggaattatttgagcaagatttctacactactgctttactacttttcggtcatggcctcattggagctccggtgtttctgtgtcaccgaaagatttgtgcatatatattagcttgtacacctagtgccctagttactgcatcagtctgtgggatgcagatcgtctgcagtactgctcattgatatatggatcccacagcctcttaggtc

SEQ ID NO: 83479 - DNA, 632 bp, Oryza sativa
atggctaactcacctccaccaaaacaagcggtatggtactaaaaatattctgctcccccggcggctctggtgtctcttctctgctttgcaccaatctcctgcatgggcctatagaagcagcactgttgggcctttcctgacgctagccacagcccacaacataagtcccattccggcccaactataacaatccacaatatactacaagtctgtatcctaaagtccaaatagtcgtcgcatacccgtacaatgtgaaccatccaaaatggaccaaccacatgtgaagcattcttccggaaggaataagtacatctgagatcccttaacttgtcaacgaatccgattttcgtccctcaaccagaaaaccaaatacaacggatccctcaactgtcaaaaccggtacagattaaatccctcgacggttttgagggcggttttggctgacgtgacgcctacgtgactaacttgactcagtattcatctgacgtggcattgacgtggcgcttacgtgacaattcgatctgaaaaaataataaatctagtgggacccacatgtcagcctcacacagaaaataataaaaaatagtgggccttacgtgtcagtccaactcacccttcctcttcttcctcct

SEQ ID NO: 83480 - DNA, 6493 bp, Oryza sativa
agaatagaataggaaagaccaagaactttatttatctgagaaatatcgatctaatgcaaagttccaaactaagcaaaaggtaaactgcttgccaacagtatagtcgaccaacgtcctcctaggacatgctctaaactagccatacaacttccgttgtcaaagcaacttattagacagacactacaaaccattggtcatcaaccaaaggtcgccatttagcactggatccatccgaggagacgaggacctagaccgggtcaacaccctagtcaagctattggcgttgtagttaagtgggaatcgtgcctattcacagcatctaccctcgggcttattccgctagatttgcctccaattttccggtgtcctcgcaagacagcaggttccaaataatattgagaagatatgtgcacaccaaaggcaaccatataaacagtgtcgttccaccacatggaaaacacttcacatctttcactgggccaggtgaaaaatatctcaaattattgaacctcgcaactccacgattccagaaaattgaggtataatcatttatctccaaatcaaaaaagcgtgctctcaaccattgggaaagcaaaaaatgttgaccgtagtccaaccatactctgattgagatgttaagccactagggggaaggtacaatgaatcccaaacacattgtctaattccacacatttcaacgactcggaatcccattcttgagtgtgatcatagggatagagtggtctacattaatgcccaaagccatacaatagtcattgaaggcttttaagttaaatcacccacactattatctgaatcatttcatgcggttctcagagaacgcaacacgcaaacggacgatatgcgcagtgaattcggcaaaagcatggatctcgtacaacaagtatacgtgactccatcttgtagacacatcgatatcaccaattttgtatggaggagtgtaccagtaaagagtggtcttacccatagccatggatatttaatttcccagaattttcatgcattaggtgattttctgttatttacttggtcttatttggcattatattcccaatatttatgccactcagaaaaacatcacacataaatgcaggaaaataaacccatcataaagcttccaagggggggattctacactatgtgaacacaatttatggaagcatcataacctagaaaaccatctctagattatttagttggaattgcatcaattttaaaagcaaagcaatgcttaaaaaacaccattacatggttatttatgagtcgggagacccacatgcaaaaccaaactatatagggcctaagcaacaagacatagccacacaaacacaattaacataattgggctatagcgtaaaatcccaacactccggaggcttaaacgcaagttgtcaataaaccgaaattaatcgggccgaattaccgttcaggccacgatcttatttgggctagcaagcacagtgtagcccaaaatgcctaatgggtcgaatttccaaaaactctaaacccatgaggatttccaggtttattatttttattaatttgtttgggctgtctcgttactattgggttttattcggttgggcggaggcagaccggcctagccggttcgcctaaatgactgagaaagaggagggggaattagggtttcccctttcctattcattgtccgcaacggcgtccaccacccggcacactggcccttgggcacggcggcggcgttggaggccgtcaactgtcgactttgaagcgatttagggcggcgcacggcgaggaggtcatcgatgacccatccactaccccgattggcaggacggcggtgacgacatcactcccgtgtggcaatttggtgcggcggcggctcggtggcacacgatggagctccgtgtcgacccgtgcatcctcatgacggcggcgaggcgaactcaacgacggcaactgagaccccaacaacggcaaccaaattgcatccggccatatcgtctcggcggaggttaatccggtagcagataaccgacgacccatcatcctcctaccacggctcgacggcagcgtcgatgggaggtcaacggcggcggcgcctcgcttcggcattaactccggcagtaacggcgacattgtcacaccctaaaaatcctaaatatataaattgttgtttaattggaattattagaatttattttaaaagcctagaagagaagatctagttttaattaataaattccaatataaaatggggccagataaaatttcattaaatactttgcttaattctataattcctagatttttctgggatttatttgagctaaggaagtatttttaataaatggaattgcatttcatgaataatttaaattgaaaaagtttgtttaaaagtcttcttttagctttgggccgaaagtcggcccaaaaccctctctctctcctcctcggcccaagccggcccagtcaagccgagccgcccgcgcgcgctcgctgccactgacaagtggggcccacctgtcaggcctgtcgtctacctctggccggccgccgcccgaaccctagcgccgcgccgccgtcgtctctttccaaattcggcagcccctttccttttccggtgaaatcaatagaggggaaatgatcttcgggatctcctctaccttttctcttttggaatcgtcggctaaaatcgtttggaaatccgtggattcgatctcgaatcggattcgtctctctccccgaaccctagaccttccttcgccgtcgccggtcgccgttggccttcgccgccgcctccttgcccctataaaaggacccccaagcccgccgttacctgccgccaccctcgccttagtctctcgtcgccggtaaaaccctagcaccgtgtagcctcgcgccgccgtcgtcgccgccgctccagccgtgcgccgccgtcgctccagtcgtcgccgtcgctcgggaaggccgccgtcgtggtcgccgtcgcgttgccgtcctcgtccgcccctccatcgttgctgtagaccgccggagcaccgccgtcgtcgtcaagccgaaggttgccgccgcttcttcctcgacgccgtcgccgttcgttgatcttctgccgccgttttggtcaccggtgagttcgccgcgtcgttctctacatgctggtgccctccgttcgcgtcgtcacgccgtcgttcgccggcgagcttgtgcgcccgagccgccgccggtggtgacgtcaccgctgacgtcatcgttgccgtccgtcgtggtccggccgtggaccggtcgatctcggccgttcgttttggttaggatcgatctcggccgttcgtttccgtgagccgccgccgtgcacccggtccaccgcaaaccctagccgctgacgcaataaacccctttttccttttcaaaaataattcattattgcgtcataattcaattaaaacccatataagtgttttaatccgatttaatctctaaaaattcataactaattcatcttagctcggatttagttggttcaagtctctaattttttctaaaattgagatctacatgttaaaaatatccacatgtactgttcatgcttgtttatgtgctgttttggtgtttttgctcttttctgtttagattccgacatttccggagagtttgttttcgcaggagaagaatttgaagagttccaagggcagcaaggcaagtcacacagatcccaaacaaccctttgaacatgttgatcccgtttaaagctattgtttctattcaactattgcatttattttcgaatgtcattgggtggaattaacctattgtttggtatagtccttttgttcttgattactttattccttgataacttgggttattataacttgactagttgagttttatatattggttcagctagatattagatatgattgcttagccatgcttagaaacattagcacactattgggataacttatgactcactattatttaatgatggcttaatgatagttcgcgatggtcaatcgtgattggttaattaattacttgccaactaaaacttgataatggtgggttgtgagtacatggttttgagagtcgtgctcatgacaattaaggaccggttcacgagtttcggttgtgaaacattaatcgtgccaaccacaagccagcgtgggcaacggctttaccttttgtatagcatggttcattgcagagcaccagactgagaagtggcggagataagcccacgggggtcgctggggagtccatgccttgtttataagggggtgattatgatccaggaaaggtgcgctgtggtggattgtgttgtgcgaggggtactgtcacagctcctttccgaggtaccgtggtggtattgaggcacatggtgacatgttgtggggctgtgtcttgtgggtacagtggtacacctctggctagagtaaaactattcgaatagccgtgcccgcagttatgggcgggtctaacaatgtctttcgtgattagtctcacacttctcaccataataaaagatgctataactggtaataatttgattagctcctagtttggaatggtatattcctggtttggagatagaactgtgcagccaggattggttttacagaatgattgggcctatgcaacagggtatgttgtatagcgttggattaatattgtttaaattactacttaactattttattaaattctgaaatgtttattaaatgctgtttatgcaaatgaaaccctactatgccatcatttgttatcctgtgcacttgcatatttgctgcgtggcttgctgagtatgtcatatactcaccttgcaatcattcatcagaggaggagttctacagtgatgctgatggtgtggaggattaggtgtagccctggtcaagctgcctgtggagtggagtcgtctgcgccgtttatcttatttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacagacatgggtttagggctttttctgagacggcggtttcccacgacggcatcgacgcaaggccgacggcgtacccaacagcgacagcgaatgatggccaacatgtctctaagtccgactacacagactgagaatatgtcaccgcgttcccggcgtggtgtcatcagagaaagagagaaacaaagtatcccatcaattcggccaattcggcccagccgaattaggcacgtctccagtccagggtatctcatcaattttagtgatttctctgacacggttttctccagttttcatcaaataaaatagatgcatatagatcaaaagcaggaaattaatctaccactagatcaagggcgggatcaaatctactgcaagtaaagcatctataatatgataaaaacgagaaaatataatcaatctataaaaacatatatatatatagatcgcataccttaatagacacatgtccggatgtatctatgaattagtaaattagtttaggaactaatcttactaattaccgtgatgaagatcagtgcataatgcgtgatctcctaattagtctggtgttgttccagtgaggcgacctatgcgcgcggcgagcagatgcacgactagggtgcacggattgctcctgcatctcttcgcgagcaaacatccatctgtatctgtcgcgtgcttgaccatcgcaggcaccatgcgcatctcagacagtacgtgcaaacaaattaaacaacaagaaaacgatctcgttagtaaacctacatgcatatatatcgacatacgcatgcatgcatgttgcttgctcctgtgcccaatccacacgagccatgcacgcatatgcctgctgctggttccagcacgcatggccgaggcgcccatgcgcattgcgaagcctgttgcgctggggcgctcccgcgcgtgcagcacctcgtgcgccgtcgcgcgaggccacgccagcagccacccgtcatgtggatgcgaggatctgccgagcaggatcactggtggagaaacctagtcccgatttataaccctcctttatttccggtttccaaaccgggagtaccaatccgggactaaagttcgctatctttagtcccgggtaaaataacccggagtaaagatcgatctttagtcccggttggtaacaaagatggctcagtcacgtggctggctgagccatctttagtcccggttggtgttaccaaccgggactaaagatcgagcagacctttttttttaatggccctgttgctgcatggtttatatatatatatatatatatatatatatatatatatatatatatatataaaccatgcatatatatgtttcaatacatatatatgcatacatacatatatat

SEQ ID NO: 83481 - DNA, 12207 bp, Oryza sativa
ttatattatattatatgtatatatggttcagtacatatgtacatgcataatatatatgtatttatacatatatatgttatgcaaatgcatatgtatatatatagaaaatgtgtacacatgcatatagaaacatatgtagtcatgtattaattacaatccattatatgtcctaactagctacgatttcgacgtagtagtagtactcgctgctagctcagaagctaaggaccggtgaattgtgtttccgtcgtagtagaattcacctttgggatcaaggatttcttcgttgatgaatcccatgagttgttcttgaaccgccacgataaattccttgtgtgtggtcaggttatccctcatgcgaataaactatatgaatatatgaaattgattagtaattaaacaagaaatcgttacgtaatgaaaatttgaatttatttgtacgtacatcgagctctcttgtggtgatgatttggtctgcaaggcagtggcaatactcgcacacgtagtagccgcacaagttagttccctgcttttgctttgcgctctacaaataaatgacaaattaacggcgtgagatctaattaatatacacttgtatgtattaatttgaatcggagaaatataaatatagagcatgtgtactcacaggaaatttgaacctccgcctaagtctttctctccagttgccgcggaccaaatgacggaaccgataccaagccctacatggagtgtaaagatatgattcgtagtagaaataattaacataacaagaatttcttaattaacagaggaacttataccaatacctgtctataagttcgaaaaccttgtcaaacgtagactcttttttatccattgagtcatatacgttgacgatgcaggccgacaggtcgaagagtaaaagcacccagtggaatctgcaatgtgcgtgggatgcattacatatgaaacacctagcaagttcgtacaggaatgaaatttattatgtaggaagacagtaaaattaaactaactctgtgttgtacggcaacagtatgaacgtcatgtaatgctgcgccttcaggagatggacgagattgtcctctgtttcttgtggatattggtcgagcattgcgacgtttactctccgagggtcgatgaatccagtatcgaaaaccctccgccgtcgggccctttgaatctccattctacaacgataaaagggagtattttattttatatagtttacttatatacaaggacctaatttattaaaggagacatagtaattaagaaatataactgaacgatatacttacaaaatccagcaactcataatagagacgtcgcgggcatccagctggtatacttcgtagattcccttgaaattgatccagagaatatcatctccttgcaagaagtccgggtccctgatcctcgctccgatcatctctctaccggtggcgctcatctccatgtacagctgatggaacttgtacatttgtgtgggtagggactgcaccagctcgggcttgacaagcggtttaccgagttcgtacatgtatttcaattccgccttttctattggttcaactcctagcaattgatccgtagttagaccggtgtcaataataaattcttctatcgtcatgtcttccccggtcaccaacggctcgatctcctggtttggttgctctccaagctgaggactggtttggactttacagaagatgctttcttcagcattcgctcatagtccgatagcttgatggcctccttgacaggtgcagacatacccctgaagaagttcctgacactggggtctataggaatcttcttttctggacttcgaggcttgaattgtctcttgacttctgatgcaaagctcctcttgcgtgcaatcgtaccccgggtccttgttcttggcggtgtcaacattcgccgtcttcgttgcccttgtgtgggcaggcggtggagctaggggggcccttgactttgaaggtgccggaagaggagcttgcggaggagtaggtgtaggagcccgaggaggagtcgatgcaggatcctaaggaggagtcggtgctagagcctgaggtggagacggtgctggtggagcatgaggaggagacggtgcaggatcctgaggaggagatggcggagccggaggagatggtgcacgagacgccgcttgtcgccctgggaggatgatgtaccgcctgcgccatagaataatggcatggcttgtgtctcatagatgcatctcaccgtctcctccagggtaatccagctcgaggtcctcgtacgcgccttcgaccaactcaacttcgaccttcgagtatcctgctggaatcggcctgtagtggtaagtacctgaagggtccgttgggatggccatgcccgacgccaccttcatgttgtgagagattatttattagtaatcaacatatataagcagcaactagcggaatggctaaatctaaaatatataaactacgaacttacctttattgataagttcttgtaaggaatatgcagctcacatggtgtccgctgagtgatgtcatcaacgggacaggtcgattcgtcctgtgtttgcatggcgtccatgctctgtgatcctacctgccccgttgaggcgcagctgctatggtttcctgacgggcttaccattgcaggaggaatggtcggctggggatcatgggaccgatgtgcggccatgcgttcatcaaccttccttgccacctcctcttgcattctgagttcgtagctcgatacccggaactctagatctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggtgagtgtcagctcgtccctatctctgttcggtcggaacgtgccctgagaggaggcttccactgcatctgttagtcgtcgcacagcctctcgtatctgatcgccaaagaccagtgagccatcaactggtttgagcgttccaccgtgagcatagtaccagaacttcgatcgttccggccaattggcggttgccggttcgataccccgctcaataaagctagcctccatctcctcccacttcggcatcgcgacgctatagcctcctgaccccaagtggtgatagtacttcttcttggcggcattttctttgtttctttccatcatcgcctacccttgtttacctgtcttatatgcaacgaactcgtcccagtgatcccttagctttgggaatgtgtcgaagttcggtgtctgccccttcgggatatacttctggtacagatctctcttgaagctctgaaactgttctgccattttcttcagagtccaccttttcactttgtcctctgtaccagcaggaagggtgaatgtcttgagcattgtggtccacaacatctctttctccgaatctgggacaaagctctcatgatctccgcgtgcccttgttgttcgccagtacaccgtactgacaggcacgttatcctgcacaacccaaccgctgtgatgtacatagttcttggcggcttcggccggggcactaggacgtccatcttcttccacttccattatgatgtgccgaccctcaagcttcttcgctgcacctcgttgcccgtgtgccctcttctgtccaacggagggttgactaccactagcctcctcctcctggttcccctccacatccctttccacgtgcccctgctggttcccctccgcatccctctccacgttcccttccttgttcaagtactggtttggatcctcgttcccctcttcttcattccagtactggctgcttccctccgcgattgtatcgtacaatatctgttcctcatcgcggtcagccatctgttgatacaagaaacatctgctaagttacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccatagctagtaaataattatatactaagtctaattacaaataaaataatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataattacatactaagtctaattacaaataaagtaatcttatattaaaactcaaataatattacatgctaagactgaaagagtcatgtatgctaagtgtaactgtcgtatatgctaagtctaattaagactaaaattgtcaattgctaggagtcgcaccaattccgtagttaataattatatagtaagtctaattataaataaaataatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataattacatactaagtctaatttgcaataaaataatcttatattaaaactcaaataatattagaacactacacaatcttatatgctaagtctaattacaagtctaatattcttaattgcattacaaatataacaatcatttatattattacgtcacttgcctgcacgaattccttctagggctagctcttccactccggcttgagggacgactccgacaacacgtcttttctgcaagatacaaaaaatatgtattaggataaatgcgaagtaacatatatatatatattgcatttcacgttcacgttcgttcacgttcgttcgctcgttcacgttccctagctcgttcacgttcgttcgctcgttctcattcacgttcgttctcgttcacgttaattcgttcgatcgttctcgttctcgctctcgttccttcgatcgttctcattctcgttcacgttctcgcggcaacgtacgttgacgtgttcgttctcgttcacgtgttcgttaacggcggtgtggcggcatcgggccggcgcttggcgcggcagcgtggcggcggcggcggcggcgtggcgacggcggcggcggcggcgttgcgtggcggcgaaggcggcggcttggcgtggcggcggcggcgtggtgtgccggcggcggcgtggcgcggcgtcgtcgtggcgcggcgtctcgtggcgggcggcgcgacggagagagagatcgagatcggagatcgatgaagggagagacggcggcggctctcaccccagagatgcggtggcggcggaagaggcggaggcggcggcgaggacgacgagctcgagacgacggcgagatacggcggcgtcggcgcggggatttgccctagacagtggcagcgaaggagagaggccgagagagatcgatcggccgaaaacgttaagtgttggtggagaagacgagggcgcacggggaaaatatatacccccggatctttactcccggttggatctttactcccggttgttctcatcaaccgggagtaaagatcttttcccgctatttccaaattctttttaaaccaggttaggttaagaactgggactaaagattatagcactgcatattattttcgcttacatatgtgtttctaaaatagaagttaatgcattaacattatttaaagtacaaagattaatgacaattacttcgaaaaattatttttgtctgtaataaattaagtggataaatcgtaataagcaaatgtatgacttaaaattaataaaaattccaataatcatatatacttagcatatgaatgatattattaaattggtaaaaactctaattaagatatgtatgtacaaactgcatgatttaaaattaataaaaattgtaatcattatatatacttagcgtaggaattatattaaattaaatgttaaaaactctaattaacatatgtaaatgccacatgcatgatttaaaccttttaaaaattcgaatagtcatatataagtagcatatgaaagatagtaaattaaattgtgaaaaactctaattaacatctgtaaatgccacatgaatgatttaatacttttaaaaattctctagtcaattataattagcatatgaatgatggtcaattaaattgtagcatatgaatgatagaaaattatgccgtacatcaattggatttatatggataatcactacattccaaatagtttacatcgtgtacacaataaatatggcattacatcggcggtgacggttgaccgcacgtactttctcctcactattgttccctccttgtgatcgctgcgtgagtaaggggtgtcttcatttgataggaggatgctagggtcaatcatcaccatgaaagggggttgcctatccaactgatcgtaatcctcgtcagtcttgtcctcaactccgacgatttttcttttgcctgagagaactacttgacgcttaggctcgtcaggccctttgcccttctttcctttgctagacatgtccttcacgaaaaagactaaaatagtcatgtatgctaagtgtttcgtgcgtatatgctaagtctaattaagactacaatagtcaattgctaggagtcgcaccaattccgtagtcaataattacatactaagtctaatttgcaataaaataatcttatattaaaactcaaataatattagaacactacacaatcttatatgctaagtctaattacaagtctaatattcttaattgcattacaaatataacaatcatttatattattacgtcacttgcctgcacgaattacttctagggctagctcttccactccggcttgagggacgactccgacaacacgtcttttctgcaagatacaaaaaatatgtattaggataaatgcgaagtaacataaatatattgcatttcacgttcacgttcgttcacgttcgtttgctcgtccacgttccctagctcgttcatgttcgttcgctcgttctcattcacgttcgttctcgttcacgttcgttgtcgttctcgttcacgttaattcgttcgatcattctcgttctcgctctcgttcgttcgatcgttctcgttctcgttcacgttctcgcggcaacgtacgttgacgtgtttgttctcgctctcgttcgttcgatcgttctcgttctcgttcacgttctcgcggcaacgtacgttgacgtgttcgttctcgttcacgtgttcgttaacagcggtgtggcggcatcgggccagcgcttggcgcggtggcggcggcgtggcgacggcggcggcggcgtggcgttgcatgcggtggcggcgttgcgcggcggcgaaggtggcggcgtggcatggcggcggcggcgttgcgcgcgcggcggtgaaggcggcggcgtggtgtgccggcggcggcatggcgcagcgtcgttgtggcgcggcgtctcgtggcgggcgtcctgacggagagagagatcgagatcggagatcgatgaagggagaggcggcggcggctctcaccccagagatgcggtggcggcggaggcggcggtgaggacgacgagctcgagacgatggcgagatacggcggcgtcggcgcggggatttgccctaggcagtggcggcgaaggagagaggccgagaaagatcgatcggccgaaaacgttaagtgttggtggagaaaacaagggcgcaccgggaaaatatatacccccggatctttactcccggttgttcccatcaaccgggagtaaagatattttcccgctatttccaaattctttttaaacccggttagggttaagaaccgggactaaagattatagcactgcatattattttcgcttatatatgtgtttcgttaatgcattaacattattaaaggtacaaagattaatgacaattacttcgaaaaattatttttgtctgtaataaattaagtggataaatcgtaataagcaaatatatgacttaaaattaataaaaattccaataatcatctatacttagcatatgaatgatgttattaaattggtaaaaactctaattaagatatgtatgtacatactgcaagatttaaaattaataaaaattgtaatcatcatatatacttagtgtaggaattatattaaattaaatgttaaaaactctaattaacatatgtaaatgccacatgcatgatttaaaccttttaaaaattcgaatagtcatatataagtagcatatgaaagatagtaaattaaattgtgaaaaactctaattaacatctgtaaatgccacatgaatgatttaatacttttaaaaattctctagtcaattataattagcatatgaatgatagtcaattaaatgtagcatatgaatgatagtaaattatgccatacatcaattgatttatatggataatcaatacatccaaaatagtttacatcgtgtacacaataattacgtcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcctatccaactgattgtaatcctcgtcagtcttgtcctcaactccgacgatttttcttttgcctgggagaaccacttgacgcttaggctcgtcaggccctctgcccttctttcctttgctagacatgtccttcacgaaaaatacttgcgttacattattggcaaggacaaaaggttcgtccgagtatccaaccttgttaaggtcaacagttgtcataccactgtcatcaatcattacgcctccaccagtcaacctaacccattggcaccggaacagaggaaccttgagaggaccatagtcaagttcccatatatcctcgatggcactgtaatacgtggcagttgttccatcgtgtcccatggcatcgacacaaacagcgctgttttggttcgtgctcttcatgtcttgggctctcatgtagaatgtgtacccattgatctcatatccctggaatgtcgcgatcgacccagacggtcccctcgccaggaaggcaagttgttggttgatcgactcgttacccatgagatgttgtcgtagccacgtggggaaagtatcaatgtgatgtcgtgtaatccatgcatcggacttaccgatgttcctggcgcgaactagagccaagtgctcctcgatgtaaggagctaccaatgaagagtgttgcagaacagtgaaatgggctttacggaataaattgttatctaccgtcattattgctttccttccgagagttcccttttcccgtagtctcccttcatggcgtgattcaggtaccccgattgggcgaaggtcttcgataaattctacgcaaaattcgatgacctcatctgttccataacccttggcgatgcttgcctctggacgagcacggttacgaacatacttcttcagaacgcccatgtacctctcgaaaggaaacatgttgtgtaggtatacaggcccgagaatacggatctctttcacaaggtgacaaagcagatgcgtcattatattgaaaaatgaaggtagaaatatcaactcaaaactgacgagacattgcaccacttcattctgaagggcttctaatctatccggatcgatgaccttctgcgaaattgcgttcatgaatgcacatagctttgttatggttccgggtgaaggtcgccgcgttgttccatatgcttcagatcattacgtgcttccagtgtatctttcaactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctataggctggcttccaggcccctttccgaacactactttaagatctttaaccatagcaaacactgttttcccgctgtgatgtttaggcttcgtacggtggctgttttcccgctgcgatgtttaggcttcgtacggtggtcggccttatgttggaagtgcttgcctttcttccgtaccgagtggtttgctgcaaggaatcgacgatgacccatgtatacaaccttcctacagtgcttaagatacatactttctgtttcatccatacagtgagtgcaagccttgtaccccttgttggactgtccggataggttgctaagggcaggccaatcgttgatggttacgaacagcagcgctcgtaggttaaactccacctgtttgtcctcgtcccacacggggacaccttccttcttccacaactgtttaagatctttaatcagtggtcttaggtacacatcgatgtcgttaccaaattgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaatttttctgtcgatgtttcgccactgcgaaccatcggcggggtgtctcagcatcccgtcctgttgacgctcttcagcgtgccatcacaacattctagcattccccttgttcctgaacaaacgccttagccgtggtattatagggaaataccacatcaccttagcaggaattctcttcttttttagctgcccgtcaacttctcctggatcgtctcgtctaatcttgtatcgtagtgctttgcaaacacggtatgcttctaggttttcatactcctcaccgcgatataggatacaatcgttcggacatgcgtgaatcttatgaacttccagtcctaacggacagactatcttcttagcctcgtacgttgtctcgggcaatttgtttccccccggaagaatgttcttgacgagtttcaataaatcgctaaatgctttgtcactaaccccattttttgccttccattgcaagaactccagagtggtatccaacgttttgtgcccctgctcgcaacctgggtacaacgaagttctgtggtcctccaccatcttgtccaatttatgggcctccttttcactttcgcagtcctccctggcatcctgcaacatctcaccaagatcatccgcaacgtcgttaccatcagcagctatttcctcctcgcccgtttgattttcttcaaatccaacatactgagtaaagtccggaatattgtcgtcttccacttcatcttcttccatttcaacaccttgctctccgtgggatgtccaacaattatagcttggcatgaaccccgactcaaacaagtggaaatgaatagtcctagatgcagaatactccttctgattcttacaattattgcatggacaacaaataaaacccctttgcctgttagcttcggccactctcaaaaaatagtgcacgccgtcaataaactctttggaccaccggtcagcgtacatccattgccgatccatctacatgagtcaaaaaaaaccgtacataaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttcgctctcatcaacttacaactaaattttggagacaaaaaaaagtgtgcaaaatataggtgcaaatgtagtatgaaaaaacaaaacattggaggatgaagttgcaaaccttttaggcacctccgatttgtatgtaatcaccaaaataaattcaatagaaattttggcatgacctcccctcttttttgaagaaattttaaagcttgctcgggcagctggaggaggaagaagacatatatataggggtgggactttagtcccgg

SEQ ID NO: 83482 - DNA, 23093 bp, Oryza sativa
tgaaccgggactaaagatcatctttagccccggtttttattgcatccgggactattgtggaaatcggccgaccgacgaaagatggtttctccaccagtgtcaatcagttaaatttgatgttactggatttatcatttaaaaactatcataatatgcaaatatttttatttaaaacatgttactttcatagatattgttggacaaagttgcatctcagatactatatcaatgtccaaaaatatttatattttgggactggggagtacttactagcgtttgtacgggattcttcatcagataattaattaacgacatacaacgagatgattggtatcaacagtagctcgctgcaaacgtgggagccgggcgagccgcgggaaatatcacaaactagctgcacacgcgaatcagagcaacgggcaggacagccgcggcgatggcacggcgcacagccgctcagccttgggcgcggtgagcccgaacacgtcgtccatgtcgagctcgagcggctccgtcccagctggcagcgaccagtcgaagcagtgcaggagctccgcgaggccgagctccacggcgaacatccccagctgcatccccgggcacgaccgccgcccggacccgaacggcaggtactggaagtccccacccttgaactccacgcgcgcgctctcgtcggcgaaccgcgacggccggaacgccgccgcgtcggtcccccacagcgcctcgtcgcggcacatggcctagttgttgatccagatgcgcgacccgcgagggacagtgtagcccccgatggcgcagtcgtggaggctctcgcggaggaggagcggcagcggcgggtggagacggagcacctccttggtgacgcacctgaggtgggggaggttgtcgaggtcgtcctggttgaccctgcggcggaggccaaccacgccggctagctcgtcctgcgcgcgcttcagttcgtctgggttgcgcaggagctccgacagcgcccactccaccgtggacgccactgtcttcgtgccgccgaacatgatgtcctacacggatccatggaagcttggattagctgccgtggagagttgtgaaaagatggcagaagctaattacacgttacgtgccatgattagccccttgatgttgtctctggtcaggtggaggtcaccgagttcgacgccgtcggctctcttgtgtcgtccgccgggagcgtcgacgaggtacgcgatcatgtcgtccaccatgtcggacgccgacacgtcgccgttcctcaacttggccaggtgctcgtcgatgatccggtcgatgaaaacgtccagcgcgtgcctcgccgccgccatcctcttaccgatgccgttgagatcgagccacccgaggcaagggatgtagtctcccatgttgaacgccatgaagatctccgagagctcgaggatgatgtcgacgaacaccttctcgtcctcccggctctgtgcaccgaacgccgcccggaaggtcacgttggtggcgaacttgaataccagatcaccgacactgcccgcgactcggcgcagctcggcaacggacctgacgagggcgtccacctcgccgcgcacgacgcgccacgagacgtcgcgccgggggctgaagagcttgagcacgcagagcttgcgcatctggcgccagaacgggccgtagtgcgcgaacgccatgtcggccaggtcgtaggagacgtacaccatggcggccgtgaccggacagtgcgagaagacgctgtcgttctcgtgtatgatctccctcaccgtctccggcgatgacaccacgaacacgttcggctggccaacgcggaggtggaagaagccgccgtggatcttggagagcttggcgaggccgcggtgggtgaactgatgcacggacagcaggttgccgaggacgggcaagccgggaggcccgggcgggaggaggatggctgttcgacggagtcggctggcgtaccagaggaagaaggcgatgctgatcaatgaagcggtgacgaagtaggcatcttgactgtagtactccatagagtgatcacttcactaaggattactacacactaacaagttcaatagcgtgtttatataatgttcgcgagttccatatattatatatagctgctcaattatgttgtttctattgtaaaactacaaaaataatatactaagacatcacgtgtatgaggtaggtgacatatccaatggagcatgcacgattatatatttctatatggttggaaactttcctcgaagctttcatcacaactttaggagaaataaaaactatcaaattctcgcgttaatcagaaggggattacttgtgactgaatttgtcaccttcaacttctacgccagttttcatgaaaaaaggcatcccttcatcatccccatttatggtgaaactcgaactctagcagagaacctgtggtttagggggtaggtccctagctcctgtttggaactcctgtactcagcacaacacaagtgtaaattatctgcccgtatcattttttcatgttgggcttacttcgtgcttgaatggcccgtaggccgtaactctaaatttccatccatttttgaccctatggcctatccatcgtaaagtaattgtgacttcaccaggccatagtaattttccaagaaatatcgggctcggcccgctcggcgtccccatacccatcgctgactttcctcatgcccgccggaatttcagaacaaccccgccgggcacaatagtattcttcattcattttagatttggtcaacatttgtttggattttaaatattttaattccaaaatttccgaaattcctgaaattttggtgccccagtaaaaatgtccaaaatgaaattgcagacatcctgcagcatcaatcgatttctttggtcttctccagtagttttgcttgttattgctgtctttttatggcgtgtttttctgttttgaatttattgtggatattcatcttgaagatcaatttgatcctgactccattgttggcttatcttgtttcaattcgaacctggtgcccgtaccttaatttggatccataaatgcaatatttgctaattcagtgaagtgatatgacaattgtttattctatgccaatactaatagttactattctatgctggttcatgtaaaggaaccgatactaatacatcgtgctggttgatttgaagaaccggtacagacgaaggtcatcattattaatttttgtactccaagaacccgcacaagttaggagggttccatatcaataccagtttttagctataatagtagtgtgtgtactaggcacaccaatggttcgtaatgttgaatagttacaaattactttggacctcctctagaaatatagtcgtatttgggatattttaatccagataaacaagatactgaacatgtgttgtgaataacggagatatctggtttgggatattttaatccagataaacaagatactcaacatgtgttgtgaataacggagatatctatgaacatgctaataatagtaatatagcatcatccagtaacatgtttaccactaaggtgattagagtaatatacccatagaagcgccagaagatgaggcattgttgttgtcgttgcctccattgtaattgtcgttctccgctccttcagtgtcgcctttctctccgtttgttgccattgacgtagaggaagccgaacatgatgaagaggatgcagtgccgagagcactcatgcgtacaacgcactctgaaaaacttgatcacctgacaacccatgcaggttctccagtggacagagttctgaaggcttgctcatcctactaccaacaaccgggactaaatgttttttttattattttttgctgcttgcataatgatttccccaaatcgagtaggtcccgacatccccaaataaaattgagatccccaaatccctacatcaaatcgatgtcacagatcgaatgaacataccatgtttacatcacagatatccccaaatcctcacatcaaattgatgtcacagatggaatgaacacactatgtatatacgttataaattcagagatcaaaatataataagaaaaggacacaaaaacaacaaagacacaaacacattcaaaagtggatcgatcgatggagatgacggcaatggaggctgcagccgcctacacccaccgcctccgcgccgacatcgccgagggcaccggtcgcatggccctcgccatcgacgaccacgacggaggccgccgcctccgcgggagccgccacccgctcgccggcttgcgcgctcgtgcagcccgcccaccacccgctcgccggcttgctagctctgccacccgccgccaactcacgccacccgcctgctcggcttgttcgctgctcactcacggctgctgcgtgtgtgcacccacgggtagggaagagagatagaggagagagaggaggaaaggaaggggagggaagagagagatggagagatagaggaaaggtcatgaggagatctcgtttgtgaggaggagatgataagtgcgagggattatgtacgacgcttcgatctttaatcccggttggtatgactaacctggactaaagatagtgggggacctaacgctttttaaactgggactaaaaatgatctttagtcccagttggtaacactagccgagactgcagatcaaaaagttttgtagggctttttaatcgggactaaaaatgatctttagtcccgtttcccattcgaactgggactaatgtgatttttgccatccgggcaaagatcacttctccggtagtgatcctataagcgaatcgaagaaacaagcaagatcaagataaaagcaaactgaattgcaaattgaattgcaaataacaatttaatacaaacgataaggtggggttatgaagacgagtaattaagcggtctagctgacacgtgtaggtacaaggtaaaatagaaatagctaaaacattaatcttacataacccgagaaaccctgaaggggtacatagctatttctggaggtgggaggatgaccaaggggtccctagggtcgtgctccactatgttgtggagcaccccacaagttccccactttggtcggggtcccagataaagttacaagctcataggcccattatagatgacaacaccttgtttccttgattgcgtccgattgatatagaatttcgagacgaggcaagatccgttcgaaagaggaataaaaatgctatttagtcacggctcctattcgaaccgggactaatgtgaattttgccatctaggcaaagattaattctccagtagtgatgctataagtaaatcgaagaaacaagcaagaagaagataaaagcattttgaattgcaaataaaaattgaatacacacgataagacggggttcaaaagacgagtaactaagcggtctagccgaacgcataggtacaaggtaaaatagcaatggctacaacttatctaacataacccgagaaaccctgaaggggtacatagctatttatggtggtgggaggacgactaaggtctctctagggtcgtgctccactgtgtttcggagcaccccaaatgtgccccgctttggtcggggtccaagataaagttataagtctatgggtccattataggtgatgcaacaccttgtttccttgattgcggccgattgatatagaatttagagataaggcttcatccgttagaaagaggacttgaagagctttccatcaagtactcactagcagaaaacagacattgtatgcacatttgtatgctcgttgatgtggcatggtctcgatgtcctccagttgacttaagatgtgaataatggttatacctatggtagtcatggtcacattagcgtgtaccgaggaaacagtagagtcagggagagatgaacagagtggagggagctccctgtctatctcgaggtggaagatagtgagcgcgagagagacatttagggagtaattcaaccaattgattgctccatccgttactagagtaacgaatctccgtcagttatacctgccacgcctcagctgcggccatggcccgactctgcacatgcgcatgttcgtgtggcaatcccaccatcatcttaactgctcaagagctgctctcaattagcaacatgtttaagttgaggtccctcctcattgtttttggaggtaatattagagcctgtttggatccatgtcacatcggatgttcggacactaattagaagtattaaatgtagactaatgacaaaacctattctataaccttggactaatataattcatgagacgattcaattgagcctaattaatccattgattagcctatgtgatgctacagtaaacatgtgcaattatggattaattaggcttaacaaatttgtctcgcgaattagctctcattaatgcaattagtttagtaagtagtctatgtttaatactccaaattagtatccaaacatcagatgcgacagggactaaagtttaatccttggatccaaacgccaccttaatcctttaattttaattgttgacccatggaatttactagaaataaattggccgtagcccatttaattctaacacctccaagtggctaaccaaatgtctgtctaagaatttacgattttttgtgaactgtttgagatcacctcttatatagcagtgtcttcattaatcactgttgtcctgacatgaacaccacatgagcgcgtgagtcacgcacgttcatactgcataggatattgcagtgtatctgtcactaatcaagcaataactatagaactacagatatcgccctcgtgcatatctgtggatcaggagatgccaaaacagcagatgacgtagacaatatgacgggccacatagaccaatgattccttgctgtgtctgcatctctagcaagctattgcaaatttgcaattgcaatgctgaaggagatggccaaaccagctatacaagatatattgtcccctgacagaaagatttattttctaatggagggagtactatatagtattatcaattttgatattctctccttggttagacctgcatgtgtatagaatatgactatgtaatcatactatatacaatatagtttatctttcgccttcgataaggacaattcgaacagacgaaatggcaggtgccaggtggtgtgttagcatgcaggaagcatttgcgtacgttctatgatgaagcaaccgtgagtcttaaggttaaggatttaaaatttcaaatcgaaaggccataaatttttgacgacttatgtcggtaacaacaggatgaatttatcaaatgatagcagtattggttacaaactttgaaatttattaaaccatgcaagatctatagttaagacaccaaccaaaatacaacttttcaaaacaaagcacaaattcaatatctatttatttttactggaactcaatatttataaatatgactttcaaaattattactccatctgttacatctacttggcaacattgactttgaccatttcaaccttgaacattatcactcttttaatgagtaaactgtgtttagggccacctttcattaccaaagtttactttggaccaccctgtaacccaacctttcactttggactaggttatttttcttttgtttcacattggaccaccctaaaaacttttctaaagcacattaatgactttatgcacatcagcacccataaaccatcaatcttcccgacttacatgtaggctattctcctaagtgggtccaaggacgagtttggactaaaataaaagaataaattgcacccatggtgcatcaacttggcaggtgggtgcaatttagtacaataactggagaaatgagcattttagtataacaagttagcagctaggtgcaatttagtataagaacttaataagtgatcatataaatgcaacagcttgtaagataagtacaattttgatacagtaaattaagaagttatgcgacaacttaattatttgaagcattttttttataaattcagtttttaagtacttattctgacaatataatagtgtggatttgcataagcatatttatatttttattctaataactaataacagaaagtcaattaaactggatgtagaaattattatatttcggttgatatttgagaaggtgaagaaaaaaattcataaagttaattggatgtaaattgtatgtgttgtataattcttaaagattaaatttaatattataaggtaatatccataggattactatgtaatggcatattgacatcgtgaaaaaaactcacccagtatttgcttagctaagttgatgcaccaaaataataaattgtcaaattcttaaactagaacacacccaattatcaatttgttgcactccgacattcaattctcaagttcttccactatatcgtacgtatctgccaagttgttgtacgatggtgcaatttactcaaaataaaaacttgaaggaactgcttgttattgcattgagtttggtgaaattttagtgacccttgttagattcttttcatactttcatgatcaatatcacacacacccaccatatttgctcatcttctacactggaggatagcaaacacatactttccatttaccatatatgctatacttctacgtagaaagtcagaataatttatacatctaccacaaaagctaaacttctacactagaagtccgcatcaactaaccatccatcaaataaagacttcacatatttatgatttctcctctaactatacatggaaaatgagacatgagctagaaaaaaataaatgttgagaaaaaagctcacaagagactattctcgtgcatgagaaaaagaaaaaaaatgatgagagagaaaaaaaaatagccatgttctccaaataagtgcaaggaggaggatccaaaaaaaggaatcatcattacactttccccctttttcacatatatccgttgtccacactcatgcacatcttgatcatgatggtatgactagttattttcttggatctgggttttgactatgcaatatatgtgatgcaagtatgccgttcttctttcatacatgggctccacataatccttattagaagtagaaataagaaagagcaaaatcactgtcttggtgaggaatcatacacattgagcgatctgagagaatcaattgaggagtaaagtaaagttatgttttatgagcaaaacaaaaaaaaaacccaaggtactcatcaggaggagtggatgtaacttgaatcaaggccgttccattcttaaatcacccaagatggtgtatgctttagaataacatgcatgctggaattatttcaagggaatcatatctctgttgtcatccataatctttacttagggatgagaaaagactaagtgtaggggtcctgttgccgatccttaagtaccgaatccaaccatcaattcttgcattaaaagcaaatggaatgccaaacttagaggtagtggttattactaaccatttccacaagtcttggtcaatatgcgtatgcagatgaactatggaccaaaaccacacgccatgtgacaaaatacacctccggacaattggatgcgattacacaaatggaggtcccatatgtcaatcaaaaccacctaccattgagtccaacaaaggtacaacatgtagggacccaccagatctcctcccaaccgaagcaatgactgggagcctgggagatgggatagaaggtcagttaaaccacaatgtcgcccgaacctccatcgattcccctcgccatctgctttcacatgtagcctcctgataatctctcaaaggctgttatgcttgattcctggtggttaccgaccttccaaccgtcataggaagactataaaaggaggagaagctcttactctcaaattgcacaacaagtggagtacaactcacctacacatttaggaagctctctagtagagttaaaatataggaagagagtgaggggaagctccgaaaggagagccctaaatgtatgatttctctctgggatgttccggagatgttggcctatcttcaggagtgtccccgatggatgccttattttacaagtaagtgtcggcgcactctctcatcttgtacctcgatggatgccttattttacaagtaagtgttcatgattcctggtatttaattaccttgcttaagtgagatatattctcatagttgcgagttcgttgcttattttttgtaataagtgccctataagtaggactcttgatgaagaaggaaattcctgcgccaggcttgaatagtaatcaatgacttaggcatagtgttgaggttagtggttaccttcgtttgttatgtgctacacggaaagtgatattcatagcaggtggtgatagccctgtctgccctttacatccctccatgtttggatacatcatagagctacaggcctgtaagttatgtctagttaattattccattgctgtcctttctagccaaagcgtaccattagttattgtccttggataaaatctctttccttgatatacacaccccttagctatgattcgatacactcagaatactctaaagctgaagtgctacatcggtatctgtgcgcttgcgggttgatctgtgaccgtaacaaatataaatacctacccatcaacgaaggtgtttagtggtacgtggtttgagcagtgaagttgaacttgccacaaggggattaagaaaccagcgagttcccaaaattcagatgaaaaattgcttcacttgtgtcttatttacttattgcattttgttggtatttcttacattcacaaataaatccgcaagcacacgaatactactgtagcatttcacccatgagtattccgaagggaaggtggtggcataaaggtatggttttatatatcattaatcaatctataattaattcaccatagtgtaaaaaagggttaggataataattaattcaccatagtataaacaaggtagtggacacaggagattcatctatattataatgtctagtacaaaataacaatacgaaactatagtacaattgtacttctatactaatcatgtttagtatacacttaacaagtacatgctaacaacataggacttagttctaggcacctaggtacagcagagagaccactcccggctggtctgccagcatggttaaagcatttacggactattacgtcatacctgaacgtagacgaatacaaagggtggacatgactgtcaccacctgccgcctaattcactttccgtggggaacacctgcatccaacgatatttatctaacctaagcattgtgcttatgccagcaaataatagcactaacctaagttggagctagagcaacctataaaggtcatttgactattaccatagcatagatcgactagcctaggttgaagtagatatacaatgtatatactactcatagaacataagctcaataaagaaatatgtaaactattctattaattcaactatagtcttacaagaagagtaaagtactaaagacatacccaaaactccgaacaaactataggaccgaagctcctctagacatatttctactagaactatagagaatacaatatggaagagagaattgctccttcggtgtttcttgtgaagtgaagagcacccctctattatagccttgtaatgatggttttatggtggttatgggccgctaatcgtgcacatctatcattgggagtggttgagtcgacacatggaagaggagtgccaagcgcgccaagtatggttcggccgaacccattccaccgccatcgcccaccgactttggtaggagtatgttaggtgggccccttggtcggttcccgtttgtttgacccccacattaggttagtttgagctgacttgtgggcccctcaatccgtgtgcttgcatgtgattcgccggaggtgtgtttccttgcttgccggcctcattttccctttaatttgactatatccatgttaattctctaatcctaatacgactatattatttctgattgatatacttttaggaaatgctaattttcccttgattcattgtcacacctgcagtttccccttttccgtagtttctaattcaccaataaattatctatagaaattactttggctaacctcgagaaaacccaagttaacaatgtatttaataatctaatttgtcagggagaattattttttgaattctcttttctctaaaatcattaacaggatattcacagcaccagaaccaatgttgttaatttaacttgtcaagatttgaagtaataataatctttatcttacgcttttggtcatgagtcatgcccgattcactcccctcttcgtccgcggtttcattttgcatgatgagttgggtcctatttcgttcgcgggttccgtttccgttcctttcctaaaactccttatcctattttccctattcctatttttcctccccctctcctcctcccactcggccgccgctccccctctcccatgccgcgtgccgcccttcccatcggagtctgagtcggcctcctcctctccccactctgctgactcccctctggccccatctcctttagtttttcccctctcctatttaagttagaacccacctcccccgctattttcctatttgttttattttagccttagacctagctagccgctgccgccgactagccctagcgccgtgtcgccaccgaccgctgctctgccaccgctggccgctgccgccgcctcccgccgttgccgtcgtcgccctagcgtcgccggtaatatgtttttcctctccgtgtcatagctattgccataatctttccggttctaatttgtttccgtcctaggttttgatctaacgtcgctgccgtctccgtgtgttgccgtcggactgtcgtcgctgtctcctcctcgccgatagtctcggttttgtgaggaacctatccgtaatctcccgtttagggtgttaattctttttagtggcggcgttgaaaccctagtagtttagccgtcaaaaccctagcctagtgccgccgccgccgctctgtgtcctagccggccgagccttagccgctgccgtcttgcctagctgccgccgctgccgcctgtgccggccgagtcgtgccctagccggcgccgctctgtgccgccgccgtcggcaccgagccaccgccgctctcccgcgtggtcatcatggtttgccactgtgctgtagctcggtagccgagttgcaatcgaaatcggtacataacaactgtcaacacatttacttttgtgtaattcacattcatagacactatttgagcactcatcaccttaggattgcaaaacttaatataatttcttagtttgtcttatccttcaccaagcctagcaacttgggttagttttgattagatgttatttatttttaatatcgcctattaacccccctagtcgacatctcgatcatatacccatgtggcaatgaaagaggggaagtggattggattggtccgccattttctgagggatggtactaacctggatctagagggaatattatttttcatggatcatctgtaacaaccctctctctaggaccatgtagcccagcccaactgacgggcgggccacttacacataccactccacatacacttttgtccttgctttgtgtaaaagggtcaacccggaattgatatcatcggagagaacagaccttatcagttgattccacccttgctaaactagcaaggtactaaacatgcgcaaacagctctcatggactacatagtccccatcctaattgggtcaggatgtcacatcatcccatatcacccgtccccaaactaaataccttgaaaaatgggtttgcccccaacctgacacatcccatcctcccaaccaaacacatgctaaatagtgaataacactcatggcaaaccagaaagaaaacgacctgcacagatccagtcttctatatcctgccgtcttcttcctcgcacacacatgcatggcaaaaacacgagcactggtaggtcagcaaacactagatggaactcagcaagtccaaaaccaactgacaaaagtttctaaaaactacaaaatagaattttggcagcgaggtgattctgttttcaaatgtcccgacggcaacaaagacactatggcgatagcgacagtggtggtactaaacgtgacaagaactcaaaaccctaaacgactacacgctaagactaacaacatgacacaatgatgcaacacaaaactaaacaaagcaaaaactgaaaagaacaattcttttgttttcttgtatagccattttctggttataggtaaagctcttgataccacttgataaaccctgagctccactcgagacactcacggcttcgattggcccgatctttcggtgagttgatgataactacgatttgggagaaacgttaacgacccaactacaaccatatgagacgttgttcttgatgcatctctccgtgggttgttgaacatgcaatacagatcaaccttattcctacaagcaaattgaagaaacaagtaagaacaagataaaaacaatatgaaatgtaaatagcagttgaataaaaatgataagttggaattccgtaactgaaaaatgacgatctgttaaactttagtttaaacaaaacccgagaaaccctgaaggggtacctagctatttaagggcatgggagttgtttgtatttcttatgataatagataaatctgcaagcgcacggaataccgttgtagcacttcaccttcgagtgaccccaaaagaatattgaactcagggaacatgtgtaatttccctaaggctaagactatccaagggcaacaacttaaggtaggcaggctagagaggactttctatgtgtcttaattatctaagctaagcaaaggtcatttcatatctattacttcgggcaccaatccctgctggtctgccagcgtggttccggctatagctctatgatgtatccgaacgtggaggattactaggccgggattcagggctgtcaccacctgccgcctacctatgacaaatccgtgggatacacaacaaataaaggtaacctttaacctagacaccacgtctaagttattaataattactctaatacttgtacaggaacttccttctttatccatagtcctagtactagagcacttagtataaatactagacaatgaacccgcaaagatgaaaatctatcttacttaaacaaagtaattaaataacataagaaaggaacatgaatgcttactttatagaagatgttctccgaacccggagcagagtatacaaacagctccggtactcctccagaattcctcctaggaagctacactcgtcgagatagaagtcggatgagggccaaacttccgggcactcctccagagcttcccctcactctctacctaattctaatgtacaaaagatacaatagagcctcttataattcagctcaaagttgtgttttggaaatgagagtgaaatcctccttatataggctccaaatgacggttaggggcttgggaaatgaccaaaagaccctgcaaccgccttaggggagaaatccgagccgtccacgtgaagccagatggcgggaggcgccatgattggttcggccgaattggcggttcgaccgaaccaaaaaactgtcctcctgacctctcctttggccggtaggttgcttaatgggcccccaacatcttgcacattgttttggcccaattctaagtggttttggtttatatatgggccctccaattcatgtaaacgcatcctgaattcgcggaggtgcattttatcgcatgacggatgtgttttctcctcaaattacctacatacacatatttcaccaacactagtagaaatgattagtaataaaccctaccactatgttggattccatattttatttcattatatgcaagtattgatggtcaaatattatgatttaaggaccgtcaacaggaggacgactaaggattctcttgggtcgtgctccactaggttgggactgttgacagctattaagtatcaaattctcgccgtcaatacctgcacaaaactgaatgtgtaaaacgtcttacataagtggttgggtatatttctaacaatttccacaagtgttgctgtatatttggatgcaggtgacaaactaccaaagttgtgaagaaatatacataaagaaggaggagaatcaaacctatattcaaacctatagtgttttggacccaaaaacctaatgaaacacctccaaatgagcccaaccactatgccaatggactgagggcccaccagagaatgtccaggagaatgggatgggcagtggcgtagttgtgggggtgccggagggggccaacaccctcctatccgaacaccaccaccacatccccctgtttttactctatattgaggttaactaagataggtatttatctagtttatttgtgcagcttagaattattattagtttagttagttagcaagcctaaaaaacattagaatgaaacatgatctacaaaattagtctgtgatttctcatttttttcaaagtaaaatagaagatacttatttgtgagattatttattagtttacattaaaaggatatagcaataaagactagttccaaactttcaatgatattattaaagagctaaaattcagttttttaaaggactagtttacgcattgattgttattagcagtgactaattgaccacccttgtcatctgttgacggtcgttacagtcaaatttcgactgtcaatatgactaaaatagtggagaattagctatgcttacaatgcatatttgttttcaaataatatagtttcacttgtacttggagaataacatgttgcaagaatttatcaaataaaataaagagaaagtggagaaaacctcactcctaagcaagcaaatggataaggaggcctccgccatgagggcccacctatcagccaccctgtcgaagcttgaggcctgctgggccggcccaggttcggcggcgcccagtctggttagctctccacgtggacatccaggattgcttctcaatgacggttgtgagggtaaaatggacatttcacatgccattaaccgccataccacccctataaaaggaggagctcattcactctcgcaacacattcaagcaagctcaaattcctcttcatactttagtattagtatcttagtgctaagtggagtagaatagaattttggtatggctctagcagctcttgtgttctcttctgtaatactttctatattaatgaaatactcttctttatatatcttcggtactttgtttagtctgagtattgttcttactttatatttgtgtcgtaccaattctatgggtagtgtaccagagaggtgcaatcatgcgggtttaatgtttaatatatcagttgctctatgtcatgttcacgggtgtagagtagtattttgtaatgtaagcacggcgcttagattattaaatatcattaattgggcatatatgctgcgggagagtagaggtgggccgctgatggtgacagctcattacggatattcctccatgtcagtatatattcctaagacaaattcctggggtgtgtactcctccgtatttagccccggttggacggctatgacaggttgtcgtaaggaactcggcaacccggggtggtctctcgatgtacaaggagggcactgttagggggtattggccacatgattgtatactagcagatgtaaactaggatttgagtgtatattagaagtataggaattgagtgctttctaattcttcttccacttagttagaattactccattacgaggatttgattagctttgcttcatgtcactctaccctacattaaacttaacccctgcttagactttgactattacaagtaatgtatgtataaggtgcactagcaaaggtcactcttattatcttccgttgggattaaaaatacggtcttggaatacttccgggtgaaatactccaatggtaaattcgtgcgcttgcagatttcttctgtaaccataaatatatatatatatatatatatatatatatatatatatagtggatctagaaaagttttggtccttgtttagatataatgatctggatttataaaatataaattgtatctttataattagatttaatccaaatcatgatctcataccggtcagcaaaccgaactgttttgttcctgccaacacacatgggatatagtttgggtctggaaacatggacacaaaataaatgaaagatcatttcagcaactatttaattggaaaaaggaatcaaaatcatccctttcaaatcaaaatatggaaaagtccaaattccttccttatgtctcttctctgtttctggcatctttcctttctccgttaaagtcaagtttgcgtcctcttttcatcgggtctaggaaaatagtcctagcagaagtcaatttatctccctgtcgttacactacatctttcttttctccgttaaagtcaagtttgcgtcctcttttcatcgggtctaggaaaatagtcccagccgaagtcaatttatctccctgtcgttacagtagcttcgtcaagctctagcagagacagtggcctacacccgacgccaccccaatcctgtgcccgattcaaccaaacccgtggagataatctcaaattagttgagcgcttttgatctatatctcctaccctatcttttccctcaagaaattgaaggaaataccatggaagtcgctcccgtatcgaggtcgaagtcgagtttacctctctagcgaaccctagttttatctctctggcaaacttgagtcggattcaaccaaattagcacctcgacggacaaaaatgccaacaaaagagaggtgatgaacggaaagttaccaattttttaattagttaacacaatattggtgcttcatatataataggaaaatgttcagagtggggtggtggaaaattcaccgtacaccaccaccacttattttatagtaaagcatggatgtttttccaatgcatccatccccgcgatcatgacaccacactcttaattagatcagcatacgggagtttactattttggtatctgcctatcgcaatggcacaaccaaacttcccaaaacattaacattgaaattcacaaaacctagataaatttcgaaaaaaaaaccttcattttgtctaaaaatgtatcagaaaaaacaaagtagtaagaaaataaagtcagaaaaaatcgagaacaaataaaatccaaggcaatttagtaaatccctgaatgattctcaagaaaacataaaagctaagaaaatcccttatctcactacaagaatataggtgtttcgtgaaggtgcttaaaaaatatagaccagcttgcaaccaatcccgtctcagtaaattcctattgaaagtatatccgcaactgggtgaggatttcaatgaattcgtgcttttgctggtggtcaataatttttatttagaagtcttcgaaattgctaaaaaataaagagggaaaaattcaacccaacattgcagaccatgtgttgcccatgtgaacatttgtgtttatccaaaactaaaatgcattagcacattagttatcttacaatcatcatgcataagtagtatttacaatgttaaaccctgaaactagctacccatcgacagctgccagaattattgaaattcaaattaatttacaggtcaaagcaagcatgcgttcagtatatatacatagttggcggtactttcaatcttacttgtagtagcaaactaacgacgtatccaagcagcgcagagtcttacttaacaatagtatcccgtcccatagtatccgtacgcagttccagccaagttggcggcaccgagtgccggcggcggccgagcagcggcgactgctgcggccgcctcggcttccatacgcgctatgtccgactgcgtcctctccttgaacttcctgatgaacgtgtcggcgcgttcgtccaccttgccgtcctccccatcgtcaggcgccacgagcaccttcctgcgggtgaccgcaggctcgacggagcgtgcggacaccgccgtaggccatgcccgggccgtcacagcggctggcggcggctgtggtggtctggccggcgccggagctgcagactgcatggacgacggtgcggcacgcggagtgatcttggataggaggtaggaggaggaggccatgatcaagttggccgtgatgatggtcgatgactccaagagtgaggagttattccggcgacgtgacggtggcatgcttaattagctagacgcgccttgtagagggtggaactggtgttggaatacgattcttcacggtagtacaggcgacaatggtgctatttatatgcgagaattaatggagaattgccatctgtttggagtgtttgtcactctacgttgtaatatttaggttgctatagtaaatatcttcgacatgtggtggtccttccacgaagacatgttcccttggacccatgcctataatatgttgtccttatcttaactgagttgtagcagtgagctttttaggcgatcgatctcatcttgattttcactacgctaaactctaggtgcgttatatatcctcaggtgatccatggtttaccaaaccagtccatatattctgcaacatgagggggtcactgctatagaaaacagcatcatagccgtttagaaaacatcatgccttgaaccgtcagcaatactgagcattattgccaattcattttcgatttggcaggagcttgtttgaattggcagtaatattccatcactatctgttcacgttaaactgacagtgataagtcagcagtgatacatgtctatgtagtactggttgctgatcgtggcagaaaaagaccatctccatcgagtcaatagtcaagtacatttattatttaatttggaaagactaacttgtacatgcaaattcatttttgtcgaaaacatatcacatgacctctctctatattggtttttctctatagaatgctcattttcagtttaactctaaattaatcaacgaaatttcgctcgcttagctcgttactgacagcatattgatttggttataccttgggtatttaattaattatacttttgattgtaatatgcatggatgcatccaacttctattattaataggaaaaccatgttcttcttttcggatgtaattagccatacgtaacctttgaaacaaatcattgtcccgaagaaacggcaccaaaactttctcttcaaaaatctggtttacaagtggcatggtgggagaataggatcagatacgaccaaaggaacaacgttacgattgcttttcagataagatggccaaaggggtgatctgtccagctatttgttggagtgtcgcacatgtattcctgacaggacacactcgtcatgcttttcagataagagcatacgcagtgttgcacttagaggaggcattagaagagagagaaaaggatagaccacacactgtgatatgttttttagccggtctcaagcaagagctgggtactagtcataggtcccgattctactggaaagagcacatgacatggcccacgcgtcagacaaattgtgtctttggcctgtatgtaggagagagattatgacttttctttatcttattttaatttatgtgaggcccacaataagtacctttgccaactttatacactgcatcagttctcacgaggtgctatatctgacatgggtcccacctttagtatcgatgcatgcatgacacactacacatgctctaacgtcgtcttattgagtacagtcttctgcgcgttactccaatgctgcacttatcttaattgcctctctaattcaaaatataaggtgtttttttttgtttcgttcggataatctttgaaaaaaatgcttcaataatatatcatttttatgacaaaaaagtatatcataagaaaatacttttggattaaaatccattaaattcagctttcactgctgtgaagcatcttattagtaccggcaagtccgtaccagttactccctctattccataatataaggcatagtcaaacttgatacggtcttcaaaactaatcttagtcttataattcttatatattacaaggtttatagtaacaaaattataaccatatgaaagtaaattcaaatgttaatccaatgatataatttttaacaagtaaaaattcaattcatattattcatattatactaaatgttggtcaaaatattttgaaggttaaatcttgaaatttgtgagcgccttacgttatgggatggagggagtagtagaaaaactagcactaatatgggatttcccaccctccgagcccctacgcatctcagaagtagaaaaatgacattgttcgggatcattactgacattgtttaataaacagcattgatgtatttagtacttcctccatctgaaaatataatattttttttcctacagaatttgtcccaaatataacttcttctccaccaatattctcttatcaatcaatcgcaaccctataccattcaaaattcccaccaacctccacttctcaaccaatcataatcttctaccgtttaattttacctacttttttataaccgtgttcaattctaaaactccttatatcctggaactgaggtagtatcaattccctacatgaccgacatagaaaggtaactattagtgtcagtttttgggcaaaccgacacaaaagagctggtcgaaggaggtgagtcaagcatattggcagagcgaaataaagatttaagtgccctcccatccgcatcgactcccctcctcttccaggctcacactctaggattgcctcgcccttctcgccccactgtgcgtgcctcccccttctctcctcttacttctggttttgccccctcatcagctagtgaggaggctgggatgctagatctagcgactctagcctccccaccggtggatccgtctagccaaactgagggcgcaagccgatcaccactcggatgccttcgacgctcatcactaggctacctccctatc

SEQ ID NO: 83483 - DNA, 3995 bp, Oryza sativa
  unsure (1)..(3995): unsure at all n locations
tcgtgacgaaatgcangnnnnnnnnnnnnnnnnnnnnnnnnnnnnnnnnnnnnnnncatccgcccacccagcgattccagctccttccaagcgtatggtgcctcgtcgttgttgatgggagtccccagcggggggtccaccatctcgaacaccttgaacgcccatgtcgtcggcggaaagaggggaggatgaggaacgagcctgacgaccatgaggagactctcgccggactccaccaggtaacgaacagcgaagcctccgccgtaatctcgcccaccacgcgagaagcggcgaacctccttggccggtatctgcagattgccgtcgtcgtcttcgtggaagcccggtaccgaaaaaacatggaggttttcttctttcgtgaagaaatggaaggctttcttgtggtgtatgacatcctccagaactgacgtggtgacggactcaacagcagtcgccttctactcaacttgatgctccatgcgccagaacacatgaacgcgtggatcgtacatcacgcagctgtggccgatggcggcagcgaggcagtgttcgtcgtccggtggcgaagagagcgtcgcggccaccatgtccgtgagcgtctcgacgtcagcgaggggtaatttctcgtcgccgcggaggctgaggagcgcatagtcccaggtgcggtagaagcagacgaagacccagccaccgtcgtaggcgccgaagtagcgcgcggcgcgtgcgtcggccgggagcgggtggccgaagccgtgggtggcgcagccggctagggcgcacgcgaaggacgtcctgtatgcgcgccggacgagtatcgacgggagcggcctcgtccccggcggcggctgcggctgcggcgcgacggcgacgcgccagttgtggcagactcgggccatgcggcggcggtcgacgaggcacgggaggcgcttgtggacgaggcggaggacgtcggcgttgaagtagaaccatggcgcgtccattggagagggctcgagaggcggaggcgcggcttgccggtggcgaggtgtgtgtgtgtggggaatgggttcctctgcttctggaaggaatttttttcggatttagatttttttttaaatatttacagaaataatctatcgaccaaaaaaattgcagaaatagcccctgccgcccacctctggggcggcaagctgacgtggcaaacgggggaggaacggacggtgacggagggagggttttttgcaggaaaacccttgccgccctctggtggggcggcaaggggcccgaatgcaaaaaagccagtcggggccggctattttgcaggcggccccttgccgccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgagagaccggctgagaggagtgtaccttctataaaaggatggttaatgaggggcttgagagttgatccacagacaagtgacataacaatcaatgttatagtaagtcgggcaactgagggtttttattgggaactaatgccacttcaaaactctcgagtgtggagatggtatttggaaaatgcattgcaacgcgggtggcctctagctttggttccgtttgttcacccgaaggatccaggtgtgcagacgaacatggatgatggcgagggaccaagtgctgaagtaaacgagacttctgtggaggaggtcaacgcacgagaggacgggggcgtagtagctccagtgggcattcaaccaggtggagtggctgacgagggggagactgtcggtgccattgtggatgaaatggagagggaggattctgacaacgagcgtgtagaggaagttgattcgtcagatgatgagacggatattaatccagcagaatgggctagtgaggatttttctaggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagttcggtgtgttaaggaaaaagatggttgtccctggagagtgcacgcgtataaggggaaatggaaggattattggacagtgtcagttgttaccaagcatacatgttttctacctagtgttcagaaataccacatgaacattacatgtgcatttgttgcatctgagatgtatgcgcatgtcatcgataatctcacatatgaaccaaggtcaataatccgacacattgaagagacatacaagtatactattagctatgccaaggcctggagggccaaacagaaaataatagagatgagatttggaacttacgaagcctcgtatgataatttgccacgcctgcttggtgttatcgaggaaagaaaccctgggagctcttacgaagtgaagaaattcccctcaattgaacatcctggcaagagtgtgctgcaaagggcgttcttagctctacatgcatgcaagatggcattcgtgaactgtcgtcctgttctctgcattgatgggacattcttgacaggaaagtatcggggccagatactaacagcaataggggtagatgggaacaatcaggtattgcctttggcatttgcttttgttgagagtgagccctcacaatctttcagaactcagtcacattcagtactctcttccccacttgcttcattacaaatccgaccggctttcgtcaatggctagacgccggggtgttgaggatccaaactggcgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagatccgcactacggcttgcgcatacatcgagtgggtcgatacagaaaatcccgttctcgacctaaccacttgtttacaagaaggtcgctggtatttcgcatccgaaagtactgagcaatacttacagagaaaagcggcttatgaacgacaatgtcgtgaacaacagagcgactggcgggtgctaactacggcactccctccatgggaagcccgtccaagatacaggtgtggtgatcgttgtcaggttcttcgttccataaatcctacaacattgggtcgaaggttctttgtttgtccaaatattcttgacgacgatttcatggtaagaatattttgattacatgattccttattttctcacaacatttactaactttgcttgctttacatctattctttcctcccaggaaccaccaaggagatgtcaatacagagaatggatagacaccagaagggttctaactccacctagccgtgttgtgcagcttgaactaccagagcaatacagggttactaaancgggttgtgaaagag

SEQ ID NO: 83484 - DNA, 1302 bp, Oryza sativa
  unsure (1)..(1302): unsure at all n locations
gcttagctgcgtgcgccatccatggagccggccacgggccgcgctttgtgcactgctcnccgtattctctcgtggatttttgtcccctcccaaccagataaccctagtggcactcgggcccagacacacatacatacgtacctccactcacacacaaaccatggtgtacctagctactagtactaccagttatcgttcaaccggaatctgttgtaacgcacggatacttagctgataggatgtacttccgctggtttcattttaattgacgttttggacaatgacacggtctataaaatatatttttgaccttatttttctattataatatatataataaataaatgtatgttacttttattatagtgctttgaaagacaaatctatatatgttgttctaatttctttaaactaaatatttttaaagttattgatggtcaaagttataaaagtttgacctcaaccttgtctaaaacgtcagctaatatggaactggagggagggagtatatcctctctccgtgtaaggattaatccttagccagttcctcctgctctgggacatggtacagcctatccagctgcaacctcggatggaggacaaccttatctggcggtggtcgaacaataccgccttttcgatctacctcgtcggcttataaagctttcttcacggggcaacacttgttcgcgtgtaccgaccccctctagcatgcgcaagcgcttgcgaagtgctggtttttcctctggctggtgctgcaaaagtgttgttggatcgccgatgtcatgttgcgtcataccatggagagccacattgcttgccccttctacacccaggagcaggagacgcgaaccatatcatcatcgcttatgtcttcgactcttcgctcgctaggtctagttccaaatcctcgcgccgctggatgggctgatgttgccctagaccatcatttttgggtccaagaccggtggccgcaaacttggcatcgacttgcgagggaccatcaccgccccttcgattctattgtttcgttgacatcctggcaactatggtagaagtgtaatgcgtgtcttcgacgctgtcctatcgtcagttctgatcatcgtcgagaggattaaacaagaaggaaggctatggacgacagcggatgtatcttagttaggaggcttcttgggaggatatgcttgtgctcgtttgttttcctcttgttttggggacccatctcgaaatagcgcttctttgtgcgtctagctagcccgcccacccttacgagcgctccgacgtattcgtggtatacaaaat

SEQ ID NO: 83485 - DNA, 13844 bp, Oryza sativa
aactgcttttgatttggaggagatgttgcaccatgctgaacctgaagttgtggctggctctgctcgtggtttggataatttcaatgcattacaaaaggcatcaaaggaacttttctacgatgacgcaaagggttgtggaaaggatttcacattgttgcgtacggtgcttgaacttctgagattgaagtctagaaacaatttgtccgatagtagtttcaacgatttgttggttctactaaaagaattgttgccgaagcccaactcaatgccaaccagcacctatgaagcgaagaagcttatatgcctgttgtcattgggtgtgcaaaagatacacgcgtgtgttaaccactgtatcctgttccgtaaagagtacgaggatttggacagctgcccaacatgcaagagtagtcgatacaaaacaagccgtagccagtccgagggtcaggatgttgtccttgacaatcttgaagagtccgatccatgcaaagacagcaacaaaaagaagattccccagctggtcatgtagtaccttccggtgaaagatcatttgaagcgtttgttctcgaacccgaggaatgccgaattgatgcgctggcatcatgaaaagcgaaaaaaggatgggatgattcgtcatcctgcagatgcaagacagtggaaggaatttgacacaaagtaccataagtttgcagaggacccaagaaacgtaaggtttgcattgagtatcgatggaatgaatccattcggtgacttgagcagctcacacagtacgtggccagtactcctaaccatgtacaacctctcaacgtggctgtgtcagaaaaggaagtatattttgttgaccatccttgtacaaggaccacgacaacctggcaatgacatggatgtgtttttggagcctttgctggaggatatgcgcgatttgtggaaacacgggatctgagtttgggacgaattccttcgggagtacttcacgctacatgcaattatctttgtcaccgtgaaagactttcccgcactgttttacctattggggcagatcaaggggaagacaggttgtgttatttgtgtggatggtactgtgtacaggtatcttaagggatcgaagaagctagtgtacatgcggcaccggcgtttcttaagaaagaaacacccgtaccgctccaaagcagaatatttcgacggtactgttgaggaaggtgatgcaccagaaccatggaagggtgataaagtgttcagaatgaccaaaaacctgaaggttgtttttgggaaggtaaaaaagaaggaaatgaataagcggaagagaaatgatgccgaagtgccagtaagctctagcatgccattcaagaagcattccattttctttaagtacctttcgtactggaaagatttagacatacgccattccattgatgtcatgcacctagagaaaaatgtcttcgatagcaccattgggactatactggacataccaactaagagcaaggataggctgaaatcacgtaaggacctcgtggatatgcagataacgataaagcttcatcctgtggatgaaggtaataatggaaaagtgtaccttccgcctgcttgctacaccttgacaagagcgaagaaaatggattgtgcaaatccctacatggggtgagagtgcctactggcttctcctcaaacattaagcgaccagtgtcgatgaaggatctgtcgctttcgagctacaattcccatgactgtcatgtaatgctcacagtattccttgccattgcaattagagcagtcgaaccagttcacgtaaagctggtcatcacaaagctgtgctatttcttcaattccatatctcagaaagtaattgatcctgaagagttaggtcctctccgggctttcgctatacagacagtgtgcgaccttgagatgtgtttccctccatcatttttcgatatgatgcaacacctcatagttcatatcgtgcctcagataattgcacttgggcccctttacctgcatcagatgtggccttttgaacgatacatgtccattctaaaaagctacgtatggaaccgcgcccacccagagggatccatgatagagggatacacaaccgaggaggtcgttgagtgttgcattgattacctaaaatatgggaaagcaattggtttaccggtacctcgacatgaaggtagattatctaggaaaggaacaaaagggaagaaaagaatccacgacaatgactacaaaaaagtgaaagatgctcatttcactgtactgcagcaactcgcattagtggagccgtacataagcaacacctgcaggaattacaagcaacaaatgtgggtcgatctaatagatggatcatgaagaaacacaagcatcactttactgaatggttcaaggacctcgatctaccagatggccataccatggaagaaagaataattaaaatgctagttgacgggccatcaagtgtgtacacctcatggcaagcatatcatctgaatggatacacgttttacacaaaagcgaaagacaaaaggagtgcatgccaaaatagtggcgttcaagtagaagcaatcgacacaactgggcaaaagagcacatactatggattcatagaagaaatctgcgaactaaactacgggccaaatatgtagattccactgtttcggtgccaatgggtgaaacacccagccggcatgtctgtggacaactttgggctgacaattttcgacttcgacaacgtaggccacaaggaagacccatgggtgcttgccgatcgggtcgctcaagttttctatgtgacagacccatctaatttgaagaaagacatagttatttcgggaaaacaaagtattttgggagttgatgatgtcgaagatatcgaggcatacaatcaatatgagaacatgatactatttacagattttcgaaacaagatactacgcgtcgaagaatcaattggcgaatcgccgaagccatacatgagaaatgaaggtgtagggagatatgtgaaaggctaattcatgtgaactgatggatgatgaatatttatgtatgaagtgtgacatgcatgatgatggataatgatgaatattatttaagtattaatatgtgacatgatgaatatttaagtattaatatgtgacatgatgaatatttaagtattaattttatattttttattcaaacaatttaataaattattaattcttttcctatcattatgattcaaacaatttattaaatatttttatggatgttgaattatttatgttgtgtaaattttatttacatatatctgcattaaaaaaagaaaagaattaaaatcattaaacaattttcgctggcaggccaataagaacacttctagcagaaatcattttcgctggcggtgagattaggtggccggccagtgaaaaaccatcgcctataagtacgcaaacgaccccaaaattttctaagtacggcgaaggcgcgaaaaccctagcgccgctaggctgcccaaattttgtgcgccagcgaaaaaccctagcgcctcctccgccaaccgccgctgcctcctccaccgcctactccgccgaccgcctcctccgccaacctcgtcctccaccgaccgccgccacctcctccagcgcctactccgccgaccgcctcctccgtcgaccgcgtcctccgccgaccgccgccgcctcctccgccgcctactccgctgaccgccgcctactctgccgaccgccgccgcctcctccgccgaccaccgcctactccgctgaccgccgcctcctccacaccgcctactccgccgaccgcctcctccgccgaccgtgtcctccgccaaccgccgccgcctcctccgtcgcctactcagccgaccgcctactccgctgaccgccgcgtcctccgacgactgccgcagcctcctcatccgtcgacctctgccgcatcgtcgctggtgagcatatgatgaatgcctgggatatttgatatgcatggtttgatgaatggttgatgaaatgcctgggatgatatttgatgaatgtttgatgaaatgcctgggatatttgggttaattctgaatttttcagtacaaacagtacatatccccatttagcaaattctgaatttgtgataaacagtacatatcccttttttcctcttcaataacagacaaacactttgatcgttaatttgcagggcagctcaaaacacactaacacatattcttcttttttcagtgaacactgctcttcttattataaaaactgaaagttctgaatttaatctgaaactcaagtgcaaatgtgatttaaatgctgaaatatgctgtagagaaaactgaaaactgaaatctgagatatcttcattaattgagtttaggttctctgatctgaattagtaatactgaatatagttctaaatctgagttagtaatactgaatatagttatacaccttttttaaagctatggaaaaacacaatgaagcacaacccgcgggtgacaagtccaatgaaactgaacttatcggcttgcaagtaatcgcggaagaattgtcgtcatcaagctccggtgaagcagggagtgactcttatcactcaccgagtgaccctcatccttctcctccaagaaagaataagggcggtggtgaggacgacgaggttgactcggattacattccccctgagccggtggtacgtaacatattttgtttatccaaatctaattgtgagtgcggattttaaccgatgacacgtcagatacaattacagaagaatgctccacgccgctcaaaaaggaaagcgcaagccgcacctatagaaagggaaccaactgtggaagccgcatctgccgtgcgcccaacagcttctcgtaaacccaaaaaaagaagaggcgagcgaggcaaaaacgtgctgtcaaaagaagtccacgcccttacgcggatcggtgagaaaggggaacccctatcgcctgaagatgtatgttccaagtatagcaaccaatgtggggcaatagtaagggataacgtggagatcacatttaaagattggaagaaagttaacccagctaaaaagaacacgtgttggacggagctgaaaagtaagttttcttttccagaagggacagacgaagaagcagcgaaggatttcgcgctaaagactatgggcaagttatggcgaaactggaaaacggatctgaacacgaaatatgttcaaaaggatcgccaaccttttaatgactatggaaagataacaaaggcctagtgggaagaattcgtggccttgaagacatcagcggaagaaaaagagaagagccagaaaatgttagaactggcaagaaaaaacatctatcctcatcatttgggatcggccggttaccgtcctaaagccaagaaatggagaaaagaagaagaagaattaaaaaaggcaggcaaaccaattcctatggaatatcataacgaacgagccaggaactgggtgcatgcaagaaccccatcttttaactcgaagggcgatgtagtcttcaaagatccaaagctccagcaggtagccaacaagatgaaggagatcgtcacacaacagaaggatgggatattcgtgccagacagagaagtggaccaactgtcagttgctttgggaacctcggagcacggaggccgcgttcgaggagtctcctcaaaggctagttggaaggatggcttcaaagaagatgctgctagctacaagaaacgtgatcgatataaggaggagttagtggctagctgtagggcagcaacattgcaagaatgcataagattttttaaccgaaacccggaacttcagcaacgcgttgataggatgcaagatgcgtttcctatgcccgatgtccctagctatccagtcgatgatataaaggaagatactccttgcagactgcttattccggttagaaggacaggaaagacaattcaggttgcaactggaagggcaatgccagggcgcagatttcattgccaagatataccagatgactatgccaaggtagaggtgcggacggtaaatgaggatcacaggatgtacgagatagactttccaacacccgaggatatcgtgtaccttggagatgcagttgaccagataatactatggcacaaaaaggatattcaattaggatcaacggattctccgccaaggatactgcggtcactatgtcatgccttgcgtaacatggacgaagaaccgggggatcctccagaagatgcatcacctcggcatcaacctgaaaagcaagccgatcagcctgaaaaacaagcagatgaaccagagcttgcaaagcaatccaatcagcctgaaaagcacgcagattaaccagagcttgcacatccaatgcctgagcaactagagcctgagcagccaatgcttgataaagcagagcttgaaagggaagaagaggttgtacaagaaagggaaaaggaggttgtacaagagagggaagaagaggctgtagaagagcacaaagaaaaaagtgcgcccaagaaaaagtttgtggtaaaggcattcccaggaaggaagagagatatcaaggggaaagcaaaggatgtttatgataaaaggaaagcaaaaggcctgaaaataagcttggataaaactttgagttttattcctactgttgatgtgccagaactatttgagaatggcaaagcattcctccccacatgggaattagaagaaggaccttggcaattaaaaaggtggcatgaatggtacatgaaagcaagtagaataaaaggcctttcatcatttacagttgccgtttcagaggaggttttcatgagcggaccatgtctactacatgttagttttaaggatatgcatgttctctaccgtaggcaaagactcgatgccaatttggtcgccatttggtgtctgtaagtgcacgagtactagctaaattgatgatagtacctatgcattatagtactaactaattcgatcatccatttttttgaaggatgaattacgtcatagcagaacagatgcgtgagactgtcggcttcctagacccttgccttataagtaagccgaaccacaccttcacgctagatgagaagagggtaccggcacatgttgcggccatgactcccgaagagagagatgcatacctgacagaaaggcatcaagctaaaattcgcgatgtggctacttacgtagctatagcacttgaatcaatgcagggcaaagaatgcatctacgccccatacgcctttgagtaagttttcgtatctaatatctactacgagtatatacttaatcgcggctcgactaaggatttttttttttttgcagcgaccactggattacttttcttctatatccaaagtataacgaagttatagtcttggattctcttgataaagacatacaatcatatcaggaaatcctcagaatcttcgatctgtaagttatatatatatggatgattgttttattctcatgacaacatgttgttagctttgatgaatctaaattaattgttttcttcaagcagtgcatataaaaggtattaccaggtaggcggacaacggcgaaacgacagagatcaaatatacatccgcaataagtggccggtaattaattttggacgacatacaactacttaattttttataaatgcacgtgtatatccatttataattaactaatataccttatattgatgtcaaaagtgtccaagcaaccgaagggaagcgtactatgtggatattatacttgcgagttccttaggatcaatggtcaatattgcaaaaattatggagatgcaagtagatgccatcaatacgtttgttaaattaattgctaactttgaattgctaacaagttctgttgccattatctcgatgcagcttctaaaattccccaagagtgatagggagctggatgataaatccattcagaatatacaacgagacttgtgctatttcattcacaatgaatgttgtcaccagcttgggaggttttttgataaagaagggcttttgggcttgccagaaaacgatattctttctaactggagcaagcatgcaatttaaattcaacgtcaatatcattagtcgacttttaagactagcagtagtgggatatagtagtagttagcacatagctgattttgctgtttatatatgtgaaaatgtccaggtctgcaggtgatggagaagaaggtggtgaagtctgaaatctgaaatctgaaatctgaatttacttttgaatctgaaatctggatggtggtacctcctgctatttttgttgctgctgctattctgatctgaaaatagatattgaaatgcagcacatgtatgtttcagacaatatattaaaattgagatgaactatgctgctgcttctgctgattgcgattgaactgattcaggtgaatgctagctttatatatatagggacattttattttgtaactgaaactgatctgcaagatgaaaaatgatgtgatgatgtcccagctgtatatatgtgatgtatggctaaatatatgtgaagagctgtaggactgaatatgaatacgagctatgaatctaagtctgaatctgaatttagtgcagttgcagtactgaaccattgcagatgggattttccaggagatgagctgtttgctggattttcaggaattggtacattcaggattctgtgctgcaatttttgaatttactctctgaaatggatatgttctgttcagaaatatatgcacataagttaataaatgggtagatgcagaaatatatatacttgtcctgaaatttatatgttatgttctgaaaattgtatacatatgctgatctgaaactgatcaagtgcaaatgtaatttaaattatatatattctgaaatctgtcctagtatatgttttggagagctgtgggtgaattctgaaatcagacctagtatactacctgtgggtgaattctgaatttgagcacaaaaagatgtactgtattctgctatttttctgaaatctgaaattatatagccaaatagtgtaagttttcactggcgggccacgtgtcaataaatggctggcgagaagtttaccctggcggcccacgtgtcaacacacagatggcgggcagttttctctggcggcccatgtgtcagcaaacgactgactgaacgcatctttgctggcggctgtccttagtcagacgctagtgaagcaagttttctctggcggttagtactagcgagccgctagcgaagaaagttttcgcttgcggctagctttagcgaaccgccagagaagagattttcgctgacggctccattgagaaagccgctagcgaaaatagatcttctctagcggctggactccgccagagaaaactatacatcttcactggcctctactctctggcggctcctagtaccgccagcgaaaacctgttttagccgccacaaaaaacgtatttcgtagtagtgtgtgcgcgtgtggcctcctcttcgccccactccgattgtggatgacgacagccatgctagaggaggtggatcaggtgacacgagattgatttgcgaaccagtgagttccgagcccaagatgagttgttgatatgtgaactagtgatttcttttactgatgagtatttgatccgtgtgttaatattgcggatcaatatatgttccattacggttgatgcagggttatttaggggttagtatttggggtttttctttgctgtatttcaagcagctgatcacttgattgaattaaaacgtctcgacgcgttttttagggcttgtgaacctcttcatttccggaccaaatatctgccacttatgaggacgacggatcatcaacaccggaaatccagtgccgattggagacctaagagcacccgcaatggtaaagtaaggtgctatctataaaacatgtacatctcagcaatatactagattaatagtaaaccacttcaatggtatgtctacatgggtatctatagctctataatccattgcctcgtttttctctatagactatctctaggttagtagatagctttgctctctctctctcttcatttaatctcttccaagtagaaaaatatgctgacatgaatctcttgtagagagcctatagataatcattgcgggtggcctaataacaccgatatcctgccatgctggccagagtagaggatctgaagtggtagtgtttacatgataaaaacttgttttttaatatacgacgttactttttagatacgtttgaccattcatcttgttaaagagaattatgtacttatcatttcttttgttttgactaaatttatcgtcagcattacttaaaatttctaatatctgcaaaaaaaaagatgaatggtaaaaaaataaatggcatcatgtatttagaaaacgatgatagtattacagtacaccaattattggtcatgttcagaacggagtgattgttcaaatacaaaatcatcactggcacgtgcaggccattggttatttaattaagttcacaagttctgttcccacctccgttataaatacaaacaaaagttgtgtagaattaattgcgtgaaaagcacatatgtatgttcggtaaagttccattaagttactcgctaaaattcaaacataataaattaacacgataagaaagcaacaacgagattaattagttgtacacgtagccgcgcaagtgtgttcttcaagctagtagacaaggttcgcttttctatctggtaagatgacaaaccaaacaagcacatcatgcataccgtcgctataactactaaaattaagctttagacatatctatcgcgtcgtgtccccttcttccactagagtctacgatggtattctaagccttcttacattttgctttcttgcttcatacggcctagcttctattgttccattgatcataggtggtatcatatatagaataatggacgattggccgtatcttgctttctaatgtggtacaggttggtgggtatattttataggattgaaacacaagaaaagtctgccaaagaaaatgtttggcagtaacatcaaaaactattttttttagaataaaaggaaaccctcaaacctcgatgactctcaaaccctcacatctgcccgttggtctgagcaccacctcctcatcgttctgatcgctcttattgctttctatagcctgacaacgctggtttgaccgtgccaaaaccaccggtccaaccgtagctcctccgttggtccgatcaacaaaaccgagaaaaacacgaatcaaaaaacttaaaagtagatcaattatattctttctatgtgtgtttataaattacaacaatagtacactaaactcgaaatctagactaaaagcttattttcgtcgagactgtcctctcaccaaagcctcaaatccaacatgtataagtagtcctaattccataggaaacgtacccaaacaagtatcaaatgtatcgttattacaattgaaactctatctttccaaatttggactacttccaaatttaactatgtatcccatatgtacacaatcccacttgtatactatatgaaatctttaccaccatgtgcattgttctttagaatatacataacacgtgatcttctttttgtccggacatcaacttctcccaagtcgactcccgatccatcacagacaacactctctcaaggcctcaagcaacaccacatttggataaacaagaaaccatatcagagcacaagttctttccccaacatgacttaatattaatacacaatagtattacatacgcatagtaatcatgcatgtcgaattcataaacatgaagtaatcacgagaatccaaaagattagctcaaatcagaaccgcccggtcagaccgtcaagtcagtcggtctaaccggtgcccggtctgaccggcattgaccgactcgtctgatcacatatctctataagcaaaacaccattcacagtaaaatcaaaaactttgttcatcgtcaaacctcggtccgaccagaccaatccagagcataaaaccctagcacaacctatgtctggtccaaccggcattacatggccggtctgaccggatatatccaaaggcaaaactgcacttcaccaatattccaccaaatcaaatatgatcaacatttccaattaattacaaaataataatcaaacctttcttttatacatttctacgcctagtactaattagatcaataacatttttagttctttgaacagttttacgcataattattatcgtgttaatgcttttgttaactacattggatcttagcatggatatgtgcgaacttcaagcatatatatatatatatatgtcatgtggttacccgcgtgttgcaacggaaaaatttagaaatacctacaaagaacatgatgaacataatttgtaatatccataaagacaaatttttaagcttgatagtatgtgatataagattatgattttttagacgattatctccacctatatatatatatatagtgcgtgtgccttggtatagactaaaaaacataatctaagatcgatgctttatttcattcccacagtttacgctaaaccgttggcttcgccagggcatccagctgatgagctgaataaaccccatgtcttgcttggcattcactacaccattggtccccatctcaacctttccgagcttcgcattttcatccttctaggcagaaatctgccaggaataccccaagcaccaaaacaccatcagggcgatcggtccatgacattccttatcgtcgggaaaacaaagccaggtactgttggaattgtatacaggatattcgtcgttggtgatttgtactactaccaccatttcaaaatgtaaaacgctgttaatttttcgcacaacgtttgactattcatcttactaaaaaatgtagtataaatatataaaaataatactccctccgggctgataatattagttgttttgaacaagggtacagtcaaactttataatctttgattataaataatttctaaaatatttgtcttaaaaatatgaaaaccagatgtgtagattattcttaaaaagtacttcaacaaaatcatatatttgttgatatttctatatatattataatataaaatagttgtcaaagctactttttggagatcgtgcccttgtcgaaaacgacaagtattatcaactcggagggagtataagttaaggttatactttacttgttgataaagcaagtcacaacaagataaatgatatttatataaaatttttgaataagatcagtagtcaaaaattgtgtaaaaagtcaacgacgtcatacatttcgaaatagagagagtatatcactcgaacagaacacctcatttgtaaagggtggcaacccacatttgtgatgcataaacgtctcgcgagtgattagtagtcactagtgagaaaacctacatgttagaagttaccatccgtcatggaggagtcatcggctacggatcataattacaaacctttatgaatgagaatttacaatttacgaattttaaatgcaaacaaaagaccctaatttattttaacgttaccacggtattccaacattccaaccatggtctcacattactggccacaaattcatgattttcaagtaaaatgtacaggcacaacatagatgtttataggccaagacctctcaatacacacaaaccatctattccatctcacctatagtccacgtgttgataggtttcagatgtcattcttttgactattgcttttcaaacgtgaggcgctaatttgacatactagatgactctaaatgagaattttttctactacaaagttgaatatatcatcgagttctacaacttccata

SEQ ID NO: 83486 - DNA, 8805 bp, Oryza sativa
ggagttccggaatgtctgcattgctgagattccaaaccaccatggaaagggccaattgccaagtatgccgtggttggtttaccggtggaaagggcccggtgggaaagaaagaccagggggaagaagcggggtagaggaattggtcaactcattaggctcaaagcacagactggcatcaaggagtccaaagcatcggttgcttccacttgtttgttgcctctacttctacttggacagctcagcagccctatattcccttgttccagcaagcaaacaaatagaatagttggaacgaatagacaagtaggacagtgttactagctagttaactcagttcattcttgactttcggcttgtagctttgctacgcaacctcgcattcgaaattagtacttgcttggacagcaggtaaagcagggacagtagtatatggtagtcctttcttagggtagggcgacgaatacttcaaattccggaaaggggtcgcgaagctaaagcgaaagttatagaaagcccctcaataatagactcgcacctgggagaaggagtgtttttaatttttaagttctagaccttgttgagatctacaactttcatatagagcatgtctctatccgagttatttgtgaaattcaaaaatttaaaatttctcccatctgtgacaggtactaccacccatcgtagataacgttatttgtgaagggtaatagttatggcccgtcaccgatgagtgctttcattttttatgggccttctcattacaaccgtcacagatgatttgttatatgtgacggggcatgtttatgacccgttataggtcatatgtgacgtgttacaactatgatccatcacagatgaccttatattagtgatggatcatccccagtagcaatatcttaaataggatacattttgaccaatttgagatgacttctaatttttctcattagtccatcgcacatggctcatcacggatgcccggctctacagtagcatatggcatctatgtctgacctaacaaagaggaatcctcaccatttaagcacaactatcggtctcagttagaaaatctattctatacaacactcttccctcccaagaatgaaactcctcccaccaacatccaaaggcacaaacccacttcacactacagttaaaagctggtcaaaatgctcccacgtcggttagaccttggtcaatccgatatacggacagcccacactatcacctctttacagtcttcatttcacataatgtatagagtgacgatatggctatcgccaaaatgaactcatgatggatctactattcttaagcattgcttttctaacatcatggtgcgaatgtgcttgtagcatgatgggacataccatccagtggggagctacccacgaaggatcaaatcctggtcttgccaaaaaaaaaactcacatgctttgaaaatagtacggatcaagaattggcctacgtatattgagccctcttgtaaaaaaaaactcacatgctttgaaaatagtacggatcaagaattggcctacgtatattgagccctcttgtatgtggtatgggagtgagccctcgtgtaggggtacaagcctaaaagcacagattaagtatcaattcatatccgtgtagggggaccgtttcgggtgccttttcttaattgtgaagatgtgatgcgtttaatatgtgtaagtatttgtgaagatgattgaatgttatatgttgaaatatttgtgaagatgcttgcatgtgtaataaattatagatgatattgcttgcataattttaagatgtatattgagttttaggatgtagtgggttataactatataggaggtgtacataccttgggaatggtcttttttctatgggcagaatttattccttccaaatgtttttttaatggcgtctcagaatttagaatgctgtctatatgttggcttcgttttcctctttatcagttctgtttataggttacaaatggatctttattatatgtatcaatataattaaatatcctagagcaatgtgcttggtatcatggtatgataagaaaaccgaataaacttatgaattgtagccttggatgaaaagaccagactcatcccgttggacaacaactacataaaaatagatataacttgtgtggcgattaattagctatatatcctttttcctgaacatggtaattgattctctaccattttgcctgaacacatggcaattaattcgcgctttttttacatctgtggaaatattaccagcacgtacttatcctagaattttagaaataaagattccaaactaactctcctgcttagattcctgtgagtaaagcaagagctctcgaccaaaacaagaggtttacaagcatggcaaaatgcaataagtaaaccttttgggcttgtctccattattggtgcgtggattcggatatccatgaatcaattcgcagaactccatagaaatattgacaccttttgtgacccccgagatttgtatacaagaggcagagatatggaccacacaatcatacaagagtctgtccaaggattgattcttgctatatgttctgcccttttgtgcctaacttgcttgagctaccatccgcagttaatttacatcaccagaataatctcacaataaactgatcatacaacctcttcctagcgcgtgacattagcatgggatataagcgcatgcggcaccttgaatttcttagcaaatacaaatactgatagtcaaacaaacagttaaatgcaacgtaaacagctactgagttacaatttctttttaagaacgtaacacagggtttcaattgttgcaactatatagtttaggcccacgaagttgaataataattcccgaaaaaaatctcgaaggccgacaaatcactactatagaaaacctctaataagtactgactcataggtgctggttcatttaaaattggcatctaatgatcgtgtcccacctttgtggaatgcaaaaatatagaaccagcagatttgagtaactgtagatgccggttctagagaaaaactggcactaatagtactaattttttaaaggataggaacctatagatatttcaaaggtgtcagttaattaaaaaactgacacctataatataacacccataaaaccgagccaagccgagccggtggggtgggattctttttatccccactcctgcaattcaaccgcccttatcctccgacctgcgagataacctttgctactctctccatctcattttctccactaccgtctccacatcccgtctccctccttgctccctctcaactaagtatgccgatcggttgccatgcgcatgacgagcttgaggtgcgcctagcgaacgtggatcccaaggtacgcatggtcagggggcgggtcttcgtcatgatcacaggcggtggggtcgtcgtgccagtgacgggtagcgccgtggacagtagaggtgggatcgggggagccatagcagctggattcatcccattcacggtcgcacgggggctcgcatcgtcggcagcccaacagggttatgaggcatggcagtggcggtaggtgtcccatcgccagccgaggaggcaagatatgggcttaggtcaaaactcctccatttctaacagtggaggagtcgaggcttggcggatggggggtgagtagcagattttggaatactagttgaatgtccacgattttctacggataaaagaaaatacattgtaatatgtccatgctcttctatttcttttttctacaggaaatattcgccttaatttgattttatatgttgatgttcatctagaagcataattgttgacattagcaaccaacttggaaaattgttcttaccttgctttctggaatcacggttcatgaaccaacaccttttacatcaagtgagaaaaacatacataatcttgtgaagaaaatgtccttagttagccccaagcaatccttgaaaagccaaaaattctaaatgtgcaatgctcaaattgaaactataacattggcttcaaacatctctaaacctttggatttaatcagggactgattcatctgaccattgtctaaacgatgtaaaatctgaaagcttcatcttttggattccagaaaagaagtaattatgaaactattttactagattggcccaactcctgatataactagatgataccccgcgcgttgctgcgggatattaagtattgacataggtttaaagggtccgtgcacagattctaaatggaaggatttaacataaaagctgcacagatgtacaccattttcaaagaaatgagttagggtccttgtataataggagcttattaaggatgatgaaccaataagtttaaagaaatgagataaagagaagtctttctcatgtagcgacaacaattgaatggtcacatatacatactttggctggagctactgtaggctatctattgtctaactgaacacagtttatatagaccaaacgcttgtttccaaatgagaagagcaaagctgaaaaataccttatacagctaatatcgatgatatgaagcttattgcccagtcaccaatccctgttttatagatgagtaacctaatatacatacaaattcggggggaagttctgcagattgatcgactgaactgacgttagcaattggctaatcgctctgtaaaaaaaggttattggttcttgcctcctcaaatacataagaatgaaagataaggaaaatcaagaaattttttgagataataatattataatttaaattatgaaatcaattaacatttgtaaagaaaatcccaggagggagggacctgcagagactatacctttcacttacatcattgatcaccatgctgcatatgatggaattatctccaatcacatcatgtgcaaaatcaccgtctgcctggaggatgacattttttttttataatttgtcacctcaaagaataatctatagtcgcataacttgcatatcaaatactgtagttgcttcactggacataatactataaccagtataaaatataaaattcatggacagttgcaaggtaacttaaatgattgaaaaattgagcatagcagaaaatgtatattttggaatcaaatctagtagtatgtaccaaaaaaaaattgtgccaatatacttattattcaacgttgtagggtacttgaatccagaaataaacctacagtcaaatctgagaagaaagtgaagcagggagtgagtaatatgcaaccacaaatactgttgtacggaagaaaagaggtcaggttgggatactaaaatatatgtcgggaactaatagctgaattgccgagaaacaatctgcatcaatcaatatcgattagaaagagatatttacctggaatgctgtattagggatgaaccgggaacaatagggatcagcatgaaggggaacaattaatctcatcgcctagaagatggatccatgaacctgtgtgatcgtatggtgcagcaatacaacaaacaacataatgtgtgtaatatatacaaagaagacaggaagagggaggcgagacaacaaccaaataacgcaggtgacatttattaggagaggaagatggatagacaactgggagccggctaggcctgcgcatgtttcccttgaactggcgcggccgcgcgggtggtatggctcgttccgtcgcttgccctactgccgacgatcccctttatgcgatgcgctgatgctgttggtgggagagagggaggcgatgcggtgcgagcttaggtcacgcggcatgggagagggaccacctgcgggctgcagcactggaaggtcgcgcggcgcaggaggcggaggacgtgctcgttgggattcgatgcggcggaagagcgagcgttgcagtggccgcggccggtgggggaggcggagcgtgatgcgggaggagaggataagatccaggtggacggcacgtgatgcggtgtaggtggaaccgtggaagcgcgatctgggcggacggatcgctcgatttagatccaacggtttggagaaaaaggatgacgtggaggcaccaggaagcagagaattcctagtagtggggatgatttgtataggtatataggattagctagtaaagaagaaaaccaaatgaacatcgatctagaaagtgatatggaaagaacctaactctcatagcctcttaagatgatgtctcaccacattgtgtcaggaatcgactaacatgctcaactattaaaatattctcttgtcttgaaaactttgagaaattgggtgcctgtatcggtttggtaatggaaccctgtcaaaccaatcaaaatatggttaccgatacatgtatgtatgtttttcttaggcttaagtccaaactgttcccgtataatttcagctattttgtctgcccactcctcatttctatacccacatattgatgttgtgttggctgctgctcatgttgattcttctacggttgatattgtctttcaccatgttgatattcacattgaccctctagccgatactgatgtggttctggtggtcattcttgccaatattgatgagacgatccccgctgataacgattgttttgattagattgctcatgatattgttgttgctgaggttgttgctgttggtgttgcccccccatactaggcaactttatgatacccaatagacacctttggaatatggatcttgctaggtgtccatgggccttcatccttagctatatcataagtaggttcctgaaactctgttttcatagccttataataaggagggtatttacagacgtcataggtttctctcgaacagtagatccattaacaacccttatgatcaaattttgtaatatattcactaaactccagattaattgattaaagctcgatttacagcatcatgtactgtatctaccctataattcaccaactcactcttacacctacattactcattcatcaaatccaatgttccaaatcatctatatacaaacgaacgacctagatcatcccacgccgaaccctctcccgatatcgcgcgtggatcgctgtttcctcccccaaaatcgcgcgccctcctctcaaaaaaaatcgcgcgcccccatctttttcctctcgcaaacgtcaccgcgcttatgccgccattcatcgccgattccttcgcctccacatgaaggggtagccgattcctctgccccaaatccaggtcgccgaacccctgtccccagctcgtcgtcactgattccccctctcacatcaccgggaccaccaccgcgtttggtcggcgccgatccccatctcgagccgccactaatcgccgcccatctcgaagaccacatcaccgcctgatcctgcttcctcgccgtcgacctccgctcgtcgttcacggccacaccactgcccacgatcatctccgagtcaccacgcggcgcgcaaccgtcacgttccatcgctgccgcccccgtcatcaattatgcctccgccaacgcctccatccgcggctccacgctcaagtcgatgccgtcaaccccaccgatgaggtattgacgtcatctactcaaccgctgcttcacatatgtaagttgcaaacaggtctctgaaaatcctcatgatctgttaattgcatgtacatatgcattaggcaataggtttggttatggatatataaagcttcagtgaacagtcaaggtggagattttgcgtcttcagtgaacatgattttggatgctctataattttcttgtattttttttgtcaactgaactgtacagatctatataattccagcaaattttctcaaacatgattcacatgcttcttattcctgcaaattttgttcttctacttcttttcctcttgcatatgtcaacataatggagtgactaacttttgggtattcttgccttttgatttgcagacacttcacataaatcaactgtgcatagacatatcccagaagaatggagtgactaaataaaattttggttgctccaagcatctctgaaagaacttgttaccctgtatagaattaagtgaacaatttaattaagtccgatttgtcattcgagggtgcttttgaagtaatacgtggtatatattaaattgcatgacttgcctttgatgaagctatatccttatggtcaaatgtcatctgtaacatttcaaattcaggatggtatgcatgggggcgatgagcctcagatttcaagtttcctttttttttatcccgtgtttgacctttgaattgcatctcaggcttagtatcatggttaatctgccaacttattcaatatcatggaataaaatacaaagaaagaatttcactccatatgcttttgaatctatcgcaggggtcagattgttgaggttcatctcaacaattcaacaaggatgacataacagctgttgaaatttcttgtttcctgcgtcctgtctctgatattcagttgcttattctgtcatttttttttgcaggaattgtcatgtcaccttggttgctttgcagctgcaaatggtagatgtccaaaagcatctgaggtaaatagctcccttctaatagcctgagttgtgccacaaattatctattatctattctcagtgatgattcaatagtggtttggcggcatatgatcttagaaggaccacttctttagacgtatatcgcattgtgtcaaaaatcattgtggattatcacacataataggtagggtaagtataacaatgttgaacattgttcttcaatcattggagcgaccccccaccccaccccctaggaggttgagaaattgaccagggctgcagg

SEQ ID NO: 83487 - DNA, 1571 bp, Oryza sativa
  unsure (1)..(1571): unsure at all n locations
gcaattcgacactcatgctcagcatnnnnnnnnnnnnnnnngcnttagntagtcnnatcttgtttcactacgtgggtaagcacgggttccgtcgttttgtgggttctccatgtctacccactcgatgaagttgcacattggacgatatgtctgcgtaagatgttacaattgtgtacgaagaagttagtttttttatccatttgaacttcgaatagatgaagcatacctgatcaaagttcgcgcattggaagaatctcctgccccgagtttgtatcatgagggaagacttgagtatgcatccatccccacaatcgcacaaaggacggtcacaccatggtggaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgacaactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctccttacccctgtccctcctaccctgcgccctaatgtgcccctgggagtacgtgagtcagtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtactgaagatcccggctgcaaatcctgcaggacaaggaccatcagtttcatacaggtatttaatagtattaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgccgttaaaacatggtgacatattcgtgcaaaagctgaaacaaaaatgaactaatctctgggctgaactgtaccgtgcgaaactggtgctgtaggtcgcactgctccgaagctaggggcgctcgaaggcaaacgaggtcctgcgaggatggaacatcaagttacgacggggtgatgttttcttcaaaaccggaccaaacttaaggaacctttggctgacaataccggcaaa

SEQ ID NO: 83488 - DNA, 2348 bp, Oryza sativa
cggttatattacatttatgtttggtttacattccaaatatcatcgtagcgttagcacgtgcatattactagtcttgaaaggtttgaaaaagatgagtcggaatctttggaggagttacacttccctctccctcaatcatcggctcaaggaatcgagttttctatatgggtcctttccgagtcatgctaaaatattccaagcacaggttttgaaaatcttgcgtcgcttgatctactttgttttctgtttatctgtcaacctgtctactgtcactcaaataatatcatcgttattaacttctttagacaggttgacagagtaaattcgtcccactgtgtgtgccaaaagtgtgttgatgcaaaattcgtcgcacacatgaaggcatgaaagatttgctttacactaatgcatgtcctatcaaatcgggttcagggcgtgctagttagtttgatcctgtaactaataatatacgaatgaaaaatttaaatcgtagtgcgaatcagtcacaaggccgatgtagtatagtatgcccatccgatgtcgatggaatttcagttcgatcggctataaccgatggatataaatataaccttgcgagtacatacttatacccataggctaaactaaatcaatacaaggatttctgactcattacacttccgactcaaatacgactgaaagtgtaatgagtagtttcctatttgtaaggagtatcattacacttctgacttatatacgactccaatcaactcataaatagaaaactatctgagaaaaattctaacatgattccattggctcaagccactatctacagaaacataaactaagatacaccttccttattatggaagcttgatttaaacccggataaacttgctaactgaatcttctacaagtatgacgtgaattccatctgattggatcttgactaatggaaattgccaatttttttgttaacacaaacatgatatcccataggtatcatgctgatgttagcatggtaccgtacatatctctggtactagacatgatacctgtaagtaccagattcggtacctatggtaccatgcaattgatccgtacccacggtatcatgctgaggtaccagattgatgtaacgtcctgtatgaaccagatctggtacataaatatcatgttgaaatcatcatgatgtcagctattccgttggaacgttggaccgttatgtactattttttgaaaaaaagataacacgaccgcgcagggaaggcaggcggctagattactcatggaataagttcatctgaggtcccttaacttgtcaatgaatccaatttttgtccttcaaccgaaaatccagatatgatgggtccctcaactgttaaaaccagtgcaaaaataagtcccaaggcagtttggacggcggtttaagctgacatggcgcctacgtggctaatttgactcagtcttcatctgacatggtgcctacgtggcaatttgatttggaaaatcataaaaacggtagccccacgtgtcaattgcaccaaaaggattaattaaaaatggaggggcccacgtgtcattcttacccctcttcttctctccccatccaggattcatggactccccagactcgctgtcgccgtcatcactggcgccggacctagaggtgtctccgtttcttagcctaccgccagcagccgcctccctaatatccccttcttctccacctccaccccaatccggcaacccggcctactcgccgccgccggaggtcctctcggacaaccatcctcttgctataactgctctaccgcagcggcctccactcaccgggatcgcggccatgttcacactctgacctactccacctccccttccttcgatgccgcagcaccgccacctcaccagagactcaccgtgctggtgactatccccagaaaacccaccatggagcgcctcctgcacttctggcccaccaaaccgacctctgccaatgccgttgcaacggctcctgcacttctctccttcctccctttacccttctctctcgggcctcctctcccctcggcccaactccgtccccctcccttccttctctcaggccgcccctctcccctcccctcggcctagctccctcctctcctcctctcgcctgggtctgccccggcccaagccgagctgcagccctcccgcgcacgcgcgccgcacgcgcgttgaccgcgcgcctcccgcgtgggtcccgcccgtcaggcgtccccgacctccagccgccggcctacttcctctctctcctgtgaaccctagcgccgttcctccctccaatccgctcaattcaaatggctcattccaaaattgattagggg

SEQ ID NO: 83489 - DNA, 17758 bp, Oryza sativa
gtggccggctccctccccgcgcctatgaaatggaaccccctccttccgttctctcgttttagcctcctcccgcgtctccccgtggccgcaccacccctccccgccgttgtccgctctctcccatgccgccggccgcctccagccgtctccagccgcctctccctcctcgcccgtgcgtcggtaggccgtgctgtcgccatcctcggcgtcgcagccacatcctctcccccggcctgccctccgtttcgcgcggtgaccatcgcaggcgcgttcccgccttcgtctagtggcgttgccgccactgtaccgccccagccgcctgtgccgcctcgctggtgctttggctgtcgtcgtcgcctccttcctcggcaccacggggccatcctcttccccggccaggccacggcgtcacccgaatttcgccggaacgctgtcgcccgcgccgcctctccctcggtctcatcggcacccactccggcagcctcttccgccgtgccagtgcgccggccgacgtcgccatctccacctccggcatcgcagcgacaaggtcgccctcagcctcgcctcccctccacccgaacccctccgctgttcatcgtcgttgtcgtcctctcgccggcccggtcatcgtcgtggcgttcgtccctccgtcaagccgttctcgttcgtcgtcctcgctttgtcaagtgagccgctgcagccccgtcgttgtcttcgtcctcggctccgcgtcgtcaagcctcgtgctggccgtgtctcgccttcgtccaaggatcgccgccgaagtcgttcgcctccgttgtccccgagccgtctccgccacgcccgttcatgtgtgcgtgtggtgacctattagtgtgcccgctcggtagccgcgtggtttccacgtgtgcagcccgcgtggtgtctagtggagtctgtttgtcggccacttgcctcggttgacacaccggatccgcttccgtcgacccgtggaccgtctctgtgtactcggtctaccgtggtcccttaggttgacatgtggggtccgcatgtcaacaagcgcagccctcctgtcttttccaggctagcgcttacacatgttttatagttgtaaaacctaattacaataatccgtaaatctccatataacagcattaaacttcggatgatcatatcttaatcatacgaaccccgaatcgacccgttcaagtctcctaatgtttgttataacctaaagaaccttgtgctttcttgttatgtattgttattgcttctttttaggcttgtagctttgcttgtgtgcttcgcgtagcttctgttgttccggcggtttccgaagcgtgcttcgcggtcgtcgccgaaggttcggaaggccgttctctctgagcaaggcaagtcgcatcacccttgagcatattgaatcccaatttataaaattattttgatttaaattattgcattaccgctttacttaaattcccgggttatcactgttttatttagccatgcctatttacctttgttatgaccttattattattgctattgttattattaccttgttcaccctaggataaacaaaacaccaactagtgggtactctattaacggttccactagtatgaatttaggtagatgcttcgctgattaattaggcaacactaggtggttttataactttagactttgggagttctcatatcatttggacactgtggaatggttggcttgtgatggaattgaacacacacctcccccctctattcaaaactcccaaaatggttttaggctgggctcgaggtgcatggttctgctagtagcacctcggccactataaggaccggtcttcgggcttctgttgcaacgcactaccgtactaaccacatgtctaataggtaaggcttaactcggtgctcagtctagtcctggcaagagtacacggatggagatggacgaagtcggggctcgatggacatctctagggcaaatgaaggttacacgggctgcggctcgatagtcgagatgccatggcatagggccggtgtcctgctgttaggggctcaatcttacctacctgtctcgggattcctgccgtaggcgaggttgggtcggttcttttgtcacggctaggatgggtaaaggggttatgtcacatcctttacgatgggttccacggccgtggaatgcagagtaaagatgtgtcttgtgggtaaagatgtacacctctgatcagagtaaatctattcgaatagccgcgccctcggttataggcaagcctagcaatgtacccaagttagtggtttacttcttaaaacctacttaacaactaaaatgtggaatggttggcctggattggcttgggacgagctgggacccaggtcgggttgccagttcggtctgaatcatcgtagaccttgggttaaggcaggttcgtgcgggttcacggccttgattaataatactgtgtagctctaggatcgtgtttacaaaatagctttgggcaactaagtgactttcaaatgctgttttctgcaaagcttaacccctatactatttccccttgtacccccttgcattattcatgcatctttcggtgtgacttgctgagtactgtggttgtactcattcatgctctatctctcccccttcagtaagagaagctttggagaagaagtcctaggtggagtcctgacttataccccagttgagcgcctgtgaagatggagccgtaggctcgctagtccgctgctgtttatttttgattgtcaggcctgaagcgcctgtgtaataatgtaagttttatcgatataataaagatgtgccttttgtatcatgtttgtgtggtgtaccccggcttttcctaggacggagattaatacactagcgttcgggaaaatgcaaattttctcggtcgcgacaagctggtatcagagccatctcgactgtaggataagccaagtggattaaacctaaggacatattttataaacaaaactattggcgaaaagttccttttttcctcctttccctaatgctatttgcaaaaggtttactcccttcttcctccttcgaatttcaactagtactagatggtctgctttgcgaagaagaagatgtcgtcagttgtctgccgaagctccggaagactgttggatccgctagcgaagcgaaggaagcagtgaagccagctgtgaagccggagtgaagatcttggagaacccatcgcaaaacctaagccatcctctagggtagagtcgttagtcgtgtgtttccttacttgtgtgtgtagcgcgtggtttggatctgtagggtgtgatgtaaccatgctaggttgtttgcttaatcaacttgcagaataagcctaacatacatcacaacagaaaaagattagatctgttaaggtcctatccttagttctgatctctttctttcctccaattttccctctctccctcttcaaaccttgtatcagatggctaacaatgaaaaaggcaataaggtcagaagtcaggacaagggtacctcaagctcccgattgaatgaagcaccagacaccagttgtgtggcagtggtccaacacctgattaaccagaatcgattgcttaaagagctactacagcagcatcagacaccaattctgaacccgagtcagatgcaacctcaagtgcagttggaggcagtccaagcactcacacctcaagtcagtgcaccaccagcatcccaaccggcccatcgcgccatgcaacatctggactcaaaagaagctagaatcatttgttttatatgtgatgaacaagcgcactatgcaaggaactgtccttagcagaaaagaaaagcatcaatgcgaaccgaagatgaagtccgtaagatgaccattaccggcatagaatggcctccaccaggaatgacaaaacgtcagataggaaatttctttcgaggtgcacaacagttgacagaacatcttttagctaatggaggtagagtgtctgatagtgaagattcagatcaagtctcctcagatgatgaagatgagaagtatctccaatgtttcaagcagaataaaatggaacataaggcatgctctcgttgtggagaaattggtcatgttgctagctcgtgtgccactacctgcgttcattatgaggaagaccatccatccgacgggtgtccaacgagcaggatcacttgtttctggtgtgaaggaactgatcatgtaccaaaagaatgtcaatttagttttctgctaacgaagaagatggcaaaccaacccgccagttccgacggagagaagcatcaaggcaacacaaatcctcgacaagacttgtgccactacctgcgttcattatgaggaagaccatccacccgacgggtgtccaacgagcaggatcacttgtttctggtgtgaaggaactgatcatgtaccaaaagaatgtcaatttagttttctgctgacaaagaagatggcaaaccaacccgccagaggacagaggaatcaaaataggaaaagaaaatgccgagtccggaaagatatctgttgcttcaattgtcatgaattgggtcacttcaccgacaagtgcccgaaaccgagaaacatagctgccaacacgtcaatccacgcaaatccctggaatcagaagcttgctccccagcgaattgtcatccatgcatcccgaagcagtcctatagcccgcgttgcaacagcttgaactccaatgagtgcactaccacaaggtgtcaatgctcaatttcagccccagcaaccagttgacaagacagaggccagtatctgcgttgtacctttagatgttccagcacagcagccaagaaatcaggtacaagatgaagaacctgagtgtaagaaagttattgtttgttacaactgcagtgaagaaggacattactccagaaattgtccacaaccaaagcgtaacccacgccatcattccggacattatgcacgaagaagacatgaccacaatattagggtcactggagcaaatgcagaacctgtcaagcctagtgctagtcagaagcaatcataatactcttgtatcggtgttgaagtacttttgttttatagttgttccctgtcaaccatgtaataagagagaaacatgagataatgaatgagtttgacaagtttatgaaggatcgatgttaagattgcaagtgctgtgagttgtgtatgttttattgatgattaaggagacctagagtctcatttccgtgagctcctactctattatgaatcaaataacctagttgtagatagaaaagaaaatcaagtgatcaaccaaagagacatttgtttggactaagagtttcagatgtgtcttcttcggatcaaaggcaacaatcatcagtctagcttttgacgaattacttcaaggttcctctgaaaggcagcaggccccagggaccacattgccaccagaagcatccacaactctcagagtgaagagtacttggttgagagaggtcaaaaggtgattgatcgaagaggtcggaaaagatgtttggttactgggaaaagatgtttggtcgaaaggtgattgataaacgataatgagaaacatgatttgtgtcactcgaggaagactcccaataacaatcgaccctacaacagtcaccctgtcattaaggcagaagaattcgcgagtaagcaagatgaccacaggtagaagtacttccatgaggacaaggatggaaacctttgtgacatgaccaagaagtcaagaagttaacctgaacagttggaatctaaagctcggttcaaccttcggctctgtattagatgctacctagaataaaagcacttgcactagtatcgttcaacacaatttcctagcaatcgatccatcgggaaagaacacatcaaggttgaaggtgcgaaagaatacgttgaatgctaaatgatgacagcatgaagagaatagtggaaagtaaaccgaatgtaaagaaagtgaatccaagttgcttgttcgtgagaaccattcccagttatgaaccaagtgatatgttcgaagataatctatagagtccagatcaaaatcacatccaacaatcagatttggtagcataaagattatacagttacaagtccagcagcaaagtcatctgggaagacgtcaaagcatgtcaagtgggataagttggttctcttgggaagcataattcaaagttagagtggtctacccttggatcgaatagtagaaatgtctagcacccggagactaggaaggctaatatgaggcaattagtggcaagttgtcaatcatatggtatccttggtaagcgggatatcttagtctgaagcatttggtggtaagctggaaggaaacgccaagcgtggtattctcatgatgaaaagcatggtatcctagtaatgacaagctggaatcgacgcataacgtgaagtgggtaacttgtatgaggctgacgccaaagatatgaactatgagaagttctagaactaaagccccatcttcaagtgccgcaacccagtcgaagtcagctagaggtgcaaccagggacaagtcaggtgaagagaagattccatctgcaacagaagatcaagccaagcagttcagactggggaagttttgctgggcaagtttgttaaagaagacgcaacggaagaagtcagaccagaagagaagactgcccacctatcttcttgctagccttctcgaatcttgggtgcaagattcctgtaagggggtggatttgtcacgtcctgataaattcatcccgaattaaaaatcattctttaaaaggaataatagaattaattaaaattcaaaaagaaatttgcaaacattaaaatgcgtacaagaaaaattcgaatgtgacccggagaatttttgttaaattctccttggtctaaaaggagccctcaaattttacttgaattttcagagcaccggaaatatttattaagcaacaacaacaattaacaaagtttattaaaaagaaaaactaaaaataatcccctttcctcctttgggccgagtttagcccaaagtctttctctcctccctcccttttcccttctctctcgggcctcctctcccctcggcccagctccgtccccctcccttccttctctcgggccacccctctcccctcccctcggcccagctccctcctctcctcctcccgcctgggcctgccccggcccaagccgagccgcagccctcccgcgcacgcgcgccgcacgcgcgttgaccgcgcacctcccacgtgggtcccgcccgtcaggcgtccccgacctccagccgccggcctccttcctctctctcctgtgaaccctagcgccgttcctccctccaatccgctcaattcaaatggctaattccaaaattgattagggggaattaaaccccattgattcctctctctttccccctaatttcccccttgaatagcaccattaatcgcccggaacagccgcgccatccccggccaccttccatggccgccggccgccattcccgcctccgttccgccctctcccgtggccagctccctccccgcgcctataaaatggaaccccctccttccgttctctcgttttagcctcctcccgcgtctccccgtggccacaccacccctccccgccgtcgtccgctctctctcgtgccgccggccgcctccagccgcctctccctcctctgtcgtgcgtcggtaggccgtgccgtcgccatcctcggcgtcgcagccacctcctctcctccggcctgccctccgtttcgcgcggtgaccatcggaggcgcgttcccgccgtcgtccagtggcgttgccgccactgtactgctccagccgcctgtgcagcctcgccggtgctatggctgtcgtcgtcgcctccttcctcggcaccgcggggccatcactccggcctccaaggcccgtaggactcttattcggatccctatccgaattaagctcatattggatctccatccaatccccttattctggcccattaagcgtgcgaccctgtaggttcatgtatactcggctgttacccgaaaactccttttcggtccacgcatcaacagtggcccctagcagaacgtattgacccacagggcatacataaagataatatcggctgaacctctggtgtatacttgtatgaacccttttgcctcacgatatcgattaagctcaaggctagatatgtgccatcctctaatatctcaatcattcatccgaacctgttgatagattatataacttgtgattgactcctcaatcacctttggcatggccatgcactttcataatctacaacatcgaggggcccagagatatctctccataggaggggcaaatcccatcttaattattcatatctcactacatgtttcatagtatacccgaaaactacttttataactacccaattacggagtagcgtttatagcagtccgtaagtaagctactacacatgttgggaaccatgataatctcagatctaaggatttaacaccaacactaaataagatcactgatgacacaacacatatggctcttgcagtgtcttatgttggatctatccaacaacatgttcactaacatgtgtccatattattaatttgatatctctatatcatgatctatgagacatgatcatcaattagtatatgtgctgatcatctaatcatatttgttccacatatgatatttaatcagggatcctatagaaatattaacaaacaagataaagagtctcatgaaagaatcacatattcattaactaataatgagttatctatttcaagaaacaatgtcggataaatatgtaaacatagtatgtgatacaatcatatctatgattgcctctagggcatatcactaacaatatatatactacacataacacacggatataatcatataaagctctgcaagcagctagggcggttaggcaaaaatggcgatcagtagtgttgcccgtgctgcaatagtaatcttgtgtctcgtcgccctcacaaaccttgcgcaagcccagaactcgccgcacgacttcctgcaaccccacaacgccgcgcgcgcggaggtcggtgtcggcaagctctcctgggacggcaccctcgccgcgtacgcgcggaggtacggcgagaagaggtcccacgactgcacgctcaagcactcccgtgggccgtatggggagaacatctaccggggcagcgccgggcggcggcggacggccgcggacgcggtggcgcggtgggtccgcgagagcgcctactacgactgcgggagcaacacctgcgtgccggggcggcgttgcgggcactacacgcaggtcacgtgggcacggaccacgaggctcgggtgcgccgccgtgacgtgcgatagcggcgccacgttcgtggtgtgtagctacgatccaccgggcaacaccaacgggagaggtccgtaccctggatgtggggattatgatgtcgtgtccgaatagctctacttaattactacctttctctagagaaatagctgtacgtatagcaaaacaccacctagtagaatttcacgtgattgttgaattttaaccccttgtgtataactccctcttatgtttacataaccaaataccattgtagtctaaatttagattttccatgataaagcattatacttgtacgttctttctttttgctcgtaatacaacaatgggaatttcagggcgatatgaacgtgatagttcattttaacccacttgttgctgtataataaaagatttatacgacatacataaatagtacagagggatgaagccatggaaaattcattattttcttatggtagggaaaaatcatcattgccaataatacgaataccagaataagctaggcccggtacttttctcgataaagatttacatcggtttacgttagcacgcttttcaaactacaaaacggcgtgttttgtgtgaaaattttctatatgaaagttgctttcaaatatcaaatatatccatttttcaagtttttaataattaaaactcaattaatcacactttaatagctttcttattttacgtgcccgcttttaatcttatgaagattcaaatgccacctaaatatattcaaagtacacctccagtaaaattagatgataccccatacactacaatacaaagacatcctttggtgtcggctccaaaagcccctttggtgccggatttggagcggacatgaaattggtggcacctatgagtcttcctcattggtgccggtccaacagccggcaactatggtgtgcatgatttcaaaaagaaaaaaagatatattgctcggctcaatcgaaccatcacagaattatctacgtcataatgaatcatatccaaccataaacaatgaacagtaacaatgaatcttgcacgtcccagaatatttcagtcagcaatttccaaatgctagctctagtcatgaaagaacactgaacacagagatcatatccaaccatgcatagcatcttgcaagaacagtgcagaacacttatccaagaacatgtaacaacaaaataacaacacgaacaaatcacataacaaatcgcttagtcgttgtccgtcgactcgccactcatcgtcgagccatctcgcgaaccccaccacccagagcaatgccccccctccctagatctacatgccactagtgggaggccgatggagagggagaggaagagggagaccggatcagcgccccgtcacctctggggagcccaccagttgcctcccttggccactgccgccaccaccaacataatcgggttcataaacctgtcatacaacacaaaagaatagcagcagaagtctcttaaattcaaataaacaaaagaacccgtggagtgtcaaccatcctacacgggcgaccagctggggcaagagccaagttgaacagctactcaccaccctcaccgcccgtgtagggcaggaagaacacacatcaatactttcatcctcacctgaaagataacaagatgaatatgaatggtactcgcaagacatacccaatataattagtacaaaggagaatgcaagcttctatttcaaaggaaggataaatgggttaagatttgccataaagctagttttatggatcaaatactatgctgagagtataagcatttgtaaatcatcgcaatctgaagtttttgacagaaagcatatatatctaaaattgaaccacaaataagcacaactggtgctctcaccatcatctatgggccaccgttgcccaaataaccattcgcaaaatatctaccaagatattcatgactagtacccaccatttaacccatgtttcatgctaatatggagtgactaacacatcaagcgtcgcccgtaaacgtggacacgactattcgcatagttttactccgatcagaggtgtaaaactttacccacacaaaatgaacaaggaacaagtgtttgatcgtcgccatccactccaaggtgagcttcgcctcaacccatcatctggtttcatctttccatgcaaaacacatccatactcatatttctccactttgcacaggttgagttcacggtgccacggtggccatcgccgtcggctctagtgcatagtcgcgcgtcacttcgccgttcccgttgacccggtgcatttccggccaagcagctgcacccctgacgtaaccaaggtcttaggagccagacgcgccaagggattccatagagatgccaccgacgtggggatcgagctcatattctctacctccagccgccagccatcaccgtagtttcctccttcctcggtgagctagagttcgattccttatgcaggaattcctcttagggtttcagtagcctcatgagcaccttcatttagcagcccacagactagagcgagccaccgccgtgaagccgacgccatctacagccgacgggtcgatcctcgtttcgccaccaccatccaagacactaggcccatccataaatttggttagctccctaatgccctctacatacacatttctgcatgtttttcatttgaatcaaaccatagctctaactggtcatgcaccccgaaccataccgccacttgcaccactactgtcattgattcagggatcaccattggccatgattagaccacctacggatgcgcaagagacccattgtggacaccccgagtattataccatccagtgtccaacgcgaccaccacatactgttggaggagtgggatccaaacacgcataaaaaagccactcatcctcaatgtgtccatgatcacggttgacaccttctgctataataaccggaatgccgagtagtgatcgtaagagataaaccataagataacttgccaggctactccgtcatatgcccgtcaaccacacgaaggcggcgactagaaaacaaggcataccccagtgcctcgatccaaagcgctatccccaattatctcaagcaatcaaaacccgttactcgtgctcagctagtccccaggaatgcgactagcctcacacattcatcgcaagcaattggaacatcatcacaagtgcataaaaaggggttaagtacagcaagtatctggtacagaatagggtccgatgtcccatctaacagcacacaagtagcagtggaagattcaaacaaaagctagaagcacaaaacaaaaccggtggtgccacaaccccacaaggtcaccgggcaagagccaagctgaaggcagcagaagatcattccctgccctcgccgcccccagaggacagtgaccacacaggaagcacaattctacgccggagtcctcatctgaaaaacagcggagccgggttaagtacaagattgtactcatgagtcttacccataaaaatatatataaggggagagagaagtatacaggtttaccttaacctagagcaatctaagttcaacatttgcataaagccaattttattgagcagatataagtgaaagcgataacacaataaactgattagcaacattataaaattctggacagcaagcgaattaatctgaaatgtacaagtaaatgagcccaaacggcgctcacaacatccaccatggaactaccaaattccatgtcatcatggcacagcctgccaacatcaccatcaaacataaacacaccagaataacccaagtttgatgctaacataactgaggcacacatcaagcattgtccataaccatggacacggctatttgaatagattatactctgatcagaagtgtacaactgtacccacaagagatgaacaaggatcaaatgccgcccaccacacaggtgcaacctacaagtgattcaagctcatcacatgtcctttcctagccccaccccaaccatttaaaccacaccggggcccccgacgactcagtcacgtgcgtgtgatgtgactaaggcgggctcaccacgcgggagataccccctgccgtaccccggccaaccgggcactccgcggatcccaaatcctcacgtttctccgatgggcgtaaatgatcacagtaggtttagtaatcaaacaggccggtcctaggatacggtgtgtggtaagtatgtagggtgcttgaatggacgtcaaaatgttcggtccttaacgacccagacagagctactgcatcaggggaaacatacctcccatcatcgccctaccacccgtccaagtcaatcatatttcatcaaccattatttaatgtaagtgctccagtttttagcccattaaccaagttgtccatatcccagaattaacaaaactgtccagccatatagttgtatccccactaagcaaaactaagcataatgaataaaacatcccaactatttccaaccaggagagtaataggtatatggcagctatatataactaaggtaaatacaccaattaattgtctaccatgtcacccaaaactattaactaaacaaatgcaaatatatatatagattcgcaaccaagggagtttaagttcattggcgctagatgcttaggtgctcgccatcccgctgagggtagtcacactcaggctctggttccgcttcagcactctccagaatcttcgaatctatcgaaaagaagcaatatgcgaataagattcaaataagcatgcatatgcaacatgctcagtaaaaacatggcctaattacagtaggtagagagtatgatgaacatattttagaaacaagaatcatctcatttacatttatggtttgagagatataaaaataacaagccatatacactgaaaatggcactatgctaaaactgaatataaactatagatcatttggtgatccccacataatctagcaaattttcatgagtgcaacttgtaccgtactaaagagtataacttactggttatatgagaagtatttggattatttaatttggagtttgaataagttagtaggtatttaagaaatctagagagtgaggaaaagaaaactactgcttgcagcactacataagatttgtttccaaagtttacttcctaaatacttcgtgattgaggaatatgaggaaggcaagatttaactcagctattggtttgtgaacacaacttatacgaggtgttggatagttcagcgagggattaagtcacaacatgaagtttctagctagcctaagaactaagaagctcaaagacaacaacttgctttcccaatggcaactcctaaaggtcgtccaacggttgctgcttcaatgcatgcatgcatgcatacactttataatgcaggtgatgtggcactgaggttgcgaaggttggagcacaaactaaccatagaacaagtacaaatcgatgacgaaaaaacatggtgatagcaacctaagtaaaccgagagagagaggggttgtaatcgccggaatggagagatacgagttgtagctgttccttgctgtaaaactttgcatcaacgacctgtggagagagttatggaggctcaacataatggcacaccaagagggacaccatgtataggaaggaaactcaccaagtggaggaaaaacagggttgttttgctgctaaaatcagtagcaagctccacctatatattttcttcccgatctccctcatgaaccctatcatatggaagatatttggatggatgggaggcttggatacttgatattgctgtggtgtgacatgcatggatggatctcaagtgtttggaggagttttgatgggaagaagtgagctgggagctcagcttgcaagaaagaaaagaacagacaagggagaaagaaaggggaagaagataaaagggtttcctgcttgtcttatgtacctgaggtgggctgcacgaccaggagggtgggtgggggcttggtggagagcctaagtcagtgacaagtgagaccaagttgagctgggcccaagggacagatagaggaaggtcggacacattgaaaacagtgaattttcaggaattttctttctctcgttcttgggtaactagtttgtcctagctaaaagagagtaaaaaatgtgtgttctagggtggagatagattgagttacctagattccatttttcaaagtttcactcaaaaattcaaaatattttaattctggcaaaaagatgaaaaggggtatgctgagacctaaattggattttaatgaggtcaaaattaattgtaaaaattctagaaaaattatattaactcatgataaataatctagtttgtattcatcataggcttgaactgaaagaggtaaatagaattgatcatccactgccctctgtaaatgttgttggacagaatcattcttgtgcctgacaaaagagaagagagtaggatacacctgagcaaagacctttccattacacaggtcatgccagaagctaactgaagatccactgttaattgttggccttgcaaaacctctgaatagaacttcaaactgaacaatgtccttccaccaaaaggaaccacaaacgctggcattttgaggcaatgtcctagagtaataggaattccaaatcagtttaacccaaggtatctgcatatgctggttaaagaactttcctaactgcttgaggagaagggccctattttgcactctcagatctattacacccaaaccacctttcttcttgggcctacaaaccttcccccaggcagccaatgattctttggtggaagttaaatcctttcccctccacagaaaatgccttcttgctctatctatattctctatcactgccaccggaagctgaagggagcacatatagtaagtgggcattgctgacagaactgaatttacaagagttagcctatctccataggagaggaaggaagaagtggccacaagtcttctttcaatccgattagtgagaggagaaaaatccactaccttgggcttagaacaactgagagggagccctagataggtgaaaggcagagaaccctgagcacaaccaaaagtctttgccagacaatcagccttctcttcatccaaatttaggggtatcagacatgactttgcataattcactttcaatcctgtggaaagagtcactgtattgaacaaagcttttagagctagaagttgtttcccagaggcttgcatgaatagcaatgtatcgtctgcatattgcacaattggaaaattttgatccccaatgacaggtataggaagcttgaacacccctctttgatgtcctttgttaacaatggtttgcaagatatctacaccaatagcaaaaagcagaggagatagaggatctccctgcctaacaccccttttgcaagggaagaactttcctgggaccccattaagaagaactgaagttgaagctgaactgaataagagctgaacccactcaatctatttgggtgggaatcccattgaagtcataatctgaaggactgcagggtgctctatcatgtcaaaagccttttcaaaatctagctttaagagtacaatttctctcttagacttctcttaggatgtccaagaagtgaatgactttatgacaattatcaataagcaaagatagtttggacagcttcttactccaacattttaagtttcttctgagctgtttgaacttggctgaaatagcaagggcatttgaactcgcgttttgaatggaaagccaagcattttcaacctgttgtaggaaaccatcatgctgaacccaaaaattctcaaatctgaacaaattagctttagggatggacgtcttcacctggatcataaggagcacatgatctgaaatgtgcttcgaaagagctagaaccatagtgttcggataggagatagaccaatttggggtaatgaaaacccaatcaagctgctccaataatggattatcctgcatgttactccaggtgaaagacctgcctttcaatgggacttcaatcaaacccagattactaattagttcattaaacaggtaaatgtcactcatgtcagcacaaggcctatttctgttgttgatagatctgtaaaaattgaaatcacccataaagatccagctttcattcaaatctatgtctagcccattcgtccagtgaacaaaaccatctctttgggggccagaagatggcccataaacattaaccagattaaaggtatcagggctaactctggtagaaaactgcacgataatagcatgatctgtttgatccacaacttgaccattgaaatgagcactattccatcccacaaacagaccaccagaggctcccctagaagggacaaaaacaaacttatcaatacgtctgggacaaaatttcttgacataagccaaatcaaaaacctctctcttaatttcctg

SEQ ID NO: 83490 - DNA, 4054 bp, Oryza sativa
  unsure (1)..(4054): unsure at all n locations
tgtgttnncattttngtcangttangaaacnnccccganttngtgaaacnnaccaccgagaattcgtaccccatttcttttagataatactccctccattttaggttataagatgttttgagtcaaagtcaaattgattcaagtttgactaagtttatagaaataaaatagtaatattttcgacccaagataaatttattataaaaatatatttaattattaatttaataaaactaatttggtaatgtaaatttactatatttgtctataaacttagttaaatttaaagcagtttaactttgactaaaggcaaaatatattataacctgaaacagagagattataaatgtttccatgcaccaaccaattcatcttttgttcatcaaaaaacacgcctgaattttcatctaaaggactgccaataagtaaacaacaaaaaaaacagaattgaattttcatataaaagactaagccgatagtaaataacaacaaaaacaaaacatgcctgaatttttttgagtgctcagacatggaatggaagctgcaattatttatttaagtgtgcgtccgacaagatttgaacttgagacttgtagctccgataccttattgagtttttttttttaaactaacgataccttattgagttgcatataactaccaattcaacccaaatattaaaatgatgaaaaaaaactaacaattcacttatactccaagtgatactgatcttcttgttcttgtatgcaggttgctcgcgtcatactgttcgtatacttcttcgctcatgtgtaccttcacttcgaccaggtaatcataatcaaccaatcgtcttctcttcagggttcagctttgtgacagtctgttgttaaattagttcctggctgttcgattaatttgcaggtgaggacggtgttcccgctagggttctacagtatgatggcggtgccgccggcgatgtcggcgatgaacctcctctggttccggaagatctgcaaggggatggtcaaggccatgtccagcgccaaccgaagtcaatgcgtcaagacagattaggacttgggtaaaaggagatgcaacgctgtctggaagccaaatgcttactagcttgcttgtttgatgattaactaaactgtaatcaatcaattgattatttgaaaaccactcgtgcgtacaaaatctgttacttaagagtagatatgtcccacactctttttctttgttcttttaaagactcattgaccgtgtattatggaataggccaagatgtaatacatttataatctctctgtttcaggttataatatattttgcctttagtcaaagttaaactgctttaaatttaactaagtttatagacaaatatagtaaatttacattaccaaattagttttattaaattaataattaaatatatttttataataaatttatcttgggtcgaaaatattactattttatttctataaacttagtcaaacttgaatcaatttgactttgactcaaaacatcttataacctaaaatggagggagtattatctaaaagaaatgcaaaatcagtcactaatcacttggattttggtcctgatcgtcgtctgtttgccaggtttgtctctgcaatatctcctggatgcgtccatgtaagtgcagacaaaggcaagcggtaggcatcatcagcttcagtatatatacgtagtttaattacattgtcatcgatcgatgatgcatatatcctgaattaattagcacggtacatctacgcatggccttgtcagcctgaattaattagcaggatatatacatatataaatatgttcgcatggccttgtaacaataccaggtcaaattaacagaccacaattaaacatgtagcaaactactatgagttcagtgtgtaatagcacataggaaacgatgagtttgacatgtggaggcaccggcagattgatgctggaattctgctgcttgatgccaattagtccggccaattactcaattagtagctgaagaattaagcaagctaactggccaaattggttgatgatatcgccagccattgattcgctgcctgcaagcgcagcctagctcctcgtcgactcgtcctcaactagcgatgatcaccaagtgatctatcagctcgccattaggaagaagctactgcttcaaagctattttcttactcatttctcaattacacatcacaatcatgaaatgtgatgacttcgattaattcttaggggttctagtagctcggtttcggttttccttgagaaaagcaaagaaaattacgcatcgcaatcgtcaaatgtcagtactctgaaacctcttaggagttaacatcctacccagtttttttctctccttagcaagattacacatcagaatgacttgttcatcaatcaatcttgtaatctgaagtgtcaatgtcgagcttaactgttattgcaggagctttgttggatactagtagagagatgcagaattgctttgctccaataaatttacctctgaattttctggaaaataccggattgatgtacacatgtgatcaggatgatcattagctgcttaaatattcagtgaaactatgagctaattaaccaattaccaaagactcttaccaaaaccatgcagctctgctggctcattgtaccggccaagcttacactggccaatctgaatacagccaaagaatcatcagattgatgtttcgcagattcctgccgtgtagattgctctcacactgccactagcttccaggttgacctagtaatactactcaaatgataactagggcgctctaatctctttccaattgtaaagtacataaatagttatgaaaaaattcggaaaagacagaggactagatatcctccctattcaatattttaagttacgtattggatactacggagtttgcacacactatagttattttaaggtaatggaaacattttatttgagctacagctaatattctaaaattaagttttaaaatttaaaatttgattgcggttgataataaacaagcaagcagcctctgctggttgccacaaaaagtactcctttcgtcccacaaaatacaaacctagtactgaatgtgatgtattctagctagtacaatgaatctggagatgtcacatccagttaggtttgttttttgtgagacggagggagtatatataagcacattgctttctcttgctccactcatcttcagctatgcagaaaccctacttgattgattgatccttgataaatcaacttatgacgggaagaggttcagacatgcaagattctctaggcttgatgcagtttcttgatcatcaccagtatctatacagcagcagtagcagcaacctgccactgcagcagcctttgttgtcccatcaccaccgatttcttgaagccaatgagggttgcgccggcgaggacgactcgccggagttcgtcgagccgccggcggcggcggcggcggccgggacgttcgagcaacggccggagttaggagcgtgcaaggaggtgtactccgaggaaggcggcgcggcggaggagaggacgggcgtggcgatggcgggggccgacgtcgaacaggtggcggtggaggatgaggaggaggctcacggcgtgcggatgatcgcgctgctgatggagtgcgcggcggcgatgtcggtgggcaacctcgcgggcgccaacggggcgctgctcgagctgtcgcagatggcctcgccgtacgcggcgtcgtgcggcgagcggctcgtggcctacttcgccagggccatggcggcgcggctggtggggtcgtgggtcggcgtcgtggcgcccatggcgccgccgccgtcgtgcggggccatcaacgccgcgttccgggcgctgtacaacgtcgcgccgttcgcgcggctcgcctacctggcgtgcaaccaggccatcctcgaggcgttccacggcaagcgcctcgtccacattgtcgacctcgacgtcgtccccggcggcgcgctgcagtggctctcgctcctcccggcactggcggcgcgggccggaagcccccccgga

SEQ ID NO: 83491 - DNA, 1179 bp, Oryza sativa
  unsure (1)..(1179): unsure at all n locations
cgctgcatagatnnnnnnnnnnnnnnnnnnnnnnnnnnnnnnnnnnnnnnnnnnnnnnnnnnnnnnnnnnnnnnnnnnntttttcctttttcttttttattattattatcgggcccgtgcaggtgcaggtagtgacggtggttctcgacgacagggcccacacgcacgcgtggtactcgttcgattggaacgggcccattatagttgagccctattgggctgggatctatatgcgggccttacaaactgggccgtaactgtagtgtgcgtacgtcgatcgggaagggaagtcacgagagagaaaaccctagaatcgaatctcggcgactaggcgagattggaggcgggcggaggaagaggaaaaaggggagcttctccggtcgcggccatgtcgctccgggccatcggttaccttctcacccgaagccggagggggttctcgccacgcgggatcccccgtgcgcaggcggagtcctcgctgggtatcctcactcgggcggggaggccagcagctcactctttccactccgttcgtctctcatctcacccggttctcaaatcgaaaatcttttcttttgttcactcgcagctcatatgtctctcatctcgttacgcgatacagatgggtttcgccgttggtggtggctctgttgttgtagccacggcttcattggttggattggcggccacaattctgtgtttcaagcaaaacactgacaagtcaggaggtatgaattgaaaaagcggattcagatggtgacataggataagcatgttaaaggtgatatagcgtagatctcagccctccaaaataacatccaaagctgagattccccccccccccccccccccccccccccccccccctccccgcccccccccccctcccccccccccccccccctcccccctcccccccccccccccccccccccccccccccccccccccccccccccccccccgccgccgcccccccccctctccccccccctttccccccccccccccccccccccccccccccccccccccccccccccccttcccacccccccccttccccccccccccccccccccccccccctctcccccccccctcccccccctccccccccccccccctcccccccctcccccccccccccgcccccccctccctctcccctccgccgcg

SEQ ID NO: 83492 - DNA, 3876 bp, Oryza sativa
  unsure (1)..(3876): unsure at all n locations
gggggggggggggggggggggggggnggggggggggggggggggggggggngggggggggggggggggggggggggggggggggggggggggggggggggngnggggggggggggggggggggggggggggggggggggggggggnggacgaatctcagccgttggatttgttttggagggctgagatctgagctatgtcaccttgtgacatgcctaccatatgtcatccaatctgaatcctgaaaaggccaagatttctcattgtttgttagtaattttttcctagtcaaacttaacaagtttgataaagtttatagaaaaatttagaaatatttaaagtatcaaattgatttcattaaatctaacattaaatatattttaataatatatttattttgtgttaaaaatactactatattttttttataaacttgatcaaacttaaagggtcttatgatatgaaacaaagggaatatttagctctgatccatgtaacttaaccatagccactaccactatctgtacataacctgtagctagggaggaggataaggaggaagtcacgaagaagttaccagctgcccaggacgccggcaaggagccttacctgagcaaggaagcagcaatcgaggcagggttcgtggacaaagatggcaagatcctgtggtctagctatctcaattacgtcgaacatgggaagactctcccggacgatgaggcatttgctaaggaggcgagagactaccaagaagccattaagaagcaggaggtgaaggtcgatgaggcgaccatgaaggccaggttccatgacttgatgaaggagtatggccgttcatacagcactgaggaggagaaggctcgccgctacgaagtattcaaggaggccaccctgtgggcagacaaggttaacgcactagagccaaggacgatcccttatggccctaacggatatgcagactttactgatgaagagttcaagcgtatgcattgccattgttctgccattgactgggagagatacatcgatgaactcaacactatggctgctcgtgggtggacctactttcgcgatccagatgcgacgacgaatgtcagcgaggcagtgaggaaggtatatatatttccctcactatcatcgcatgtgttttctttgggcctgtttagttccaaaaaaacttttcgtaaaaacatcatatcgaatctttggacatatatatggagcattaaatatagataaaaagaaaaaataattgcacagtttgcatgcaaatcgcgagacgaatctttgaacctaattagaccatgattaggcataagtgctacagtaattcacatgtactaatgacggattaattaggctcaaaagattcatctcgcggtttccaggcgagttatgaaattagttttttcattcgtgtccgaaaacccctttcgacatccagtcaaacgtccgatgtgacataaaaaaattttcatttcactgtaacgccccgacatttgttagccataaacacagcaaactcacaccggggtgttatgcattacctgtgatatagtaccagtcccaggatacactagctggtatacacagaataaatgtggaatcaaagtaaattgctttattacatcactgggtagtagtccttacaaacgttgccatcatggacaggcccacatatgagcaacacagcattacagagaaccataaaatcgacggcacagaagcgaacagcgcggagaactaagcgactacgcactaggcaaagaacttaggcaactaacttattccacaggcgaggcttggggctaggcacaaaacatctagaagtcttcatactcaacttgctcctggagatactcctcagctgtcaggtcgacgtcttcatcttcaaactctatagattattataaggggcaagggtgagtacttaacgtactcagcaagccggggaaaagaatgacatgtcggtctaacaaggaggctacggttttatttgcgaacaccttgctgcatcatcgcgtcaaaatctttcttttgatcaggtgtgaacttttctggattgatggtcacaatgttcccttcatcaacgtccgtgaaacataacttttggattttttctttaacaaatcctgggctagccgaggacggtgatggcggtagtttctcggccatgaagaaaattgcttatctgactcctaatctgtcccaccgggcgtgccaaaagcgtgttgacgaaaaacacgaggcctgggagatctgcttaactccagtgcaggtccaaagctcgccttcgggtgtgttagcgtgccagttgatttgatcctgcaatcaacaagaaatagatacaaagaaaccgcggttaaatctataaacgatagccgatcggctaggtgccgatgacatatcatttatctttgagccgatgtcatatgtaaatcgatcggcgtttgtaaataggtaataaagaattaaatctacttgatcggctgtagatattagcaatatacaattattatatcgatatatacttaaatcaaatgattgggatagatcggtcgccgtgccgagacagtataaatcacttagatcgaaatatatattaataacaggactatatatgttcgtaccatagccgatcggatagatctagcatatatcggctaatactccgatacgactctatattaagatgttaaaacaagcagaatataacaaacagaagcttaatatacttggatgcaataatatcttgacataaagggcagatttaacgtgtcaatgaagcatatagagcaaatatagttaaattagataagatcggctgaaactccgatactaccctaatcggtaaccagaaggcaggctagagattgatattctaagcatgacttaatagatcaaactcaactgatacagcattaagtatgaaaagaagaacaatatctagacaatcaagccgctgaagtttcatagagtggtagatatcttatataatctaaaccaacgtcgatatctaacctaatcggctaccctctgttaacagatgttagccgattgtgggttagatggtgatattgctagagattatgtaagatatatgataactcgatgaattacataaacaagattagagtatcataaagatgtaagcactaatcccgagaacgcaagccgtcataacaagttttacctcttgttgaagatcgaaaccgatgcagctcaacccgaaagtaagaactcgtcgaaataaaacaaaagcaaaagggtggcgatgcgccgaaattgtattgaacgtgtgtgttaattgattacatggggttcggggtctatttatacccgaaaattacaaactatgtccatatcggacacgactcttatctctaacaaaatctaagataccataagtctttgcgacagacttttacccaaacatatctttaaggaaattacataaaatattttaattaatagatacaattgccttctcaggactctatccatgtgcggcaattatcttgaagcacctcaattcaacccgatgtcatacaccaagtcgtattgtcggaatcggctgcatcggcttacctagtccgactcagacccagccgatcctaatcgtagccgatctggactccagccgattcttgctctgttctcaaatcgatctccgccttcgactccacttcgatctaatcttcttttccgatgccgatattaccaaatttggttgttaacaaaaatataaggcacatttctttttgtcaccaaaatcaagaagtaattaactcgtccccaatnnnnnnnnnnnnnnnnnnnnnnnnnnnnnnnnnnnnnnnnnnnnnnnnnnnnnnnntgcnntgtaactccgttcgca

SEQ ID NO: 83493 - DNA, 3720 bp, Oryza sativa
ccacaaagctgagtgcctatattctgcagcaactgaatagagcattcagtaggaggattttcagaatcactattatcatcagcctcaaaaaacttagggggtaaaggatgaaaagaagaaataataccactctgttcagccagaagcttgagccttttagcacttttccccctaggttttccaatccctagattggggtcaggtgacatgtactcctctgtgagcttgtttattctagagctcctcctacgatcagtgtccacaattaccacagttttaccttttttctttttgcttttcttcaaggaaggccgacaagaggacaaattctgctgaaaagggtccaggggcatatctgagacatgttgcacaggggggacacagctaatgggctcaattatttcagcattttcaaattgttgggcctccaaatcttcctatcccaacatggtctgttgagtctcactgtcttcaatcccaaccaccagcagaactgctgctagaagagcaaactgaacaatatgaataacaggcaaagagaagggcacaatctgaaggtcttgaggggggcccaaatccagagaccactgaggtgagagctgcagcaatctgaagggactctgattctgaactgacaaagtgccttcccaagtagagagagttgtgttaaaagcagacagaatcctccaaaagaacagattaataagaaaccgaggctggacaagatgttcaaaagagataattccctggttctacagcaccatgttatgagaaccagccaccactgacagagcactattctgagaaatatgctgattagcatgggcatcctcttgcatattgtccccaaagacttccacatggtgtgccagctgcgggacaggatcagggataggaatatgattcacaggaggaagatcttcatccccaggcatgatatcaggcatctccccatgacacagaaagaccgaaacagtccaagatcttccaacacccccaaaagcagcagcccttttaatcacaattcttttagggacctcaagggcagaagagtacaaagctttaaccaacaaacttcctcttatattatcatctaactggactttgactacttttccaaaaagagagactgctttgtcaataacggtcggggttttgaaatccaacgggaagtccaaaaacataacccacccttccacagtaaaaggagagtttcggcaactagaagtgagatcatggggaacaaaacatagcataaactgattatccacctcatagggaccccccgcgattagcgtatctcttagcagagcagacgcaacccgaacataaagaaactccataggatgatggttgacctctaacacatgataccccaacacattctgaacatagtttaccgccaactgttgaaaaccctcaaactggtcaggggttgggggaggctcaatgcaagccacagccataccttcattgcgccttggaggatcctcttgaagacagagatcaacgcactcaagctgatgatcccagggttcatgcagttgtatggttggagggaggaaaagagcagggtcagggttgacaaccgccatggaagcactatgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcagcggaggcccaacacacacaaagacaaacgagaaacagcggaagactagggcgacgaccacaggcacttgacggcaggcacgagctagacaccaaagccttcatcctccaggaacccctcttctgggtttgggaaaaattgagcaagactgagtacaaccaccgtactcaacaagacacacccacaagtgcagaataaaagcaagggagtacaaaggagttatactataaagggttagggttgcagtaaacagcatttaaagacattagttgctcaaagctattttgtaaacacgattctagaactatacaattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacgaaagacgtgacatagtttccaacccatcctagccatagacaagagtaccgacccaatcccacctacggccggaacccctgggacaggcaggcaggactgagcccctagcagcaggacaccggccctgtgccatgacatctcgactaccgggccgcagctcgtgtagccttcatttgtcctagagatgtccatcgacccccgacttcttccatctccatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaatttcacaataaccaaaccattccatagtgtccaggtgatacgaacattcccaaagtctagagttgtaaaaccgcctaatgttacctaattaaaagcgaagcatctacctaaaatcatactagtgataccatgagtagagtgtccactagttggggttttgtttattctagggtgaacaaggaaataataacaataacaataataataaggtcgtaacaaaggtaaataggcatggctaaataaaacagtgataatgcgggaatttaaataaagcgataatgcaataatttaaatcaacataattttataaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaatttaaaatcggatttattgcgtcagccgaggggaggagcgcgcggaccgggtccacgggagtggggcccacgcggcagcctctcggtccacggtggaccgggtgcacgcggctcacaccggccggcgccgtgggtcccacgcgtcagccgcacccgagggctcgggcggctgacggccgggccccacatggcagccgcggcgcgcgcccgaaggcggcctcgccggcacagccgacgggaggcggcgcgcccgcgcccctatggtcgccggcggcggccataggcacggcggagcggcggccgagag

SEQ ID NO: 83494 - DNA, 1885 bp, Oryza sativa
  unsure (1)..(1885): unsure at all n locations
cgtgtctttgannnnnnnnnnnnnnnnnnnnnnnnnnnnnnnnnnnnnnnnnnnnnnnnnnnnnnnnnnnnnnnnnnnnnnnnntgtttgtgtctcgacgagatgtataaatttggttggtacaatattacaaatatatatatatatatatatatatatatatatatatatatatatatatatatatatatatatatatatatatatatatatatatatatgtgagcgatgaaatcatatgtataatataactccaccattacaatggtttttagagggcatatcgaaattacatccagctgacgacgacggcgctcagcttcttcataggacgtacgtttcagtttccactcctcttttgttcttcttttcgcggggacatgcaataagcacgagcccaaattaagttgattatttcgccagattaagcaaaagatcacaaaaaatgtcaagaacaagagaagaatgtcatcgggttcagtacatatatgcatcgatcgatgaattaggccgggaggtaggacggcggcagcggcaggccgacgaccttgccgcagcggagggcgttctccggcatgttgtactcgtcccggagcgacctcgccggcgagacgacgctgatgtagagctgctcgccgaggtagtgcctctcccagatgttggacctcacgttccacatcccggcgttgtcgaacgtcagcatgatcgccgtccacgacctcgggtacacctggaccgagtgccggctcaccccgtccagcaggttgtacgtcttcctctcctccgccgaccacttccccggccccatcctgcgccatcagtcagtcagtcaacggtagcatcagatcgtatccatcatttatcttatttaaaaattttatgtaaatatagaaaaatcaaatcgtatttaaagtacactcgacaataatcaaattacaataaaattacaataaaatagatgataactgcataattatttttaaataaaataaatggtcaaaactcaaacgtttgtgaaaaaacatatattataaacgaatgttaaaagtaaaaaaaacatcgtatattataaatggaggtaatttaaaaaactttttttatatcattcgtcttattaaaaaattttattattatgcgcatcagtaagttagttaacagtagtatcagatcatatacatcattcataatattcaattttttatgcaaatataaaaaaaatcaaattatgtttaaagcacacttgacgataaatcaaattacaataaaatagatgatacttatataattttttaaaaataaaatgaatggccaagcctatctttaataaaaggttaatggaggtagtagtaatggggggcgatgtatgtacgtacccgacggcgaagaaggcgtagccgtcgaggtggacggagtccatgctcttctcggggttctcgaagatgatctcgatgaaggtgcggaactcggcggtgatgacgttggggacgacgtggagggggccattgacggcgggcggcacgtcggtcatctggttgtacctgaagacgccgtcggtgacgttgaagtactcggcgagcttgagcggcgtctcggcgtcgacgtgggagacgccattgaagccgtacttgagcttgccgtcgatgtggccccgggagaccatgagcctgatggtgcgcgtgatgttgatctggccgtagtggtaggacccctgcgggttggggcgggcggcgctcgccgtcaggttccaccggaacgacctccactggttgatcgaccacgcccatcccgccggcggctccggcacggccggcgacggcggcgtgctcgagccggcgtagcggatgacggctgacaccgacttggcctcgtggatgaaccgcgtggg

SEQ ID NO: 83495 - DNA, 10926 bp, Oryza sativa
cggcgagtggcggaaacggtggagggaggcacggggagcgtttatatagggtcgggagggggagagagaggccggatgagggggaatcggccgcggaagatccggccgccattgatgcgccggcgaagttagggggaaactttctgaacaaatccgagggagagagagagggaaaagtggggggaaagggagagggaatcacggggagtgatttccccctctttattgcgcgcggggacggcgggaggcggcgggattcgcggcggcggcggcgctagggcacgggcgaggcggcgggagcggcgggaggtaggggataacgggtgggccccacctgtcagcgagggtggcgggcgggcccgcccgtcagcggcacgcgcgcggggaggaggccgattgggccgcgggggagaggagagagagggagggaggtgggccgagccggcccaagaggggaagggggggggggaaaaagggactttttagggtttttctttttataaaacctttttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacatggattttacttattctatgcataattttgaggatgtattttagagtcgttttgggacacgacacactaggcaaagcactaggcaaagaagctgggagcaaaaggggaacactctgccgctgatgcgaggaagaggaagggtttccttgattcgtgaaacaaacaatttccttccctaaaccatccccaccaacatcaggcttagacacagtcttgggccgccagacatgggccttctttttattccaacagaccacggcccgatggtctaatttgcgacaggaagcgcatttgaccatattaacacattcaaattcccggtgaccatgcgacagacaacgatcacaaaaaggaggggttttaggccgatctaaaattgaattcttcttatcagccgataatggcggatcacaattccgctgagcacggaccagagtcttaccgacggtgatctccggaaaacgaagacgggcaaaaatagacttgacaggaataacattcttagtctgaaatttagaatccgcaccctttgaagagtgaaccaaagagagatctaaagactttgttatgttaggctttagaaaaccagagaccctgggaggattaaccagcttaggagaggaatcagtcttaacaggcttggaacgcgcagcagactgctttttagattttctagaaacaagtgtccattcagaattctgctcagcagaccatagcctccattctctctgccaatttggacctccatccctccaaagatggaatcgagcatgatagtctttacagatgaaagaacgaagattatagatccaaatacccacggctttagaacaaaccaaaaaggaattgctccgatccttttgatgagcgacaaacagatcacccggagatcccccaatacaagccctcagcgctagaccaaccgaagaagtgcacaaccgaaaagaagaacgggggaaatcgaccacaagacaaaaaggacgacgagagaaaaaatgagaaaagtgcaccgggaaagagaacctggattagacttcatcacggatacggtcaccaggggaaaaatcccaaccccctgggggcgctggtgtcaccatggatgcactcagaggactccatggaccgcctccccaatcgtccaagaaacccggaacaaggatatcgcctccattcgctcccgatgaattagctcagttctatcttatttcggggtattttggtttagggtagtgctaaaacttttggtagttttttggcgctatacaatagttactaatatacatgtactaaaccattaatatatggtctcacctctcatacacatatgatgttttggagttatttatacaatagttactaatatacatgtactaaaccattaatatatggtctcacatctcatacacatatgatgttttggagtctgtgttgtagctggctacaaatctgtcgtccactttccttctctctcctctcttatattttccacatgtgcttatagttgatttgtagcctgcccttatacttgctttgacaatgggtcaaggatttataaataaatactaaagaaaacagatacactttacaaatttaggtctaaccatgtggggtggtgcgggttctatttccagaacctcatggacttttctgaaaaataaccagcaactgacatgtggacctctatgtttaaaatctggaaattataatgaaagtagtttaaataatttctgtagcactgaaaatggtgcaaacatgtaaactccatagaaaaatcattttagctccaaatgagttgaatcaaaatttgttagaataaaaaaatgaactatttttttatgtcaagtaaagtctgtaagaactatatgaaaaatacatccaaatttggtcatatgtaaatagccacatatagtgtattcaaacatgtaaaattcataggaaattagttacaactccaaatgaaatgattctagatttgtgaaaaatggtcatttatggtaatttttgtgcataagatgacatgtattacaacttgttgccatggagggtagcaagggtatacttatgctatcttgttgatgaacaacatgatttacttgatatacatgtttcaaatgcattattaaatactgttgtaaaatacttgtaaaataaaatttgctttatgctaaaaattaaagactacaaatagcctttcctttgatttagagcttgcatgtatttaggtttgatttttgccttgccagtacattaatgtactgattcttgcttgttgtatattttgttttccttagtccctgttgcaggttataagattgttttaggttgagtgttgcgggaactactcttccaggatagttataactgggggcttacccatagtcggttgcttgtggagttcttttgggtagacatgcttccactgtacctatatatttggccggtcggcgtatctaataacttagatgtaaatgtacaataggtttaaatatttgtatgccctatgttggatgtcgttgcttgatataaaaatgtgggactagtcctcctccgagaaactagtctagcatgagtaagtgtttagaataactgagttgttacagaactccagcgatttgagtcaagtctccaagaatgtgtaatacatatggtcgccgccttcgtgtggtttgaccggcacgtctcaggctaaagttgattggcatgccgagtcgcaacaatatatctcttgttctctactgggtgctttgggatctatatgttgtacgttattttgcatgccaaagctccaatgagtttggatggttatttttggtatttcttactgacattactagaaatattcattcccagcaatggcgctaaaaatagtcctggtatatttatggttacaaaagtagtccacaagcgcatggatataccattgtagcatttcacccggaagtatttcaaggtatcgtatttttaaacccaagggaagataataagagtgaacttttccaatacactttatacatatgttacttgtaattgttaaagcctaagcaggggttaattttaatttaggggtaaagtgacacgaagcaaagctgatcaaatcctcataatgaagtaattctaagtggaagaagaattagaaagcactcaattcatatacttctagtatacactcaaatcctagtttacatctgttagtatataatcgtgtggccaatatcccctaacagttacttacgacaacctatcatggccgtccaactggggctaaatacggagcagtaccctccccaggaatttgtcttaggaatatatactaacgtggaggaatacctgtactgaactgtcaccatcagcggcccacctgtactgtcccgcagcatatatgcccaattaatgatatttaataatctaagcaccgcgcttacattactaaatactactctacaccaaattaatgacatagagcaactgataaatcatacattaaacccgcaccattgcacctctctggtaagctacccacacaatcagtacgacacagatataaagtaagaacagtactcagactaaacaatgtacgaaagatatataaagaagaatatttcattaatatcgaaagtattacagaagagaatacaagagctgctagagctataccgaaactcttccgaagactttgaggactcctaatactattctactctactccacttagcagtaagatactaatactaaagtatgaagaggaattttagcttgcttgagtgtgttgagagagtgaatgagctcctcgtcttatagggcaggtatgacggttgtagtcatgtgaattgtccattttactctcacaaccgtcattgaggagtgatctggaccgtccacgtggagggccagccggagctgacgccaccagggttcggctgaacctgggtcggccaacagacctccagcatcgggtagggcactgacaggtgggtcctcttgtcggttgtgacagttaaggcggtttctggacggttacacctgacatatggcccctccttatcctctagcttgcttaggagtgaggttttctccactttctctttattttatttgataaattcctacaacatgttattctccaagtacaagtgaatctacattgtttgaaaacaaatatgcattgtaagcattgctaattcttcattattttagttatattgacggtcaaaatttgtctgtaacgaccgtcaacagttaccatattattcggtttttgtttgagaccccatatgtcgaggagtgatcctctctagtgggagatcgtgagatcccccttttatgagttcggccgggggaaaaggctcgcttggggagatcgcgagtctgccctgaatgctactaaatcgtgtgcgagcgccaagattatacaggttcgggccgctatggagcgtaataccctactcctgtgcgtgagattatggttgagtgttacaagggttcctaacctccggagagtgctcccgctcttctcctcctagagttcaggttttactgagtgtcgtcccctctctcggtgggcaaggtcctccttttatagttcaaggggttaccacatgcgctgcttctacctactctttcataggagggggacccactttaccttgaccgggccacgatccttgccttcgcccggaagctaagcagcagtccgtccttgagcgggacccagcaccgccccccgcctgacacgggggacagccttgtcattccctcataaatggatgaagactcgtggtggtcctcctctcatggagggaactctgaatgacgcttcgatgggatgggacatacctacctccactccgccagatacagaggcgacgtgggggcacaggcgcccgtccaatcggacgtgaccggcaacaggccggtcacagactggtcacgtccgattgacgtgggttagtcaggcggcaccgcatgtatgcccttaccgcataaacgcggtgaggaacagttggggcgctgtgaattgatggctgttcagcctgggtcccctccctgctcgctccccccaccacatggcagttgggcgagggcctcggggcgaggcagcacgagggcccgaggggcacgacgtggcaccccgaggccccccggccgtttctgcgactcgtgaggtgcgggagtagggccaggctgtggagccacgcggctggatgggaaggtaacttcccctcactttgcatacccccgggcccatatctctgacaaatataatagattttgtttgcttatccattcaagtaatagcaccagcatgatgtttaattatatgaatgtgctagtcatcttaattaatatgcatgttttgaaggctgaacgcctgaacacacatcaacaaagaaaatgtggtaagcaaaagaactggaaaatcagaaaatttacttcaaaatgaactgaattactctgtcaaatactaagttcttgtgttgaactgaattatttttcagctgctagccgcttccatattcttttgcccccatcatcatttaaattgcttgcaaatattgcacaagcgtacgtgttgtttcaaactcttcagggccttgagcccttgagccgccgctggaagacggtctagttgatgtgaataatcatgggatggataaccaagggtcaggggggttctttacaaaaagtaatgtatgtggcgggcgtttttttttttttgtaaaattgctacatccggttggcagcccttggattgagatcgagaggaccccattgcacgagtgcatgtgtgcatgcgatggctcgtgtgcacctgatacgctgccgtgctaagtagctgcttggcgcaatatatatgtaacaatttgagtggtttaggccaactcaatttctggaaccatacttaccttgcaagctttcatatcagcatttcttaaaagtttaaactcggtgaatagtcattgggattcgagcataaggtcatattagtttggatggacacttttctaacttacaatcaatttaagccttcccagagcttcacagatttgattgcagccgtatagcaagtgtttgccagggcatcgatacatccaacctccattggggtgcttggtttagtcggtgtatgtcaccattccgcttgcattggtaagatcttgtaagagcttggttaaaagcttgagtgtgtgtgatatttaagcctccacttcctagtagttaataggaacgtgcatatttttgtgtatgttttttgttttcaacatgcatagaaaatttgggataactgtgctcaacatgaacatcttggtcaagtgatattagaatgatcaacatgaccaatatgaggtaagtgatgttcttccaggtaagatcaaatctactctatcttattttgaagaaaattatgatcctcgtgctaacattgattgggagctagtggttgatagagaatttaaggagcatgacttgtctgagaaacatatggttatgcgtgcctctagtgttctaattaaaaatgtttttttctaattggaaagtaggcataacaaaacaccacaatcttggaaagacatgatacgatatttgagagatgtttatgttcccatgtattatgctgacattctgttcaacaaactgcaaagtttaaaacaagataatagaagtgttacttcatactattataatatacatgcttgtttattacgttgtggtttagatgaatgcgaagaagctacataattgaggtttttacatgggcttaacaaagaaatttaggacacgcttgcttgtcaatgatatagatctctttctaattttttacaacttgcttgcaatgctgaaagtaaaatagaggaggacatgaaaaggaaacatgctatgttttttcctcctattactaatcatttgcaggaagtgcataatcatgaaaatgaggagagtgacatgaaagagctgccgttcccattattcacactcaaatttgatggatctccatcatcagaagagagaatcacatgtaatctacatggtgctgcaattaatcaaggttagtttgccgttaataaattgaaatcatccacttttattgctatcatagagcaaccattagttgagattcctttgtcacaagttgatttaattactgatcattttgataaagaagtgttgtgtgataatgcttcaattatatccatgccaaactagtgaatgaacatgctattcctattggtaattcttactgcgctgattttaagcatgttattcacattgctaatgaggtagaggaacgtgaattgatatcttctttaaatactttgggctacgttccgtttgatgatttttgtgagttcaatagtttgaaggagaaattatttgctaaatctgatttgccatgtccaactaatgctatttttcatatctttggcgaatataatgatagagaaatataattggtgtatagaatttatatatgttcagaattagaacctcctgtagatgtggataaaacatgcaagctagagagacctattattgctaatcatgttatcttgagtttgtcttgtttcaattggaagaaacaggtttctctaaatggactacgcgacaagcaccatatggaaaaaccgagtacggttttccgtgaagaaggggaggatgatgtgaccatggctactatagatacaaccgcagttcacatcatgaattaacaagaagacatcaagatcaagtcctcccaagtgctggaatttgattcggccgcctactacattgctgacttcaaacggccgccaaatatgcatatgagctttgttttgggtccacgagtacatgatagaaagctctcggagtcctcattccaacggatccagcctcattgctattttccattcaattcagatgcaattgaagaaataagttgccgcgtcacgtgtcttgggcctctgggcttgtatctttgtttgggagcttgtatccttgtttgggaccccggcacaagtggggcccatgtggggtgcgccccaacaagttggagcacaaccctagggacccctagatcttcctcccacctttataaatagctaggtagcccttcagagtttcttgggttttgttagattaatgtttagccattgctacttgcttgcagcacgcatgtcggctagaccgtccgtctgcttgttcttcggaaccccaacttatcatttgttttttcaattcctatttgcaattcagattgctttaatcttgtacttgcttgtttcttctatttgcttgcaggaataaggttggtctgcacttgcaagatcaacaacctacatagaggtgtatcgatcgctaagactcaacacaacaacgtcttgtacggttgtactcggatcatcaacgtttcttccaaatcatagttatcatcaactcaccgaaagatcgggccttgagtgtctcgagtgaactcagtgtttatcacttgggccccacctctatcgatcgccttcctccagagactgtcatgtgggcacctaaggcggtgcatggttgtctggccccatattaagtcggtttgagctaacatatgggcccttcaatctgtgtgctgtcacatgattcatcgaaggtgcgctttttgcacgccgttacatttctccttcactttattgtataaaccctacattcatactatttatccaagacaagtggatctataatatttataacaaatgttagttctcttttatttattgaggtaattgacagtcgaaatcggtaattaacggccatcagtaccaaactgcatttataaatgccttagattcaactcaatgtgcgttgagggctttgtttatatattgtttcacgtgtgtaatacatgttaatttcctagggcttgtctaagtatcttcctcttggtcaattacaaattgtgtgaagtcatattgctcgttattcctagacctttttactaaaccttcttagcttttcacccatgttgcttaatgcttatcgtctagactgtgctttgtttttgctagaaaatgaaacaaaagaatgaagcctattaataatgttggaggtacaccactaggacctttcggccggacctaccaaaaccaagggcttaggcgagaagtcaggacagagcggacgggtttcaccaaggacgggttccctcagagaattgtgtgggtgaagatcgcaaggtgggaacccctgccgagaaggacacacgcttcgccaaagattgggccgagccatttggctcgttaagagcccaaatatgtaaaggacactgtgtgcccccaataatgtctctttcacaagggtaaccatgtaaattctcctgtacaacttaaaccctaaaggggagatctgtaataggattataaatagccccctagggccatgtaacaaggggatccaaaaatttttactaaggaatataattgttcttactttccaaccactgttgagagaaccacgtctttcgacgtgacacggttgtctattcgacaacaaataatatagttttgtgagataacaagagcatgtttccaaattatagcaatgtatgtctcagatagttttattttggattgcactaaatgcgcagcaaacaccttatttgtttgcttcatatataattctttttccattcctatggtctaaatatgaaatattatcttcttagtcaactgcaggcactcatacacattcaaggctttgtatgaagtcaacttcgaaaaaaatgaatgtttaggaatttatctcatcaatggataaagcggcaaatattttataagatcttagaaattatattttttgtagaaatttgttatagattggtgtaaataacatttacaggttttttgcaataccgtgcttgtgccttttgtacaatgattccatgctatttgagacatgacgcttataaaagattttatagaaacaattttgtacatttctgaatattaatatcgatgattttatagtggtatattgcttgtaatattgatgtgttgctgcgattcaaaaggatgttactagtaggtgtacctgtactcacatatatgttagtggctttgcaataatatgagttattgggcttgtgagtttggaactccacctccccgcatggaaaacatgataatttattaatatataattaattaagtattagctaaaagaaatttaaacacatataataggttgggattgaggaaaacactaaattaatcaaggtcagcctaccccctgaggaagaaacatt

SEQ ID NO: 83496 - DNA, 977 bp, Oryza sativa
  unsure (1)..(977): unsure at all n locations
tgaaacgtggctgatatgcnnnnnnnnnnnnnnnnnnnnnnnnnnnnnnnnnnnnnnnnnnnnntagttttccattttgaaaattgacggaagtagtcgcctaccgccctctgggagggcgatttttaaaaatcaccatcccagagggcggcgaaaatgacgtggcagacggccgttcgctttcgggcgacggccgtcaacgaaatttgcaggcggcccccttgccgccctccgctagggcgattttgtactgtgcggggggccgcctgcaaatgggcggcgagggggcatggaattttgcaggcggcccccttgccgccctgggggagggcgatttttgcctcccccctataaagcccagtcccccctctctgaaatttcattatattcactaaaaatccaaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttaaggcgtagtacagaaatgcgaggttaacgcagttattgttttcatcaggcacaatgtcaaataaggtcacatttcagatagttcacggtgaaggaaatattagatttggtccaaatggtgttgatctgtcagattttgaatgacatctaagggcatcgataggcctgccgagagaacatttcagtcaatttatagttggttgttgagaggattagaatagcccaagagtctacacatggc

SEQ ID NO: 83497 - DNA, 5615 bp, Oryza sativa
  unsure (1)..(5615): unsure at all n locations
ttggctgaanaataaggggcctatgntatngtannnccntngnnnngtagncagngganccaagcttaaccagttcgaaccccgctccggtggtattccctccttccgccgttcctcgcgccgccccgccgaggcgcgccggtgtcctttttacatctcggccagccttcgtcttcctcctctcgccatccgacgcggccgccacgtaggcgccacgtcggctagaccaagtcaacccgccagcctcgtccccgctcgcgtgcgctcggtccacggaaagcctaacggctgtgcgtgggcccgccacccttcggtccacccggtgcaccaaaccgcgcgccactcccatccgaaccctagcgcgcgccacatgcaccgctcccacgatgagccgcgccaccgacaagcgggccccactcgggaccccgcaaggtggactcggcccaccggccctctctctccctcactctccccgcgccccttgggccgcctctctgggccggccggcccattagtttggccgagccgcgcctctcctctcgggccacgcccaagccgcccgagggagtctaaatcacatccctccaatttctttccaaaaagggtttaataaattattaaatcctttttcctttgattagtaaatccaataaactttgaaaatccatatattcccaaccgctcatccgattgactccgttccacttccagtaattccgtaaaattgagatctatttaatggcactattaattaggctaaataggatctttcttttgggtcttgtgtaggttttcgattgtttgcgtatagttgcggttaccggattttcgtcaatcgtggttttctcggagattcgtgaagcttcgtgaagaccttgagcaaggcaagtcaccctttgatcaatttctcctataattggaaagtcattattattttgtttgcaacttgcattattagaatcactcacgtttaacttgcttggcctcggtttgcatgccaaaccgacagacctacctagtagtcgcactaattcctgtaggctgtactaccctgactccttatcgctccacctttgtggtaccacggtatccgtgctctctgagcgcgtataccaaatatcccacatacaccgttgtttatcgaaaacttgggaaatgggtttgtaaagccttgaaaacccgacatgtggtgtcggtgtgtttaaaaataaaatgaattgtgaaaactcgcgatgcgggggttgtgcctatgtggcactgtcccgtattcgcatataaggaccgattcctgtgggaaacgcatcgagcataatcaaagtgcaaccacaaggtggaatgggacaccctggctaagtaactagtcggttcagggaaacctcgcatgccaatagttgggaacgccagggcggggtcggttggagccaaaccgggttcctggtaagcaaggaagagaagcttgctgaattaccgatcgaggtggttggagtttgatttgtgaaaactaaaatggcctatatttatgtgaggatttgatccttctatgtggcatgaggtaaccctgggtcggcttgggaaaggctttgtcgcgagcctctgacaccggccagtgtctggagtaagttcgtatcttgtgggtaaagtgtacccctctgcagaggttaactaactgttcgaacagccgtacccacggtcatgggcgggtgtgaggtggttcccgttgcgtagatttgtttgcctgtactttgtgaaaagtggttgtggtttgggaatcgttaccagaatcagcctatgtggcagatggatgacctgagtggtcagaaacgaatctgtgtgattcgggatgtctgcgggcatcatagactaggcttcccgagtggaagcggattgctttgctgctgggcagctggactctgggagtccgagaaaatgaaaaaggctctgggagccgcctaatcaagtgaaatggctctggaagccgataagtaatgatctgactcggggggtcgatacatttccaattgagctgttgaaaagcatctcttaagtcgatttgagacgcaagtctctttttgacccaaacttaaaaagaaataaatcacttagtgatttcaaaatgatttcaaacaaaagatttgcaaaacaaccttgcctctcttccaagcttgcattaaacacctaagttcccgtgacttgctgagtacgaaagtactcacccttgctctatataaatatatatatagttcctccgccctgaagagaagatgaagtgaagtgaagaatagggtttcgccctgattcccagctgtcgcctgtggtgttgggtgttagaccgttggttccgctgctgctgttgttgttggtgttcgcctcgtccgtgtcgtcggttgtattctcgggctgtctgagctgcaaccaaggttaaggtaaataagtcctctatttattttaaggattgctatgattcatatttgttaccgtgggtaccagcaccatgtcctgggactggtaccgagaccgcggtttcgtaggaagcggttcgcgccgttttcccctacgacacgctcctgtcaggtgtcgttgtacgacggtaccagattggggtgtgacatttaatttcatatttccttttacatttataatttgttttatttaatttttcaagctcttctttccaattctctacaagcgccactggtttgttttcattgttcatctggaagatgaaatgtttgtctttcttgactcattacatgaagaaggttctgaatatcaagatgaagttaagaatagattggtcagtttattttcaaatttttaaatatatgtattactgttcaatttgtgatttggaatttataattacagagttttctttttatattttgtagacatccaattttgcacttgcttggaattccatcatggaagaatatcaaatcaattttgatgctttcaaaattgtatatccaccagtacctcgccaaaataatctgtaagttgtttttctttactgtaacttttagtccaataatattttttatttgtttttttttgttagagttgtacagatgcccaattgttctcttgttgacaggaatcttgtatgttttgttggtcattcagaaattcttgactgttctgtttttctaattgttgcataacctgtttgttttgttgttaatgcacaattttagtttgtttgttatgattatcattcaaaaaatttagttcctgtttgtcaattgtttcattcagaattactagatgggataagagcctgtttcttagtacaacatggactagaactgcaatagatttcattagtaaatttacagagtaaatagtatgaccataactgcattagctttttttaattttttttgtttgttttattttttatgataagtaactgtggttacttatgtcctttttctttttcctagttttgattgccgagtttttactctaaaatacatggaactatggggtccaagagttcagctgacaaaccatttctatcaaaaagacattcaaaacattaggattcaatatgtcaaccgtcttttcttccatccagacaattctgttctcggtacaggaacaaagaaactagtgattgactttgctcaggtaaattttttttagaatcattatttttttcacaattttttttatttagtccttatatttttatctctctttttatttgtagggaaattgattctggaataaattttgtttgttcaaatatgatagttggcaacttttgcaggactacaactgtacataaactcatgtggtagataaaatgcaaagtagttcataaaatgtagttgatataagaaacaaacatttaagtacaaaccagagtacatgttctggaatattacagaaacttatggaatatgtctatttccattgtattcaagtaaacctctctctattttcagtcatttccatttctattcttttgtgccacccctttttgatgaagatgaatttctcttctttttgccttctaattcatccccagaattatgcttctcctgtgatatatcttgttgcaaatcttttcttttgtttgaaacatctttctttttctgctctacaccatcctgcaacaaataatatctttctttattactttttttaaaaaaatcaattcatatggatttgtaatttttgttacctgttctcttgtatttttaacctttcttctcttcttccttggcaagtcaaactcaacgtgtttcagagggcacgttgaaaatgtgtgatctgtcctctgaaaatgactgcaatgatatagttctttttgctgtatttcttccataattgtcttgtatctttgagctggcctgcctttggattttgcaatatctggatccaacaatatttcttctgtattttcctcagattgttgattgccttgttcatgtgagttcaaattgtcttctgcatttggatctgaatcattgatctcctgctctgcatctttatttgaacacattaattccaattgtttagcgattttgtccatctcttccactgcaaactggaaagtttcattgcttttcgatccatttgatgctatttctgcacttttccttgacaaaatgttgaatctcaggattgagctctatgctaaaggtatatttccattgccttttcccccaagacctttgtactctttttttgtccatctttcaataatatatttttctggtatcttcattgcattgaggtggagcattactttcaatacatggcagcatagaagtccatctttctcaaactttgagcaaatgcagttgaaatcctccttttccaagtccacaataacaaggtacttccttcttctgattacttgaatattttgattcaatgccaaaaaaacttcataagttttgaacttctctacttcatttatttgaaatctagttgttcttttcaactcaacttgaaacttgatgaagattttgcgattatacattctcattgcttggtactcaatgtagtaatgggaccaaagtttgcttggtttctttgttcttgaaatgtgatcatcaaactgttccaagttttgaattgtatccattactctttcatactctatcatgaagtttgtaatgttgtactgtggaccaacattattcttaaaccttgagttagtcccttcactgagagctgtgctttttataaatggacagaaatcacccttgaaatacactggaataaatctttttctaattgaccacatgtgctttagaaaattgatatgctgaacttcaaagctgtcaatcatttcttgccataaatactcaaattcttcttctgtaactgagttatttatgatgtcttcatactcatcatacaacccttcttttgctttgaacaaatttccagatagattgaaagctttctttacaatatgaaagaagcaatttccgtgctttgcattttgaaatacttgagcaattgctgatctcattgctccatcctgatcagtaatgattatttttggttctttttgtgacatagctttcaaaaaagttctgaacatccatggggtccgaattctngagtttnaanngatggtctcaggagttcgtcct

SEQ ID NO: 83498 - DNA, 9126 bp, Oryza sativa
tccggagcatgagagccaatgaagcaaccaaagaacgaattctctcctggtgtgcagggctgtagttgtgacattactttgtatatacccttgtaattccagccccctgttttgtttcttttcttttcttttcttttgtctattttatttttcccgtttcccctttcttaataccccctctgctataacctgtaacttgtaaacctcatttctcttaatgaaatgactataaggtagagcacgctctaccttcttgcttcaaaaaaaaaaacatcgcttattttccatttagattgaacatggaaatgcacatatgtgaaggactagatcattggcatttgaactgtgaaacacggtgtatagccataaaatttaaatggtgctaaacaattaaaactgtccaatgaattgtacatcatcgctcaatcagtatatcagaaaggagatattgacttattgcaataccattgacaagaacatactgtattcatgtttgtgtcttggaagtaccataaacctaactcactcttctagcttgagattttctaacatggaaatgattaaccattacagctgtatcttgatgaaggagagctaagctatcccataagtaatagaaaacacctctaaaaaagacgaaaataggtatggcactgtcatgaagagaacaagtcatcctataaaaaccacatgagtaacttagagaacaacagggcacatgaacacatctaagattctaagtaaaagtgtaactgtaatgtgagtgcaggtaccatgctacaataacaatactacctcttcaatttcctgtgggatatgattatgaaaatcttgaagcatccgatgcctatccaaacaaaagaacaaaactggatttatgatggaaagattgtagttcagacttcagacagtagagtccttaggagaagaaaccaagcttttgcttctcctcatctaactcagctgtatcattatcagcattcccttgcttagctacagcctcacgcggcagtggagaattccattttgttgtaactgattgctgatagagtaccccgccagccagagtgaagagcaagcaaaccaaaccaattgaactcgcatgtttatcccagatcataacattgattgcaaccgtgagaaacttgttgacaacacgcctgttactgtgaaagccgtggcagagattgttttccttgctgcgaaaccaaagaagctaatgagcagcccaaacacaggacaaggaaactgtcacaaaggcatcaagttcaaaccaactctggccccttgattcaatggctgatctgaagactgataagtgctctccagtcaaaaaccaaaatacaggagcgattaccagctagagaagattgttgtagagtacgaagccccatgtgttcagcccagtttatgagaacttaagattctgagaagtagctggtgagaagctagctggtaagaatctgtagaagctgagaaacccagcttctagcttctaatttatttttggatttcataactatagattcttataatctgagtgaaaatctggactatttggtggagcttctagcagtaatagcttctaaaaaaatcttcagctcctagaagctcctccaagcaggcccatagttactagataagcaactgcccatgggtaggctgtgaggctgaaccccgaatatgtcatcacgtaaccaacagcacctcctaaaatagtcacaaaggacaaaattgtaagcttggaaggacatggctgcttcctgaatcctgaaggcagtatcatcagcgatggcaaccaaaagcggggtcaacgatctgaacactataaaggtatccacattagcacgcttcaggagatgtgtaggtgttggtgaagatggcaaggtagaacacaagcgccgccggcgcaaacttctttgcggtctggaagttgaagggatcatggtagagtagtccaagctttgcgagggtccagacaccagccactgatgtcaagtactgaagtgcagtcaggaggccagggtagctgaacttggtcatggcatacttgttgatgatcgccagcaagctcgagcacagagaggcagccgaaccacggagccctagcagctacaaacgcctctcaccaatcggccgagatgcagatcccgcaggtgagattcggattccgatcgcattcgtgaggaaaggggaaatgcagagcagtcaccgctccgacgaggggtcttaccaagaaagctcaagacagtatatatctcgggtggacggattcccgcgggagggggagggagagctccgccgctggcggccggccggcagctgccgcgacccgcgcgtgggcgaggttgagcggatcgggagaagagggaggggcatgtttgtggtgtaatttggcttctattatttaatcttggtaggccaaattatttagtttagctttcattatttattgaatgtttggagacgtatacgcgtcggacgtacggcgcgagccgaaaaatcggacgcctcgcacgaccgtccgatgcagcacgcgcgcgccagccgtccgattggagaaacaactgtcacccgacgcccgcgccgttgcaacacccaaacacattaatctgtttcattcaatgtgtcccgccgttgaccactagcacgaggggagatcttcgcggagcgactggcgctgcgctgccaccggcgattctctccagcgccggcgaccctatccctcgcgcccctatcctcctcgcgccggcgaagcctgcaacaacgccgacgtgccgccacaccacacgcagtcaccgccctgcaacttcgccaccgacgccatggctcatctgatacaccaagttgagagggatttttcgccgagctcatctagtgcaaacagaggaacaaccccaatgcataatgcaacgaatttggtgagtaaaaaatttctagggttttacttgtttcactttttttttgaaaaagtttcaataaaaaattgaagtatagatctatgaaacaatgtcttccctcatgcaacatttatattcatgtcttatttttaattgtaacttctgtataaatttggactggaatttgacttgaacaataatccttaacttgctaaaacataattgtacaagttaatgaaacaagataaaatgttacagattgatgtccaagcaccaagctcatctggtggcttccttgatgtgctattatccaaatcctctgggcatgaaactgacttggtgagttgtccttggatttgaaatatcacaaatgtaggggggatattttgctttgaaaacacagtatgtaacttagtgaaacttttttgtgtactaggttgtggatgtggaaagtgttgacaacacagatgtggctgctgtgactgttgaaattgatgaacaattggatgaagatgcatctgaaaatgatgaaaaagaaaaggatgttgtttgttccccaccaattgttccatacattggaatggagttcgatatagtggaagaggcaagaaatgtttacaacgcttatgcttataagctaggatttggaacaagaattgcatcatctagaaacagccaggcatcatcaggggaaaaaaagcatcgaagaaatgtaaagtatctgaaaatggagacaatcatgatgatgaaccgaagttgataaggagagaatttgagtgtgttcatgcacgtaagccagaaaataccacaaaagatagtgctggtggcagtagcttcatttctgaagagaacaaggaaaatccgcccctgcttgaaggtaacaaaaagaaggctcccttgctggtggaagggaagaggaaacgaccaaaggttgcaaagtatgattgcaaagctcatatggctgtagggcttagggacaacaagtggagagtcattgctttccaaccaaaacacacgcatccgatggtgaagcgccttggaagaaggagatattacagatctcataggcacatctcaaatgaagactatgaatttctaaagactttgcattatcgaaacattgcaacatcgcagattttggcgttgttaggagatttgcacggtggtgtaaggaatctaactttcattgctaaagatgtctcaaatttgaggacaaaactgagacaacaagtttcactcaaagatgttgcaatgactattgattatttccagtaaactcaagcagatagcccctccttcttctatgctgcaagatatgatgaagacaacgtgttgaaggcgttgttttgggtggatggcagaacacggaaactgtatcaaagctataaagactgtgtcttctttgacacaacctttatgactaaccgttacaacatgccatttgcacctattgttggaattaataaccacctgcaaacaatattgcttggatgtgctttgatttgtgatgaaacaactgaaacattcatatgggtctttgaaacatggatgcaagcaatgaatggacagaaggtaggttcagtgatgacagtccgagataaagcaatgagagcagcgattaaaaaggtgttccccggtacaattcatagatgttgcttatggcacgtgacaacaaaagcagatcagcaactcctgcccgtgtatacttcaaagaaaggcttccgtgaagctctgtatagatgcatatatgactctgaaacaatagatcagtttctatcagattggcaaaaaatggtagatgaatatgacctccatggaaaccaaactttgaataacttgtgggaaacaaaagaaatgtgggctccggtatactttaacacaagttttttcccttttactgggacgacagggagatcagaaggtctaaatggactattcaaattatttgtacacccacaagattcagtgtggatctttgtcaaacaatatgagcatataattgagacaaggcttgacagagaggacagggagggctacagagtagagacaacagaacctagaatgtattcaaggtaatgtgatatgcctgtcttgaaacaatttgaaaaagatgtgctttctgtttttaattagaaaaattgatgaaacaaataatatctgtactgtgtaacataaactgtgcaagtgtggaacaattgacattaatgggttgaaacattgaattatgcaggtcactgattgagaaacaagcatcgcagttttacactacaagtgtgtttgcagacaaattctagtatgaaatatatgaagcaacagggctggatgcagaaaaaacacaagaagtccccgacataatatataatgttatgccaagtgacatagaaagaacaggtaaaaaatatagggtcacagttgatgcagcacactcaacctactcctgctcgtgccacaaatttgaaagagatggacttctttgctcacacatcttgagggtgatggctgtccttaacatccatgagattccaagtaagtacttgctgaaatggtggtcagagcaagcgacattgcaaatacgtgatgagtacaatggtccagcaccatcaattggagtcccggcaacaagcaagctgagattcaacgcattatgcagggcaatgacaagccttgcttcagatgcatgtgttaatgaggaaaagtacttgattgtttcagctgggattcagaacctacacgcaatggttgcaacaccacacactgttgagacacaacatcagtaaggtatttttcctagtcaacaagacccatcaagttcagctaagaatccagcaaccaagaaaaggacagggaggctggtagaaaaaactcataggatgaagccaataggggaacaaataactgaaagcagcaagaagaggaggacaaaaaagaagagctcatgctcatattgcttcaacgagacacacaatgtttcaacatggccgtatctcaagatagcgaacatgcgagacgctctactaaaccaaaaatggtgcaagagacggagttgacactctgagaaaaaagagtttcaagagctataaatttagatgcgatgcactatactgttagaaaatatagtggtaattgccatattacaatataaaactatcttcttgtgttaggtgaaacaaattatgttgtgagatgcaacagacatattttttttaattcacatatgggcagaatgttggatgattatgtgaaatgagtctttcttatgatttatgtgaatgattgttaagtggaaagaagggaatgccaaaaaaaaaattacatctctgcactaatgattacagtggaaaaagaatatgtagagctggtgaaacattcattaagtgtagggtgagacaactgtataacagtaggtgaaacatttgcttcttatggaacagaacatgtggagctgtgaaacaatcattaagaacaggctgtaactattatgtaacagtaagtgaaacattgcttcttatggaacagatcatctggaactatggaacaatcattgataacaagctgaaacatataagtactagaaggtgaaacattgtttcactctaaaaagaacatcttgaactatgaaaacaatcattcatgactgccccctagtagatgcaacattatataaagagtagcagttcaacttgatagcacaacttcagtgcacaaacaaaaaacagaaaacacaacacacttcagtgcacaaattcagaccacacatagctacccagagcatccactttgcactattttttctaccatttttacaacttcagtgacacgactgccccctacactaatttgcttgaagttgatcatggttaacgaatttccggtagttaggcatgtccccttcattgaatgcttgcaggtttttcccatcccaattctcaatgtatctcaagctgaagaaactgcaatcaaacctaatgcatggaaaagcaagtgataagttaaaatgacacacttgtgcacaaaaaaaaaagaaaaatgaaacaacaatttggaaacaaaacatataaattgctttgtactggatactgtggaggagagcaagtctgaaactttgatatatctttgattggaattttagcatccactgcaaccttggtgaaatttgtgacctgaacggcacatcggcattgggacaaaaaaaagaacttaaaactcaatgaaacaattaaaaaattataatggaacacatggtgttccagtgaacatcttaccaggttttgagagagtatgaaccactgagaaatatcatccctcttgattgaatcaaagtaatttatttgttcccgcaaatggttgatgcaagtcagcacccaatgcttgtcacgtacaattgggaagaacaacttgatggggtgggaggcaaaaaaagtagcatatattaaatgataactggaacaaggaacagctatgaatgaaacaatatgttagcatatggtgaaactaacaattgaaacaaataaatgatcattgaaacatagtgttaaaaatagctgaaacattgtattagtatgttgtgaaacatatcagcagactaactgaaacatgaaaaaaaatcagagggatgggaaactggtaccagatctagtttaggaagtttatgctccttgttgattgatttcagccattttacacagctttcagacacaaacttctcaggattgcaaatcaatttatcctaaggaaaaaaagggaacaattgaattaaaagcaaaaaaacaaaaacaaaaatagatgtaataaaaagggggtggttaaaacatgttaccgtcaagccaggggaaaaacaaatttttttatgcttgatttcatcttagaatcttccctacagtttgcattgaacatctcaatccaacatgacataacttcattgttcaactctcctctaggtttcattgcttcacggaaatactcaagtgagacatggaattctccaatccttaagaatggagttgtcctgtttttcccaaaaaaaaagttgggaaaaaattcagataaagctgttctgaaacaaatgttttgcatttattgagacatgtcatagtgactgatgaaacaataggggaacctacactgaaacatattaataataaaaaggttgaaacatattttgcgcaaaaaaaagtgtgaaaacacttacaactctttggcatctgccttccttgacctatttggcaaagaatcaacaacagatcttctgtacacatcatctatttcagaagcggtcttcaacttcttcgcctctacatcactatcacctttctgtgcccttttcttcctatttttcttctcatgggtgcttggaccactactaccagcacctactatagaggaaaaaacattagagaggggtaggggtgttgttcatagttactttacccacaccgaaaagagagagagagagagatagagaaagagaaggaacaaaaaagtggtgattttacctagaggtagcgagcttgtagcacgtggcggtgaagatgtagctggggatgttgcccttactgctgctagagagagaactactgaagttgatgtttttgttgcaatgggtgaagggggggctggagaaggtgtccttgcagtgggtgaaggagttgcagaagatgtccttgcagaaacaggtgactgaggtgatggagaaggtatccttccatccattgccgattgaggaacatttgaaacatccaaggagagcatctcaacagccaagtcctgagtactaatgaaatcaggatcagattcattgaagagtctgaatgacggtgcatcacatgcatcatctagatttgagatatcagagtgggaagcaaaaatataatcatcaatagctgggctgcttggcacagaaccgccagaagcttcctggcttggtccatcaaaatctgtagcctcagctgccccctcaatgcttgatggttttgaaacggcctcagctaccccctcagtgcttggtgtgtttgaaacaacctcagctgccaacccagtgcttggtgggtttgaaacagcctcggaaatgcccactgcagtgttgctgtcagctagcaccttgcttatgtcagaaatcatatcacatgttctttttgcacgcaaatcaatcatgtccctcttgaagttgtcaagtgctgaaacaaactcatcctgccacatggcactgtgcttctcaatactagatttt

SEQ ID NO: 83499 - DNA, 2198 bp, Oryza sativa
  unsure (1)..(2198): unsure at all n locations
ctttgaacaaatttccagatagattgaaagctttctttacaatatgaaagaagcaatttccgtgctttgcattttgaaatacttgagcaattgctgatctcattgctccatcctgatcagtaatgattatttttggttctttttgtgacatagctttcaaaaaagttctgaacatccatttaaatgtttctgaagtctcatcatgcaaaaatgcacaaccaaaaacaattgtgtttccatgtccagaaattccaacaaagggagcaaacgggaggttgtatctgttggtgaaatatgttgtgtcaaaactcacaacatcaccatatttctcataccactccctcgatctcccgtctgtccaaaacagatttttcactttcttgctctcatccaaatcaaactcataaaagaaatgtggatctttttcttttttccttctgaaaaattccaaagttttcatcatatcattgctgcttgtctccttgttaattgtggttctcacattgcttatatctttcttcgtataaggcaaagaagtcaatcctcctcttagaacagataaaattacaatcatgtgccttgttggtattgtcggagacatgggaccgggggtatcttgactagaggtttggggcagctgcagtcacccatgtggcctgaccccctcgggggggggggggggtcgggcccgagggtgatgtggccgcccctccctctgtctccccgaggggtcgggccgctcccgtttcggccccgagggctggggcgccccgaccccctgtgggtttggcgccacgtgtgtgggttaggtgagcacagcggcgctcacctaaccgcgtttattgcgggttggacgagcaccccacgccgcatttaatgcagcacagcacactcgttcggtccgtgacaggtcacagtgtgtgaccggtcacagaccggtcagatcgcgggttaggtggcaacaggcggcatgacacacgcctcgccccgtcccgtcggaatgatgagagcctccaggcactcgtccctagccggagccggcgtgggaactcctggagttggcacgtcagccccggccagatacattccaggcttcatcgcaaccatggcaaggaagtcattgtatgaagaagggcagacgtgtagcatgctaaactgacacgtggtggacaagaatgatcggtctgtgactggtctgacgccggtcgcgtcatcggcagacaaccgtgctcccacgatgcatctgcctccggtggagtggaggtaggtatgacccatctcgtcggatggtcatttggaaagcagccatggcaaatctccgcccattaatgagggagtaacagggagatccccggtgtcaggcgagtgacggcgctgagcctcactcaaggacaagttgtgatttagcttccaggcgaaggtgcaagccaagttttggtcaagatagggtaggtccccacccaaaagaaaagtaggtagaagtggtgcatgtggtatccccttgagatataaaaggaggaccttgcccaccaaaaaggggggaaaaaaagaaaaaaggacgctagaggggttctggagcctgaactctctagctctccggctctctgtaactccttcacacacagatccaccagaacacaggagtagggtattacgcttctcagcggcccgaacctgtctacatcgcccgtgtctcgtgcacttgctctctcgcgaacattctccagatcgatcgagggcgaagaacctcacttagcgtccccggccgaaccggcaaaggggggcctgcgcggtctcccggtgaggagctccacgctccgtcaggtatattacattccttcaaggtccttatgagcattttttcttctgtagtcatgtgtttgtgtgatttgagaaatctcacttcatctcttggacttagttgatgattgtggtctaattgtacccttgaaatattccaaatctcattcctctctgaaataaccagagcacacttgcaatctgttgcatcattttcatttgtatttctttccgaaaccactgtttcctctgcgcttactgatttggattgagaagttggtttgccttgtctattacatctgaacgttactctagtcacttctccaggggtacggaattcccgagtcaaagagcaatcgagtcgaagcgcatatcaaaaggcggatntcaaaagcacg

SEQ ID NO: 83500 - DNA, 4481 bp, Oryza sativa
  unsure (1)..(4481): unsure at all n locations
aacttcaatcatcaatcattgttatctagagaaaaaggtacaaccaacaaaaattaccttttcaccatctaacaaattgaatatatcaagattccaattatccattgcatcctcttcattactctcatcttcctggaatttgaattacattacaaagttaaaatttactaaaattatcataatttttaatactacaacaggaagtaatacatccaagacaacatgcctcatttgccgcatcattattccattcttcaatattagcattagtacgatttgttgttaatatcattgaattctgcaaaacaaaatttttatatcaatacttatttgcttttgaatttgaattattagattcaattaaataattaatatttcatacctgaaatgcacttggactcgcaacaaaagtagagtgtgctgaattttgttcctgtaaattccaataaaaacagaaatattacaactaaattatatatgatattcaaatattgtttttcttacctgcatatcagaaatcgtaggctgtgatgatatgatttgttccattaagcttgtgtacgacatatttgcaacctgcaaataaattttcatatagtattttgactaccaccttcaaatttttcctttaatagcaaaaactttgtaatatgaacttactgaattcattgatccgaaaagagataattcatcatatgaatatttgttgctgtaatcaacaaatgcttctgtcacacttgctgaattatccatactttgcttttctactgttgcatcttctgctcctaatccaatatgatctgttatatttgcaattaaagtaattgtgatcaaattatatataggttccagtcaaactgtataacaatcaagttgaagtttaaaattattcttattctgtttcaaattgactgtaatttttgcattttgtgtttttttactgaaggaattatgcatttgttcaattccattttgaattgttacctgtgtttggttcatccagagcattgcttattcctacctcattacctgttatgcctgcaatagattgattgattcaacattaaaaattagagtaaatttgtattccagtttgaaatttttagtattggaattacagttttttatgtaatttttatacaaattaactgtaatgaaagaattgttctgaaatagaataagaatacctgtgtaagatcttacctgagtttacaaaagttgtttcatactctgtcaaaatactttgtttcatattctgaatttgttttgactgaatacttctttctccttctgacaattcaattgtgatacctgcaaaataaaaatcattatgaaggaagttaagatagatactgtattttcagttattgttacatgtatttttattacttcttctctgtaactagttttaatgttaatattttagattttaaaaagtacccacttgaaagtatatagttcagatcatttagatgtttgtcatttttttaaaaatacattgaactacataattttttgtttcttacctgagctcaacatagctgtgttaatttctgtcagattcgattgacttataatctctgtatccatttctgtcagagctttgaagtgcttttttatatctgatggcattttttaaaaaaaatttcagactcattttaatcttcttatttgtgaataaaatttgaaattatcttgttcacctgattctttttcttctatttccatagaactcttgctttgtttctccttttgtatgccacctgcatagaaagaataaattaatattgcaaagaacttttgaatttctaaaccagcaagttctgaaacatagagtgtatttcccaatctttttcataagtccatttacagtgaacatatatttgtattacagagaaattatactataattccagtaaacagaaactgtaactacttaaaaatccaactacaatcaatttgatacttgattatagatactgaagtgaacaaatgaatcagtttgtataattctttcaaaataattttaatattacactaagtatgtatttcaattacagtgtaatgctactataattccagttaaaatttactgtaactcttgtttacctatattttttccttctatttccttagaacttttgcattctttgtccttttgtatgacacctgtaaagaaatattcaagatagtctttaaatgtttttcaaacctgtatgagtatgttccataagtagtattacagtaaataagtatttcaatttgagtataatgctactgtaattccagttaaaatttacttatggaacaaactatctgatggcactttttcttataatatctgatggcactttttcttttctatttctttctatttcaattagatatgatttgttttggtttttacatatgtactacttttgaagtatttgataccctgttttttgctcgaaaaatctgaaatcatcttgaaattgagattgaaactgcattagatcatgatttcatatgaattttacattgtttctttgtagttacatgtattttcaattgaaattgtagtgttcactctatatatttgtaatacaagttcactgtaactagtttcattatattctattttgagacattgaacaaatcaacaatgatctattatctgaaatcttcattttgttgtctgatgatgagagaaacattgaactgagatagtcttgagtttaaaacatatcttgaatgtgttcctgaatttgtgcatgattgtgtgagctaaactattttgtttactgaactaatctttttacaatgagttaatactagaattattgtgattcttgtatgtaattttattacttttttactgtaacatgttaagaaatttgtgagttcatatgaattggctcttttgtttgtgctgtatgagatattgaacttttatgtaatattgagttggatgagacaagtggttgacattgagatttgaatttgtcattagtttaatatggtgattatgctgataaaattgaatgtatgacaattcaggatatgctatatggcctagttgttatatttctgtataactgtataactgtgatatcttcagagtgaaattcagtaaggttggaagattaatcaatctgtcatgtttttttataaagttagtttggtattcatcaatagtacacagtaatacaatcatccagaatgcagtttcgtagtactgaatgcagtgtagttttacttctaacattacatagttcagatctacagagcaaacatatgaaattttcagttctgagttgttgtatttatccagcaaagtggattgttaaccttgtttcatttgacatattcagcaatttcatgtattcttttgaattgtatatttgacctaaactctctctttgatctttttcaggaattgtatataggggataagaattggagccttgaactaaccttgaactggagccttcttgtttctcttgattttgccttcctcttgttttttctttgtgttcgccagattctgtgtttcctttgtatggatctcaactttctgttcagaagttgtctttgatttcttctttcctctagaactactctttgattctgacattgtactctctccttccatctgcgatttggatcctctttttctctcttctttctcttctcctagctccatgtttgattcgtgctagatctgtttgtgaactaatagtgctgttgaaaagtaggggattgaaaagtgtggtcccatacatggttgattcatgtgacatgtttttcatctacttggcttccaagtttggcccctactacttttttggataggctgttggattataatttgggctttatttccttgtgttttgcttctaattttgtatcttgggcctgctttttactaatgggcttttatggatctggatatggacttgggccttcaaataattcgcatgggcgaaaaaatcatgggctttgtttatttgtgtttgattcaaattttgtattttgggccttctttttactaatgggcttttatggatctggatatggatttgggcttttatggatctggatctagatttgggctttaaaaaaatggcgttcaaataatcaaataatatatctgtttttaagtgtaatatctatttgtatcactttttctgagttgttggatgtgcatcctatggtagataaaatctgcatgattggagcttcagaaatcattcgattcctatatagacagccccattttttatttgtcttggatcgaccaaaaaaatgcaatagatcttggtgcgaagaaataactgcttacatattttcattttagttctcgatatttttagaaatgtttctaggtaattaacatccaattgtagaagagaaaatataacattgtcgtcctgaaaaannnnnnnnnnnnnnnnnnnnnnnnnnnnnnnnnnnnnntgaggcgcattcattccagcgcg

SEQ ID NO: 83501 - DNA, 3961 bp, Oryza sativa
aacaagtagtgctacatgcatattttcttaagcatggagtaaccttagggggatgatacagaacggtatcccgtttggatacattttcctaaccttatgagtcccctaattttagtactgtatttcttgattgcttattcatgcatgacaatatcagaaatcgatattcatcattgccaatcataagcagaactgcattgatgcgtgtcatatagctacaggtactatcatgacactcatgattcttattttgcatagtaatgaaagcatacatgaaaaaaccacttacctacagtttgcctagattatttaacctagttaaacattgtagacagctattgaagtatttctgacagtaatgactttctcaatctcagatggttcaaattgctagagcctacctttccaattatatagctctctctctctctctctctctctctccaacatgtaggttcatttgggaatcaactaactacctcatgttaattccgtattagttttgcagtacacagagcagcacaagctcagatgatgcaccgtagcatcggtattgaaagacagtcgagcaggacgtatgtgaccaacttctacaatttcatacaaaattacaagatttttaccatattgactcttagcttatacgacagtttagtttctgtctaaactttcagatatgaaaagatcgcaaattgtattgctccatctaattgattagttataagactggttggacatgccatccaaaatagatagactggttgaatggacttgaaaattacttcaaccatgttgaatggagttgagaattacttcaaccatcttcctgtcatgagatgctcgtgcaatgctctcgatgttcattgaagaaaaatgaaaatgaacaaaacaaaagaaaatatgctccatattatgtcgcatgtcatagtatataatgcatgtcaaaacgtgagcatgcactggtcatatatccacaataaatataaaactaagatataagcagtctgtgaacatttatcaattatcagaagattattagcaactgaagaccatgcaaatatgtgggatgcgacccaatggacaaatctgaggtaaataaaaaaaaatgagtagagcatgttcaaatccaattaatgggcaatgcaagcccaagtccagactttgtaaagttaaattcaatttaagaataatttgtatcaatacaaaagttgtagaatttatagtatatttggcgatggataatctagaaaggactaacatatttggaaagagtttccaaaaaaattggcatacaattttgcaggagagaaaagggaaaattcctaattgcaaatgcacagtgaatagttacatgcataattgcataccaatataccattcaactttacaaactttacttttgtctctgaaaatgaaagattaatgtgtaaattacaagtaaattattaaggacaattctataaaagaaaacttggtggaaaagaagtaaacccaaacctttcatggatcaaagaaaaccactgcaattggtatcatgccttataatgctcagcttcgttacaggaagaacacctatatctttgtcgatacctatttgagagctcaataggaaacaccactgctctcccaataactaaatcaaatgtgaacagtgcacacctcagctagccttgaaccatcaccggtgatgttctggctatcagccatgcctacacaggcaaaaatgcagacaaacacagctagcgccgcaagctgaccagtgccaatctccatgaaccaagagatcccaaatggcttcttgactaaatgaactttagagtccggcaagaatattgtgttctctatgactttactctagcagtcattctcgataatcaagttcccatagttgaaaatgggggaacagagttcgcatgcatcaggtgagataatcatttgcttcagattcctagaaatgaccaccacaagttgcttcaagaaagagatcaatggccgaatctccttctcagcaatcaagaaaccccaaattgttggcaagtagccagttcataatcttgctccacaaaaaagtgcagtttttaccagcgcttgcctaccaactacttgatgaaatgctcaaatgacaaaatggcaagcacagctagccttcagggctgcaaacgcaaatagaaaggggaaaagatgccatcaaagtcataaacgtgctaattaatcagattgactgtccaaagaaaaagatcaggaattacctagcgcttgccatctgatcgacgcagatatcgtccagagcggacatggagacgaagaccccagtagtatggagcgtaaatcaggaaggagatggcgatgctagcaagaatcagacacatgagtcctactgttgtatccatctcgcattgcaagcgagggtgagcggctgccgccacggccagggggaacgatgactaaacagagaggtggattggtagagcgacacagccgggacggtgatggagtggttgagtggagcacgactggaacggtgagatggagtggccgagggggtggggggccgggccgccggggtggagcggcggccgggacggtgatggagtgaagcacagtcaacacagcgtggtggagcggaggaccggcgcgtccgagatgatggagaggagcgcatgcaggcgagtggagccaagtgtgatcgagggaaaggagatggcatatgtaacgctccgcttttcgtgagacgttaaaaactaattcggtaaaatcctaattgcgaaaattttcgttctttgtgtgcgagtctaagtcgtgccaagatctcatttcaaatctcgttgttccctctcatcgaaatcaaaatcctccacctcaaattcctcttccgattcaagtctccaaatcaaattccgaaattcagtcgcatcctttgaatcctcgctaaacgctcgctcccaattccgaaaaataccaaactctatcttgagccttccttgattcctccctgaaccctcgagttcgaatatcgaatttgaatccaaatccaaactccaattctctccaaatcagccttctctgtgaaagtctattctacctccctctggctcagtgggccgactcttcttccccggcccatctcctctcagcccgctcccctcctcatgtgcgttgcacgtgccctacctgagagaaagcgcctctctctctcccccgatctctctctctcgttttctctcgctctctctcgcccgcgctccgcgccgccactttgtcgttcaaacccgccaccgccttcgctctttcccgcgcgcgcgcgcgcgtggccgaccggccggtcgctgccgccgtccgccttgccgcgcctgcgccgcgcagccacccagccccgctcgccttttgccgacgtcgccactgtcatcgcctggttccgatgcccccatgccgcatccttccaaaaccaggagacagagctcgtgctcctctctctcgttctcatatcctccttcctcccaaaatagcaagggagcaaagctcgtttctctcctcttttcacctttttccttagccggcgtcacgcccgtgaccgcctctgccgccgcttggccgctagctccgagcacgaccgccagctgccgccttgaccgccccaaggtcggtttgaaccgacctcccgcgcgaaccgacctcgcctccactataaagccgagtccctcctctcaatccctcccgcttcagtctccaccgctgcagtgccatcgccgccttgctgccgccgtcctcgccttcctccgccatcgcgtgtgccgggaagccagcgtgcgcgcggagccaaagaggactctggtcgccctctctccctccccttccccggcccgagaccgaggtgatcccgcatgtgccgtcggacgctcttcccagcgatctcccgacgcggtagctcctgttctccctccccactcttcctcccccctag

SEQ ID NO: 83502 - DNA, 6340 bp, Oryza sativa
ctgtgtgtataccactatacttctctcactaacatgaacttgttcagcctcagcctctgcattgtcaccttccatgcctacttgctgcacttctgcattatcaccttccatgccaacttgctccatttctgcattatcactttccatgtcaacttgttctaccccattcccatctgattcatctcccatgtcctcttccatctccaactcatagtcacttccttcatcctcatatgatagatcaactaggattggtgcatctgcatacacctcagccacccctccatccacaatacaatcattcatgtattggcacatactgtcgtcatccaatagtgcccttaactcagaattaagatctttccctgggaacaacaaatgtagcattgttccttcaccaactttgtagtggtcatgcaaatggcctactattttaggcagagataccttatcttgatctaggtaagacattgcctcacttccaccaacatagtgcttctccctaccagacaccacaaaatctctattgaagtgaaacgtaacttgaagggtgtttaagacgtccatggaacctacatgcaagttggaaaaaaatcacttccccatcgttttaaaatacctaggttttagatcccaaataaaaagagaggcaatggatgatatagtatgaccaaatcgaggttaccaactgttgttctacataaacaatgctgactacaccaaatccgagggcacagtgcgcatctaccacaacatataatttggtggagaaccctaaatcaaaatggggagaccacgataaagaaagggtggactcaccagctcgtgctgctccagttgcggtcgccccaaaccaccaccgcgctgcattccaccgctgtcgacgcgccccctagcgccacccgagccgtcgccctcttcgtcgccaagctcacagtaaacatgtctagggtttcggtcaatgaaaaaatgagcgggatggctacacgcgtgggcatttaccagtccggatctcactcagctaacgataacctagtgtcagctacctatttcccaccatcctcagctaagtcagcaatgttgaccacagtcaagttgccatgtcatcaaatactgcccataatactgccataggagtcggtctgtaccggttttaatattgagggttagggtcgttctatccgggttttcttaacattacgaattagatttttttaccattaaggaagtcaaggacttcttagccgatcgagacaaaggttatggaaagcccaaatcgacaacgacatcccagcgtaataatgggcctccggcccggtccccctccccttctctctctcaaacaaaaacaaaaggggagaaaccctcaacacccgtccgtcccgtctcgttctgcgccgtctcgccggtctccatctccatcaccggagaacagcgatgtcggcgacctactgcttccgccgcatacttttgcctttcactcctcgcgcccagtcaatctccccatctcctcggcctcggcaatagtatcctcgcgagttcgcccgccggcgccaatctccatcccgcgagcagccgtgccggcgtcctgctgcttccgcccccggtgagcacccgtgccctacactcatcgtctttattccccatcttctgttgtagatctgggatattttttcgctttgtctcaatcctagtactaataacaggtttcccccaaaaagaaatatatttggtgcccctggcatccggtagatcggcatgccagcggccttggtggcgtgcagcggcaagcgccggcggcggacggccaccactcatgctgctcgggactcatcgtcgtgggcttctctggcggaggatctggtgagcctgataggctggcgggtgctggctggagatgtgcgagactacatctgcttccgcgccgcgtgccaccactggcgctcctgcaccgccagcccgtgcggccgcggcgttgtggacccacgcttccacccgcggcggtggatgatgctccctgaggggaacggtctctacccgggccacggcatgctgcgtggcttcgttcgcttcttcaacctctccaccggcgctttcgtccgtctcaagctgcccatcgtccgcgaccaccgcatccttgactccgtcgacggaatcctcctcctgcagcggaaccgtgacaccgcggtccgtcttctccaccccttcaccggcgacatcgtcgacttcccgccgctggacaccttgctgccgtacatgggccgccggtcggaggaatatctcagagatgtcgctgctgcctccataacatcatcagctgatgatcaagccgtcttgcttatgatatggttattccgcacggtgcgcgtagccttcgccgcctctggggataagcagtggagggtgtcgagctggtccatgtaccaagcctatactccattgccattccaaggcaagctatacatattggatcaagccacggcttatggtggacctgaggtcttgcagatagacccacccctgcaactgcaactggaagggacgacggagctctcgctaccaccaccaaaatcaattgctaaatgtccagcaaggacacctgactcattctttctctaccatttggtagaatgtgactctgacattctgttggtcacctttggtgttagtgtgtatgcacaaatttcagtttacagactagctgatcttatttcgggaacaactgtcccggtgacttgcatcggcagcaattcccttttccttggtaataggaatctctgtgtcagctccaaggcgtttcctaccattgtgggtgatgccattgtgttttaccatcagaaggagaattatcttgcacaataccacctcagaagcggcacattgtcacccacatcagatggatgtatctttgcgactaatatgccaagtcctagtagcatcattcaccatatctacacctgttgctttcgtacacaatggttagtgacatgttttttatttttttcccgtcattgttctctttaataatagttattcctttcaatggagcattttgtgctctgcttggtaattaagctcattgtttcccctctctacctgtaggaccaagggacatttattgtttcaaagggagaacagggcatggcagatgaaacggaagtagggatagacggggtaagtcttgcctccggtgcaatgattctgcttgaatgtatgcatttttggcttctactatgcacccaactctcaatacaactgattgatcaatttattaattattgagtctttttcctagtattaaagtgaaagcaagatggctgcagagctttgcattttaattagatattatgcaactatctgggcacacatttctcaattggggtttgcaaatcttcgtgagaccctacaagtgtatatatttattactaacattgattgcttatttttgttgagatacactgaaaaagtaattgtcttctgatgaattgtgtcgtgtaaacaacttgctttcttctaattgtatgacatgcaatcttttgcatgtttgcgagaaaaaatacgctgtgcattttagttacaattattattatgcataagatgaattagtaggttatgctatttagagtttttgttttttgaaaagaaacatattcggtgaggaaaataagatgtaggttaagatttgcatttgcactttacagcacaaatggacagttagctgcacccatctgcatacaggactgaaaatggtctcacagctgcttgtatggagctactaaaggagtttgaacaagtaatgctggccattgaggttatgcaacctacaaaacatatgaaagtagtagtaatgaccttgatgtaacacaatttgaactgtacaatgtgcctgtagagtgtccatgttctctcttgtcttcttaggtaactcgccaagcatcacaaccacaattagcacagttgaatttgattatggttgtcatttacaattgcaatgttatcactgttacaaatcatacttgactagtttatttcttctgttagcactgaacttaattagcagagagaaagcaaatgcatttctgtgaggatgtgcatatgtatttgcaagttattgcattgtttgggagttgaacacacattgctcacatgttgattttccagaagctttaaaaggatagtcttaatatgttcagtggagatgctagtttgccattttcatatttaggatctaagacattctctatctaaatgctttatcatgcatgtgtttcctactattttatttgattagattggttcagttagtatagtgatgactaacttgtcgcctgtttttctacttgggtcctgctaggcgtaaacaactcttgttttgtgttggtggtggtgcctgcctgcctggttttccttcagggatatatttgttgatctacaggggaagtagttcccgggggctgtgaaagttttgctttggtacttataatcatgttactatttatgtgacaaagatgcttccctctgttgttgaatcaggcaactgtttcatgttgaaacaactaaattaattattgtaattggcatggtattttccaatggagttatgtaaccctggcttgtaaagttcttgtgacaattgatcaaacttccatcatcatagtagaattctaatatatccttatgagctagtcaaacttagctatcatgagcataactaattagagttgtttgatgaaaatattgtaaaattctatctaattctgggggttcctttggatttttggcaagaggtattctagcctagcctagccatgctttgtgtttggaactggtgaaaaaaaaatcctagctttttggagcaagctatcctccacgggccagaaaaaccgggctcgtcgagaaattcgtgagaaatgacgagcattcgagcaaccgttcggcgtagctgaaacaagctagtttgctagctcgagctatagctcaacttggctatgctaccaaattaccaaaacgatcgtcatacactaagctaaaatcatgcgctttgcaagcaaaatgtacaatcaaaatattactccctctgtctctcgatatttgacgctgttgacttttttaaacacatttgaccgtttatcttattcaaaaatttttgtgaaatatataaaactatatgtatatgtatacctaagtatatttaacactgaatcaaataatatgaaaagaattaatacttacttaaattttttaataaaacgaacaatccaatatgttttgaaaagtcaacagcgtcaaatatttagagacggagcgaatactatctaaaataactttcccctcccgtctctctcggtgcctcctctgagaggtgactttcagtgcgacgtagagttttcccctccggattccctctccgtctccggtggtctttggccgccggcgaggggatgaggggtccgagggatagtcgggctcatcccgtagtcaggtaaattctgtagtaggtttttttttttccttttgctgtgcagttcgaagaggatggtggcatcttcctccttcgtcctggaggtgtctggccatggatggaattgctggagctcgctctggcatatatcgtccggttgaagacctctgggttaatcacctacgtcctactcctctgtgtgtgcaggtcggagttctccagatccccataggagaggatgcgccggctgttctagaattctccagctagaaaatacacaagaatgtgttcttctccttcggcatcgatgtcggatttacaaggggcggctgtgatttatttgtttggccaaggtagcttcaacctccatcacggaggtcccgactgggtttgctcctcggctcaatcatttgtagcttgccatgctatcatctccgtcgttgtgggcagtgggcacaagttggatcattgctcttgtgaaagaggcagatgaaggacccgattgccttttcttttcttttcaagtccttttctgcaatctgcatcttctaaagttaatttcctcatcttacagggtactttccgcaaactggatctactcccagttcctatgttccctcgtgtaccatgtacttaagctcactaaagagtataagtgcatgctgggacacgccgcgcacagaaattggctcgaacaaaattaccatgaagcacaagcacatgctaaatattgttgactgaatgtttctagtttcacttaaccatagccatgggacttgaaaattgcaattagaatcatctaagtcaatatacatggaaaaccatgatttcaaacatttataatactaaattatcatgtgttaacctttttagactcat

SEQ ID NO: 83503 - DNA, 14183 bp, Oryza sativa
caagggacgaaggccgaggagacaacatgggcgaaggccacatggcgaaagccgtggcatgaagtacacaagcttcgccggggatggacctcatcggagagccattcggccgaagactacgaggcgaaagccttgccacgaagggcatgggtttcgccaactaccaaacttcaccaagaaaaggcccagcgggccaacatgccttccggaggcttcgccaacaattgggccgagctacttggcccattaggagcccatgcaagcaaaagacactgtatgcccataataatgtccctatcataaaagcaaccatgtaaattcccctgtaaagcctaaaccctagaggaggaatctgtaatagggttataagtagcccatgtaacaggggatctgaaaaatttttactaagcaatacaattgtctctttttccaaccactgttgagagaaccacttgaagcagttgtcgaatcgaaaccactgagagtgaacgaaaccactgatgccattgaagaagatcgttaaggagagagttgccaagcgaaaggagggtagcagcgagggggagatggctggggaagaaggagcagagcctttggcttccaaggccgaagcaagagccacgccacctccggcggtgtcgccatctctcccaccttcggcaccgactacttcgacagaccaggaggcggcgaaggcagcggccgcggcgaaagcgctccagatcagggacgtaatcctttcgtctcaaataccgggggcgtctcaagctgccgcctcgtcgcaacaagctacaacttcgacaacactcaccaactcgcaagccaacgctagccttgaagctcaagccgaagctgacatgggcgctatgcgtcagaacatggccaagttgcaagatacgcttcgccagatgcaagagcagcagcaagcgtacgaagcggcaaggcaagccaaggcctacgcctagcagtttttgacagtcttaacccagccccaagcttttcctccgcatgctgcacaagtcgtacaagctcgctgccgccttcatcctccacacctgccgccgtgctcaccggtgaggatcccttcctctttttctcctctccctcctagcaccgagccgcgccgccgccttccgcaacgccgattgccgtcgccggtgaccgcgtgccgccgccgcactaccatagccgtccggccggcttgaagctgagccgagcccggcagccgccgcccgcgccgtccgatcggctcccggccaatctggaccatcggtctcgaggaccggctgtgggccacccgcacggtcccggtccacggtggatcggcccatttgagccgctgccaggtggggcccacttgccggcgccgcccccctgtgctgacatcatcacctgggtttattgcgcaataaaacctcttaaggcttttctttttatagtaaaaacacagataatcttctaaaaatcataactacttcatccgagctccgtttaagtccattcaagtctaagtaaattcataaaaatccctagaatccattaaaaatggttttgtttcctgtttcaatagacttatagcatgttttgcttgtgtgctttgtttgtcgcgtagttttcagccatttcgtcgctccgtggtgcgtcaaagtctttgcaaatgtctcatcagtgcgagagcaaggcaagtcatgcttgttaattgatcatattgctcccatattgtaaatgctctacttttccataaatactgcatggttttataatgtcatggtatgggctatttacctactgttctcagccttattatttgtatgtcctattcctttgctaacctgggatttaacatgattagatgttggattaggaatttcttagccatgtttagttcaactagtacacaaagggggattcacattaatacatagatattggcttttagcataaaccatggttgttcgactggctcaaactctgcgacggacgcgggtgtccattcggccacaaaatcagcgaggacttgggacttaattgcagtgcgagcgacaaagtgtaggtcgaaaggtgatagctcagcggcccatttgcttaggcgccccgtgatttcttttcctcgaagcacttcgcccaaagggtactgcgaaggtactacgattatgtggacttggaagtagtgtttaagcattcttgaagccatcactagggcgtaagcaagtttttccatttcaatgtatctaactttcgcccctggagcgcttcggagatgaaatatactggcttctggcctgcttcggtttcttgtaccaaagctgcgctgacagcgacaggcgaagctgctagatagagccacaactctctctctctggcactgggctgaccaaagctggagggctttggagatactgcttaagctcatcgaaggctgcttggcactcgagcgtccaactgaactttcctacccctcgaagggtcttgaagaatggcaagcccctttcggacgcctttgataggaatcaactaagtgccgcaatttgccccgcgagcttttgtacttgtcgtacgctcgatggtggcttcatttgctgaatggcatcgattttttcggggttcgcttcgatcccccgttcggacacaaggaatcccaataacttaccagcacgaacgccgaacacacacttctctggatttagcttcatgccggatgcacggagattgtcgaaagtctcttgcaagtctgacgcatggtcgaaggccttgcgactttttacgacaatgtcatcaacgtaggcttcgatatttcgccccaattgtgaccccaagactttgtacaccagcctggcaaacgtagcccccgcgtttctcaggccgaagggcattctgagatggcagaaggtgctgaagggcgtgataaaggctgtcttggggatatttgccgggttcatgtgaatttggtgatatccagagtatgcatccaagaagctcatgagctcacatccggcagtcgaatcaactagctgatcgatccgaggcaaggggaaatcatccttcgggcacatcttgttgaggtccatgaaatcaacacacattcgccacttgccgtttgacttttttaccaatactggatttgctaacgactctgggtggtcaatctcttgtattactcctgcttttagcagcttgttcacttccgctttcgctgcctcctggcaatctaccgatattttccttagcttctgctttttcggctttgcgttaggcttgactgcgagatggtgcatgatgagatctggcaaaacacctcccacctcgtctggaccccaggcgaagatatcaatgtttttcttgaggacaaccaggatgctattcacttgttgctcatccaggtctccgccgagcgatatgactttcgctggatcggattcatctatctgcaattggacaactttgctgtggggggcgggtttcggtgttggttttgcgttttcttgcccttcgacttctaaggtatgaacttccctgttgaaaggagccaccgtggcagccgaaggctgggactccttgacaactatcacaccagctgggccaggcatcttgagcttgaggtagttgtgatgagagactgcttcaaactttgtcaaagtgccccggccgaagatggcgttgtaattgtatgggatgtcaacaacgttgaagagtatctcttcttctcttctgttatctttcgtgccgaaggcgactttgatgagggcctgccccagtacttgcactgcttcacctccgaacccccggagcgaagttggtgcttgggataacgccaaagttggcaaacccatcttggtatatgtcccgacgaatatgacatcagtcgaacttcccccatcgatcaagatgtgccggacttcaaaaccagccatctctgccgaaactaccaacgggtcttggtgtgggaaaagaaccccatcggcatcctttagcccgaaggatattggctgcgacaagtatcttgggaccccatcaccttctgagacaatgttgtgcactactcgaagttgcatcttcttctgtcgttttgacacttgtgaggggggatcggatcttgtgatgacctgaatcactcttcgctgcgcgtcttggtgttattctgcttgaggtgcttggttgaggaccgcttcacgcggtgcctcttcggcccttgcttgctgctgcctcggcgcttgagcgttcccttgctgccgaatatttcgacattgctcggtcgtgtgtgaagagcgtccatgaaaagcgcagtacaggtccttgattttcttgcgaaaaggttgttgttgtccgcccgcttgttgggcgtcgaactccttgcggagggcctgcacttcttcaaccgccatcactgccttgctagttcgctcagtcctgaatttcttccatgtcattggggcttggttcggccttggatgctgtccttggttcgccggagcggtagggtgaaccaagacgggcgctgaacttacaacttgggcttggacctgagcttgggcgttggcctgtgcagtggccgctgcggctgaagctgccttgtcatattcggcttgtatctcttgtcttcgcttggtgtcctcttcacctcgagcatatcaatcaattatgcgaaagaggtgttcgatcgtcctcagctccttgcgttcaagctttcttgtgagttcgccctcgagtaagctggctgaagcagcattgatgacggaagcttcggttatgtcttgcacttggcaccgtgcttgcaagaagcgacgtatgttttcccttgttgattatcctggcctttggcaaatgccgagaaggtcatgctgaattttcggctcctcataggtgcctcgaaagttaaggacaaagacatcgcgcaattgctcccatgagtaaatgctgctagtaggcaaattaaagtaccaagacctggcaatgccatcgagcgcgaggtgaattaccttcgccttcgtattttcgtcaccatgggtagcttcgattgcggatttgtagatggaaaggaactccttcgagtccgtttctcccgaataccttaataggaggaacttgagctggggggatggggtgattcttgatccccgaactgagggtcaaacccttttcgccacccgtcttgaccatggtcccttgctgagagggccaattcaactgtgggtatcagggcgcgaacggcaaagccacagcttgtacatgaggttggactgcgggtgtcgattgatgccccgtgccgaacatcattgcctggttttgctggtctgacgaagtagcttgcattgccactgcagggtcgaacatggcttgattccaggcttgatttggtggtggggctgctccgtacccagggggtacggcttgtgcgaaagtcatgggtgcttgggccgctgtgcttgggtcaaactatggcggttggcctttaggcgaagccccttgagcttgacttggtatggcgaactagcccaacagctgtcccaccggtgcaccctgatttgggcttccctcggcctaggccggaggcgaagttcttggtaaattgttgtggggttgattgagttgttgcaagaaggcttgaaactgtgcttgtaaggtcgaagttgcttccatcattgcttgtggcgtgtgaacaggcttcgcgtactaggcttgaggtgccgtcaggcgaacaggtgccgaggccacttgcggtgtcggacgcgcggcaacggctggggcgggcttggcgaagtacaccggtgcttgcacagcgtgtggaagaagaacttggggctgagcgtagaagtgcagggtgtgggccttggcttgtcttgctgcttcgtacgcttgttgctgctcttgcatctggcgaagcgtgtcttgaagtttagccatattctgacgcatggcccccatgtcagcttcggcttgtgctttgaggttggcgttgccttgtgaggtggtgattgctgtcgatgtcgtggccggttgggcgaaggcggcggtcgaaggcgcccccggtgcttgggatgacaagatcgcgtcgggcgccgaaggcgggagagcagacggcaacaccagtggcagtgccgctctagcttcgccctcaagaagccgaaggctccgctccctcttcggctaccatctcgccttcgctgccaccttcctttcgcttagcaactctctccttggcgatcttcttcggtggcatcagtggtttcgctcggagctccccacggtcggcgccagctgttgtcgaatggacaactgcgtcacgtcgaaaggcgtggatttctcaacaatagttggaagttaaaacaattgtattgcttagtaaaaatttttggatccccctattacatggccttagggagctatttatagccctattacaggttcccctttagggtttaggttttacagaggaatttacatggctacccttatgatagggatattattgggggcacacggtgtccttgtatgggccactattgggctaaatggctcggcctatttatttggcgaagtcctccgaaagcacaacggcccgctaggcctccttacggtggggttcggtacttggcgaagcccgtgccttcgtgccaaggctttcgcctcaccgtcttcgcccgtgcggccttctgacgaggcctttgcctggcgaagtccgcgtattccgagccacggctttcgccatgtggctttcgcccatatggttcttttctcgacctttgccgcttgcctccggtctgagcctttcacctatgttcttggtttcggtaggtccggccgaaggcccttcgtggtgtacctccaacaccatgcatcatgtccacggtaacaggtaatccctgggtcaaaagagatggtcattttcgggatcaatgtggtacagcctttcctaacagttggcataatctcaggtcatctactttcataatttcattgtcttctgctacatctcctgaataaaaatggggtcatatgcttaactccataaacatcacagaggatagagaaaaacttaaacaaaaggttggtctcaagctagacagatgcacatattgtcatgaaattggggtcacggggacgtaagtttcttgcctacagctagctatatttgtttttatggctgctcttctgatttcattagatatttagatgcatgtaaaattttgctcttatttcaaatagtatatttatttaatttcaagaaatggaatatactaaacagcaccatttcccatagactgatgcacaagaaaacaatcaatcctggtcgcttcttgaggattcttaatttttatttgtttccaacagggaattgttaagtaaaaaatagcaattttattgtgaagaacagaagaatggtgtcttatgaactagattagagccaactggaagttagtagaaaaccatcatattcgttctttttcatgatatgaagtacactaattttgtctggtttactgtcatttacaaatttcttaaacattacacagaaataaaacaacaatgtcttaactcacatgggatggacatggactccataaaatttattagaatttgaaatacaaagcattattaatccctaaatgatatatatatggaataacaaaatccatggatcccagtaatggtagcaaccagctgagttgctctgctactaactgtaggattgagaactcacattctaactgtgcctaattcaatgcttgcaattagtcatcagctcggttaatatttgtctagcagttgttctattgaactgtacagaataaccaaaaaattaatatattcatttcttactatgccacataaaataagctataacttcattaaagtcaaaacagttctattaaagtcaagttctcttgaagctccacttttcttatataaaagtaaagtggacctaaaaactttcaaatatgcatgaacacaatagcgttaatagggtgtaatgaattttctagaaatagcaacaccaattagacaaattagtgaaatctaatatcctcaatgattgcaggtacaacatcatcatagattcaccacttaccgtcaacccaactaggatgctaagaggggctccgtaagtacttggtatagttaataccaaaaatctaaaaatattctcataaatcgaatttatcctttttcatccctcatatagagtgcttgagtttaaagaggaaagctattcaacaattggggttatgcccccgttatggtggtgcagactcagtaatatggggccagtttggtttgagatctaaattaggcttgccaattttttggcaatctcaacaataattgtgtatgtttggattgaagccaaattttggcatgcctatataacataggccatttcaatagccaaattagtttaatttggcttcaatccaaacacatgttggccttcccaaaaattagcatgccaaaacttgccaaaatttggcatggtaaggccaacattggtcacaaaccaaactggcccatggttttatgtagaaccattctgcacattccatcttgtcaattgcttcgaggaaggtgatctcggttagacacaggtccactgcaattttgaactacagtaaatatgtgttcaaaggaaggagcatctatctaccataccctatagttcaacaaataattaccctcattctttcattcatcactcaagggttcagatcatccgtgtaaaatccaacgcatcagatcatctccacctccccacctctgcattccccagccccacgcacatcgatctccccctcatcccgcaatccgcacgccctctcaccttcctccctccctcccctaaccgcgtcgccgccctgatcgccgcacccgcgatctccgcacaaatcccgcaaggccgccaccccttccaggccgctctagaccggcgtcgtcgcccgcatcgccccctccgctccgatccccatatcgcgagttgcaagcagagcatgggaggggaggggaggggcgccgtcgtcccactgcagaccggcccgttcctcgcgctctcctctcttggccccctccgcggccaggaagacgtcgccaccaccccctctatccgcgacgacgccacaacctccgtccgcgccgaccccacgctgcccatgccgccggtccttcgtccacgcaccgccgccgccgatcctcctttcgcgcgccgctatcgctgcctccaccgccgtccgcgtcgaccccacgctacccatgccggcggcctgctgccccacatcgtgttaacaccgggatcaggattctggccatcgtctccacgcagatataggagttgtgaatttcccccttttatctttcttggtttttctgctctcagttctaataggcctacagattgtctgaatccatttgaacaaggttctgcacaaatcttctgatagaattctgattttcacaaaattaaccgtggtggtattttacgcatgtggcaatttaattaccaaaataataactatttctatcactcttaatgtttaggtaacctgcccaagtgaattgtattaactaattgatgtttttttggggggtctctgttgctgttcctggatgattctcttctgtttcatggtctgcagtgcatggacagtgtttacaaggtagccctatactcctatattcatcacaacatagtaggtaggtgcgtatccatttgctttaattcacatagaaaactccctacaattgaaattcacgaataaggtgcatattttgttctcagccgcatcaccgtctgtttccgccatggcagcgtgactccgcgcgacggctggaggaggcgaggtcgggcctgccctccatagacggcagactccgcgtgacggctggaggaggcgaggtcgggcctgccctccatcgacactccacgccgccgcagcccgcagccccatcagcgccgtcgctccatcgccgtcccgacctcgaaggcgaaccggtttcgagtccctcgcgctgccactgatcccagggctcctcaaccctgcaagccgtcgatcctgcctgcgaacaaggtaagagtgcttctcgatcccgttcctgtacaataggaggcatacgtggcatgttatggttcattcatagagatgcataatggctttatcccctttgttgaccaaatccccattgttcattattaaacattgttcactgtgcatggatatctgtgatgcaaaactctaatccaaaatctgaagtccttagtggtttactgtacctgacaagcaaacatctcaaacatgtttgtaaaaacctctcgaaagtagagtagcacgttcctcgaccctgttcattgaggtaagtattgtttaatgatgctaatgtatggtactgttaagctgatatttgatgctactgaaatatgtaacatatggacatgaatgttcacttcttttttatgtaaaatgtatattacctcattaatatgagtgctttcaaacctgacaccatcataattggaatatttgattatgagaaaacccttataatttatctctactgttcttgagagttagaaaaatctttcaatacattttagtagttttagatgctaaaattccagaagttgaaggcttatccatgcagttttagatttttggttggatggaatttggattcattgaacattcttaaactatggctcttttaccatcaaaactttacattttccatatcatcttcgactgcttgtagacaaacaactacagaagaatatctcatgctttttatgaaaccggctaatgtgacagtatcgaggggggtcttggccggatcagttgctcatggccggtaggagtgaggagtacacaggcttccacactacgaggtaatctgcgtgcatgattcatgtgcctgttggtttctctatctaaatgatagttcattttggtatacctccatcattccaggaaacttcaatgctcgagttgtcgagctaggttggggatatttgattctttaatctatatagggtttggtagcgtgcactcagcccttaggacttaacatgacagtaagtgagaaaaagggaaaacagtgagtttttgcatcaggctggctcaactaaatgatttttatgtccctttggtaatgaaaagagatttttctgttgtataccatctcatatgctcttaagatacattttgatttacataacaattatgtttctatgtgaaagaaactaaatatatatttggtcattttggtaactgttcgtttaacttgcatggcatgttgactaaacgagaattggcaactggaggggacagttgcagttcagtgcctgacttggctggctgtaggtacaagtattcatagtcaactaataaacggaatacatctcctcgtgctaattgcaggtccttttcatgacagaacttactcaagaacgaaatgaaatctgcatatagtcagtagcaactaaatttacattttctgtatgtaaatttacatttagtgtaggatttatgggcaatggctgagttcgacaatacgagggacttataataggtgtctccccaagctgaaaactgagcagatttttgtagtgcttctgtaattaaaaatgccaactgacctattgattttttttaaaaaaaaaaactttcctattgattaattagtggagatattaccttactaacattctctttacctttattatttttgacataatcaatgagaagatatgtcttgacataatcaaaaggggttgagatttcatgagcaaacaattagataatattttctcagcccaggtttagtcctattcccatgcttcactgcttgctccactcctttttgtgacttggcaggtaccatctcatgaggttcgtggtggttttcgattctatttatgtacaggtgatcactttatgaacaataatcatcttgattttcctccatcaatgttcatgttacttgctgttggtattgctaactagacttcgtttaagagaaatttcttctgttgtttagctacctttggtagggttatttcacttctgaaatttattcatttatttaccccatatttgctatttagacaaaatagcatgatctctcttttgtgtcacaaggtaatatcccagccatcaaggggtctttgatctgttagtaatccaggtcatggcctatattacatggccacagatcctatgaggtgggctgtattacattgccagacatcctatattacattgccactggtaggggtgaaaacggtacggaaacggacggaaacaacctttatcgttttcgtttccatatttttttcggaatcggaatcggaatcggaaaccccggaaacgaaaacggaaacgaatattatcgaaatcgaaaacagagcgaaaacgaaccggtgcggatacggtaacgaaaatttatcggaatacagaaacccctcaaactgagcttcaaacttttgtgaagttcaattctcaagttttaacagtcaacaattcattataaaacacaattatatgaagtctaattggtaagtctcaacagcaaaatatattcttctataacttcatataatttgtataacaaatattctaaaaaaattacagcaaaataccatggtataaggtataaagtatacactattagcccgcagcccgcagcctctctctccctccacgggccggcttccccttcccctcctccctcttcgggccgccggcccagcccttttgctcctccctcgccgagaagtctataatgcctccttcctctcaattcaaatattttttagggtagtaaatgatttcaaatgaaaaaaaagtcaataacaaagttgtataacttatcaagatcaacaacttttgttttggtcattttgctatatgactttgtttcaataatttgaatttgaatttcaaattatgacaacttcaaacaacatttttaaatactaaatgatttcaaatgaaaaagtcatcaacaacaaagttgtataactcatcaatatctacaacttttgttttgatcattttgctatatgactttgtttctataatttgaatttgaatttcaaattataacaacttcagacaatattttcaagtactaaatgatttcaactgaaaaagtcatcaacaataaagttgtataactcatcaatatctataacttttattttggtcatttcttcatccgataaagtgatagtaatatcattcacaaaatttacatatatctccaatagtctataaactatataagagatatgtatattttgtgaacgatcttataaatcactttatcggatgaagaaatgacccaaataaaagttatagatcttgatgagttataccactttgttattgatgactttttcagttgaaatcatttaatacttaaaaatgttattcgaagttatcataatttgaaattcaaattcaaactgttcaaacaaagtcatatagaaaaataaccaatactaaagttgtagatcttgatgagttatacaactttgttgttgacaactttcccatttgaaatcatttactacccgaaaaattatttgaatttcttatattttaaaattcaaactttatatagtccaatcaaactcggatggagaaatgaccaaaagaaaattggtagatcttaacgagttctacaactttatttttgataactttttcacacaagttcatttaatatcataaaattcgattcaaagttttaatattttaaaattaattgtttttccctcctcctcgcttcaaattttttcatctcctcttctctctccctatccagatatttttacctccactctctctctttctatcctctcccctcactctctttctttccttaactctctttctctcctctccactcctcctagggcggcggtggcggtggcgggagctggcggcggcggcggcggcactgctcggccgccttgggctccggcctggagctggcggtggcgggggcggcgacctcggtcgaagagtgggcggcaacctcgggcggcggcaccaccgccatctcctcctcaccgtcgccgccgacgacgacgaggagccgacgggccagatccggcggcgacggttctcgtcccgcccggatccggcggcggcggacctcgtcccgcccgaatccgacggcggccttgggtgaagagt

SEQ ID NO: 83504 - DNA, 2244 bp, Oryza sativa
gccgacgacgacgaggaggcgggggcaggtggcggcgagcttgggcgacggctagggtttctttttttgaattctttttggaattttatttttttccgtgatttagtgggtagccggcatcgacggtgtggccagtggccggcgtcgtccgcgtcggcggcgtcgtctgtggtggtggcggcggcgaaaatggtgggggcgaggacggagcgagagagccgactagccgaggacggcggccaggcggccagcggtggcgctctcgacccctggatgcgccgctccgccgccgcctctctcgatctctgatgcgccgcctctctcgatctctctctctctctctcctctctagggttagccagttagggacttgggttgggctgggaacttggggaggaattatggactatttggatgggcctttttaacttcggaaattccgacaaactttccggaatttttccgaccgattccgagttccgacggaaactggtattatcatattcgattccgtttccgaaaaaatatttccgttttcgattccgtttccgcgaaattccgaaaaaattccgaccggctgattccgtttccgaaaacaggtccggaatccggaaaaattccgaaccgttttcacccctagccactggcaatgcagcttaacgagatatgggaattaatctgggaatttcactgtaatttacgcatctctgcatgtggatttactgttatgaaagatgcttgtgattttctatactgattcgtttagttgtttctcatatacaatggatagagtgattggggagctaaagctgtgtcaccttctctccagttgtatcgagagataaattagtgagataggtactgtcattaagaattttgctattttgatgtcatgaccacttataaagagcatgccctgtacttgccatttcttttgtttatggtacatttttcagtgtcatttaacattcaagtacttccaaattgattccttcctagcttctgaacatacaagactcagagctcatatttccaatttgtttgtataatcaatattttttagcatcatggatgcatatttagtgttttctgcacttgaatctgtaaataaactatatggtgtcagatattactatggtgtttaatatagagcacatgttaataagcaattgtgaggtgggcttatctatgcatattttattaagaatccgttacatggttgccggtgtgctgtatagttcatttattttgatccatatttgtacctaaatggtgcatctggaagtatttgtaaatatgagttggattactaatcttatatgttgtcgattaggtaagtatggataaaaatcagtttggtggtggaccgagaattgtatttggagatataaccaataaccaaacggtgtagtgaaatggaaagatatcatatatattagtgcttaccccttagtacatatataagtgatatatgaatcgttcttctctgtttcattttgcaaaaaaaaccacaggtaaaattaatgatgaagattgacagttgaggaatagaaaacaacatgaataccgtgcaaggaaacaaatttacgtgaaatatatttgatgtacggcattaattgatttaaagctcacatgcacatcacagaccatataaaaatatttttttgctaacaagaaattctaaaaattattaaaaacaaatataattgcaccatagcgtttagcacgggcatattactagtaagcaatagttgagtaactcagatagtcagatagagatcaaatagctaaagcagcagctcgatgactacctgtttctcttgtgcctagcaaaatgcccgtgtgctgttacggaattaaaaatatcacatcggcacattgcaaagaagaaatctattttgaattttagaacttaattttagaattagtgagagatttttcatctttttatattttagccgtaaaaaatttcaagcggactcaattgacttgtaccttggactttatacaagtagtggacagtggtcccacatcagaaatttagggaatttggtgatggggaccacaactatcttttaaaggaatatagatttatcttttaaaggaatatagatttatattttagccgtaaaaattttcaagcggactcaattgttttgtacattagactctatacaactatttgaagagggggtggacagtggtcccacgtatcagagatttggagagtttggtggtggggtg

SEQ ID NO: 83505 - DNA, 742 bp, Oryza sativa
  unsure (1)..(742): unsure at all n locations
atgcgggttagacnactcattgataacccncgnnnnnnnnnnnnnnnnnnnnnnnnnnnnnnnnnnnnnnntgtaacgttggtttccatttattagagcatgtgttaaggggacatattcgtgggagtgtgagtgtggcgttggtgtgtgtgcacgcgtttcgtgtaattaaaaaattaaatcaaatatagaaatgaacggaaaaaaaaatccaaaaatgaagtttgaaaatcttaaattgactacggcgccggatctgctacaccccaaaatcctgtggtgcacatgaacccaagagagtctcgaaccggcgaaaagtcaaaaattctctcgcggaatcggatagaaaccggaggggcggcgcggcgtctacgcgtggcgcgagggggatattcgggtggcgacgatgaggtagacgacgcgcgtgggggcggaggcggcggcgtcagcacgcggcgtggtcggctggagattacgatggctaaacatggtttttattaggggagattattattattattatcagtggaagccaaggaaatgatcccatcaatcgactcgtacacccaatcacagtccgagatttatatcgttagctgaccaagaacgggtagtcaagttgcgttgatttttttctgttatttaggtgcagctctttttattattattattttagattttcatttcaagcttgccaaccttgtaaaaagtaattattgggtatatatttctggataaaata

SEQ ID NO: 83506 - DNA, 759 bp, Oryza sativa
  unsure (1)..(759): unsure at all n locations
aagtcgttagatactgggttgcaaccnnccccnnnnnnnnnnnnnnnnnnnnnnntgagtgaaatttctgatggacgaccctgacctccttctcattgttggtgggtcatcatgtaatgcaccaagaggtatgggaggctcgtcaccttcaacttggggtctgcgagattgctcatctgtttgcttcattgtcaactcatccaacttgtcccacaactcattaaatttcttctcttggctctgtgcacatagcctcttaaagagctccataagatgcttgttcttgaatccgggcgccgagttcaacgagggcgtctacttcctggatgacgggagactctacgatgaggcgttccaaatcttgaatccctttgcccagttcccctgcagcgacaacggcaagtggctgccgccggcggtggcggcggcggcggaggcggttaccggccgcgtggacaagctcttgccggagcaaggcccgtcgtactacacgccgccggtttggattctgccgtgagactgccatgttcttagttagattgtctgatgacttgttgtcgtgttgatatggtttgttgatttgtgcaatccatgatgtgttctcgagatccatgtgtgcttgcaattgctttgatccatcatagcatctcttcagtactctgctattttcaccatgttagactaatgcaagaaattgttggttctcatgactcagattgccttaattagtgaatcaatatattgcaaccaaacactgat

SEQ ID NO: 83507 - DNA, 15850 bp, Oryza sativa
ctttgcttgaccttattgagattagatatatatttgccaataattaactaatcgcatgattgagtttgtcctacatggctcattgaagagtcgttcacactggaacagagcttagcgtgctggttatagatagagatccaacaaaataaagttgttaagttctcaaaataaaaaggctgaaaagaggcatatctttcgtgctctcttttcctatagacattgggttgtccccaaggaagcaaatggttggtgcagattcaatgcaaatataggaacaagacggaaattctgttcaaacagctcttggctcatttttatgggttttttcgctttgaactaacattgagttaaattgaccttagttaagccgcaaaacaggtctaatttattagtttgaatgtcatgttagcatttgaccaaaaatacctctaaaatccagtgaattcaggaccgtaggactgctttgagattcgtgcaacaacatccaatcctaatacatcttttcctctccccccagtcccgattcccgtcgccgccatagcttcgcttcctcgcgcacgcagccgaaagacgtcaacgatacccctcgaccttgatagctagctgaaaaacatcaacagctccagcgcggctccccttctccccttctcccctctcctcctcctaaagctgccctcacccccatcctcctcaagccagtggcggcaaagtgccccccatcccaccgtctttctcatctttgacaactctccccaccgtcagatccatcatcaccagtcaccgcctcctaaccacaagctcactttgccccgccaccatgctggcccaccgcacaccttcatccccacggtcccagcacctcaccacccacagtgcgtgtccaccaccgattgccttccgcggctatccctttctatcccttgatctgggaccctaaactctaacttcactgtttttcgtcggcccaccgccggtcaccgaaccttcatctgagttagacgaggaattaggtgcacaaatattcaagcagatagggtgtttcaaaatatataagaaattctcttcattttctgtcgaatgttatttaacagttgtctggaaccaagaataaagccaagcagtactactagtactagtgtacttcgatgacattggcagctaaccgtgtcaccggtagtttgattctttaagataatgaaaaatcacagcctttgcttccacagttacagcttattattaattaatactacaatgctcacagcataaaaaactgaaagtgccaaagtattaagatgacaagataacataccaaaacactgaggtaaaaatttgtatgaacgtcgagatccgtcatgcaagctggatattgtccatatatatattcttaatgcttagagatattatagcaatataagatgggacccatagtcctatattcttttatgtatagcacaatatataatgtatatggttttcttttgatcttaagttagggctcactaagaaaagggaactctatttagcaggattaaaagagcaatatgttgcaaaggcttaaatttttttttatggtctagctttaagtttaaggttcgtcatagcaatattctctcatttgcttctctcccaatgtataaaggtagaaaaaatattactttattgcttgaggtactttttatgcaactagaaaggtagcccgcgcattcgcgcgggcatgtttttatttcgtttcgaaaacagatctatcaaaataagtttaaattaaagtgaggtattttgcttcttaactgaatgttcattgtattttttctttaaaagtcttgagaaactttcattgctcataaatatataatttttaccatcctactatctcctttttagttgatcaaatatacatatcttagatagtgcttcttatacataggaccctacaatatttttaagaaaaatacctagtccatatgagtcttaaaataaaaattagtaggaaatttataatcatatcgttatacgaaatgctattgattttgtattgacaccttagaggcatttacatgcaagtcgtggaatttagtgtattcatttaattattattgacctttgtctcttgatgtgtcaaagggaaatatgacttgtatgactaaaatagttcactgtgtaaaagcttcaacactatcttgtgggttaagtgctccactaaaatagttctgtgtaaaaacattacaaaagttatttctacaggtagcccatgagtccgaggcaaaaggcttatcacataggaggctgcacatttgaggaacatgtaaaaagtcttctcgtggaaatcatttgtttaggagtgtgctgaacataattgtatattcaattaaaaaagttggaaaagtggcttaaagttgtcatttcacattgattggttatgaaaataatggtatatacaaatctttgtgcccatatcattgtttcgcaacaatcaatagaacttgatagttacttttggtattccttttggtatgtagcaaattggctaaatattttacaacttattgtatcgtttacaaagatgcacctgctttatttctctgtatactggattgtctcattgtttattaatggatgccttgggcgcatgcgacactatatatatttggaaaaagtacgaagcttgcgcccgccccctgcaccgccctgcctcgccaccgctgccgcctcgcctcactactgcctctgccgtcgcctatgttggagagaagagagagagtgtgtgtgtgtgtgatagattgggaaagagatagaatagagactgacaggtggggtctatctatttttttataaaagaattgctgactggactgccacgtagaccaaaaccaccgtggattgggtcgaggggggtatttcgtcctgtttgcataattgggggtgaagaatgtccggttttcggattcaagggggtaatttcggtcgaccgcgatagttcggggggaggggggtaattcgtactttttcctatatatttcaaataaaaagccttctcgagtctaaattgatttcgcagtgtgggaaactccacgtagcttagcaggaacataatttcatagctaaaaatactccacatgtgtgattataatgtagtgtggtttgattgttgtcatgatttaaatattttttactctaaaatttatgattaaacattaggaatttacataatgcaaacgatcacttgtgtgattttattttagctaacatgcattgggcctttagttattatatttatattgcataatcctaaatacgaagcatacaatgcttatcctattttatctttcttgtttgaaagaattagccatttatacaaccatggtagtttaaatactaaataacttttaacttttaagtttctaaaataattggtacaaaaaggttttagctcggtcatctgtggtacacatatagtcccaagcaaatttgccccctcacgctgacagtgtcccgggtaatgtcgatggggataaaactgtgaccgattaggagtattaattttttcagttccagaaagaaaaatgaatctcagttttttagaccactgtctaatgttttcttccgtaagtgtacaaatgaagctatagccgatctcatatcctttacattagatcgatgtatatggtccacatcattatattattttatatagatctaatggttaaaattaattggtccatcgatttaaatatttttattttttcttagaatttgcaggattttttctaatttatcagagagccacgtgacgatttagtagcgtttgtagtatataatataagacacgtataattatattattttgacttatgggggagtaatttcttttggaacatttaggtttattctaatttaattattgtgaaattatgtttgatgataaaatctatatcattatttttttcataatattttagaactatttaaatggcacgtaaaagtcagaaattataaccataatgtgacattctttttgaaagtttaaatacaagcagtttagatgttatattttttttaatcatcaactgtgcttgtctattcttctgtctaactaatatattaaataaaaataggaataagaaataagagagggaacaaagaaggagagagagagaggaggcataccggctgtcaagtacgtacgtacctacaacttcacgtatagtcggataggaggattgcttttttttttaatagattgatctaatggctaaaattgctgggtccaccgaattaaataaaattttaatagattgatctaatggctaaaaatactgggtcctccgaattaaataaaaatcaatggtcagatgttttgcttttttcctagaatttttaagaatttctctaatttattagagtgacatgtggcagtttaagagtgtttgtagggtacacgtggcagcttaggagcgtttgtaggaagtttaatggacttctagtatataatagatattgtggatgtccttatacttttgcaactaagtttagattgaactatggtactttttgtacaaaatgtggatgaccttatatttttcccttatgtattaatagtggtgtatcaacattttgttcctcggggtcactggatcacagctaactaaattaattatatcatgctaactagtactccctctatcccaaaataaatgcggttttgcactatttatgtccaacgttcgatcgttcatcttatttgaatatttttatgattaatattttttattgttattaaatgataaaacatgaataacactttatgtgtgactattttttttaatcttttataaatttttcaaataagacggacaatcaaacgttggacacggatacccacggctgcacttattttgggacagaggtagtactccctccatctacttttaatagtcatatttcatcttggcacacagaccaatgataagtaattctacttatcatccatttaaatatactattagttattcctcgtaaacaagcgatttattaatatttacatttctcgatgcccatgtagccaatcttgtgtggaagaatggagagtcacgcattaaatccgagaaagtcattaagaagataggttgttggattgaaatatgcctatcaaaaataaatttttcagatttggaaatatgactatcaaaattagatgcagggattataagttaataattactccctccgtcccaaaatataaaaatctagtactggataggatatttcctagtacaacgaatctggtattaggaaatgtcccatcatattataggttcttatattttgggatggagggagtagataatttggttgtgttctagtatcaagttttcaacctctgtttttttttcacgtgtatgcttcccgaactgctaaatggtgtgtatatttttaaaaatccataagaaagttgctgtaaaaaaatcatattaatctattttttaaaaataacatacttatttaatcatatgttaataatcgatcccgttttccatacgcaggttctcaaactcttctaccgaaaaagccttagtacatattgtacacttcgataattcttgctcaccactatatgtatatatatgtgactgttagaaacttagaataattagtgacgccacacaggtagttgccgtagtggagcggatgtgaattgtattatccgtgcggatgaaaaaggaagcattgaagcaagatgatggccagcagaaccggttggtttatttgccacgtaggacgatctgtctgacaccacttgcaagtgtgtgtgacgtgcagccttccacaaacgtacagtgccagcagctagcaaacaagtaaccaaggaacactgagacccggctgttcacactagctggctcggtcactataaaacttactcctatatcgcacgtgcgagctagctatttgttgcttcttttttttttttgcttcgatcgacatggtagatcgaggtagcgctggattcaattttattatcgaaaaaaaactagcttcattctgagtacgcaccatatatatatatttcaaatacacctactcacacgcgcgcacatccatataagtatgtcataacacacgtctaaataagattaaagacctgatatcatgtactccctctatattaaaaaaaaactttattatgtcgagattcaaacctagaattagattttttttcggacggaagaagtagcacacaagcatgcacgcgctttaatggttgaacatactaccatatctcaaaatgtacaaatttattctactcactccatttctacatatgattatttctgagttgtttaaaaaaatataaacatttatatattgttttattttttttcctcttcagctatcttattggttaatttttaaatcgcttgcatttcactccaaccatttgatatgttggaatgcttagatttccatgtgatggatttagtattaaaaaatgtttatattttgtacaaaatttgaatactttaaatgtttagatttccatgtattggaattagtataaaaaatccttatattgtgtaaaaattggagtacctggatttaaactctgaaagaaaatacgagcagcctgtcgagcagatatcatacgtttaatcgatctgatgtctgaaaggaaaatacgagcaacgtcgtaactcgtacgtgtatagccgggcagatgctggtggacatgttccatatataaaagaaaagactccagctatcttaaaaagtactccctcgtaaaggaaatcgtttaggataatgtttaagtcaaaccttgaaaatataaattatgaataactcttaagttgttgagtttgaaaatgtaaaaattatgtgaatagatttgtcttgaaaaatactttcataaaagtatacatatatcacttttcaataaatttttttatagaaacaagaagtcaaagttgtgttttgtagaccatgtcgctgtccaaaacggcttcctttatgagtatggagggagtatgctaactactctcgttttggtttcatatcgttttggtttcatatttcaagacggtttgattttctttgtttcatcaagtacataaaaaaaaatctaataactgaataatttaattctgacagtaggtttgttttgcgttggaaatgttacaatgtttttctataaacttgattaatttttttagaaaacaacctaaaacggggaagagagtatgtcgttagttttctctatacttctgtaaaatcaaagtgtttttcattgttattctatgatgaacaattggcattgaagattattggttttgatatttgaagattattggcaaagtgattttggagatgattgattttcaggtgatgaacagggttactgtttttatcgggaccgggatgaacagggttactgttggaccggtcagaccggcggaacaacggcggtcagaccggcgacagcaacaggaggcggcgacaggttttggtgattagaccggtgatctataccggtcagaccgatagcttctagacagtcagaccggcgcttcaccttcggtcggaccatgatccgtcgaatttgagagtaacttttaatttcgcaaaaagtttaggttttgggtataccaaccattcacacctccctctggttaacttagttattgtgtttcgatccaacgagttcctctcctccacacatgtgagttacataaatccttttatgacaaacccatgtcaacaaccttcattgtaagaaatggctgttgagggagacatgagatatattctaaaaaaaatgaaagaaaaataaaaaaaagaaagaaaggaagggagacatcagacatgagatgcccaggtggattagggtcggccggcggccgtgatcgaccaacaacggcatgcatgcatgcaaggggtgacgtcatgacgagatacggagggtggggatccacggcgggccgcccccgttcacactatcgccatttactaatccgcatagggttggcggtgggcccaccctccccgccttagcgttcacacctgttcctttcccgcgcttcggattcgtagtttttttatataaaaaaaaagaatagaaatgttggagctgtgctgaactagtcgtcgtcttcgtcgggctagctagcgtatataagagtcgacgagggcgagcgaattcattccatcatccgcaccaacaccattagttatattacccacacatcgccacgcattgccggccatgtctgccgccgcctgcatctcctccttccctccaccgccaatggccgccgcggcggcgccggcgccggagaccaccatcgacgtcttcgtcgtcgccaaccacacgccggtgaccgccgccgccgacaaaaggtacagcatcgttcggtgtactgtgtctcgatcgagatctttaatttctcctcgtttgagtttgcttgaattcttggtggtttttgtgatcgatcctggccgcatgcagcagctgcgagggggacgtcgtcgccggcggcgggaggacggtgaggaggccgcgggcggtggcgcggacgctggagtgcgagcggcgggtggtcggcgaggggttcgcggtgaggaggggcatcgggaggaaggagctcgacagcctcgatcctttcatctccctcgacgagttcgagtgtacgtactgtaccaccacccatctaccttctcttctctcgctcatctcgcctccctctcttcccctctagtagtgtacacaagttgaaaacgtacgtctttgactgaatcccaaaaaataaatttgtcccttacaagatgaggatttttggattaattaaacggctggacggttttatagcattgagcacatactaatacatgttcttttaagtaagtgatgtcattaacttttttatgatgtttgatcatcttatttttttaaaaaaaatgattcagtatcatttattttgttgttatttgttttatcattaacggaattcaagaatgactttttttaatggctgtagtaaatttttgaataactgaataagacaaatatttaaatttcaatcaaaagttaacaacgtcatctattaaaaatgagatggagtatcaatgacgtacctacatgtaactacccgatgtccttagacaccaggtagcttgtctatttctagctattttatatcatattaatcatcatataactcaaaaattagactataagtaatttttattttgagttcaccaacggaggatattatgtaggcacacgaattaattagttggagtaaccagtgatcaagaaaaatggtttccaaacggatatatgttgagtatcgtgtaatgtcccttcaggtcaccaactagctctcatatgattattcaacagagtattcacaccttgttaacgttccctttctgtttctattttacagtttctccaccagccggcttccatgatcatccccacagaggtttgtgatttcttaatccccgttgatacagctgtgcatagttttatatttacacgctaatctcatgaacaattaatttagcttaagttttaataaagtatagttattatatgttattcctgaattctgatcttacaattttcttccattttgtatgtggcacctgttccttcaggattcgagaatgttacctacatgctcgaggtaactaattaacagtttgattcatttccatcaacaatattgtagtattggcgtatcagttgtaataggaaaaccaccaagaatatatttaatctgtcacacaattccatctcattctttctaaaagaatatttagtgacaaattaactgttgttcttaactaattttaatctgttgttttcagggaggcttcagttaccatgacttttcaggccacaagggcaccatcaacacaggagatgttcaggttaggtctccaactgtaccattaaacttagagttggactactcagagcaatatcctttataacttgtccctgttttcctttttccttattttcgttgaaattaacagcctaacaacaactatgaatagtgttatagtactgttcttcaagtaattacttctccatttcaaattacttgtcgttctaactttatctaaagccaaacatttatatcattgacatttactttctaaaagttcatataatttaacatcataagtttattttttagattcaccataaaaaagactttcataatatataattcacttgtagttataatagctagacgaatttttagaaatatatattaatggctaaagctgatacaggtgtttgaactatgacaaaagatataacgacaataataatttgaaagagtaatataatcgggtacagagatgtaggggtagtacttattaaagacattaattcctcgagaacgacttgtctgaaaactgagttaattgtatttactttctgaaaacttgaaatgactatgacatagtgtcagcgtgtgatcactagtggagtaggtactctaaacatgcaaaatgttgctatctactttttttaatagtgaagtacaactcgtggcatctattcatctggaatatacacaaccattgcatattgccgtcacgccgaagaaaaaggaacaaaaggttactatcgaacaaataagaaagaacactatgtttgattgttctaggggataaagctggagttctactccaagtagtttgagatttatacacctggaaattatttatggctctttgaaacgtaggaatcttacaggagaagtcctctaaaactcctccattccgaatgcgacctgaacttaaacttccactggataccttttgattgactataagactattttctgtgcattttgcagtgcatgagatgcaactttgcttgttacttttgataaccacaaaaggatttttgacaacaaacagtaggggtcatttttaaaataaattgatcaaacgaattcatgtgcagattaattggaaaggaaaagagggaatattggttatgttcttccctcttctttcgcaacttacctccattgttttccgtgcatgttttttaaaatgttaaatgtatgtcttttcaaaaaaaatattacagaaaaattgctttaaaaatcatattaatctatttttcaagtttttttagtttaataattaattaatctcgctctgatcacttgctttgttttccatgtaacttgcctcccgaactcagcccggtaaagagagctaacttggtgtatgcatggttgtcgttggcagtggatgacggcggggcgcggcgtggtgcacgcggagatgcccggcggccatggcgtccagaggggcatcaacctctggatcaacctctcctccaaggacaaaatgtactcttcttcctgtgcctctctcatcagccgcagcaatggcggctactacgtaacagttgctgaccactcgctgtgccgtgccgtgccgtggccatgatgcgtgcgtgcgtgcagggtggagccgaggtaccaggagctggcgagccacgacatccccgccgcggagcgcgacggcgtgtccgtcaaggtgatcgccggcgaggccctgggcgcgcgctcgccgctccagacgcgcaccccggcgctctgcctcgacgtcgccatgcggcccggcgcgcgcctgcgagcgcccgtcccgcccgggtggagcgcgtgctcgtacgtcatcgacggcgaggccgtcttcggggacgaggccgcggcggcgggcgcgcacacctgcgtcgtgttcggcggcggcggcgacggcgtggccgcgcgggcgacggagcgctccgcggcgaggttcctgctggtggcggcgcggccgcacggcgaggccgtggtgaaggacgggccgttcgtgatgaacacccgggaggaggtggagcaggccagggaagactaccggaaccgccgcaacggcttcgagatggccgccggctggagctccgaccacgttgccaccgccgccgcggcgcactgatggtcaccggcgacggcgaggccggtgaccatggtgtcatcagctcatccaggtcgcaggtgaacgctgcgtttgcgcgggaggataggaattttagggaatttcgttgcaaagttgatgtaagataaaatggaggattaggtgtgccgtgtgaaactcctgtaaaataaccttatgcgaatattgaatttcgttcaatttttgtgtttgaaacgatgttaaaacttactgatcaaatttatgggtggtcatcttgtgtgagaatcaaatttatgccattgaatcatcttgcagaatatctacttcagctgctacattgctaatctgaatttcattgtataaaatacaaatggagaacgaagtgttttttttttctttttgttgttctgggtggtcatcttgtttatgtttccatggaacgtcaaacatgcctttgtgccaaaatgccattttagaaaacagagctagtttgttctctccatggtatatcctttgtagtgtcttgttaaatgcagaacataatgtatatcagtttgatgaaaaactaggcgataaacctgccgattgtgaataggattaaacaaacaatttaaggtgcaacacagctgcatggtcaaactatttttcacctgtttcagtgatatcctctctacagctccccataaattttgatacaaaatttgaacttgaatattaaaatcagttaaagcagaaaaaaataacaggccaaaaatatttggattcgtcatacttgagaagttctggagatgggcaccaacatttcaagaaactggtggtaccagccgttacactggtttcctgaactctgcttctgaatttgtaagataaggtcataagggaatttcacgatcaactgaactttggaacaataacttactgtttacttccagtcgaatgtcagttcgtttcagttttttccacctgttacatctgttgtttcgttctttgattgcctgcctccagatttttctttttttttttgcaactaggaaggtagcccgtgcgatgcgcgggcatgtatattaattcgttaaaatcatgcttgacaagttaaattaatatgttttttcctttctttttaattgaatgttcatcgtctcgctcttttcttatgaaatattaagaatttattaattaatgaatatattttatgtgtatccagctatccttacctctaattcatatgcatgcaagtatattcttgcacaagatctatctatctatgatatgtggcacccatatgatatttttctaaaaatacctagtcaacaggagtaataaaatgtaaatttaatatgaaaaatataacttttaaatatgaaaggccatcaattatgtaatgctattagtggcttatatacacgcaagagtaaaaaacccatgacacattggaatttaggatagcacatatttatcattggcttttgtgtctttatatgtgtgaaagcaaatatgactcgtttgaaatatatataaaaaagtaaataaaaaaatattgttgggacataaaatgagatattttgtatagttaagggagtacactgattcaaactcggtgtaagtgatctatataattgtatgagtaaaagcactgcgatgaatataattgtttaaacgattaaaaaagttggataagagacttaaaattatttgtgccaatattcgatagttcgtatgtgaaataacattagcaatgcatgctagatattataactcattcattgtgtcctgctctgatactgttaattttctatttcttttctcaaagtattggattttttccattgctaaaataaaaagtttcgtgaggtccaatttaattgtgcgatgtggaatacaacccatatgccatttcataaagattgtgcgaggctccacgtagttcgatggaaatatgatttgatgtctaaacataaccgctcacgtgtcattgcttttacaatgtgaaatttttgttgatatcatagattgaatatttttctgtaaaattatattagagttataatttatttactacaaattgacattttttttaattttttagctagcttgtagtgggcataaattagtgcctatcatctttccacttctaaatttttgttacatagttaggctttttttttatgttcgtgccaatttattatatctgctacaatcatatatataattatacatttaactctcactaagtatagttaatgttatttttctaatctctatatttctagcacctcgatgatttgtctggtcgaaaactctctcttttgtttcttctttcataaagccataccaccttagttttgtcttatgatgttgaatctatatttgatctaaattttcaaagcacataatcttaactgtgtttatagcttttttggatgattaactaaagatgcaaactgtacaaagtaacatataagattacgttgtttagctacgaaataaatttattttgtactatgtttctgtcattatcattcatcatttctgcagcaacgtttccttatacagggttttatctaattaggttagttgtgacttatttttcttgattgtcatctcatgctatgttaagccatacttcctccatgcatgatacgatcaaatttccttgttctgttcatttaggtcacgtcaaactttgtttgtgcttattctttgatgtttcgtatcttaatttatatgcagtgaacatatacaaaaattaattttgatggactgcaacactgcattacgattaggctggaagattttatcatatgaatgatgcctctctctctctctcgttaacggaacatatgcgcggagtatgtgtggttgactcatggatagcgtcatcaagcgacagaacacgcgtgccatcttgaattttttaagtaggttaagattaagattagatctagtgattgaaaatatttgccctaccaatttaaagaaaaaaatcaatggtgagatgtttttcttttttttcttataatttctgtgtttttttcataatttattagagtatcatatggtggtttaggagcatttgtaggattgccacgtggtgacttaggagcgtttatcgaatctaaatttaatatttgtgtaatatggtgcttaaaaatttgctcttaaaacatttatattagaaatctaagctatttatatgtatatggattcatcaattaaagttgaatagttaagttagagaaagaaatgaaggaaagtgggagggatgaatgtacgtagtcaccgtgaggggaggaggtccaggagaaaagggcggtggagatgatttttgatgggttttgggatttttttaaaagatagatctgacggtgtaaaatattgggtccaccgtattaacttaaaattgatggctatatgtatttcttttttcttataatttcttcgatttctctgatttattgagtgctggttgttgtaaataatggacacatacaaggccagccacgtggcatattgatggtccataattggcacctataagtcggtataggtgtcgattattggtacaaaacaggcacctacacacattataggtgccgattctaccaccaacaccgatgactaaagtcatccgtgctattatctgggtatcggttagaaaaaccggcatgtaaaagggtttcttgttacctatggtgtagttgaatgtgctcccagtaaattattgatttaaccccagtccacctggtccatcttgtatgagcacagctactaattaaaatttttgtgattagctggctggtttgcaagctcattggatgattttctagcaacagtgtagaagaaaaaaaaaatatcggtgttg

SEQ ID NO: 83508 - DNA, 868 bp, Oryza sativa
cattccaccatcgatcaaacatccttcctaatcacaaacatctatgctccccatgccaactccgagagacaagaagtgtttgatctgctcactgccttgaggaccacacgccttgagccctggatgcgcatcggcgatttcaacatatacagattcccacatgagaagacaatgacagcataaatacaagaggaatggaagagttcaacagttggattaatggtgaggggttgtttgacatagacatccctagtagaaagttcacttggtcaaacaagagaagatgcccgacttcggtaaaacttgacagagttctgatcgacaccgcctggaaccaaactttcgccaacgcctccgccaaagcactaatagcaacaacttcagaccacatccccatcctcgctgagttctcggacaactgttcaaaatcagacatttttcgtttagaaaattactggttgcagatgcctgatttcatcgcgatgacagaaacaaactggagcagaggaaccagacccctgacagcaatctccaagctcaaccacaaactcagacggcttcgagccagcacgaaagcctggaacagaaataagcgcagcattccaaccctcctgtcagccaacaaagacacattggaatacctagacaaaattgaggagtggcgtcaactgactgatttggaatactacctgagacagaggattcaaaaacactgcaatgagctaaatgatttcatcacgcaaaaatggaagagaagagctcgtatcagattctgcacactaggtgatgaaaacacaagattttatcacactctggcttcagtaagtagacaaaaaaattccatcagactttttattgaagatggtgt

SEQ ID NO: 83509 - DNA, 1360 bp, Oryza sativa
ccttataaagagaaagtatctttataatcagtctataacccaagttaataggaaacaaggggattcacaattttggtcagggctcatgaaggtcaaaaataccttcttaaatatgggttcttggattgtaaataatggaagacaaataaggttctgggaagataaatggctgggtaacttggcttttaaagacaaatatccatctttatattctattgttcgaaggaaaagttctactattgctagtgttatgagttctgttccacttaatgtttcctttaggagagccttagttggccataatcttacatattggcatgaattgtgtacttctattatacatattcaatcgaaccattcttctgattgctttagatggaattatcatcagagtggtagtttttttgttaggtcaatgtatctagctttaattaataatggatatatcgaaagaaataagattatttggaagcttaagatgccactcaagattaagatctttatgtggtacttgcttaaaggggttgtgctgactaaggacaatttggcaagacgaaattggaatggcaatttaagatgttgtttctgcatgaaaaatgagaccatacaacatctttttcttgactgtcattatgcaagatttgtttggagagcagtacaattctcttttggtttaaaccttccaagtatcatatctaatatgtttgatgggtggcttatgggggttaataagaagaaatgtaatctcatacttgtaggagcatctgccatatgttgggccctatggttgagtaggaatgatttagtgtttaacaaatcaccatatactttatatatgcaggtaatattcaaggtaatatattggctccggttttgggcaaagctgcaaaagtgtgaagaggatggtgaacttatgaaggttgcatgtcgcaaactcgagacgacggtgacgtaactctttgcaaactatggatggagattcacaaatagacttgaataaatgtgtactctttatcttggtttgctttttattttgttgagtgtgtttgattacatttgaactacactctttgtatgagtgatactttgtaataattggttgtaactctgttgagtcaaggccgggatataaattccattatctaaaaatataaatgatgttgatatatatgctagttgaagctgaagttaacaagcattttactccaattgtctttccttttccctcctcttttcacacagtgccaccaaagatgttgatacaaagctaccaaggtgaaaaatagcatgctaacacatgtggattaaatcatagtaagacacgtcaaagccattgccatcagcacctgaaaacaggaca

SEQ ID NO: 83510 - DNA, 5057 bp, Oryza sativa
  unsure (1)..(5057): unsure at all n locations
tgtaaacttgaattaaagaaataatcaatgtttattgtagcatatggtttattcaataaaggctctatatatatgctttattgacttgttattcctcaaatagctttaattgcttattgtgaaaaggagaataaaattaagaaaaaatgaataccgaatccttgaaaacagtcatgacgacaaggacatattcgatgtgagcaagaaaaaatggggtgccgaatccctggaaacagccttgacgacagggacgtacccggaataatagagaaaaatatgagaaaaaaaaggttcaaaaaattctcttggttattttgtgctaaaggttgtttgagaaagagtgataaatacaataggtatatgtgtttagtgtttattcttcaacctatgtgcttgttaagatgttgcattataaatcgtatgaaatcatgaatttttattattgtttcaaacttaattgtaaaatctttggttcatggttatactttaatgcatgcttgttatgttatagatggattcatcttctttttattgcaacatatgacttgatatgctatatgtatgctgagctcttgaacattaatgaacataattcctatgcttgatgaaatcattgtcaaatgggggagaagtaatgtgaaaattttggattttatgaaatcattgtcaaaagggggagaagtaatgtgaaaattttggatttttggagaagcatggtgaatttttgaagagttgttgagaagagcatgtttttggttcaattgggaatttctttcttttaaaaaggggaagaagttttcttttggattttttagcacgatgtgtacatttgtacgaagtgtgctttttatttttccaaacaccaaaacatttttatgagtttgccaatgtgttcatcaagggggagattgtaaaattaaagatgtttttgattattattctgtgatgaacaattgggcattggagattattggttttgttatttggaatttattcacgaagtggttttggtgatgattgggtttacaggtgaatcgcaggattgttatttcatgtgaccggtcagactgggctctggtagccggtcagaccggcgtgtaatacgcggtcagaccggcgcagcccgcggtctgaccggccgacactgtgtcggtttcggtttcgggttgtttagttggatatccgagtttatttcatgattatgacttctagatggatactatacgtatgtaacactattgtttgctgctaatgagtcaagttagagatagcttggtcaaagaatatggtttctttgtttgttccatgagtaggtgtctcgatgtctccggagagtatttgcggtgatggaccgggagtcggcttggggataagacaacgtccgtggtggtcagagatcatgcgggatactaaggctagagttgatgcacgtggttgatggagattccatatggcatacgatggagttattgtgtgcgtgtgggatgcggagttgaatttggaaggagtccaaatttggtacgattggttatgtaaagtttctttcttgtactagagggtttcctaaggtgtttaggactcctagtatgagtttggttcgtggctttaggctgcctaccccatgtataaatagagggggagcgtgaggcttccctgtatcgctttagagagcaattgagttgagttttgagttagggtttcgagtttagtcgaaatttttgtaaggagtgctgttggtgcactttgtaaacacagagagaatcaataaagtcgtcatctactttaagagttcttcgatttgtgtttaccgggtttcggcggtctaaccggcaactcaccggtggtcagaccgacggcaatcggcagtcacaccggcgggaacacggcggtcagaccggcggcggcgatagcaagcagcaggcgatctcggcggttagaccggtagatcaacactggtcagaccggcggctcgcttcggtcagaccggctaatctacttcggtcagaccgatctcatcgaaattgagggtaacttttatttccgctaaaagttttcggtttttgggtataccaaccattcaccctcccctctctggttggcttagttcttgtaattcgattctatagcaaccagtcatgccagcatgttctaggacctcaagacaatactaacacggactgagatggatgtcggtaggacgagcacttatcccaagaaagtgatggaatttgccaagatccttcatagagaactcagactgaagagcagtgataatcatccgtaggaggtcaccaaagaaagctatatatggggacaatatcatcaacatatagtaatagatagatcacagaaaaacctcgatgataagcaaattgagacgcattagacttagcctctgtgaagccaagagaaagcagaatgttggcaaactagctgtaccatgaccggggggcctgttacaatccatagagggacttgttcagacgacaaaccatgtcaagcatggtgggatccacaaatccgaccggttgagagcaataaattctcctgaatagtaccatgcaataatgcattcttaacgtcgagttgatgaatcagccaatcccgagagctgaaagtggatggttcgacaatcagcgtaaatgtctcatcgaagtcaatgccaagacgttgtgtgaagccacatagaacccaatgagccttatatctgtcaagagagccatcatcttaaacttgtgacgaagttagtgtcgggtgtattcggaatgagctcccaagtgtgattcactagcatagcattgtactcatccattggaacatgctagtgcgggtctattcggtgaggagttcatataagcacgaaacctccataatctattcagccgactcatagaaatataatcaagagagatatggggagggtcggtagggatcagacttctcgacgaggtcaaccggacagtgcacagttgataacaagaggagacgtagtgctgtgattgtagggttcggatcatgttgatcgaaagccgaatcatgtttgtcaatttccatcaaatcaagagttatcaatacctaccggaagatcgagacctagtttcttgtaataaaatatatagatggtagtcatttgaacgtgttacatgtgtaggtttgggcgtccatatatgcctatataatgggcacggtgatgcacacaataatcaaacaagattcacagaaactaccatcaataacaggactcctgcacttcatacatggccactgccagctctataaacaagaggtttagcctcgccggtgccacggcgcttgtcaccggtggcagcaaaggcatcgggtacgtataatcaacttaccaaatcaaactgactaattgtttggctcatacgcttcatcattccagtggtgcaaatttatcgaagcatatcatatgaattattaaccatgtaaccgcgccatcgtggaagagctggcgagcttcggcgcgacggtgcacacctgcgctcggaaccaggcggagctgagcagatgccaggaggagtggacggccaagggcctcgccgtcaccgtctccgtctgcgacgtggcggtgcgcgccgacagggaggcgctcgccggcagggtgtccgccatgttcgacggcaagctcagcatcctggtagaagaacacgagcacgcaccatgatatgtgatattatcttctaatccagtataatatctctatatggacacgaaccgatgaaacggccggatggatatatatatatatgcaggtgaacaacgctgggacggcgtacctgaagccggcggcggacctgacgccggaggagacgtcgaggttgatgacgaccaacttcgagtcgtgcttccacctgagccagctgttctaccctctcctcaaggactccggaagaggcagtatcgttaatatctcgtccgtcgcttctgtcctcgcgttccattctcttcctatctactcggctgccaaaggtaaaaaaattaaactcccactctgtatgctatggacttcttgtcctattgcacaaaacaacaagcctagcttgcaaatataatttcactgaactgcacctcctccttcaggtcatatatttgacgacgcttaggattagattttgtttaacttttaaatttccaacgtaccattagttttatattattagaataagtttgtaaaatttaacagaaatttatgttatgatggtatagtttgaggcaaatacatgtatgcggtataggatgatatttattacatcctaaatgtatcgttgtgaacgggtataaatccaactccatctatctagtttattttgtgagagcgtttcacccaactcaactcccactatcaggtggatctaaatctaactccatctatctagtttattatgtgagagggttattccacccagcgttatttcagatctcatgttttattttggcacgtggcgcgcacatccagcgcgagagaaattaatgaattgatttatgtgcacttgcttctcaagttgtaataatcactagctatgcgctttgtaacgtcaggagcaatgaaccaagtcacaaggaacctggcttgtgagtgggcgagcgatgggatcagagtcaattccgttgcaccgggctacatccagactccactcctaactgccgtaagttcctcgttttacaaatactccctcctcctattttatgacgccattggcttttcgaccgacgtttgaccattcgttttatttaaaaattttatacaaatatgaaaatatttatgacattcttaaagaacatttgatgataaatcaagtcacaataaaataaatgataattacataatttttttaataagacgaatggtcaaacgttgaataaaaagtcaacggtgtcatacattaaaatatggatatggaggtagtaatatttttcaaaaataataatagctaggtactataattttagtgccgctttgttttagtatcttgctacgcnnnnnnnnnnnnnnnnnnnnnnnnnnnnnnnncaacgcgtgcgcattcaagagc

SEQ ID NO: 83511 - DNA, 4443 bp, Oryza sativa
atggagaatgtggtaaggtggttgtcaattgtcctcctgaagatcctgccccagtgtcatcttctgacaaccgccgtagaattttaagagcactgagttctggatcatacgccacaaagataaagaacacaagagcaaccatagtagcattcaccggagcaacctccaggtcatgcaaggcgatgagtcatgattcaagtggttcaaccaagcagcatgttgagtcgtccgcaggtaagaggaaatggcaaaaagaaagtgttgaggtaaatagagatgattaacaagatatctgtgatcccgtatatcatggttatccttcgtattttctgaatggactgcttgacatcatgggccatgagaagttcagtccaaaactcctaatatcttgttctgaaagatgacgactgaaaaattgctatcgctacttgtttataatcaagctaattttcatttgtgtatgtttctaaaatatagcggttgctcacatttgtctgtattgcatggcatttgaacacatgttttgcaaccataatgtaaatagacaacccaccaatggagaaaactgttgagaattactacaattagtcacacaatagtattatgtttcagtagcatgtggcaatggacttcacttactagttagaaggtacagtaccgctgttgattcctcatttagggcatacaaaagattcctcagatgctatatttgtttaatcctaagttgaatcaaatcctttcgaccacagggcagagaataatccaaattatataagacatgggtatgcattgaataccacatattcaaatctctttaaaagcctaatttgctactgggagtggcacttgttgactgcatgtatcatataatctagtgttaaacaactaagaatgggttcatacgtaaccgtattgaatgttcaaattaaaaatgagtatagcaaactacatttgacagcaaaaatgcactgttttcagtttcacatatatggacaatatgggcaaaagtattcatatgaaagaatagtaggatcacaatgcagacatgagaaggtattcagtcatcatatgaacagtgaggagaagcagtacagccaacatcaaaaggatcttccgatccacaacaatgccaatactggaacactttgcctgaatctggagtatccagagtcccacccgcatagacactttcaaattttctcttcgtttctcctggatagacagagattggccattcagatattagactaacacaagcagacaatgttaactagttcaaaataaacaactcagtcagaatttctgtctaggtcatatgccaatagcccctcggatgtttggattttccataggaacattggactataaaatatccttaacacaatttttcccctcaggattatgttgggagaaaacgttatgcacccaattctactgaaatctcttgctaaatctcgaattcgtttctctcaaagaagccctcagctacacatatgaatagctcgagcaatcaaatgaatctgaaagaaactactccagcttccttccatttctccgacgagttcctcacctccgaagtgggcggtgtggtggcggcacgccgaggggtggttcgccgccgggtcgtaatgcttcttgcagttcttgcacgtgcgcagctcgggccctcctccgccgccgactccggccgaggcggccacgggtagccggactagccgacggcgcgtggcgagctgggcggcggggcacgcccggggcggagcccgtagcaacggcggcgcgcgcgcttgcggcgtcgccattgggagggatgagcaagtgcggcggagagggagaaggggttggtgggatcgggtcgagaggcggaaccgagagcgacaaatgcgggtgggccgctagtctgtagttgggctcaaatgcgggtaaggatcagaagcagcccatgaagcccacgttggaatcgtggtagaggtagcccatatgcaagcctagggattgggtgctcggcctaaaattcagactatcaaaattgataaaatttgctatataacacttaaagtcaccgaaacaacgcgtatcttcttgtgaacagcataaaaatattataattagctagatactcaccgcattattttattattttgggtggaaacggagagagaaactttcataaaagacgacgagtttgcccgtggggtcattgtgtataaccctcacgccggtgaagacgttgacggccggccgcgaatcctcgccacggcgcacgggtcgacggcgacggtgacccagccgccgtcatgagcgccgcacaagcacgtgtcccagacgccttccaggaggctgaggtggcgggtgaagccggagagtcggagtagaggctgaagtaggacgatgtgtcgtgggacgggaggagcagccacgggagcccgcagtgcagggcgttgacgaaggccgcggcagtgcgccatgggcggtagacggccgtgaagccaatgcggtcgacgaggcagttcagttgcttgaagatgacgccgagtagcttgggcaggaggccatctgaccacggcagccgtgacgaatgcctcggatctgccctagctcctccgtcgcgcgtcgccggctgacggcgaaatttggcactggtcgtcgacggtgagcggcgagctctgaccctgcgcgtctctggcggggatcaaccgaccctgtgaccagcgtttcggctatcgccggtcaattcggtacatttatcgttctttctctctctccgtttccaccaaaaataataaaataatttagcgagtgtcgggcaactaattttcacatttttgcgatgtctacaagaagatatgtgttctttggtgtcttacaacaaaaaccacaattttttagtgtcctgtaacaaattctgccatcatccccgaaaaaaaaattctggcatcaatttgacggattaagttataaaaaggtgtttagtcattgagacatctgaaacaagatatatgagaaattatcacaccacaaagctagaatacatagttaaaacatctttaaaaataaattcattaattggaacattataacattttctgcaggtatggaacatacaaaccaaagatgtaaaacacggttccaaacatatctctctcgtgcttgaagtatatttatttcaaaagtagaataatgtgaattgttgtttcaaatatttaatttaatacacgacataattagatcgcatatcaaaataatcccccatccctacttctaacccacccaacaacgttgcgcctccctctcgacctcgcacctgtactgctagctacctactcatctgtggtgcaccgtctcaggtgaaggccgccgactgctctctccacgctaaatccgtcccactgatctcctctgtttccaatggttcacacccacccactccaccttctaatcactctgcccaccacggccgccgccgggcacggccccgccgcccgcccgcccgccgccagatgggaagggaggagggggggagaggggaggaggaaggggagggggaggaggagagggatctgtgaagaggataagtgcgacgaaggggaggaggaagagaaagggatttgtgaggatgtggttgcgattgtggaggagaggataagtgctaggaattacatactacgcattgaattttagtcccgattagtattaccaatcgggattaaagtggtgatctttagatccggttggtgtcaccaaccgggactaaagatcctcggtcccctgacaggggatgaactgggactaaagattgtattaccaacagtaacctcaaacagtatttacgtcagaggtactgttttacactgtagtgctaacttaaaaaaactgtgcgcctctgacgttaccgtccaaagtcagaggagccggttcccgaccagtgtatctatgggtggaagtgcaactaccaggataccattccctactttattttattaactggcgtaatacaaagcaacaattaatatatccaaggtaacacacggtagtctatagctaggcgcacttgaaaccctctggcacgttgcggccgcagtagttgacgaggagcgggaggtcgacagcgacatcctcgagcttgacgccatcgccgagcacgctggccttgatggcgaggcagaggcacacggcagcacactgctagaaaaagcattttcatcaatattgggtatttattttcacatacgaacatgacccttagagccaaacagccacctacaaaaatataaatcgggcgtgcctacgaaaatgattttcgtagacggaccacatgaggtgcgcctgcaaaaattagcgtggtatatatatatgacacatcagttgatatttttctaagtgtccttacctctccccttcaccctcctctcccctccccttcacctctcccctcccctcccg

SEQ ID NO: 83512 - DNA, 697 bp, Oryza sativa
actaaatgatttcaactgaaaaaatcatcaacaacaaagtggtataactcatcaggatctataacttgtattttggtcgtttcttcatccgataaagtggtttgtaacattgttcacaaaatgtacatatctcttatttagttttataacatataagagagatatgtaaattttgtgaaaatattactatcactttgtcggatgaagaaatgaccaaaatagaagttataaatcttggtaagttatacaattttattgttgatgactttttcagctgaaatcatttacttcttcaaaatattatttgaagttttgaaattcaaatttttagttgataaaatgaagtcacaagaaaaaaatagccaaaataactgcatgcagtaagaacacaataatatgatagagcatgattttagaaacatttaggaaaaagaatcatccaatttggaatttatatgagtgtgataaactagttttattttttttttcaaattttattttcccatacggctccttaaatggcccgtaatcaatttttccatacgggctcttaagtgatccacatgcagcggacttcttaagaggcctgcatgaaaaaatcgatttttccatgcgggccacttaaggagccgtatgggaaaatgcctctcgatttttccagacgcgactagttatggtccatttacaaaaatcatgg

SEQ ID NO: 83513 - DNA, 2479 bp, Oryza sativa
cagtacattaagaattgaaaagtttttcctacatttaatgtgagagttcccaccctattggtgctatatgtcagatgagactaaagtggaaattgtaagagaaagaacataaataattaaatactatttacgaaagtttgtaactaggacatagtactacttattatgaaaaagtttataactatgacatactacttattatggaaaagtttataactatgacatacttatatttctcatatatattgttgctaacacatggtgcctgcactgcatgtgtatagttcgtggccggcaacgatttcgcacaggttgagttcaaccgtcttcctttgggccgtctcggtaaacctgaggacatctcgtcgttggtggcgttcctgtgcatgcctgcggcctcctacatcactggccagattatatgcgtcgatgggggccgtatgctttcttaataaactctacatatacaaaataaagatatatcatgtatcataatatattctactgaattgggagacttccaagaagaatgaaatctttgtgtgcccgtgtaccaaccacacacaacaggctagctagtcttctctgcatgcgtagagcatagactgggtgtaatgtgtaaaatggccaatatatatttgtattaagtttgggaaatcatgtggagaagattggcaagccgagtgtaatgaattttccatgaaataaaatttacggttcctatgattattgatacaaaacagtatgaatgagaccttgatttgttttgacttaagattcattataaggtttattcatgctgtattggaaaaatcaactattcattggattcgttccttttatacactagtacagatcatcttatctgtgacggctcctcacatgtctaggttttgcgggccgtcacaatgaagtcatctcaaacaggcccaaaacgaggccgacaaagatatacttgcacagacatgttagatgtgcataaaaatcgagcccgtcacggatgacacctatttgtgacgggctccaacttgaggaccgacaaagataactgatgatatctttgtcgggccctaacagaagcacgtcactgatgtccatcattggtgacgggctccaacttgaggcctggttgaaataactattatattaggcccatcacgatgaatgttatcggtgatgagcttttacttaggcccgacaaagataactaaaatacctgttaccgtcgtattttttttggccgttacagatatttattgcacagtataaataccccaactacctagtgtaatggttatcccactgttcactattttggtgggagtataagacggtgatttttgtctcttttctccaagaaaatcataaattgcaaatttaattgaaaaatagtagtcaattctcaaaaatttagtaaatacttacctacaaaatgtatatgtaatatttttctacttttatgaagctcggggatggatcaaagttacatgtatgggaaaactatgcgacgtcataccaaggtgtatagaaatggcatattgaattttattaacgccgcggaggaggataggaaaagaagaacaacgattgcatgtgttgtccatgtgcagattgcaaaaatgagaatatgttttacagcagagtggacgtacacgctaatctgatacaaagagatttcatgaagggctacacatgttgggtgaagcatggagatcaaggatcaagaagtggtgcacaaaatctagaacatgaagatcatgagcatgaatcaggaagtggtgcacaaaattaggaagatggagatgagcatgacatgtttgtacattctccactgggcggtgaaatggttgatgtggatcacaatctactgcaagacatgttacgtgatgttgagaacctagcttacaacgagagagattctataaagtttaacaagttggccagtgactcggagatgtctctgtatgccgggtgcaaagcaaaacacaccaaattgtcagctaccttggacctaatgaagttgaaggcaagtagtggatggacgggcaagattttcatagatcttataggaattttgaaggccatgcttcctaatgagaacacattgtccgagatgacatatgaagctaatcaggttttgtgtcccctggggttagaggtcagtagaattcacgcttgtccaaaccactacatattgtaccacaagcaatatccgaacatagatcttttaggaatttcatgtgatggatgaaatattttgtattattaaaaaaactttttgtacgaatgaagtacttatattcctatgaatttctattgtagcattaaacaagcctttctgttatatgaaattagtaaattatttagtgaaatatatgaaaatagtaatttttatagtgattttagttaatttggtgaattatttagtgaaataaataattatttagtgaactattgttcgttactaattatttagtga

SEQ ID NO: 83514 - DNA, 993 bp, Oryza sativa
cccggttagggcatatgtattgtgagcatgatgtgatgtgaccctgtagttctggttggagctgcctttaagttcggctgcttagtggaagctctatgatttagactccctttagttgctcttgccgtgtggacgtgtaaaattcgggcaggatgggtgttgtatgggtattttgaatttattttgggtgtgtatttatgtatctaacattctaactacgcatttatcgctgtttcacgtcatgtatgtaaccgtgcagttattagtttattgtcttcattcgtgcttagcataacgacattaatggcttaccttgttattcaattgcggcggcagcctctgcgggctcggttcactgctccatccaatgtttccaaatatgcggatgcttctactcaagtgttgtcagcaaattttcctggaaaaggtgagagcaagtactgtttccttttttatgcttttgtttcgcactttatgccgctgttgcgtgatgttcctttctcaaataggaagtctcttacacttgttcttttctcttgcctcttatattttgatttgctaggcagtaatagcctgagtctctcaagtgcttttcctcacaaaacagttgctccaagttataagaagacaacgagggtgaatcaagggcttttcaaacctggcaccaatcgaaaccttacttggcaaaagcctgtgtcaagtgataaccttgtgataagtttctctgatgatgatagtgggtccgactctggaatgtcaaagcaagataagagaggcaggaaagacagttcacaaggtacatataaaacagggattaatgtgcacactggaattatgagggaagaagcacctcaacagaagatccatgctgcaaaggttggatctgcaaattggtcagctgttccactaacatataggaattcacgggtaggcaggggattgagtgccacctttgctaggagagatccacctgtctcgcaagtcactccccaa

SEQ ID NO: 83515 - DNA, 5966 bp, Oryza sativa
tcaagagcatagaaggaagtgcgaagtagaggaaagagaagctctaagagcttatcgcagagcacaaagagctttaattgaggccaatgaaaggtgtgccattcttcgcagaaaaagagagctttgctctgcacaagtccatggttttatcgctgaaaattcttctttggcacagcctttgagtattcagaatgctggacacggtcttgtaatgccatctgtgctcaactctcaagctaatgcagatggtcagatgcctggaaatcagggtggcaggtctggcagtccatacccagaggagtcccctcagcagccagttgataagcatgaggcacgctcacacaatttcaatgataacagcacaccttcagattacatggaggatgatcttctacccccctcaaagcgggcaagatcagattgtatttcaaatctggaagatcacatggaagaaactatacatgtttatcctgtggaaaacagacaaatttctggtgaaagtgtgcaggactatgagcttttggaagcttctttgagatcaaggttggtggagagatttgggaagaaatcatatttgaataattctggagaagccactgaagaactctcctttggaaaagtatctgagattgagcgtgagaaggcatatgtgggacctctgctacaggaggctgatgagaatgttatgacaaacattgaaggttatacgcatttctgtattccccaagtccattgtgttcctattattgacttttgcgttaaacttagtgatggcctacgtacatgtcatgcatcaaaatattgccagttgccatcatactggagatctagcatgttttcatctgttaaattaatcagtcatcttgctatctttgcaataactaattactatggccaagctcttctaaacacccaaaacatggctaaaattggtcgattgaaataaaattgagtgggcattaaatcctacaacatacagagtagttctttatcttctatatccatcacaactggaggacatgttgagtgtatccttgcatgttaattaaaaatgtggataagtatggcatgtctttctacagtttaatgacatgaggtctattgcataggtatggtggagcttgggaatgatgcacatgaaaagagagctgattctagcaatgcgccttcaattggcaactatgatcatgaggaaaatatttcctcttttggagaattatgcatgccattgagcgtgactcatcccattattccttcttcagctccacaaaatgctgcaagacacatgaagggtttatttcctgatttacacaagaaagcttcagactacaaaaatgactgtcagaccagcaatgcagcctctgtagcaacggttcgtttgccagatgttgccaaggataatgctaagatgcactcaacaactagaaaggatatggacattgtgagtggtgcggttgatcccttctggcctttctgtatgtttgagcttcgaggaaaatgcaatgatgaagaatgtccatggcaacatgttgagcatcatgcttggagaaagtcaaagcacacaaagcattcaaagccctcattttcaggtttgttttatgttcagacaatattaatcttgttgatgattgattatggtgcatacatgtatggttttcatattatgtttgctgaagtttctacattaatgcctggaattaatgcagggtggattccttatggtctgtttcagcatattctgcccgtgccaacttatcgtgttggttcaaatcttattagggctgatctgaacttgatccagtcggtgttggctagcagcatttggcagtattggcaaagggggttttgtgcttcctttccttttcctttatctgttcaaagggtgcttccatcagatgctccatccttacaggctggtgatgattcgagtgcaaattttgatagggacagacaactattgaatcttcgaatgctggatagtaggaaggtgggtaggattcgtcatatcacagttatcgtcagaattgtgggagttatcagtatctggttctccgctctgaacttatcctttcaagtttgctgtcctgcctaatattgtgatggctctggctaactcttttcggtgctcaatttgtgttagtccactcctttcattcttctccttgcaaaaaaggaagatagatacagatggaattttgcacccaaagtggacaaattattaaatttgccattgatagtgttcttatttgccacatctgttttcttagtagctgaaactcatgacttgacatacttcctgctagtttcatactatctagtttcttgccctattctcttcttatattttgactagtgttatttaactttgtgtgctgtagaataagattgtacagggatctgttgatgctgaactattcttagaaggggcactaattctgtattttggaaaaatcaacaaacctgataggctcaaggtgatcttccccgttgagtgttttgagatgttctagctctttcaagtttcaactttcaacacattttaattgggcttcatttattttctacctgcttatctcaaaatattcatcctgcaggctcttttatatctagcacgtgctattgaggccgatccaagcacagttatcttgtgggtgttttatcttcatatttactatcaaaaggatgaaggactagggaaagatgacatgttttcccatgcggtagactattttatcaatcttttgccgatcggttcacaccctactatgaaagtttcatagtaaaatgcgtgaactgttaatacttttttcttttgtttagcctgcatgtcctgttttacttttatgtgctgagtggttggtctgctcaccttagaaatgcaaaaggctatatcataatttcatttaatttcctacactgtttcgattccatactcagttcgttcatttataaacacttgatgagccctttcatgctatgacacgcttcaactgaagtatgctcagtgacggaggtttgagcagtgaaaggcttttatgagtttgtattcactttgtacttattggacaagacataactagatggtcaactgagaaaaaaaaaactagttggacttcttgtcagaccaaaatattggaccattggtagcatgagcattattgtatttctagaccatgtaggctatgacacaatgtatatttgctttagtttgtatcatcttatactaatattatgtggtctttgataaaacatctacttttcttccttttaggttcaacacaatgtttgctcctatgaactatggcttatgtacattaacagcaggttgcgctttgatgatcggttggatgcttacaatgatgctttgagcatgctctgccaaatgacagctgtcacagacatggaattgaaagatagaagttcttttgtcctagatatcttgttacagatggtttacttcttgtgcatgtctggaaatgtggacaaagcaatttccaggatttatgggattctgccgactgcaactcccgactgttctggtgacaagttgctcgctgatgtcatttcttgcttgaccatttctgacagatgcatattttggatttcctgcatatatgtctcaatttacaggaaacttccagaggaaattatagatcaactggaatttcttaaggatttacctaattcgttagtatggtctcctattgaacttacagtagataacagaagtcagattttagtactattgaactatgctgctggtaagattgctgtagatattaatgaaacggttaaaaacggggatccatcttacctgaggctctcacaattcctcgctgttaaccacattaattgtctagctactcttgaaggcttccaatcttgtgctaatctgctggtgaagtatatggaggagtatccaatgtgtcctcatattcttgttttctcagctcggctacatagaaagtacggttcatgtcctggtctgaaaggatttgatgaattgctcctgggttggcctaaagaggtgcaaggaattcagtatctgtggaaccaatgtgctgagcatgctctggcagataatatcgagctagctgagaagttgctgactcgctggtttgaagaatatggaaaagatggtgatattcaaagtggtggtgctactagaccaatggagatcagcaatgaagagtctgtacggtcatcagtttcctctatacaagaagttggttctggtacatctacatcagaggatcaaatcttttggctattaaacctctcattatacaggacgatagagaacaatctacaggaagcaaaagttgctatggacaaagcattgaagttagcacatggggagagctatgagcactgtataaaggaacatgctgcaattcacacactggagaaaacgtcatcatctacagatgttcaaactcaagcaaccttcagtcttatcagtggttatcttgtagatcaacggaacttgcccgtgagggatctgctgtcaagaaggtttatgaagaatgttaagaagcacaggcttaagcggttgatagatgagactataggcccaacttccgcgaatcctgctctgataaactctgtcctcgaggtgtgctacggtccatctctccttccagaaacgataggtgaagttaagtacctggtcgattttgttgaatcagtgatggaggttcttcctgcaaactaccgtctggccttggcggttggtaaattcatggttaagcattgcacaggtgatgactctatttccatgggcacccgattctgggccagctccattctgatcaacgccattttccgagctgttcctgtcgcaccagaatcagtatggttagaaggtgccagtctccttgagaaacttcaggcagcagagaccgtgaagagattctaccagcaggcaacctcagtctacccgttctccttcaagctatggcactcttacttgaactcctgtaaggccagtgggagcagcacagagagcatcgccgaagctgcgaggcaacggggcatcgagctgagcgtaacgcctccctagcaggggccctcttggtttgatgacgtggcgattcgccaggtggagctgtagttagtgttgtgtttactggaaagtgagagtagatacacccggtggtgatggggcgactggataattttcttcttgtttaggcacaggtttagtgacacataggcggtggataccaaccataccatacatcacagcagctgctgttactgatggtgtgacttatggatcaaaaaaagaggatataggcatacggttttgcatgcccccacagagtggagttttggctgactcgagagtatgatgtttttgtaggcagatttcttgatctgtttcaggtttatgtttgtttaccctgttgcagtgtatggcatgcacaactgttgtttttttgaaacattatgatcgatcaatcatgaatgtgaatgagaattttgttaaaccattgcgatgtgtttgcatctgaatccatagctgctgcatcgaatttttgttgattcgcgagctcatgcgtctcatttttgttttcatagcggattgctggtgttaaatagccgaatacaggggtcggtgtttccattaccgacctttgtttgctcggctagtggactcgattaatagtcagatttcttttaggcaatgattttcaaatgttcacatagtttttagccagggacgtgtttatttatgcataaacctaaggaacagaatgtacatttttgttagtactggcactgtgattcctccatcaaattatcagtagtacttcctctgtttaacacattataaagatccacatatgtgcttataatgtggaaacagtggaatcgaagggagtagaaggtttacgcaaatttttagtcaaattttgtgaaatttagtactccctccgtccctaaatataagagattttggc

SEQ ID NO: 83516 - DNA, 2931 bp, Oryza sativa
caggcgggccgggcaaccgcacgggataatctattcaaccgcccggaaaaatgggtattggagtagtgcatatttagggcctcttatatataggcaccgggaacatgaggtacatggagtgatgtacacaagcagatcctctgatcacttacttcccactgactttgaatcactggtacgtgggttgttgggtagatggcccacatatcagtgacccacgttagagaaaagtaacttggaggatctcaatctgtaatatactacttctcataatttggtttataataacaatccattgattccaaatagttcagtgaatactacggattagtctacaaatgcaacacatatagtagaatcaaagtagcaagtcgatcatggcacgctgcaatggaacacttcgggctagacccttttgttttatgaaagaacatgcgacccttcttgccttaatgagcaaatataaaaaatggtgagtgcatcaaaacatgtctctggacgaggggttctgttttttctggaacttgttgatggatgtagagtggagatggctagggacagtgttgtggatctgagagaaagggtggtcatggcggccatacatggtgaagaagaggatgggaaagttgagggcaaactcttaccgaggcgattttggtgtgacggagatgtggagggcaaggtgcgggagtgtcttagcgatcatcgatgacattttagtagttagagacttagaggcagggcctatgtgcgaagagagatagagatagagagatgggggacttgacatgtggacctagggtatttcaaagaattcacatgatttctctcttcaatttaaccgaaaataaatattctaatggacgcggtgtccatgatctaattttcatgtttacagagtgttttctccccaaagtcacttcatgtagtgttctacagctaaaaccgtgaagtcatgatgtcctgttgttaacagtgaaatttggtaaagcccgaagacatcatcggctgagagtcagtgtcggcttccgagttctagagacagccaatggtagtcattaagtcgccatgctgtcgtgttcctggtggaatcggatcagtcaaaggaagcttatctagaagagtccaagttcaaggaggatgtggcatggtagtttatctattaattaggcatagtttgttagtttccttttatctttaggaaaatgtgtttagtgtccgatagggactttatcttttccttttatctttagtttctttcttgtccgacaaggactagtatctacccatgggtataaatatgtacacccggggtctatgtaatctatcaatctcgatcaatacaactactctcggcgcatcgccaccctctttcctgaggtttttacttatcaaccggcggaacttggcacctgacgcggggctgcatcggctttcgatctccggcgaaggggtaagtcctacgttccgccggccttggtgaatctatcggctatgttggtgttgaggctgcatcgcttcgatctcttggatcgctctggtttctttgatatatttgcctacctgatatctcaattctatctctagttgcattgtgtttagagacgcatcggtttagttgggactgtctcggttaggtccgatcttctgtcttagtcgatatatctctacaatcataatgatgttataaatagatttgttatatccatcacattagacagatctatcggctcatcgagtattagattatcatatacaatctcgtgctacatcggttaggttcgacctactagattgttgttgataatataagtcttgttaagccgataggttcatgctaatgttttatcagggtgctagccgataagttatctggatttagccgatgacaacaaaggtttcactgtttaacctaatctgtggattttatggcatcggacctccagccgatgcatgctttaaccctcggatcaatgcttattatatcatatcacattgctagctgattggtttatactggattatgttgttggtatattttattatcatcagccaattgcctttatattattatctacattggacatatagccgattgctcaaaaccctatcactatcgctagtatcggcatcggctggaattgctccatcggcttgtcagctgatcggctgtttgatctactgtttgcatatcttgtcagttgcagggtcaaactgactggcacgcccgcatctcatcaacctttggatctgcactggagctaagcagatctcccaggccagtgtgtgtttttcgcgtcaacacctgtagaacatgtctatttgttacattgaaggttaatgatctcttgatgtagtaggggtggaatgacatgctagagtaaaactcaaagcccagcagatcaaatgaatgagatgaagcattccttgtgcaaactgtcctagaatcccaacggccggtgtcgatctaaccataattttgctagcctaacataactcaggatgggaatggttaggtttggcccatttatccattgaacctacgcacaaatatgctccattgggcctttaggattgattcaaaactctaaatgggccaaatggtttgaatcctagaaacctgggaaacaccggatcaatccaagcgactccttcgtgtcctctcgactccttgcggccctccagcgtcatgtccttcttggcacagtggcggcggcactcggacgacggccctctagggccgtctcatcctccacggcacgctggtggcggccctccagcgtcatgtcctccttggcacagtggcggcggcgctcggacggcggcccttagggcggtctcatcccccatggcacattggcgggccctctagcgtcgtcttgtcctccttggcacagtggcggcagcgctccagtagtggccctccagggc

SEQ ID NO: 83517 - DNA, 8005 bp, Oryza sativa
cccactcaagtactctactcacaggtaacctctcccctccattttttatcgatccatccatcgctcgctcgctcgaacgacgccgcggcgcgatcaagatcgcacccacttcacctcgatccgccactccggagaagaagcggcgcggcgcaccgatcgatgcatccgctggtgggggcgctggtggcgggggcgcgggagcggtggtggtgccgcggggaaggcggcgcggcggtgcggcacgcggtggcgtgggcgggggcgctggcgctggccgtgtccgtggcgtcgttcgcgccggaggccgcgttcgtgtgggcgcttaccggcggcggaggaggcggggggagtggggagttgtgcgcggcgggcgcggtgcgggtgccgctcgacggcgggggggacttcgtgtgcgtgccggcgaggatggcggtgcggtccggcgccgacatgatcgtgcccccggcgttcgccggcctcgccgtcggcgcctccgcctgcttcgtccgcgccctcgccatcggccgccgcctcgacgactactagcgatcgaatccgccgccgccgccgctcttctcgtcgacgagatcaacggcatatgctctcttctctccgcgcttacaaatacgcctcctactttacaaggcgtatttctattcacattttcttcgctcacaaatacgccttctatcttggaaggcgtattttgcttcacattcctttcctgtaatctgaaattctgaataatttacttacaaatgccggcaatctttggtgtaatcacaagattatcaaacaagaccatggaaaatgtgcacacaagctgcaatttctgagtgatgattcgtagtggttacacagaaatcaccattttcaaggcgtattttgatttcacatttttcttcggttacaaatacgccttccaccttggaaggagtactttacttcacattctatttctttaatctgaatttctgaaatgatgtacttacaaatgctggttaatctttggtgtaatcataagatcatcaaacaagaccatggaaaatgtgcacacaatgtccagtcttttgcatacagattcatagctgcctagttggttacacagaatttgccattaatcatcactgtgttgtatatgtcaaattaacttgtattgataatttctcactgtaaaagacctaattaagcagctatctctaagatgattacatgcatgtttggtgatctacaacactactatcatgtactaggtaagacttccaactccatcaccttttagatacataaacaattaggtgtaggtatccacacatcattttcaggaagagatgactgaatgtcacctgaaacatagaagctgctgagacaggacaacaggagcatatttcttctcctgtcaagtttttttttctttttttcttttcctgcagtgatcactagacactgctttagtttccaagcatgacaacaacaagtgctccatagcataggagcaattattcaggagagaaaaaaaaaggctgtttgtataatgcctttatccaagatcttgtagtccataattcagaggtgctgctgagataggtcaatatgttttttttcttcttctctagtcaagcatttctttcttcctgcagtgatcaactagacactgcttaatttccaggcatgacaacaagtgctctatagcataggaggaattattcaggaaaaaaacacaaaaacttgtacaatgtcttatctgagaatctgtggtccttaggatgtaccgtgaggtatcaccacacttcaattatgcacatatataccatcatcaaccccaattcaacatctccatctcctgactcccaaaaccaaaggaaacccagcgattttcattgtttaccaatgaacaatgcttataccaatatgagtccattgggtgatcaaatcctggccgtccggtttgtgcccggggacggccgccccagatcgacggccggcgaggcgaccagctgggtgaagctgatgggctcggcgtagcgcggcgagccgtggaagaaggcgtggacgcagttgtggtaggcggcctgggtgccgtgcaccttgtcccagaagatgtagttgtcccggtccgggcacaggtgggtggtcgccgagcagtcggcctccgcgttcagcttgccgtctccgcagcacgccctcgccacctccctcacccctgttccatccatccaaccacacataattaaaaagataaggtgaaaaggagctaaccacagtggccctaatcacgaagataaaggaagaggcaaaaatcttgggctatggcaggagccaaacgtctagctgagatgttaccgtagacccggaccattgtgctgtaaatattactctttttcgttacttgtaaatttgcccttctatatccaatgaataggcaagctttgcctttcgttcaaaaaaaaaagataaggtgaaacctctgtgttctttttttcttttgaagtgaaatactgtaggaaagaatcctgaaggagaaagctctgtctggaacacaggaacttcgtagaagttttttataggaaagaaatgtgtatttttattgaagtataaagtgacttgtctatccttcgctatcaaccaaaataaacttctatttaaacttgttaatttaatggcgggctaatgataaatatttctgaatatatattaagatgctctcctggtttcaaaattatctaagagtttcttttatgtagtttatattgcaaaatgatgggtctcctatgaatttctaattatgagtatgagaatcgaaagacatgaagattctcaattctccatggcatctaggagatggataattttttagaaacaagaagaccagaagtatcttactctctattcactaccatttcacaaacatcttcgacttgtaacttaccagccgaagatggattctttatcatgtcgtagaaggtgtagtaaatgctgccgatggagtacaccaagtccggcatggaggctgtggcggcggcggtcatctctcgtcggaggagacggttgaagagccgtgcctgccagttgtcagtgccactgcatgaaccattttcaatggggaccctggagatcggtagacaccctagaggtagcacgtcaagtatccccagcctccgagcccctagattgtacagtgtctgcatcacgagcaacacaacatgaacatctttttaaaaagaaataagatgcatatatgttagactgacatgtttccccctccaatgttaaatgcaagtcgtttgagactgaattatcgacaatggaaatcaatcaatccaacctctacatccagtaagttgtttgagactatagtcaatctaaacagaagttgctaaagaattttgagacactatctaatttaaattttgattatatcctttgtaattgaaggcaaccgctcttattttccaatacgtgccaatagggacttctttggaataaaatagttttataagattttcacaagaattggttgttcatttccaccaaaatttccacaaaagttatccattccaatggaggcctaaacaggggggaataagaacatagtacttcttttcacaagtctaagagaaccttgttaggaaaaaaataaccgttgtttggaattatgaaagtacatatacaccttgatatgcttgatgtaagtggcaaccatgtgggcgatgaaggccggcgcgtcgctgacggggacgatgccatcagtgaaggcattgtagtcgttgccgccggtgcaggtaatgaacaaggactgggagagcaagttgtcgatgttctcaccgtcgacctcgccggcggtgatcattgcctcctttgttttggtgaagagcttgacctgctctccaaggctgattgtgccgttcccctgcatgtcatatcatgcaattgatcaaactatctgaacaattcactcaaaaaaaaatcgaagtatctgaatagaatagggatagtaatactgattgtcttttctcaagagaaaaagtaagaaaacaatttaattttagaccgttcgtttttcatcgtagaaaaggagcttttcgatgccttcctctgtttcattactaaagtaaaagaaattaatcaatattagtccatagccactagtccatatctctgttcttcattatgtaatgcaggtagaacagagtgttcaatttgtgctagactgactagctgactttagatttcgttgctgtactttgtaacaatctgtgatttatccattgatttgttctgtgcaatacaatctctgcttccaaatgggcaatcggatgcaagcatggtacccaactcatcagcgtgtgcataactcaatgcatttcaaggcacatggatggtgctgagagatgactccggttcattcgttgcagcaagaacaggatgtggtgtctgttcgttgcaggtgcactttttctgaagtttgggcctgccgtgatggagcgaaattggcaatcgaatggggatgccaaaggattgtggttgaaacagagtatcatggaattgttcaggtatggaattcgaagaaaggccatcgctcaggggtgtttctttcccctcgaggggatgtcccctcgtttcttatatgacattaaaataattatggaaactttttaaaaatatattgttcatgattgtaatccttcagataaaatacaacttcatgtttacatcccaagataagagagagagagagaagggagtaggtcatgcatcactaagcatcaaattttggattgggtttcaaatttcagtatggtatggccaacatcctttatatgattcaaaatcttcaaaaattgcataaatctagctgaattaatttgttctgctaaaagcaaaacagaaattccagccgttcttattctgtgaacgctattacttacaatgaagtcgaggatgccggatccgctggaggcgtagttggcgccgacgaggcctcgccggagttcgccgtctcttcccggcgtcgtcagggagaggtacgccggcgggctcttcttgaaccccacatgctgcgctgcaaatcaatatatatgcacatgcgtaataatttgatttttctttctttctttcgtcggtaataatcaaataataagagatccatacacataaaaaaattattcctctttttaaaaatatatatagatctttgatttatattttttggggctcaaataaatgattttctttttctttctcgaatatagaatataagcaaaaaaaaaaaagcttcctcagctgatgtttaccgatgacgtcggcgaggttgaagccgttggtgaagcggccaccgccgccgccgtcggcggcggcggcctcgggcgggaggtcgatgccgcagggtggctccggcggcctcggcgccggcggcggcaggaagtcgttgttgccgacgtccaccagcgagtcgccgaacacgtacatcgccgggaccgtctgccggccgaccccctcgccggccgccgacgaggcggcagaggcggcggccaccacaacggcggccactcgcagccatccagccgccgccgccgccgtgctccacctcctctcccccgccatggctgatcgatcgaatcagctgagctaccagcgaagtgatggtcccgagctcatcgattagtagctgagctgagcttaatgagaattgagaagtggcgaattatatttagttaactagtaataaaaacacccatgctttgtagtaatgaatgaaattaaatatgttataatatatcatattttaattaacatgttagtatgacttgtttacttatttatttaaatatatggtattcacttgtttattaaaaataaatataggaatatttcacaacattgagaaaatgccaagggctaatttgtacaaagtgtactactaaaagaatggtgaggtggaagtgcgaaagattttgatgtgaaacacgagcgagagagccgagagcgaatcaaaatcaagaattgatttgccttgttaatctcctgtggtgcagaaggatgtggggtagaccggtggagtgtgtgggccaggcattcagtcctatgaattattgttgctctgtgacgtttgttgttgcctgcctgggctggatagatagtacttcatcatttttaaaatatactttctgtccttctaaattatactccttttgttgtagaatgtaagaagttttaaaattaaacacggttattaaaacaataggtagaagttagtgctggagggttgtgattggatgagtagtagaggtaggtggaaaaaataaatggtagacggtttgtgattggttgtgaaaaaaatgttggtgaaggagttgttatattttgagataaattctgagggttaataaaatacccatgggtaaattggaaccatgctattataatttttcaaagtttaagatatgccatcggtaaaatacacatgctttgtaatgaataaaattaaatatattataatatatcatacttttatcaatatgttagtacgacttgtttacttatttaaatatatggtattatatggtattcgcttgtttattaaaaataaatataggaatatttacaacattaagaaaatgccaagggctaatttgtacaaagtatactactaaaagaatggtgaggtggtagtgcaaaagattttgatgtgaaacacgagcgagagagccgagagcgaatcaaaatcaagaattgatttgcgttgttaatctcctgtggtgcaggaggatgtgggtagaccggtggagtgtgtgggccaggcatttagtgtgaattattgttgctcggtgtcgtttgtgcaattgtgcttgccttcctgggcctggatagatactactcctattcgatagtactccctccgaaaaaaagaaaaaaaataacctagctaaacataggttgagtttttttagacgaaagcagtgggtcggaatttaatggatgtgttaggattttgagttagacagagtaagctactactactcagtaagaatttggaatatcaatttcaatatatgactacatgtttttagttttgtaattaatacctccattttttagttattatatttttacattatgtttgaccattcgttttattcaaaaataatttaaataaatattttttttattttggcttgatttatcaataaagaaactttaatcagtacttgtattattaagatttacataattttttaataagacaaatagtcaaagattgtaacaaaagttaacggtgttatatattaaaatatgagtgagaatctagactagtactactatttagggagctagaaattacgagagaagctataactaacaaaaactcttcaatcaagatcggactagatacaatcatacaatacactattattcttgttcttttcttttatagactgagttctaaactttaaatttaaactttcttgtttttcaaactgttaaacgatgtatttatgtgtaaaaattttctatataaagtttttttttaaaaagaaatcaaacaaatatatttttcaaagttataatagttatacttaattaatcatatgtcaatgagtttcccatgctgctaatatgctagtccgatatggagtttcaaacaaacccataggatcgttggcaaagctccagctccttcgggcctagccaaacagtttcaactccatccataataggagtggagcgagctaaagtagtcccacaatacgaactattgaggtgaagctttgcttaggatgtagttctatcaaatatgcccttagtcaccaaactagttgtctagcacacgtcttctggtagaattttaaatatatgttcattgaaaaatatagccgtacgaaattgtttcatcgtttactcatattttcttaacatgttaaatagtaatattttagtcattattattagtgattttgcgattttaaggtttaatagtatgtattctattttttttggaagggaa

SEQ ID NO: 83518 - DNA, 4969 bp, Oryza sativa
tttctcgtgtgttttttgcctttttttgccaattattttctcgtgtgtttttttgcttgttttttttcaaatgttatttttgttgctttttttaaaaacaagagaatatagacgaaataaaagccgtgtagtaggtggcaaaaaatcgatggatcctatccgactcagagcgatttttttaatagacggtgtttttttcttgcgcggttttttaaaaccatttgttaaaatggcgcgttttttctgacagttttttccttgcatgttttattttttaaaaaagttaccgatgatggaaataattttcctcgcgcgtttttttatttatttatggaagatggaaaacctttttagcgtgtttttttgcgctttttctgacttttttctcacgcgtttgtttgaaccgtttctattctctcgtgcattttttttaaaaaatagttagattatattagagatagagaagagatatatattgattagaaattttgccctttctatttttttcctgtgtgcattttttattttatacgaacaagcgctttatttttttacgaaccatttttttcgccactttcttatggaatcggacaaaattttttagattttttttctgttttttttcgcctttatagtaatctgactttttttcctgtttttaacggaatcgaatctagtattttttttcactttttttttgccttttataggaatcagattttttttcgttcggattacgcttttttttttgccacataggggaaacggaacttttgttgttgttgtttttcttttttttttttcagctttcctttttctttttatgcacctttctgcttttgttctctcttttattattatttttaacaaaaacggcctcaagtaccttattgcaagattataggaactcaaatataaatataaaaattatagggactcaaaagcaaaagtacaaacccaaaaattaaaatcatataaaaatggaatgctctcgacctgtaggttccgttttattaaacagatctctaatccggcacatcattttgtttcaccaagatatgtgagatatcacggtatagattaagaatcggatctatagtcggactttttttctgtttctgagagggaatcggataggagtcggaccttttttttttagcttttttttttacagacgaaggaaacatcttttattattttttaagtagtagagacagagacagatatagagattttttttcgcttttttgacatggaatcggattattttttcgcccttttttggatcggacatttacggttttttttctcgctcgtccgtttttttggggcggtttttttgtcgccctttttcacagaatcggactttttttttgcccttttttattggacagttacggtttttttcatttggtttttttcgccggttttttgtcgccctttttttcacggaatcgaattatttttttcgccggacagttacggtttttttttgcccagtttttttcctcgctcgtccggtttttttgacggacgatggaagcatatctttttaagtagtagagaagagatagagatatatggttttgatctcctgatgtgtgctgaataggacttggtacgatttaaaccaactcctgttcggttgatttacagccaatttggagtgttgatttttttttctatagtcagattttttttatgttatgctgaaccttttttagatggaaacttgttttttttgtcatggtggggtatcgaatcggttttccaaggcggttaatttttttccgtgttgaatagaaataggacttttttttttgctgcgcctcttttttttttgcatttttctgccctttttttaaattttatggtacgataggaataggaatcagatgattttttggggcgcttctttttttttttgccttttttacgtttttttttcgatttttttcctttttttgctttcttttttgtcggacagatttgttttttttccacccggtttttttccgcccaggttttttttatcggacttttttttttctccacgatacatataattcatttttctttggaataggacagttttctttttatttttttaaactctttttaccgcgtcgatgtagtcggattcgtttcggtattttttccttttttttcctttttttttgtcggacatatttgttttttttccgcccgtttttttttcgccaggtttttttatcggacttttctttttttcgctcggtttttttctcccgttttttgacggacgacagaagcacctagagaagtgttttttttcttttctccaatccaatacagatcggatctcttccagggaaatcagattttttttctccagggaatcgaactctttttttttcgctttttttattcattaaacggtttgtctctcggacttttttttccctttttaagggatcgggtgtttttttgccagggacgggtgtttttttcgcccggttttttttttcacttttttttggatcggactttttttttcgtccggtttttttatcggacaaacttggttttttctgcccggttttttttcacccggtttttttgacggacgatggaagcacctcttattttttaagtagtagtagatatatatatatatatataatgattcttttatgcaccttggataaccctttgtttcatgaatctatgaactggctgttgtatgaattggttgatgtctcataggtttaatagggtaaccctttgctccattggataaccatttatttaataaaaccatcaagggttgccccctactaaaccatgggccagagtggtcatgtggaatggtttaggtcaatccagaacctaaccattcccatcttgaaacataaccactcaagcacttctttctcaagtcgtgtcaactctagttctcgatacattctattcctaacagatcaaatctcacccacaacttcctcctataacaccctcggttagcaaatacaaaagtaacaagatgaatggggtggataagctttgtagtgttgattgggtctgtccatcattccacaccaactatttatggcaccttaggccatgtgcaatgggatgcttaggctgatgcctagagaagaaaaccgtatttacttatacaccatggttgtatccggctataaaatgtcctgattgaacacatccgttacaaggctctccatattgaattcctaatatagtaatgtatcccggggcgtctcaccatcaaaccaccaatactacgctcaactcttacttccactcgcattatttgtccatttgcacgctaattaagatattaaaaggggatgtatgatcaagggaaaaacattttttgtgttctgccacttagatgagtataggtttacttgtgagtatgcagtacgcaaggtgtagccatgtatatattggtacatgcagtgatttctactaaccagcgaaacaagggatgatatataaacaaccaatgggactcggatttggcaatggatgattggttaattaattgtgggctgtccactagaagacaagggacaaatagacatgcggctgtgttaattctttcagagagttcccaactcattaccattgttcttcgtgcgcacatttttcaaactgttaaatagtgtgttttttaaaaaaaagattatattgtaaagttgctttaaaaatcatattaattcatttttaaaaaattagtaaataattaattaattatatgctaatgagttactccgttttacgtgtgtacaggaggtgcgctttcagcctcaccaagctgctcacggtgcgtatgtggagtgtgagtgtgcaataaagtccagcccacaagataatgaaaaaaatagcaggctcaaaatgttgggctcgttcgcatgtcgtgcatggtgcatgcaacgctacaaagcctcaatctaagtttgggcctatttagagcttgtgataactgtaatttttcccaaaataaaaaattcgtccaactttttatcctttttatgggaatatatagatacagggtgcaaaaaagaaactttttttagggaaaaaattgtttttgagggaaactgcaaaaaagaagctataagtcaaaagttggttctttttttatcttttctagattcttataagctggatttctacgatctgcaacatgcttgttctgttcatgacaatcatgggtgtccctaagcccgactgagcaaggcgtgtgcttggcagtggtgggctggtggccatctgattattcaacttgtatcaactggaattgcatgcaaaattaaaaaaaaagaaaagttaatattgtttattccttaatagtcagaatatgagatcagtgttaagatagagccaggttaccgacacaaagtgatactgccagccattgttcatagatgacatatgtaagttgggagtacctatatatctttcgaaagattttcatgatcgtatcacacagatttttaatctttggattaaaatccgatagatataataaaaagcaaaaagcaattaagaaacaccataatggacactaaattaccatatcctcaagaaaaagaccaaatccaatacaaaatttaaaatttacatgcgaagattcaaaaattacagtgcaacttacaaaagttacagtgtaagttttataaattacactgtaacttataagaaaatgcactgtaaatttgagtgagaaaatcgagtgagagataagaaaaaatctttcgagtgagatatagcaaaatcgatgtaagtttgtcgtcaattgtcatgggtagtgggccgatgggtcgaggccctaaggataaggatagtgtcggttggataagattagattgggtcctccctccatcatctatataaggatggattgtatcatcattctaattaaacaatgaatcagattagtctcctccaacctaaatccccctct

SEQ ID NO: 83519 - DNA, 1261 bp, Oryza sativa
aattatcttaatcttgattaaaacactgaaaaagaggcacgcaactcctaattgaggcagtcataccactgacacatgatatcgaccaccgactaaccctcaagcaacaaacctaaacacgaaaactagcaagcaaacagactaagaagacgataaagctaagggcggcgactctgaagctcggggcggcgcttgcaatcgagggataggactgacatctaaagtagacaagggataggaaccaattcatgctcaaatccaaattaaacaaagcaacaaatgactcaaataaataacctagcatggtgatttttatgcatggaacaaccttttccacgaaccgagacaaaagacactaatgcaactgactaaacaataaattaatgcatagactagttgcatggaaaatgatgcgcataacattgccccatcgaacatagacacgacctaatgcataacccccaatagattcccgactgactgtcgaataaactccaaataaaattttactaaaaccctagactgagctaattttaaagatccgatccgaatgaacgaccaagattttttttcccaccaaccaaagaggcaaaccccaaattttcccgaaacaaaatccaagtgaaaaaggcatatgcatatgaaaaagggttcagagggctcctaggttttctagttggcttgccctacggtcaaggtcggctctgatgctaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccacttcacaggcaatccttgacggcagcgacgaaaccaactttgacaaaacagctccaactaggaagatcttcagctctggtgtggggaaaaagagagcaagactgagtactacccactgtactcagcaagtcataccggaagaggaggtatgatgcaggatataaccaaaggaggctaggggttcttttgcataaagatagcatttaaaagcagtagttgaaagcagtaaaacagttgtagcaattatcaatattaaccaaacactgtccaacgttacaccacgttgcaacaggcccaaccaaccacttgaactacacccgttcattaagctaaactaggggtaa

SEQ ID NO: 83520 - DNA, 10058 bp, Oryza sativa
gacatccagctcgagccgctgattatgaccaaggaggaggatgcgactaaggaagggcgcacaacgagagcatcgtcgtctgcaaaagcctcgcctcagctctctccaccgaaggccgtcatcttggtggagcaggaggcagtaggcatggcggcacaacatgatagtgcgtcacttgtgcccgcgtcggaggtgcaccatcagcccgagccggtggcaaccacctgggcaaagcagccatggcacaccgtgagccacgacgcgtcaccgaagccagcagcagcttttcctgtgatgccgtgtcatcccactgcgacctccacaacaaggcgacgacctctgcagcgactgccacccccagcgggcacatgttcccatcgttggtcttggcaacggcgccgtcatcgcttccctcaatgcagacggaggtaggtgcgaaggctgcggattcctcggtcaacgctccgatccaatccgcaagaggcacgatctctggaggttgttggattggcgcagctgctgcgtgggccaaccatggctcgatctgagcttacgggagatgccctcatgccccgacagttgtgggtggcgcgatttccgcgagatcatgatgcggcagcttcggagctgatttcggcggcggtggttggtgcggtggatggccggcgcccgcgcggtgttcgcggcttggataagaaggaagcacagcagcgccgtttttaccgtgtcatcgtcgattggctgcgctgcggcagagaggagctgcggataggatgttcgcctctgtttttaatgggccaacataacctttcttttgggctgttccagtggactgggcttcaagtgtggcagcccatgtcttggctgttgtgttggccaggtggggctaaccttggaaaacagatcagatatgcaatcaagcttgcaacgtgctgtggacttatcctttctctcaaagcttttggatggggtccacctgcatgtgttatcagcgagatagtatggtggtgcatcataatctttgatttatttaccctttcaattttttgcaataaagtaacaagccgagatgtaaaaggcttaagttatgttaggttttatttagaaagtcgtatgagctgctcgaaaggagggatgtagtgtcataggtagtaggccgagaggtcgaggccctagggataaggatagagtcggttggataagattagactgggtccttcctccatctatataaggatggattgtatcgtcattctagttaagcaatgaatcaaaattagtctctcccaacctaagtctccctctcatccctagcagccgtcgccgcccggctatcctcccggcggtgtttaccccctatgaaccctagcccataacaatttggtagagaaacaaggaaaaagaacaagcgcatgtgtcatacttaacatgatatatgcattgatatatgtcaaatatgtgggcatgagggttgaggacgtgcaatttatcaccaagtcaacatccaagaccataaaaagataaggagttccagtgaagaaattgtaaatttgatattttcagatataaacatatttttttcttgaaaaaaagagagaatataagcatagtttcaatatccaattgagaaatgcttaggtattccacacaagaaaaaataacttattgtttgatatttatttcccacaagaaaagaaatccatctggtgtaaactcccaacttagatcaagactattctggctcctttgctcggttagagaagagtgcattattcacccaagccttgttgatagcaaggggataactggaggcatttcaccaatatgctcaacaggttatctagtagatcataatgacaagaacactagatgattttaccccaaaaaataaaaaacactaaatgattaaacatattatatgtggttacaaataaaggctatattgccttctacatgaaagtcattatcatttctttctggggtatttcgatgacctgtaatgatataattttcatcttttgaaggttcaaacatgaattttccatggttatgcatagggaaaaattctgttataccagatatacaaacatggctagataatctcaatctctgatggctatattgtaatataaccatcaataatatttgctctatcatacttggtttgtgctcttttaatgcctacacaagagagttggccagttgtcaattgatggcttaatttggatctagatgtacttcactggtaatttcttcacccctacactccagtagacactcttattaaattctctaaaggagcaacaaagcaattcccatctgagaagatccaacatattgttttgttcccaacattcagtggaaaataaaaatgcatgtaaaatatagccagaggttgaattccattgtcatagaagagtatattgtagcaactgtaatatgaataactcgtcgcaagtattgttttttagagagaaaaatacctaaaagtgttgcgccagcttgtcttgacgcgcgcagcggggagggaggcggaggccggcgcgcggcgcggggaggaaggggagctgggcctggcggcggaggcggcggcgtctgcatcggcgcgcggggatggaggcgaaggccgtcgctggcgaagggagggaggggagccgggcctggcgacagaggcggctgcggcggcatctgcatcggtgcgcggggtgggaggcggaggccgtcgccggcgaagggagggaggggagccaggcctggcggtggcggcggcggcggcatctgcatcagcgcacggggagggaggcgaccggcgccggcgaagggagggaggcgaagaccggcgccggcgaagggagggaggggagccgggactggcggcggcggcgctcggtggcgtcggcgtctgcggaggcggcgccggtggcgtcggcgtctgcgcgcgcagcggggagggaggcggaggttggcgcgcgaagaagggaggcaggggcggcggcgacggcagccggcgccgagggaagaagcgacgcggaggaatgaaggaggcggcgtcagaagaagaagagaaaagaggaggagaggagaagagagaactgacgggtgggtcccacatgtaataaggtcaaatgagtaagggcaaaagggactttttgtgcttcagttaacaccgttagaagcccttaatataatagggtcataccatatctttaattttgaaaaaaaaggtcaaataagcaaagttgaaaaaaaagagtcaaattggtagttagcttttaaaagagggtcaaatacgcaattgccctattaggaaagcagggcccgtgacaaatttgaaaagtatgctgcaaaagaattacatgtgaagtgttgttgttaatggaatgatcgctcacagatgcagccaatgaaagactggagtcattttctgctgcatggaaaattatcacagattgtccaaccatcccacttgaagcaggattctgcacattatgtgcatgaacagtgttcttctgggaaattctatcttcattactcttgaaattcttgcaacccgtacatctgcagttctctgaacagaaaacactagctttgaagcattcacagtatttcttcagatactctgttctcttgcatttacacccctttgtatgtttacccacaatatcaccctctgctgctttgctctggaattgaaagatagaatgagtttcatacacatcatggaagcatatgttatacaagtacgcagctgagcatctcattggttcttcatatgagaaactttgccttaaatcttgctacgggctttttgcacccaatgactggtaactgctaaaatatgactgcactcaaacttagccaatgtgattgaatcataggaaaaataacaagaaaaacaaaataaagtggtaatgatatcatgacaataaattaatttctagcaatggaaaagacctgtaagttctagatgaccaaaaacaatgcattttgtgtcgctgttgctctgaacctcaaataatattcaaaaatagaatccaaggaaacaacatctaactgacttgtagacatgaaactttgtctaatgacataacaatgtatgaatttcagtccctggaaaataatatcggcatcgttaactgtgagagtttaggacaccaaagaagtctcaaaacttgagggtgccagtttcagtttcttggtgcaaaaaacgtagcatatgctctcaggtattttgaacttccaaattgtaaagtgacgacatgcacggttaacttaagagatatgaaatggcaaccctcaagcctagtggtattttaaaataattcttgggggggggggtggttgggtcttaacggagagggtagatacactttatacatttatttggtatggtggtacccaccaggtttggctgaaagccggtgtttatactgttcacaacctagtgtgaaatcgtcctttattataccttttgctcatgaacaaactaaacaggcaaacaattaacccaaaaatgcttataggctagctactagagaattagaatctgaatagagaaaacatgccatcttgcaaaaagatacatcatgccctacctcacagttgtgggctgtgctattcgaaacttttggcataaaagctgcaggattccgttccaatgcaacattgatagcatcatgtcttgcattctcatgattaacattgttgcaacagtttgtgcaattgcaaccaatgcagtatctgcctttttcaaagcactcacaatacctacaaattcagtcaaaccaaaagactagtatgtgtgaatgtgtgattatggttacaaacgaaaccaggtcattggctctagttattactaaaaaagcctagggccattaaccttgcaagtgtaaattcctcgcaagaaaaaaaaaggcttcacaggtaggaaggaaattgatcaatgatggaagcatgcaaaagttaaatgcagcatctcataattgcaacaaaccttcagagaaataggttgcaacaagcgttcagagaaacaggtaggaagggaaaagaagagatagcttgcaaaaatcaactttcaaccaacatgaaatccaactaagagttattaatttcacacaagaacatgtattctaaactttgtggttgaagagtgtctactgacataatatttctaacaaaaaatctacaaagcaataaaagcagcgccaaagttctataaaaatagtaacaacttgttttatatttatcaaataggaaaaaaaattatatggaaaaacaattcttatgcagcaattggaggaaatttattatggaacctacagcttcaggcatttcgaatacttgcagctgcagtttgttttccttgtcagtgtcacatcttttgtttcagaccacatatcgctagatggcttttgagaactcagcatcctgaagagacagaaaagaagacaatttacctcctttagtaaagtaaactcagttacgtaccatgtgaaacatattcattatctgctctcctaattttctcaattaatccaagaaactcatatatgcattagcgcaaacaatttgcaaacagtgaattatacaactttaaaggtatgcatcatactatcgcaaatatgaagctatcaatttcaatttcttcaacgaagcattccatctcactattccaagaaatggagaactcacacgtcaataaaggttgcaggccttggcaacaatggcctctccatcttcggtgaaccttgcttcagctctggggatacatgttgcggtgaccgccgctcctgcaactttgtgggcttttcaactggcaatacctctaactttggaaaatcttgtggcagtatggatgaagactgctgcacttgcagcttcttggccggaggtgggctaggcaatgacatacgacgcttctgggcaaatgttgaagggcatgtcactggaggccatagtggcagtgatgaatttacttttgccagtgggagctgatagcagggcggcccaagcgcatgcgagagcgctgccgcggtggcagcgatatctgccttggcagcatacaaggaagaggcaaaatctatcttcactgaccctggacgaagctataacggcttctccatttcccaccagttcctagatcccactctggtgccgaattaaacacctgatcagacaaaatcaatcctcttctccgagatcatctagcacattgcagacaaaatcaattgggattgatcagtactaaatatttggacctgaagtctgagcaaaatcgatcaaaactcacatgtaaatgaaacaaaagaagaagcgaggatgcacatcggtttcagtcattttgatcactacgaaacagtggcggatctaacatgggaaatggaggttcagttgaactaccccgaacattttgagaacaaacttaaggcaaatttctagaacagaagctagggttaacgcaaattcgagaagaaaaaggtacgcgggtagagagaaagagagagagagctgagaaagtggacgtgcatagccatggatggatgctcaccaggatacggcggaagcagcaggacaaccgacggcgcccctactcgctcgcgggatggatggggatcggcggcggcggcggcggaggcggcggacgaactcacggggagtcggcgtcgccgccgagaggaaggggaaacaccgccgcacgactatttcctttttttttcttttttttaaacaaaaataatcgtttttggctacattttattgcccatgatttatttgatcaccattcaactcgtgttttcactttagattggaccacccaactcttttcttatttaataaacatctagaaaggaagcccgcgcagatgcgcgggcatcttatttatatagtttaatgaaaacaatgttaatataagttatatcgcatcatttatacgctgtgaaatagaccgtagactttaatatataaaaatgataaggatgtctctagggttttaaatctcccactatagctgtttgagaaggattctagctatttgctctcatgtacaatttagccgctatagctccatttagcccgatatagctgcggctatagctgtaagctaaccgctaaatgccttaggccactatttaaaacattggatgtctcccatattaaaaaaaatcactttgttctggttgtcacttcaaactgtagactttattatatataaatgataaggatgtctcctatattaaaaaaatctgtttgtcatggttgtgacttcaactcattatcattgtttagaaactaagtacctattaatagataaaactccatatatttataccagtaaaataagtctaatacattattaatacactaaaatatccactgcacctaagtattcatgtctgacttattttccaatttgtatatagatatcctaaaaataccacttgcaccaattaatgggatatcattgttaaagtgaaacataaatgtccctctgctgggtgaagccgattgtagcggcaaaacttactttctctgtgtttccttgaaacatgggtcttgtatcgatatagtagtgcctctccatactagcctggagcactattttaatgcctaattcacaccacaccctcatggagtattgtatcgataaatagtaagcctagcacaattggcgagagtggtctccactggggttgcttcaactgacccatatgtatgcccttgctatacttatgttagcgtagcaaactctgctgtccatgcttggtgccctttagtaaaggacaaagagaagatgaatgcgatcaaaataatgtttttgttttaagttttgagtatatttatggtatagagtaaacaccatttatttgtggtgttaactattacttcttaaataattatgatatagataaaatattctctttcaaaaatgaccgaggttaataaaagattatagctaaagagacataccgccaggataatgttcagagcaccatcttattatttaaattttaacaaatatctatagtttagtgtttggtttcttttcaacacctattgttgataatcacatgagacatctttaatcatttggataatgtacttatttttttcaaaacttatttacaatatataactaatttgtaagagaacacttatagtcacgtcggtggcatatatcacatacatccatcaattatgtctcatatgttggaattcctcaactataaaaaaatataacatgattggtagtatgttgcacatgttacttgattattcatttgttgtcaaaactatttggcaaagaaaataaaatgtacatataaaatcataaatctcataatggattaaggtgttctattatatcaagatcattggatgaaaatatttttttatatctatgtatcatgtgctgctcacttctcaaataccaatcaagtagttatagaaaattcaaaaaaaactttgagaatcttaatctcaaataaattaaaattaaatcaaagatagttgaaaaaaacacaactaaattttgttgtttttatgtttttacatatgtagatttaaattagcgttgtatatttgttaagggattttttacaccaaaatataacttgaaattattttaaaaaaacatcatatcactaattattatttgtcggcccgatgtgtcgtgatgtatttatgacataatataacttttataatatttatttaattaaaggaatacaacaaagatcacaaattagatacataattttaaaataatttaaaatgtgaatgtttatagaccgattatatagatctagtttaacattgtgtatttgtggagtaatatattttatctctatattgtagaaaattatattttaaagaccgtcgatttttcttccaatggttatatgtaagtatgggttttttttctgccacgtggcactatctaatctcaccgccgattttcatttaattggtggacccgttattttaaaccattagattcattaatttttatttaatttggtggacccattactttaatctaatcattatttggtgtatatatatatatatatatatatatatatatatatatatatatatagacacacacacaataccttcccggtataaaagtgggaataccatcggaaaaaaatcaagtatgtctagtacgtatgattcgggaaaaaaaaagagcttacgttgtgtttgccccaagaaaaaaaaagcccgtgccaaaaaagagataaaaaaatatgtacaaagtatcatcggaagaaaaaataaaatataattttctaccgtataagataaagcgaaaaaccatatgcacatagtaccatctatatatctatctatctatatattatatactaaataaaatacattaaacctccaacaaacactcccaaaccgtcacatgacaccctataaatactctcaagtcgccacgtggcaccctaataaaataaataaatctaaccatcgatatttatttaaatcggtgaacccattattaatgtgaatgtttatagaccgattatatagatctagtttaacaatgtgcatttgtagaataatatattttatctctatatcatagaaaattatattttaaagaccgtcgattttttttccgatggttgtatgtacgtatgaggttttttctttatcgtatatggcagaaaattatatttttgatttttttatgatactatgtacatatttttttagctttattttttttacacgcgtggctttatcttttttatcggtcctaagacctaagctttattgtttcttccaaatcatattactattttttttccaatccaactatacgtattttcttttctatacatgaggaaaatgttaggtatatatctaatctaatgatgtccaccaattttaaaagaaaatcgaggatgtatataaatctaatctaatgatctaacgggttcactgatttaagtgaaaatggatggtgagattagacagtgtcaggtgacgatttgagagcgtttgtagaagcgtcatgtgacggcttagaagcgtttgta

SEQ ID NO: 83521 - DNA, 5118 bp, Oryza sativa
  unsure (1)..(5118): unsure at all n locations
tgcgataatgacggccgcatagatgaactagcgctacgtccacaccacgaaagaagaaaaaaaacgaaaaaaagggcgagcagcaacagatggccaatccgccgctaccgaccgccagcctcttggctgcacgcggagccgatcgcccgcactgatcacctgtcccggccgcttgcggcaccgccgcatgctgtacggcaccgcaagctgcctcaccagctcatcgcttaccaccgccactgctgtagcaacagcacagcgcgagcgagaaaccctaacgaaagaataggaggggagaggggaatggaggttgaaatatctgaccggtcttaaccgaacacaaattttttcataggccgggatcctttccacaccgggttggtccacgggggttgggtcatgaccccggccgttccgggtctaatcgaacatagccttatggaattagaaggcttataggtgttggcaaaactaaactaaggtcagggctatggcctaagcttatggcaaggtaaaaaaaaattcaaaacaatttattattttttggtttatcatgtgttcatttatatatcttcttccatttattccctttattgaaatatttgttgtggttttgaattcatatggtcttttatgttttttatcctattatgatgaatcttgatatagattggtgttcacaaacattttgggaaaaaaattgttactgataaggttttattagtgtttcacttatatgggtgtagtacaacttatagcaattatccgaagtgtcaatgaacctctattttaaaagataggttcaatgtgggctttcattttgctataaaccttgttttagattgtgtgggtgtgttatttataaatgcattcctgattttacccgttgtcatggagtttgatcattcgttctgattgttgtcatggatactgattacgatcaaatattgaatattgccttgtttattttatttcttgtacaatgtgaggcatgtgttgatattaatcacttacaatttattagtatatgcacttttagcttccttagggccaaaggtcaaacagaacattcacttataatttattttggcacaacatttatatccttaacacatttcaaattttaagtttcatgtcttagggttaaaagatatgaatcatcacattttagagttacgagcactagttaaaacatagataaacacaatttttagtgtggttaataattacctaatttggtatattttgcatactgtgcataaaataaacttttgaccaattttattcctgtttcaacagatagatcagcttgaattcacaaaattttagaaacaagtttcactcaatttggagttgatttgaattagttataaattttcttaggttaattcacttttttcttcattgaaataattataagtgtattacgcctattttttattcattttcccgaattagttttctaaaggaaaagtccccttacactgacaggtgggtcccagtcattttattaaagaaaatattatttttagtagaaaatgttgaaccatggtgacggtgaaactttaccatcaaatggcaatgggtccatgtgccaggaacgagagtttctttaccaaggatctggtcctagatgtcaatgtcccaaattttcattaggacatgagcatttgcatgagatattgatcaaaacatttcctggtgagctccttatatcatacgctcttttcttgggaaacttttattgcatagcgtaccggatgagactcctctaactttatgcagttggggctcacatgtcagtggcataactatatatttacatatatttacattgtaggaagtcagcgatccgtttccaacagcacctaagctgagagccatccgatgagcttttctattcgtgttgtacttcatgcattttgtttggcgcacggatccgatgaggcgacgaggcaacggcacatcgacgcgatggtgcgcaagcacaagtgcgactggttcggcctacctcgaagcagcaacgtgctggcgcaggtctgcatcatatgcgacgtgaacgcgatgcaagggaggagcaagtaagagagagcggtggtcctgcgcggcttgggttagggcacgacgggcggtacccctcaagcactgcagcagggtgcggccggccggcccgggtcatcgacagaaagctcaacagagcagggtgtggtggcggagcttggcgagttgcccgcacggtgagcacggctgccattgctggtaggaaacgatggagaaataaacgattaaaaacaatagatcaatcacagaagacacgagattttaacgtggaaaaccctcctaaaacaggagagaaaaaaccacgggcgctagcaagcaaaatatcttcactatatctagggtgaggttacatcgcggtacggcggcttacaagaggtatatatatatggtggaacctaaaagggatgacgatcggtctccagcctccactacgctccggcccaagccttcgggggacgggcctccgctccattacagaaagtgcaaatgaatttgaatcacaagtcaacaattgcgaggcggccctattggctgggagcctgcgggcctacgggagctgtcttggttcgcttggtggcctgccggctctagtgggctgtttggcctattggctgggccattcttgtctagccccactgctccggtaggcaggcctggtagggacaaggggaggaaaggatggatgggtttgttgacataaaaaggaataagttcacctgtgcttcctcatcttaacatcgagatttttttctcttaacaataaaaaccagaaatatatacacctaaactcaaacaaatagtcctatgatagtatggggcccacatatcttatttctaccagcaaaaccacccatatatactgcttaggatcttgattgcacgatttgtttgagtttagggatactcatttctggttttatggttaggggacctcaaaaatctcgctgttaagttgagggaccttcggtgaacttattcctcatagaaaaagctatgaggttggacctttaaaattgatttctcgatttagggaaatattttacctcgatagtgatgagcacgggttccgatcttgtaaagataactgttgatttagcaaaaacatgatacacattacctcacttcagatcaatattatctgaaccctgcaatcgtagaaccatgtcccctttggttatcatttatctcgccgagaagactaatttctacatgtgaatcgaataatacaagaaaaacatggtagattaaaaaaatattgtttagtttcgagtttacaattcattaataattttttcttcattgggaaaatttaacatctcggtgtaagatgaatattatatgttcaaaacttgtcgtcaaaaattaaaaacatagagtgaatctttgtccggtggagggatgccaccaccgccttgacatcggccnnnnnnnnnnnnnnnnnnnnnnnnaaccacctaggccacttctccatgactgacgccctcgaggcctcaccgacaatgaccgactatgtggctatgcggccgcactccttgctccctatgcggctatgcctcatccttgtgacgcaagagcgattatgttgtgttgttaccgtgctctctcatgtggtatgtagagcaccatccttttcaaaacgatatctcactcatagaacataaaggtcgtaggacaaaaactgatttatatggttggtctattttaaagataaaatattgttgggctgggcataattcttttattttattatataaaactaaagttacatgtggtgtttgaatctcctgaagatgaagatgaagttttttacgcaaaacgaggtggtaataacgtgtgattaattgagttttaattattataaacttggaaaatgtattaatctgatattttagaacaactttcatataaaaaggtttcgcatgaaacacaccgtttagcggtttgaaatacgtgccatgaaaatctttatctccatccaacttttgttggactaacgaacagggatatttacattgcacaggacgcaaggttcaaggaaagatgtaactaattgtccacagtgttttgtaaattgttcttcattggttcattccatcagtatgtaagagaacggccttctttttaaatctctggaaccatttttttgtggcacatcccctggaaaattaaatctttcatatgcttccaaatatgccatctaactagcaaaaagacctgcataaaacctgttcggttgaattgcattcttgcgagtaacactaccagaaagaagtttaattagatatggtattttctaagtattattctgaaaataatatgggattgcccgacctttatgtagaatcactccacagacctaaccacgcaatctgtgaaaatgtgactatggaaatgtattcctctgacattggcttaaacgttgtagacgtgtatgtagttcacttcatctctgccgttgaagcaatccgggggcattccaatcctgcatcttgccttctgtatcatgcggctcagtagcgcaccacgccgccagcaatggaaggacaaaatctaattcgtgcgctctctctgtattgccctatcgcgtgacatgttcaccggccgtccgcccgatcccacaagcactggtgcgtccgtctaaaccacacatggcctggcgattcacgtatgtggcattatcgagaagaatctgaatctgaagccatatgatgctctaggctacacctgcgagagggacacatccacctatacacctctactttaaaaaattttttttcttaaactaatcatctgatctacgatctgattacaccgttgtgttcgtaagaattgaatctttataaaaagatctcacatgattatattttgataaaaaaatataaattacttttataatatatctaaattacttttagatttgactaaattacttcttggatccataaaagtaaattcaataaagcctaaaagtaatttacatatattatagaataaacctccacacaaaagaaagtacctgtcatgacattaaaagtaaatccgtatgaggtaaaacat

SEQ ID NO: 83522 - DNA, 7595 bp, Oryza sativa
aaatcagtcagaattttgtctttttttgttacaactaaaatacaatgaatttgaagataagatttcacacgtaggtgtaatactattgaaaatatatgtccaattttttctaaaattttctgtgatatttgctagttggtgtgcgcattgcacatgatatgttcctttttagacatcatttatttgagagcgaagggatgctctgctgtgaaatttccgtgtatgaattgttcgttgcgtgtggataagcagattgtggttcacattctaatttctcccaaccggattttttttccacaaaccgtttgtggagtgacattatgataaacggtgtagtcatggcatgtagtgtgttgtcaaactgatgcattgatgagacgtatagaaaaagacgtgttatatacgcttttatgcattttgtgttattgatgccgataaattgggaaaataccaccgactagtttgacttcgttgagggttgagctgagattctattaaatgattgggaagtgtacagcgactatactgacaacgatcattggccatgttgtttgctggcttatatttagtttggaatttctttgttttcaaacagatttaatcaaatgtgcacgtaccgaagggagtaacttttttttttgtcatgaaaccacgtcaaaatagcacccatcctttttcagaacaaaaaagcagctattacaaacatatatatttgattgctgttagattggtacaaacaaccacggaacagaaacaacggtaccaaacaagatttgctacaaggccgacttcccaattttgaatgcaatcacttcaattcagcaaaaaaatcgctgaaacaaatggcagacagaggggtgttgtgttgtacatcaactgacagatacttcatttccttttggtttcgtatcgctcgtgcatacagtgtgtgctgcttaggttgttggtaacactgatgaagaagatgtgcggtgaaattggcaccactttggaattggtttctgttggacaaaaggatttcctcacgatctggtggtcgatggcttctccacaacaagtgtaagtaacaagaatgagccgaaagagatgatgagcgcaatggccatcaagataagcatggcttgtagcgtgatatttgggctcaggaagaagatgactgcgatggcacccgattgccaaaccctccactgtgcaaaagctgcctcctgcatttgacatttttccaaaataaatatttcagtatccatttaagcatcagcaattgaaatgtgattcattatatttttccgtcatcgataggaagaatgctactgtgcagatgaaaagctgaagaaaactaaaatgagactaccttgacatcctcgaacagcagcccaagtaatgcgcttaactgtgtatgtaagacaccatcaccaacaccccataaagcacctataaacagtggaactgccgcaccaagcaatccacccattggactgtaggcagtagaaagatgagctcattgtgataccaatggcaagcataactgcagaagaatggtacaacagcacaatgatgattcatgaagccaaacctgtaaaaaagaagtaaccagaacaggactacagcatgaagaatagctccaaccgaaacgatagatgtagctgaatgaagcccagaggtcaaacgtccagcaaccaatgcacactgcagtgtcagacaaccatcaaaagtcagctaaaacataaattatggcattttcaatagtttagcatgatatagattagttatagatagctgggaaacaagatatgccatactttcacaaagcaatagcaacagtaggaccctagggaaacgataatctagagttcagactgaaatgccaccaggatagtgctaacaactttagtgatttaaacttacaacagcatcggctgcaccatatattgccatggctccgccaactccagagacgccaagaacaggtgttacaatatttttagtgaatacagccctaaaaattacacagcattatctcacagaaaaaatattaataaatcaaacagcaaaaaaatgtccaaaagcaatttgtgctactaagtgcttaccatacaaatgccgcttgtaatcctgaatatactataagagggatgataagaatcatccttcggtccttgagaggggcaacaatatacttcatcatggccccaaatgaggaatgtgttggagcagtatttcctttctcatcccttttggaaagtaaacacattaatacaatgccgacaatcatgcagccaagaaacacaacaaacagcagatttttccccgtgacacttcatcctggagtaacaaggaatcacatggacaagcatgattgttattaagaacataaaaggtttcaaaatttatcaaaagtcatacagaccttaactagtatattgatcaacagcttgaacaaatacttttgagggtttagacttctgagtattgctaacctcaggagtcaggacattttataatagttaagtccatgggaaattagagtaggactgctaatattttagatatttattttaaaatgtacatctaaatgataaacattaagatttattttcggtagtgctcattgtgattcttctatagttgtcttgtagtgtgctgcaatatttttgtttgcgatcattattttgttacaactaatatactgatgcattttgagacaattttggcataatgtaaacctagcagaattttgaattgggtatagaggtataacagaagtttccaggatagaataaaagaaacaatgggactctccggttaatatcaaaactatattttctcttactacaacaaatcatgatgctaaaagtacatctcatgaagctcactttagttactagttagcagtacacaaatcacaatacataacaaatgacagtctaggatattctaataagacatgagaagatcaaaattaagatgctaacctttccatctctcagtagtgcaagagagatcagatttccgatgacctgcataattcgaatgttgtattaagtcatagacaccttgtatctgtagagcccacatgtgcagaaagaaatactagtagacgctgcgcttgtggtatgaagaacgaatactaaaatatgtcttggcaagttttggtggagaatagctttgtacgagtacgaccagtcgaccatacctgtgtgctagcaaacattccccagaactctccattgaagttccccaaagtttggccttcaggcaaattattgtctcttgcatgactgagggcagcagacgtgagatatgtaccctgcagtgtgagatatattatgtgagctggattactggatgcaacagaagacttcacaagctcactggcaagtaaatacctgcccaacccagatgatcgatgcagaaaaacccagatacagggaggctggcaccattgtgtacctgacaatttgttgtgcaaattaacatccatatatagaatctcagcataccttaaatataatgtattcatttttaataatattttgcacagctgaatcatttagtagtatattagaaagcacatcaactagggccaaaatccatcggccatccatatcttttgagagtgctatatataaaagaaaatgaaacatgttgctggtaaatagtctagtagaaaacttgtcgatagttttaactaggagtaattcgctacatgtgctacttcagatttcactctcagctacaccaaaaaagggtaacacagcatttgattaccagaaaatggaaatgccctccgtccacaaccaaacactcaaaataaactggtgagaccgcatcccgaatcaaacatgagctacacactacaccgccaaattaagactatatgatcgattaagatcagtaataccagtgtctgagcgaaaggagcatcatatcaacacggtctagctagctaggcatttcatcaaacaggcgtgaggcatccaaaccagcacgcccaattaggcaccagcgctaccatgcgcgggacggtccatgtgaaaactcaaaaccatgcgattcataggcgagcgcacgcaccatgtcgggacgaggttagcgaggatgaagatgacgtagccgctggtgccgacgacgagcgcgcgcttggagccgagccacgtgaccacgggcgacgcggtcaccgcgaagagcgtgaaggaggtgtacaggatccccatggacaccgtgcccaggtcgccctcctgcagccagcatcacccacggatcaggaaaggcggcgatcgagatcagctcgagaccgatcgccgacgacgacgaggacgacgagagatgcacactcacggtgttgaccgagctctggaggttctgcgcggcgcagtaggcggagaagatgaagaggaacgcggcggagaggacgtgcaggtcgcccgcgtggctccagcggtggcccgagtaacccaacggcgcgacgccggcgaggagcggcgccgtggcacccccgtcggcgccggcgccggccggccgcctcctcatcgccttcgtcgtcgcggtggtggcctcctcgcgcgtccatggcccgcggcggcggaggcggaagcttctagaagcgatcgatccgcgcggcttgagggttgaggcgggaagcttcttctagaaggttttttttttttatatagatagaggaggagacgaggaccggcgacggcgaggagagtggagcggaggcggcgaggtggggcccacatggcggtttgtacctacctgcatgtggggcccacatggcgtttccttcctgtccccgcctcttcttgtcacttcgtcagtggccttcgaagattctttttttcttcttcacttctatttttcaaatatgttatttgaatacggagtatatggtattcacttgtttaaaagaaatattaaaatattctataatattactacatccgttcaaaaaaagactgcagttttacatattttcatatccaacgtttaaccgtccgtcttatttgaaattttcttatgattagtatttttgttgttattaaatgataaaatattaatagtattttatgtgtgactaattttttagtttttttataaatttttcaaataagacggatggtcaaatattgaacacataaaccctcaactgcatttaaaatgtgacggaggtagtaataaaattttaagggctaatttataaaaaagtgtaaaagaatgttgaggtggtagtgccaccaccatatttttaaaggagtatagattttgatgtgcacacgaacgagagagccgagagcaaatcaaaatcaagaattgatttgcgatttgcgttgtttttcttgttgtggtgcaggaggatgtggggtagaccgatggagtgtgtgggtcccgttcgtttccactacaaagagtggataaatttttggatattcgtgatattttaaactactaaacggtgcgtttcgtgtgaaaactttctatataaaagttgttttaaaatatcagattatttttcaagtttgtaataattaaaactcaattaattacacattattaccaccttggttttgtgtgaaacacttaatctttatcttcatcttcatctttagaagattcaaacaccacctgcgttgtttttttctccaacaaaagttggataaacttttggatactcgtagcacgtttttcaaactgctaaacggtacgtttcttgcgaaaacattctatatgaaagttgttctaaaatatcagattaattcattttttaagtttataataattaaaacttaattaatcacacgttattaccacctcgttttgcgtgaaacacttaatctttttcagaagattcaaacactaccttagtgacgccgataatttgggaaaatattgacttcgttgaaagttgagcagagattttattaaatgattgggaagtgtacagcgactatatcgacaacgatctttggtcatgttgttttctggcttatatttggtttggaatttcttgttttcaaacagatttaatcaaatgtacacttctggagcatcgtttcgacatatttgcaaacgaaaagtaatttatgaataaaacttttatatacgtgttcttaacgatttaaaagcaaaggcagaaaaataaacttcgatgaaaaaaaatctcaaaatcaactctaaatttaaggttgaaaattcaaattttgactgataagcataagcataagaaaaagatgaggcccttcatatattaatgaccgaaggagtaaccttcttctttttttcatcaaaccacgtcgaaataacactcatcctttttcagaacaaaagagcagctattataaacatatatatttgactgatgttacatttggtagaaacaaccacggaacagaaacaactggaggaaaacagattttgctacaaggccgtcactctaattttgaatgcaatcacttcaattcagcaaaaatcgctgaaacaaatggagtcagggtggtgttgtgttgcacatcaactgacagatacctcatttccttttggtttcgtatcgctcgtgcatacagtatgtgctgctttggttgttggtaacactgatcaagatatgtggtgaaattggccccactttggaattggtttctgttggacaaaaggatttcggatttcctcacgatctgacggtcgatggcttctccacaacaagtgtaagtaacaagaatgcgccgaaagagatgatgagcgcagtggccatcaagataagcatggcttgtagcgtaatatttgggctcaggaagaagatgactgcgatggcacccgattgccaaaccttcaactgtgcaaaagctgcctcctgcatttgacatttttccaaaataatcatttcagtatccatttaagtatcagcaaatgaaatgccatatattatatttttccgtcatcgataggaagaacgctaccgtgctgatgaaaagctaaagaaaactaaaacgatattaccttgacatcctcgaacagcagcccaagtaatgcacttaactgtgtattcaagacaccatcaccaacaccccataaggcacctataaacagtggaactgctgcaccaagcagtccacccattggactgtaggcaatagaaagatgagctcactgtgataccaatggcaagcataactgcagaagaaaggtgtaacagcacagtgacgattaacgaaaccaaacctgtaaaaaagaagtaaccagaacaggactacagcctgaagaatagctccaaccgaaacgatagatgtagctgaatgaagcccagaggtcaaacgtccagcaaccaatgaacactgcagtgtcaggtaaccatcaaaagtcagctaaaacataaattatggcattttcaatagtttagcatgatatagattagttatagataactgggaaacaagatatgccatactttcacaaagcaatagcaacagtaggaccctagggaaaggataatagagagttcatagtgaaatggcatcaggctatgctaacaactttagtgatttaaacttacaacaacatcggctgcaccatatattgccatggctccgccaacgccagag

SEQ ID NO: 83523 - DNA, 2129 bp, Oryza sativa
  unsure (1)..(2129): unsure at all n locations
acgcgttgacccgtcctcacnnnnnnnnnnnnnnnnnnnnnnnnnnnnnnnnnnnnnatatagaaattaaattaaatcagcataaattacgtcattaactaaaaatgattataaaataaacaactcacaacattataaatgtataagaaaacctatgcttcaaataaaatgttctcttaacttacttatccgatctttgatccgattataccattgtgttcataacaattaaatctttataacgtgatctcacatgtttattttaataaaaaaatataaattagttttagatttcattaagttgaatcttagacatataaaaataaattcaataaaatataaaattaatttacatatattatagaagtaacttaaaacaaaatgaaggtaacatgtcacaacattagaaataaatccgttgtgggggtaactatgatatattgattaaatctaatttctggatagatttatgtttttacccccacaatagatttcttttaataccataacaagttactttacttttactttttgttttaagttacttctataatatgggtaaattacttttatgactaagaagtaatttaataaatctaaaagtaatttagatatattataaaagtaatttatattttttataaaatataatcatgtgagatcttgttatagatttaattgttatgaacataatggtgtaatcggatagtaaatcggatgggtaatctaagagaaaattccatgagaagaaaaagatacatgcacttttgagtatacaagtagcaacttatatgagattgaggtaggtgattattaccaaacagagaacggtctcgttgtagacacgttccaatggaagaacagacacaacgatggcatttttgtttacgatcggtctttccatactccctccgtactcgtaaaggaagtcgttttatgataatatttaaggtaatctttatgaatataaatcatgaataactctcaggttgttgagtttaaaaatgtaaaaattatatgaatagatttgtctcgaaaaatactttcataaaagtatagatatatcacttttcaataaatacttttatagaaacaagaagccaaagttgtgttttgtagaccgtatcgctatccaaaatgacttcctttacgagcatggagggagtattttttttgaataagttcactttgactcccttaactattgtcgaatctaattcatatccctaaacgacaataccagatatttcgacccccaactattaaaaccgttaccatttaactcccacgacggttctggagagcggtttcgctgacgtggcgcctatgtggcgatgttgacatggttttattccacgtggcattgacgtggcacttaccgggcattataattttaaaaatatgtgtggcatctgtttatcattcatgaaaaaaaaaaactggggggacacctcgatgtgaggtaagcacatctcatccaaatcgatcagcagaaatctctaactggagaaaccaagccggcggtgagtatttcacggggccttgctccggcaagaacttgtccaggtccccggcagccgcaagccacttgccgctgtctctgcatggccagcagtggcatcgccgctcctcggcttcggcggcggcagcctggatacttgttcgcctcgtacgatctggagcagcctcgcgtgacgaacagcatccgcccacccagcgacgaacaactccttccaagcgtatgatgcccgtggttgttgatgggattccacggcgaatactcctccgcgccaccaccgccccagcgcacgcgacgccggcgctccctcctcttcagcggcggccgccccttcccggggtgcccccacatgcgcgccttctcgacggcggaggcgcgagaggagatcgaggccgccatggacagcaaggagaccgtctacttcgacgacgtggccgcctgcgtgcacgatgctgccggcgagacgctccccaccactactacatgaaacatttttctggacacaagaaaatgagagatggacaccagtnnnnnnnnnnnnnnnnnnnnnnnnnnnnnnnnnnnnnnnnnnnnnnnnnnnatacctgcntgtaaacttggccccgtcttt

SEQ ID NO: 83524 - DNA, 849 bp, Oryza sativa
acagcctaagatcccaggtaggagtaaaattttttacctcgtcacatttaaagtctggacacatgtatgaagtattaaatataggaaaaaaataattacacatattgcgtgtaaattgcgagacgaatcttttaaacctaattgctccatgatctaacaatgtggtgctaccgtaaacatttgctaatcacggattaattaggcttaataaattcgttttgcagtttacatgcggaatctgtaatttgttttgttattagtctacgtatagtactttaaatttgtgtccgtatatctattgtggcacgcctaaactttttacccctagatctaaacacaaccataaaatagaatagaattgaattgcgaaagggcctgtaacttagtgtttacaagagccttagtagcaccttaggtccggggcttgactcctcatgggagcgaattttataggatttaacggctctgtgctttcattggtaggcgacgtactcgtcgacatcgaggtgcctgtggtgacttcgtcaatctctaggatttaccggcccagtcttcgaagatgctcataggggtagggtttatgtgcatgcgttcgtaggggtgagtgtgtgtgcattgtgagtaccagtgttatactgtgtaattttaaaaaaatagaattgaatttagagggtatttagatgcaaggtgtaaagttgttcatagggtgtttgcttcagtaaaccgcgagacgaatttattaagcctaattaattcgtcattagcacatgtttactgtagcaacacattgtcaaatcatggaacaatcaggcttaaaagagttgtctcacaaattagtcgcaatatgtg

SEQ ID NO: 83525 - DNA, 2057 bp, Oryza sativa
  unsure (1)..(2057): unsure at all n locations
cgcgcgcttgtagatcatacaacnnnnnnnnnnnnnnnnnnnnnnnnnnnnnnnnnnnnnnnnnnnnnnnnnnnnnnnnnnnnnnttcatgcctcttatattccagcacagcacattccaagatttaaaaacattacgcatctcgcgtgacgaacagcatccgcccacccagcgacgaacaactccttccaagcgtatgatgcccgtggttgttgatgggattccacggcgactactccttcgcgccaccaccgccccagcgcacgcgacgccggcgctccctcctcttcagcggcggccgccccttcccggggtgcccccacatgcgcgccttctcgacggcggaggcgcgagaggagatcgaggccgccatggacagcaaggagaccgtctacttcgacgacgtggccgcctgcgtgcacgatgctgccggcgagacgctcccgaccactactacatgaaacatttttctggacacaagaaaatgagagatggacaccagtccgtcccccgcacaaggaaatatattttcgtgtgcaggaaaataatccaccccacacgctaccatccttatcctcctccccatcctcccatcatgggcgcgcgctgccatttcctccccatactgccatcctccctctccctctccctgtccttctcccatctacctgtacccctctcctcctcggcgacgccggtgcactcggttagggtggcggaggcggcggcatcggcggccggggtggcggcatcagctaccgtggtgttggcggagcggatccgtctccggccgacacgtggaggtcggatccatcgctggccgccgtggggaggccgggtccatggcctatcaccgctgggaggccggatccattgccgactgctgcggggaggccggatccatcgacgaccgccgcgggaaggctggatccaccgcctgccaccgtggggaggctggatccgcggcctgccaccgtggggaggccggatccatcgtccgcacacgattttcgcgtgcgggtgcgtcacccgcatgaaaaaatcgggattttcgcagacgccgccttccagacaggtggaagctccgcacgcgaaaatcgattccacccgcacggaaaaatatttcatgtagtagtggaccttcgagtccctcgcccaccttcgaccttcgagtccttgttgggcggcgacggctcgtggcagtgggaggaccaggggaacggcggcgggatcttggtggttgatggtggtggcaatcagatgcgatataggcactgatgcggtagctggcgacgagtggcacagctcctcattgccgccttccgctcctcaccagtgccttccgaaggaaagagaaagggagagagaggggggaggatgaaggaagagaagagagcatgatttatgtgggacctacacatatttttttatttttaatgccacctaagcaccacatcaacgccacgtggaaagaagaccgaatcaatactgccacgtagatgccacgtctgcgaaactaccctccaaaaccgccgagggagtcaaattacaccagttttaagagttaggggttcgagatatccggctttgtgatttatggtcacagaatagatttcgatcactttcgagggtcacaaaactgaacttattcctattttttccggccttgtgagaacggatgttttgggccgaattcaacgggccagcagcgagtggctgcaacacagcatgggtatccggcccaaaatagacaattttttttatttttcttaaaagttaaaaataaattgtgtgaagtttctatactttgtttaatgtttctatatgaaaatgcatatatacaacatttgtatgtattatgagttgggccataaatgggctgcacatagcttgtgggcaaaaaagactaaccaataatttagccgaaagagggaaagtgttacaagtaagctacgttacagggggaaagtctacggtatgttcttnnnngnnnnnnnttncnnnnntnnnnnnnngnnnnntncaggcgttntcaatgnnnagcaatcaagggccgc

SEQ ID NO: 83526 - DNA, 11845 bp, Oryza sativa
gaggaaggcgaagtcgcgaagacggcgtcggaggagacgccgaggacgcggaatgatgcactcggtgttccacccccgccgtgcccgctcgatcatccgctccagcaccggcgacgccgtgcccttcacaccaaacccagaaacagaaaaccatcagcctcaatgcaaggtcgtcaagaacccctgatccatccagaattcaccaccagtaacagagaagaaccagaagtccatcttacaagaacgaaggaatgtgtggcgatgctcttcccatccgacgtgacgacctgcacgtcggcggccaccgccggccggagcacgtccagatccgcccaccgcgtcatcgatcagaaactcccaagaatacccaaattctcttgatcaacaattcgactggccggctaaccaagaaacgatctactgaaataagggagggaaaaaataagagggctgccgccgccgccgaccccgagggctgcgacgggcggtccgccgcccgcggacgccgagagccaccgccgctgacgccgatgaccgacgccgcgcggccgcgcagagccgccgccgcctgctccctgctacgctgcccgcgccggccgccgacaagccgagagccgccgccgcctgctgggccgccgccgacgcctcggctgccagcctaggccctatggttctagcctgacttgtgctctgcaagtctgcagtctgcccgataagtgaaaaagtaagaggggaaaaataagagagggaaaatgagggggaaactaaaataatggagggaaaaataagatagggaaaatgaaaaaacaatgagataataatgtatatggcttaatgaacacaattagaattgacataatatcataaataacttgagacaataaaattgggggaaatatatatatatatattaataatctgaatatatagttgttgcctcgttaaaaaccttacgccctagagtagggttcccccgtaaggaaaaaagagtacaacaactattttacattatagcatcaattactccggatcaacagcaccatcatctttggtaaggcaaatttccgccaatgcgtcttccactgcatcggcaagctcttgatcatctagacggtgttgtgttcgttcatctgctttcatccagtctttaagacaaaagattgactcaaccgtctcgggtgttaggcatgaccttcgttcttcaataattcttccagtagcgctgaatgcttgctcggaagaaacggaggaggccggaaccagaagaatatctcgagcaaagtgagctaacataggaagagttcgctctttctctttccaccacccaaggagatcgacatcgtcgccatcaagcgtcggatcatgctcagtatgatcggtgacgaggtagtggttaagctctgaatccgggttccatgttgatttgttctgtgaggatggagaggcttggtccttgcctgtatgctgcttccacaaatttagtgcacttgacttgcttgctttcttttgtgaggtctgctcaggaactcggggagtaccaccaagcttggttcggtacagacggaaaaccctatagagctcattattgacatgttgaaaagcttcagaataatcaagccccactgcatcacctattgagttcatggcaaccttggcaatttccaactttttgcgaggatcaagtatcaaagcaaagcaataaaggtgaggtatagcggtgaagtatttgagaaatttttcttccatgggtttaacaatggaagacagaatacgatcagaccggttttcatccaaaacaagtgccagcttccaaatccactcaagcaccaaacaagatgtaggatagtaaattcctgataattgaactgtagcattataaaagggcttcagaaatttacgcacacgtgtagcaatctcccaatcctgatcggtgagaatcaaaatctcaccatcaccgtcgtcatcggtatccttcattctgacatgcatcgaattgatgaaaatagaaattaactcctcatacccttttaattgtcgcagcaacaggtatgttgtgttccacctatgtttgacatcaatgccaaacatccgtccaggtttattcttcacaatgccaaacatccgtccaggtttattcttcgctttacagtagtcttggaacctcgctttgaccactgtgttacctcctatgatacgaacagaacggcgaattttgtttaacaatttatccagaacaatcatgcctgcaaaaaaataggtcgcatatattaaaataaataagcaatatgccgcatacactaaaatcaataaattattaataacattagtacctggttgaacgatgagattgatgacgtgacaaatgcatctctgatgaatgacaaagcctccaacataacttcttagatccggctccaaaatcgacatggccgttgtgtttgctgatgcattgtcaagagtaatggaaacaaccctagattgtaaattgatttctctcaatacctctaggattatcgtggctatggcatctcccgtgtgtgacgtcatgagtttgaaccctatgactctcttattcaacgaccgattgttgtcaagataatgaagaacaacactaagataagatgttctttggtgttgggatgtccagatgtccgatgtcacagcaaatgaaaaactagtagtactcaaagtttgcttcaacacactcaacttagaacgatatatagctgtaatatcgttcttggtggttttcctagaaacttttttgtactgtgggcaaaaagctttttggatcattctctcaaaatgtttgctttcccccattctaattggtagatcctcagcaacaataaacttagcaatctcttctctagctatttttgaatcataggtccatgtacttactgaaccgtcagggccgaaggacaaatgtgtctgtcttgctcctgccggcgccttgttcttgagatgcgccaagtaatgccggttgagatggcctgtccctgaagaagtagctgcagacaaaattttttcgcaatatttgcattgagcacgaggtatacttttaccgtcaaccatctcggtgaataattcgaagtgtcgccaacactccgctcttctggcagatggctggttatcggaatttggtgtgggcaacgtcgtggcgtcgacgtcgacggagaagttggcctcgccaggagatggctgatcaccgtcatcgccctccagaccatccatgtggcgatcatccatcccgtagtcgtccatgcccggggatagctgccgggcatcgaccgacctctggtatggaccggttgtcgactcgtgttgacgctttttggacctccgcatattttctatgaaaaatagatacggtggggagatgtgttgaaagaagaagaagaagtgtgttgaaatcagaaaataggtatggtttatatagggtatgccagggccggtccgccggccggcgacgcgtctgaacactgaactgatctgaacgactctcggcggctaccgatcgactcttcggttcagcggctcggttgaacgcgtgacgtcaggagcgcaggagacggctgcggctagaagcctggaacgctgcggctgcgtgactcctcgcgggtcgcggcgacgcggccggccatatctgaagtttctgaacgactgaacgcgtcgggcgtcggccacgcacgcacacacattgaactactgaagtctgaacggctgaagtttgagtgtcagtctgagtgaccacgcacttagttctggccttctgggcatgccgcatgcggcacagcaacaggcaaggcgaccatgcacatctgcatgagtgcatggcactgttcccttgagaaattaatcaccgcgtctacatgagttaaattccattcaaaacaagaggaagaaattaatcaccgcgtcgcatgcagccatgcacgcgctcggcgctcctgcggtgacttacgggccgactcctgcgctcctgactttcggccatttttcgtgctgggccggccttcgggccttcgggcctttttcgtgctgggctggcccaggcactgcccaatagcctgccgtgccgcccagcgtgcctcaacttacggcccaggcacggcccaactacgggccgtgccggcccggcccatagccgtgccgtgctgggcgtgctttctctcgtgctgggccatcgtgccttgggccggcccaagaaagcacggcccaagtcccacctctagttgaggaggagccggagatcaccttcttcgacgtggagacctccatgccatggggtcctagggagaggcgcacgctgctcgagttcgggtccatcttcctctgcccgcgacagctggttgaggtcgcggagcccttcgtcacgctcgtgcgcccctccgaccttggggtggtcacggaggcgcttgagcgtaagggcatcacgcgtggcgccctcgaacacgccccgcccttctgtgacgttgctaataacatccacaacgtcctgcacggtgaggggagggggttcttgtcattgtatttcttgacatgtctccttccttgactttcaggaatgaggaatccattttctttccctttccattttcttttctctcaaggaaatatgtagtttactactgcagccatatactagcaagcacgttccaagcatgtacattgttgggtgagtttgaataaaagcttttattatctaaaattcgatacatgcacatggttcaatgccaactaaataaaaaaaaatctttctttccaactccaacttactatgctgcatgactcaacggttatcaattctaatacatcaacagtcactgctttgggcctgttcttttgatactattttcaaccttaccaaattttggtaaagttgtcaaaaaaattggctacatttagtttgctgccaaatttgggtaactatataaaaaatcctgctaaaattttggtaagttgccaaaattttggcaaaatttggtaatgtttttttttatcaaagtgaacaggcctttaactccgttttcaatttcaatcagagccactttttacaatacaagcacaatatcatatcgatgccaacacaccatagaagaagaataagatttaattagcacttgagtgacatgatagtttcatcaacgctagacgaatgcacaatatccattttagtgttctataatggttaattttttaccactgtaaagatttttttttaaaaaaaaactactttattttggcccttttcgtagtgctctctaacgttgttagttctggacagggcgaatctgggctggtcacaacatcatttcgtttgactcagagataataagggaagcattcgctgaaattggacggtcgcctcctgaaccaaaggggatgatcgacaccttacctctgcttacccagacgtttgggaggagagcagggaacatgaaggtgatgaccttgttgtttgcataaaatcacttacaatttcaaactaagaatgctttaggttcagtttgacattgcggcatatggatcctgatcataaactcgtttgctgcaacaactttttgacattttggtgtttgttaaactgattttcttataatcttgtcaatattattatggtatgaaaatacgaaacaattggaagagacgtgaaagttggataatatatataatcataattcaatctataaaccaaacgaccaaaattatatgttcaaatttttagagcaattttaaaaatgagcacagcgcaacaccaacacaacaaccacaaaccgagccttagttatagatgtaccataaaagataggaaaaactacaaaaaccatcccataagtcacttgaagtttgataagttattttgtaacaaatgtccactccatgctctgttttgttgtaaaaatcaccctagtgcgcatgtcacaccccaatccggcaccgccgtacaacggcacctgataggagcgtgtcgtaagaaaaacggcgcgaaccgctacctacgaaaccgcgatctcggtaccagtcccaggacatagtgctggtacccacggtgacaaatatgaatcattgcaaatccttaaaataaatagaggacttatttaccttaacttaggttgcagctcagaacaacccgagaatgcaaccgacgacacggacgagtaaacaccaacaacagcagcagcagcggaaccaacgaactaacacccaacaccacaggcgacggctgggaacaaggacgaaaccctaatcttcacttcacttcatcttcacttcaaggcggaggaactatatatatttatatagagcaagggtgagtactttcgtactcagcaagtcacgggaatttaggtgtttaatgcaagcttggaagagaggcaaggttgttttgcaaatcctttgtttgaattcattttgaaaacactaagtgatttatttctttttgagtttggatcgaaaagagacttgtgtctcgatttgacttaagaaatgcttttcaacaactcaaatggtaatatatcgacctccagggtcagatcattacttatcggctcccagagccttttcactcgattaagcggctcccagagcctttttcattttctcggactcccagagtccagctgcccagcagcaaagcaatccgcttccactcgggaagcctagtctatgatgcccacagacatcccgaatcacacagattcgtttctgactactcaggtcatccatctgccacgtaggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcagaggttcgcaacaaagcctttcccaagccgacccagggttacctcatgccacatagaaggatcaattcctcacataaatataggccattttagttttcacaaatcaaactccaaccacctcgatcggtaatctggcaagcttcgtgttcttgccttaccaggaacccgggttggctccaaccgaccccgccccggcgttccccaactattggcatgcgaggtttccctgaaccgactagttacttagccagggtgtcccattccaccttgtggttgcactttgattatgcttgatgagtttcccacaggaatcggtccttatatgcgaatacgggacagcgccacgcaggcaccacccccgcatcgcgagttttcacaattcattttatttttaaacacaccgacaccacatgtcgggttttgaaggcttcacaaacccatttcccaatttttcgacaatcaacggtgtatgtgggacaattggtatacacgctcaaagagcacggataccaaagtaccacaagggtggagcgacaaggaatcagggtagtacagcctacaggaattagtgcgactactgggtaggtccgtcggtttggcacgcaaaccgaggccaagcatgttatatgtgtgtgactctaataatgcaagttgcaaacaaaataataatgattttccaattataggagcaattgatcaaagggtgacttgccttgctcaaggtcttcgcgaagcttcacgaatcttcgagaaaacccgcgatcgacgaaaatccggtaaccgcaactatacgcaaacaatcaaaaacctaaacaaaagaccaaaagaaagatcctattaggctaattaatagtgccattaaatagatctcaattttacggaattactggatgtggaacggaatcaatcggagctacggatcgggagatacgaattttggaagtttaattggattttctggacaaggaaatgatttatcggaattttctggaatacgagaaatggtttatggaatttatagaaataatattctcaagaatattattgacattcactgacgtgcgggagcaaaggaaatgattcatggaattttgggaataaggaattgatttatgaaaaagggaaaaggatttattaatccctttggataagaaaaggaaggagggataggaatcagattttaccgagcggcttggcgcggcccgagaggatttgcgcggctcggccgagcttattgggccggcgcgggctacggagaggcggcccaagagaggggcgtggggagagagagggggaaggggagccgggtggaccgggctcacctcgcggggtcccgagcgggcccgcttgtcggtgaggcggtgcacggtggaagcggcgcacacggggacgggcgctagggtttcgggtgcgcgtggttcgggcgcggcgcgccgggtggacggatggtggcgggcccacgtgcagccgcacggcttgccgtggaccgcgcgcacgggagggaagacggagggagggggcggctgaccggcttggcccggtcaaagccgaggtggcgccgacgtggcgcctacgtggcagccacgcgggccggcgggaggaggaagaaggggaggccgagatggacggcggacggcggccaagttcaccggagctcgtcgtgacgattcgagagagagggagtacaccggaacgatgggacggacaagaggaagtgagccaccgggtcggattcgccggagggaggccagcgacgacgaatcgtggcggcgcacgccggcggcgcgaaaaggggggaaacttcaccggagcaacgggggttcgattcaaaaggatgggagcatctccggggttcaaggagttcatttccggcgttggatggggtagagcgacgccgtggaggtccggcgacgagaggcggcctccgggagcgggcgccgacggcggcaaggccatggcgagcggcagcggggcttggggcggcgcctacgaaccacgcgagttaaaggaggaggagggcgagcgaggaagaggaacggagggctaccgcgtcgggacagggcaccgtgacgagcggcggcggcgcgggagcaagctctccagcctcgggccggggaaggggaaggagaagagtggccggagtccgcgtcagctcctcgtgcgcacgccggcttcaccagcacgcgcgacggcggagggaggcgaggacggcggcagcatggtggggatggtggtccggcggcaatggcgctgtgggaggaaacgagaggaaacgagtgggaggtcgagacgctgagggggggggctcgggttatataggcgaggaggagaggtcggtttggaggaggaaaaccgacattggcggtcaagggatgcaggggcgatgagctggcggtcgtcgacgcgtgcagccaaggcggcggcaggtgatgatgccggcggtgtcaggcaaaagtggaaaaggagggggaaaaggggggctctgctctttgccgagttggggcgggagagggatgggagcgggagctcggcctcacggttttggcaggacacgcgtggagcggctcgggcacgcgctgcagagctcgcggcaggcagcggggccgagcggcagcgcggcgcaggcgctgacggtggcggcgaccgggcggtcggccacgaccgacgcgtgcgcgggaaccaaaggcggtggcgggaatcggcgacggggagagaggaagcagagagagcgagagagagagagggcggcgctctctctcggctcgggcacgacgctcgtgctctgcacgtgcgaaggggagggggatcaggctgagaggagggatgggccgagggaaaggaattcagcccacaaaacagagggaggaaaaaatagacttttatagggaatttgagttggagagatttggggcttgggtttaaatttcaaatttgagattcgatctcgggggtttagggaggaatcaagggagactcaaggaaaggattcgagatgggaatttgatatttttcggaaatggggacaggtatttggcggggattcaaagggaggcgattgaatttcggagtttgatagccggaattggaatcttgaggtggacgatttgatggcgacgagagggaacaacgggaaattgaattgagatccagggcacgacttagactcgcacacaaagaacgaaattttcgcaattaggattttgccgaattagtttttaacgtctcacgagaagcggagcgttacagcgcacgtgcttaattaaatcaccctagagctaccacatgatgctaagctacccgagtaaattttattcaattgcttgcattagatttatccttcatgtttcattgaactttctttatatagcaaaacacagtgtaagaacatctaagctctcatcagcatttctatttgtggaatcttcaaaaattattttatcaaaactatattctacgtgtatctaagtttggtaaagatcacattgacggcttataatttattaaaacatgttgattcggttagacatacattcactggagtggtttttcaataaaattgagtagctgggtaggtatttgcaataaaataacttatatggtgaaatgtcaaacttcaagtaacttatgaggtggtttttataaatttccctaaagaaaaccaagatttgcatgctaaagaatccagaccttcgttgaatgttctcatggatatacatgatccttcttgtcatttgaatgaatatggctgatttctgcagatggcaaatttggcagattactttaatctagggccgcaaattcacaggtatattatatagagtgtaaaatccaaaatttatattcattgcatctgaattccaaatgcgtcctttctcaactttggatttttcttatcctttcctatttgaattgaaaacacatatacccaaggcatcatgttggtaacttagcttgacattcattaagtgattatttcattactggttacctagcccgctgagcagtttctattaatattaccttcaatcataaatatttgatatttatgacaatatttggtcaaaattttaaaattctaacaagaatctttctaaagaggtgtggtggaaacaatcactgttttttgaatatatatatatcgcccatcaacatttactcctgctaccaaacataatacgaatcaaaagtaatgattaacttcctcatgatcccacttcagtacatatcatgttcaaattgttttgtttagtttcattggcacatacgcacttctccaagtactcggtatttattgtcaattagagaagtagattaggaatcgttatttcaccttcttttattcagttttaagtatatatatatcctaaaattaatagagtaaatgatcttccactaatttgctttgcaatttaagccatgttcttttcatctgattattcattggatcattgaaacaaattattttctacattcttcaaaagatgtgctttcctaataaactttctcctgctacattgtttagacccttgtttttaagctattcgttaagtttaatctatgacaataatctgctcaataatttgcaggagtctgtatgatgtcaggatgaatcttgatgttctcaagtgttgttctacagtgctgttcctggtgtgtttggattacctacctcctgtttttctgttcctattaacttcatatgatctggaaaacaacattgttcaagcaatgcttctttgactgaaagtctgaaacaactacttgtttctatcatttttttccacgcatttggcatctgatgcagcagagtgagaactagtgattgcatagcatgatatgtcaacaatccaacttcgaagtgtgtggggtcattcatagatatctattattgaaattaagaatatttaaat

SEQ ID NO: 83527 - DNA, 5147 bp, Oryza sativa
gagaggggcaacaatatacttcatcatagccccaaatgaggaatgtgttggagcattatttcctttctcgtcccttttggaaagtaaacacattaatataatgccgacaatcatgcagccaagaaacacaacaaacagcagacttttccccgtgacacttcctccatcctggagtaacaaggaatcacatgatcaagcatgatttttattaagaacataaaaggtttcaaaatttaacaaaagtcatacagacttttaactagtatattgatgaacagtttgaacaaatacttttgggggtttagacttttgagtattgctaacctcaggagtcagggcatcttataatagttaagttcatgggaaattagagtaggacagctaatattttagatatttattttaaaatgtacatctaaaagataaatattaagatttattttcagtagtgctcattgcaattattctatagttctcttgtagtgtgctgcaatatttttgtttgcaatcattattttgttacaactaatatatcgatgcattttgagacaattttgtaaacctagcagaacacatattttgaattgggtatagaggtacaacagaagtttccaggatagaataaaagaaacaatgggactctccagttaacatcagaactatattttctcttactgcaacaaatcatgatgctaaaagtacgtatcatgaagttcactttagttactagttagcggtacacaatatataacaaatgacagtccaggatattctgataagacatgagaagatcaaaattaagatgctaacctttccatctctcagtagtgcaagagagatcaaatttccaatgacctgcataattcaaatgtaaatagtcaaagacaccttgtatctgtagagcccacatgtgcagaaagaaatagatgctacacttgagttatgaagaacagatactaaaatatgtcttggcaagttttggtggagaatagctttgtacaaccatacctgtgtgctagcaaacattccccagaactctccattgaagttccccaaagtttggccttcaggcaaattattgtctcttgcatgactgagggcagcagacgtgagatatgtaccctgcagtgtgagatatattatgtgagctggattactggataccagagaagacttatcaagcacactgtcaagtaaatacctgcccaacccagatgatcgatgcagtaaaacccagatacagggaggctggcaccattgtgtacctgataatttgttgcacaaattaaaatccgtatatagaatctcagaatatgttaaacataaaggattcatttctaatagtattttgtgtacctgacaatttgttgcacaaattaacatccatatatagaatctcagcatatgttaaacataaaggattcatttctaatagtattttgcacagctgaaatatttcatagtataatagaaagcacatcaactagggccagaatccatcggccatccatatttgtatgagagtgctatatattaaagaagaaaatgaaacattgttgctggtaaatactccctacgttttttaatagatgacgccgttgacttttgaacacatgtttattcattcatcttattcaaaaattttatgcaaatgtataagatataaataatgcttaaaatactttgagtgataaaacaattcacaaaaaaaataattagataacattttttgaataaaacaaatgatcaaacgtgtgacaaaaagtcaactacgtcatcaattaaaaaactgaggtagtagcatagtaaaaaaaacttgtcgattgttttaactaatttgctgtatgggctctcagctacaccaaaaagggtaacagagcatttaattatcagaaaatgaaaatgcattccgtgcacaaccaaacacttacagtagactggtgagacgagctacactgcaccgccaaattaaaaccatatgatcgattaacaacagtagtacccgtgtctgagcaaaaggagcatcatatcaacacggtctagctaggcatttcatcaaacaggcgtgaggcatccaaaccagcacgcccaattaggcaccagcgataccatgcggaccatgtcaaaaatcaaaaccatgggatccgtaggcgaaggcgtcaaaacccaaaaccatgggatccgtaggcgaaggcgagcgtacggccgcacgcaccatgtcgggacgaggttggcgaggatgaagatgacgtagccgctggtgccgacgacgagcgcgcgcttggagccgagccacgtgaccacgggcgacgcggccaccgagaagagcgtgaaggaggtgtacagaatccccatggacaccgtgcccaggtcgccctcctgcggccagcatcatccacggatcaggaaaggcggcgatcgagatcagctcgaccgatcgacgacgaggaggacgaggacgaggaccgaggagggacgagatggcacactcacggtgttgaccgagctctcgaggttctgcgcggcgcagtaggcggagaagacgaagaggaacgcggcggagaggacgtgcaggtcgccggcgtggctacggcggtggcccgagtaacccaacggcgcggcgccggcgaggagcggcgccgcggccgcctcctcctcctcgtcgcggtggtggcctcctcgcgcgtccatggcccgcggcggaggcggaagcttctagaagcgatcgatccgcgcggcttgaggcgggaagctccttctagaaggccttttatagagcgggtagagtgaggtagcgaggggatgggaggggagcggaggcgacgaggcgcggaggcggaggtggggcccacatggcagtggctcgaagccgcggggtttgtccccacctgcaggtaactgctttggcgtttccttcctgtccccgcctcttgtcattttgtcagtggcctactggccttggaagatttttttttctagttacttccaatttttcaactaacaaggaccacttggtatcaggatagagatcagtcgactgcaccatgcctttgtcactaataaatgagcccgacgacacatcaggtccacatatcaatgacaaaggcacggtgtagtgggcagtgactgaagaggatcccaatcgcttggcataattggtggatgaagttcggcttcgtttacacaaatttttaaaaaacgatggtagaaagtagagatgtttgattcaaggtaaagttagaaagacaagtaatttaaatgagagtaaatcgtttttcctatcttgccgattgtattctcttatgctgtgtttggtaatgggagttagggaactctcccaaacaagtaaaatgaagcagtcccgttcgttagtcatgaaaagggtggattaaattttagattaaggttgcacgcttttcaaactgctaaacggtgtgtttcgtgcgaaaactttctatatgaaagttgttctaaaatatcagattaatcctttttcaagtttgaaataattaaaacttaattaatcacacgttattaccatctcgttttatgtgaaacacttaatctttatattcatctttattttcaggagattcaaacaatattatgagtatgcatgattttggattattggcttaggtatagtgtagactaagattcaaagactaaaaatttagacaaattttactacatggcactcaaagtttgtgtaatttgctaggggatatcgtaaaaacgtgctacagctgaaaaatactttaaaactagcaatttgctagaacacattttcaatccaattagagagagaactttttagaataacgagaatgatcttgagactctaaaatgatcctatcctaaaaacaaggatgagtccaacccatcttacctcatccccaaatcaaacacatgctaagctgcctgcaaccccagtgttgttatgctcttggattttttttcaaggatggcagtgacagtggcttggccgttggttcatatcctaatccaatgctgccgttggagctaaatagttaatcgcatccatttgcagctcaagcagtatcatacaatttgggggatcttctttgtcaggtgacgcatctgatcaaatcatggaactactaattaaaccatctgcctctccaacaaaaaaactaaaccatcagctgccgacgagattatcctactctgatgataatttgctccggattcgtcgcccgtttgagccaaaagtttcagctcggattcatccttactttcttggtgcaaaatgctgcagcttctggtcggcaacttggcagtcggcagttggcagtgggcaatgcatgttcagaacttcagatgaatcagatcgttgcgtttcaggctttcagctcggtcactctacttcttttcgttgcctaatgcatagaaacaagccgctatatgtgattcgcttatacttcatcgattcaaaaagagaagatatcacaattcacaagttatcggtatatggaaggactgcaatgaatttggagataggccatctagcgttgttgagaaatatccgccgaactgattcatctaaactttaggaaaggtatttttggtgtttcgaggctacgatttataagttgaagagacattggctatgtttagttcctttcaaacttccaacttttccgtcagatcaaatgtttggacacatgaagcattaaatataaacgaaaaaaacaattacatagtttgcatgtaaattgagagatgaatcttttgagcctaattacgtcataatttgataatgtgatgctacaactaatgatggattaattaggcttattagtctacatttaatacttcaattgtgtgtccgtatacgtcaattttttttgccaaaacaaataaacacctaaacatggccattatcaacattcttatagtatagacaggcaatcggatctttcaaacaaatgaagacacgtgatcaatgttatgaaaaatacatttttaacacgagaattttatgcttctactcttaccggtcacaagtcaaaactgagtgacaaaagcgataaaataacctaaattgtttctaaaattcaaaattggctacggctcaactgcgagtgtagataatcaagacaaatctttaatttaaacgcttccga

SEQ ID NO: 83528 - DNA, 5633 bp, Oryza sativa
  unsure (1)..(5633): unsure at all n locations
cgatgtgnctnattgattgacttgcagcctcnnnnnnnnnnnnnnnnnnnnnnnnnnnnnnnnnnnnnnnnnnnnggtaacttgcgcgtgctgtgtgttgatcttaccgtccctcaatgtccgcctcgtcgtcatgaggatgtctgcatcgccatagtggagcctggcgtccccgagcaagactggtatcatcatcgggcactcatatcggatcatatctttgaagttcacatgtatgaggtttgtgcgcactggacggttaatttgaggagaataactgcttcaacaaacgacactgtatatattatgtcaatcggggaagaaagtgctgctagcagctcctaattagttggccaatctgtcatgcgcgtgcatcatatggaaacatgcacttgcgtggctgtctgttgatgctcatgatgatcaggaaaataacttggcgactgacgtccggtcatgccgatcagagaaacaactcggcgacgacagtgattggatccatcgcttaaattaatcttgccggctagattggatccaagttggagaagaaaagcttagcgaattcgtcggcgacgaggaagttgcagctcccgaagtaaagaggaagccggcgactcgtgaagttgattccatcgtacttgtcgatagaaactcgacgcacccctacctagcgcgccaactgtcgaaacatgaattcggcaataataaaagggggtagcgcacgagacctaaaagtggatggatgcggagacaaggatttaaacaggtttaggccctctcaatgagaggtaataccctactcctgtttagggatttaaatccgccgggtgtagtatagatctgacgatcatatgtgctcatgccccctagagggcctcctgtccaccttatataggatgggagccaggattacaagatagaaaccttaaccaatacggtatcggtttcctaaatctattttacaatattgtcaaatcaggactttaggtcgctccataatataaaaggaaacgtaatacccaagtcatgatttgttacatattcctttgatataagctatcccctatgactagtcagataaccatgccgtatgggtatgaggtacccataatctccacatggcaaacacataattgccgatgaccgcttctctgtcctctgatgagatagcatgatcaggttctctccaaaatgttaggaaaaaatttcaatggcaaccatatatcgtaaacaggatacttgtttgatatgcaatgcccaaaccattgataacaggtaaagagtactatgatctgctcgtcaaagaccacgaagaaaaaatgatctacagatgtctgtaacacactaattcttgaggatatattagcaacaataaccttttggtatgcacttgtgttacaaattttataacatcgaatgaataacaggaaacctaaccattaccagaaggatattaatagtgtcagcaaataaagttgggtaaacattgcaaaaatcatctctcgggatcaaggtatattgcaatcatgttatcttacaggaatcctataaaaaaagcaaaataccagggcctatattgtccatgttggaagatttaaaaaattggttaaagcaaatgtaattggcacattaaaatgacaggaaggaataatatgagatatagcttaggaggttgacaaattacagattaattagcattctttaactgtagatagaaataaatgtaagatttgatgcagacgcctactcagtgctcatattacttccatagatactctccatgcactttagcttgttttcacttatagaaaatcggcatccttatgagagatttagagtctcatgggagcataaatctctactatctcataaccatttgtgataccttttttttcgagggtgctcatacctaaacacaaaaaactaaaatacattcctatccttgaaaattatcaaaggccattgatatgcagcttgaggtgccatggtagaaattaggcgagattccccatgttgatacatctgctgatgatctgcagttatgcacccatccacaacaaagtcaattagtatacctggggatactaccagctttttatgaatgataatcaaatagtgtgttcccaaattagataagatatattgagcactcaaccattgggagtttatatattgaaggacaataagtacaacgtatctgagagcatatttttagagtttatgaaaaattgggcggcgaccggccggcgatggaatcagtctgcggcgcgatgtagagagaccacttaacataatggttctagcatgtagatcatagaataatcaaataatttgatacccctggatacccctattctggaaatagtacaactgaataaattggctagactacagtacaaagaagaataattgaataaattggctagactacaatacagagcataataactgaatatgttggatagattatagtaccaaccaagtctaggtataattctgtccaacagaattaacagtgcacatgctattctcttcaaaattcacatgattcataccaaaattaatggttcagacttagtaacattttaaacatggaatcaggtagggaaacatatatacatgatgagagttgaggagaaacaaagacctttctagcagctgttgttagggtctggccgtttgggcgtctgacacccaaattcagatccacaggagtcagaaaagcagcagtgtcgatcccattgaactgcagctcaccgagaatgtcacggaggaatgtcaccgaatcccagtcccaatgtataaagtctttgaggtacctgatttagatttcagtaaacaaatgactacatatgattgagtaaataatatgggcacacatctgcaaataaaagtaacattattatgatatagttattgtagtgaatactcttttcatatatatactcgaactgcttgtaaaataatttaacaacaatgttctcttctccattgcaaatatacaaataaataaaaacccatgaaacattaagctcaatttattgtaaatcccatcatcatgacatcataccatctcattttcaaattacattttcaaggaaaaaattattagtctgcacaagcagaatttgaatgacaactaatagtaaaaactgaaatcaagaaaatgaataatctgaaaacttttccctgcattagttagtacagagtacgtgcagatcagtggtgagagggacataccgaactccttggcggaggtcgcgctggaccggacggcatgggcgaagcccggtcggcggggaaatccatttgcgatgcgatgtagagagaacgaaggaagcacgacggtgactggatggtagcggcgcgatggtgacctgcgggggcgacggcgattgacggtgacctgcggggagacggcggttagggttgggaatcgcaaggcgaggaggtgcgatggtggtgagggcttccggtggcgaggaacggtggcgaagcgtagaagatcggtgaggaaggcaatgccggtgggagagatcgctgcggagcagatcggcgcaggcggcgacctagcgacgggagggtgaggatggattttttttcgggagttacgggggatagacggggtgagcgtgtcgatgagtctgaccgttggataagcgttgaagcgatgaggtgcgttggatgtgtgacatgatgaatgatgaatgagtaaaccatttgtttaactataggatagattagacattctcaaaaataagtttatggggattggattttagcagtttcatagtgatgcatgccgtttggacgtacatgtgtgttttcgtgtaattcaaaaaaaaattgtatttttttcatgtgcagacgctcaagaggaccgtatgtgatgtggttgcattatgggtcctcttagagcctactggggttctcatgtagaaaaaattatttgtgaagtagtgttgtgaaaaataatgggactacattaagtgaaaatcaaaggtcggatgtttttgtctcttcattgaattttattaggccatttccaactcaagacactagccatagtttccttaaactccacatcattaagaaactagtaatagacactactcttccaacgcaaacaccactattccatacttaaatttaatgctacttatctcacataatgtcttggatgttatgtagaaaccatgtctaatgcaagacgtggtttccttctctttcctcatttattcacttgccacgtcatttttcatcctaggtggcatcttatttaatgctatggacaacatcctagtcattgggttgggaatgcccttagagaaagtttaatagtatagcccattactagctccaaatcatttatagccaatgtaatagccaattcatacaatagttgcttactatatgtcacgcccagaaatttagcccaaatttttagactattttgtgtattaaatccctgtccaggactagccagggtacacaaaatgacaagtaataaatagatccaaacgtaaataaagcgtaaaatacttaaagaataggcacttagtcctcacactgaaacaaaagcagcagcagcggaaaaggcgatcctagcggggcttcagctccactccataggcaaaactcaactgaggtctgaaccttggtcctctaacttcatcttcagctcagaagcactacacttctgaaaaaggggaacaacagcaaggctgagtactaccaccgtactcagcaagccacaccaatgatgcagacgtgcaagggcagacaaagaggggtttgtggctatttgcataaaggcggttgtaaaacattttattgagcaaaacggtaaaacagttcagtaattaaagtaatattaaatttccactgatcaacgctacaccacgttgaacaggcccaaccaacctaccagaactacagtgcattgggtcgatttattaagtgtgagactaatcacggtgaatctggtcgatcgcctataaccgcgggcacggctattcgaatagttttactttggccaaaggtgcacaactgtacccacaagacacaatccaccggcatgtcaccatgtcatcatgtgccctgatgcacacatcaccatgtcgagtgattgtgacaagacccttcatataaccccctctgaccaatcgcaccgcacctcaggtttcacccccactcctcgcaaggcagcgggcagtcccctctcgtgccacggtgaatccagaagccgatcaactgaataccccagccaacccaactccattacgcccacccttgcctgggaacgtcagccagaggaaagctatacttcaagtcaggcagttacccattcctgcttgtggcaagcgctgtatgtcttccagggtttcccgcgaactggtccttcattgccatgtgtgcgaccagcaaaaccatgcacccacagcccaccaataagtcgcattttagttggataattatggccaataaacatgcccgcatgtctcgagcacgcagctcattcagatactaaaaaggtctaatactgcaattatnnnnnnnnnnnnnnnnnnnnnnnnnnnnnnnnnnnnnnncgcttgnagctnggtacnttagtcntccatcgaacccgcccc

SEQ ID NO: 83529 - DNA, 3350 bp, Oryza sativa
gaggaggaggaagggatcgagcaggttggttaggttttaccaggaggggacgaggttggcggcgatgaagaggaggtagccggaggtgccgagcacgagcgcgcgcctggaccccatccgccgcaccaccggcgagcccaccaccgagaacgccgtgaacgacgtgtacaggagccccagcgacaccgaccccaggttctcgtcctgcaaccccacccacccaccagcaatgcaaaacaccaaatccgatcggattaatctgaatccatggaggccgcgtctgcgtgatcgatcgatcggtcgaattgaatcgattcggctaccgtgttgacggtgctctgcaggttctgggcggcgtggtaggcgaggaagacgaagaggaaggccgagctcagcaggtgcaggtcgcgggtctgggacgtcgccgccctcgccgccgccgcggcgccgcgtctgccggataccagcggggcggcctcctcctcctcctcgtcgagggccaccgcgagctcggctccggcgggagcgtggccgtcttccatggcggatttggggggaggagttggtggtggcgtggcttcggtgccaaactgcgcgagcactctgctctgcttgtgatttgggggaaggggggaggggcttgtttttctaaatttaaggtctacgaggggtgtttgtgataaattaagtggtttcaggagaatagcagatagtttagggggtctttgtgagaattttagctgtttcgtgtccgaagaagtccgaaccgcccgatgacaggcgtttgtttgttttaagaagagatagtagcttttacagggtgtggttagtttctgaaaaaagttgaaagtttgaagaaagttgggagtttagaaaaaaagttagaagtttatatgtgtaggaaaatttttggatgtgatgtgatgtgatggaaaattggaaatttggggtagttggggtgaactaaacacggccatagagagaaaaaaaaaacttcgtgaaatgatatttgggccatcttagtcacttaaatacggcaaacacaacatctaacctaagcccattttataggtggcaattaatcttatgtacttggacggacgggtatatagctataaatacaaacatatattttaatgagtaggtttcactgtaataaagctaaccaattgagctacgctcgcttcgttatataaaatggtgtttttgttgttaaacatagcatacatatctagtgaaataacttactcttttatctttgttcaagtaaaattttccatacgcttgatgtgttttgagtaagggtgaaattgaaatatgcatttttatagcttagccctttaagattgtcttggttgttggttgtttttgttgatacttatggacaagataacagatcacaagtagacatgtgcaactaaactatattgaactaatttagacttcactagcatagttgcacagaggaaaccattggataacctattcggttctgttggactctaattgtgcttttttgtctcttagtttttaaatcgtataaagattaaatttgattttatagtaaaaccaagtccatcttttatactttctctgttcaagtttaaatgtcatatatataaaaaaacggatctccacaaattgattgttacatttgcattggccacccattacgtctcgggtccaatgccctagccctttttggctcttgtgcaaaattactccgtcatcacgcattgtgcatcgggagtgatcctccactactcgttgtgttgcggctctacatattggatcaataaaattgacaacaatttttggttccaattatattgcgataatgtatctcttttctccatagttcgtcaactacaacagcttgcatgaaatggacaaccgtccacatgtagaaggtgtcatggaagtggagggaagcgagcaagtggacgctcttttggagagggagcgttatttcgctaaggtggtcgtatacgattctgcagatgtttatgtcgatgtcttggaggactacgtagctagtgacacgaaaattcccgattcccaagtcgtcgtagacgtacaaaagatggttgtcaccaaaagcgagctcgatagtgcgcatgtggtcgagagggagttttatggcgttcatatgattcggtgcgagtttcatggccaatacgaaaatacaatggcaaacaacatttattttcaacgcacaaatgcaatcaactaaaattcattcataaaatcagaaaaaaaaactgtagattcatttctatgaagacttaggaagaatgcaatcaaaggacaatccgtacaaaaccatactcgctcatcgaggattagaaagtatttgatcgttgacattgtgaagatgaaggcaaataatttccgttgatcttgaattctgatctcttacacagtccaataagagacaacctcatctttttcttatgcatatatttatcagctaaaatttaaattttcaaccttaaatttagagttgattttgggtttttttatcgtaaattatttttcagattgtgcttttagatcgttaagaacacgtatataacagtttattcacaaattattttccgtttgcaaataagctaaacaatggtcaatgggactgagaggaagaataagactgtctttgaggagaggagatagaggagattgagaagatacgcaaaacgagatgagctattagcacatgattaattgactattaagtattttaaacttcaaaaatggattaatatgatttttttaaagcaacttcttatagaattttttttaaaaaatacaccgtttagtagttcgggaaacgtgcacgcggaaagcgaaacaaaactcactacaatcacctagatcaccaggaaagaacacggcattagaatacgagaaagtgaagaaatgccgtaaacaccgtcagaaaagggtaaatcggcaaacgcgttccaccaaaaccctccacgtcagcatatcaacatccaggcccaacgcgcagaggatcccccgcaccagtcaacccaccctctatgacagtagggcccagcacgcggtggggcccaccccgcagtgaccgaaaagcctccccgtcattagcccggacagcgaccggaacccccttcaaaggcaccgccaatgccactgacaggtgggcccgtggttcatcggccccagatgtcagtgacaaaggcacgtacctttgaaggtagaggagcctcctgatcccccctcccacccgcacgccctcgccgccatgtcgtccgccaccgccgccgccaccgccaccatcgccgccgccgccgcgaagctcgccgacacccccggccccgccccct

SEQ ID NO: 83530 - DNA, 17386 bp, Oryza sativa
aacttttaagtttttcatcacatcaaaacttttctacacatacaaattttcaacttttccgtcgcatcgttccaatttcaaccaaacttctaattttagcgtgaactaaacacaccctagatatggagttgatctagagctcctgtgtcgaaggtccagtttgagactgtcgagtggattattgccgaagattttgatttgaaaactactaaacatttttttaaaaaaactcaacaaataggtctgaacaatgcagtagagtttttttttcttgagaacacatggtttttaaaaattatagtgcaaataatttgtttgaataatccgataataaaattggtgtttttgtctgattgtacagttttctcctactctattcaataaaattagtgctcgttgattcaataaaataaaatccgataaatgaaatggtgaaaaaaaaggggacggtgcatatgcatatgtatcctctttgtttatttgttgccactggccgccgtcctttcggagcgagataaggcgatgattatgctagttgcccacgtcctccatggaaacttaagaccctgtttagatgggactaagactttagttttaaagtccctatcacatcgaatgtttggatatctatctatctattatatactaaaagtccattaattatcctacaaacgctcctaagccgccatgtggcgtttctacaaacactcttatgttgccatgtggcattttataatctcaccatcgattttcatttaaattagtggacccattattttagaccattggattagatctatttgctttctattgatatcgtgtgaattcgagtgaaaccgttttataccggaaattctcacgttcatacgcacaatggaaaaaaggaaaaatctcacgtacttacgcggaccttaaaaaaaaaacctatatgtactgttcatttaaagaaacgtacttacgtactatataaaatctattaaaaaggtactgtttcagttgaaaaaaatacgtacgtacacgagtaaaaagaaaagctataagacctaaaaaatatatttacgtcgctagaaaaaagatggtttataaaatagtatattttatagtagtaaaacaaaatttattactccacaaatatgataaaaaagtataatttaaaaatatatgtttacagctgtgcgggcattgttcttacaaggtgagactttaaaaagtagatctatctaacaatatatatagtcacttcctattttatttatgcatgcaagtgaagtggtacaggataaaataatatgtagtcacaattttatatatatatttttatatatgattgaatgaatagaacttagaagaatatacattttacgagcgaagtagacaacatatgtcataaattctaattatgatttttatcataaataacacaatggtccaaatagataaagagtgaacgtgcgatttaaagttaaaagttatgacgatctaaaaaatattgttacaaatatttaatttagaaggttgtggttattcaaaaattgttattgcaaatattttcatgaagagaaaagagagaaaaataatcaagaggataatcttcctacgaactattccaaaattattgttgcaaatattttcataaagagaaaaagtaatcaagaggataaacttcctacaaacgcttctaatccaccacatattaccctataagcgttcctagaccgccacgtggcgctccaataaatcatagaaattgtaagaaaaaataaaacatccgaccatcgattttcatttattctggtggacccattatgttcaaccattagatctatcttaaaaattaataattaaatttatttgtaaaaaggctcacgtcatactgccactaccagccaatatacatgcacatagctacctaggtattcctccttaagaaaagtacgtacctacgtacgtacagtacgtacgcaggtattcctccttaagaaaaaatatgtacctatgtatcgtactatgaacgtacacacaccgggtctcacatccttattttttcttttttcttctcatttagattagatggaaaaccaaaataataatttaaaccctttattaattaaatatgctttaagttgtaaaaatatgtgcaatttcgagttgtattcaaattaggctctaatacttggaagatgccatgtgatgctctaataaattggagaaaatgtaaaaaaaaattgtaagaaaaaacaaaatatctagctatcgatttgcacttaaaccggtgaatccattattttcaaccattcaattagatttattcaggtaagccctcgctcctaaaaccagctaatccctctctatgcacgtacatacacaagagatgccaaaaacaaaaaagaagagtgcatatatggttcatcccatctggtagttttctgtttctttcttcgtagccctaaggtgttcctcaaattatacatgtatgtagcgaccactctttacgaggttgacgaagaagccacactgccatagcgctgcttcatgacaccctcgccaattttcttgaaaatattgttttaactaataatgtaaaaggcaatcctaagcgagcatataaacgtgtgcacacccacctttgaatatttcacggtacaaatacttccttcttttacggtaaggatatgaggtaatctatggttagttatgatgatatatgactttttttcagtagttctttaataaataaaaaataaattgcccgcgcaactgcgcgggcttccttcctagttaaacaaacagctcagtgggcaaaacattcgccgtcgcacaagcaaggagcgagactgcggtctcgcagcgcagtgtcgcgccatcctcgcgcaagaccgttcttgacgtcatcgccacctaatttttgtgcaatgtttctgcgggaccgatggtatatttctgtcaaaacaattgcatcccgaatattttttaaaaaaaccaaatgaacagtatatttttaaatttaattcaccaaagctcgactagttttggcttatgtgacacttgcatagtattttacacaacaaaaaataaataaatagtcaaccgtgatctactcacgcatcactcgactaaatgttttacggagtaattctttttctacaactacacaggcaagaataaagataatttacataatggattgtaaattgttaattgccgttgtacgttgatgatgtaataatcggttgcagtttcttatagcttcttgaagcaaagaccaaatgttatatcccaacagagctcatgagtagtactacatcaaaacggtccagacatgagtattaccgagttgaatttgttttacaacttgaatgcatatgaaaccatttagagctaacattcaatctatgtgggcatttatgcaaatcgatcttcctcgcgtcggtatttctttcatataacatagcttttctcacacttttaaaaatatatatactccatccgtgttccacgttagaaagaagatgtttcgatctcttcatcacttagttccattttttcttgtattgacaaactctcctagtcttgggaactccacacatctacaaattccgctatagccttttatatatactgaaattatcgtatctcgtatacactaaggcttatttaaattgaagcatttttttttgttgtactaacatttattttaacgatttaatagtatcatatgggtgatatgtgttgatttgctatcaatttttggccacacactaactaaaattctgtattaattgggcaagccaaaagcttgccaagtgccaaacattcttttcttaagtaaagtatcaaaattttggtatggtaaaaattgactccaaaccaaatctgccattccgtcggggagcacctccggtcgggccccttcaccgtgggaggccaccgctggtacttctatgtcaagcccaacggcgacggcactgatgcgaccgccgttcatcctcattaagaagaggctcaagcacgcaagcccctttgttctttgtactactccctccatcccaaaatgtttgacgtcgttgactttttttaaaaatgtttgaccgttcgtcttattcaaaaaatttaagtaattattaattcttttcctatcatttgatttattgttaaatatacttttatgcatacatatagttttacatatttcagaaaagtttttaaataagatgaacggtcaaacatggtttaaaaagtcaacggcgtcaaatatttaggaaaggagggagtataacattgagaggccgaggttgatttgcgaggaaaatctcggctagtacatcgatgtcggcacggtggtgaccatgctggtgctagctgatcggcacggctgcgatgttctgaagaaggcgtagtgcttcggttttctcaaatctccagcaagtctcagggtagtcattgccactgatggcttcgtgcatctgacatggaactgcacctctgttttgttggagttgactgccatgaactcagcagcttagttgagtggtactcagtgtcttatttcaatggtggttcatgtggtttcttgactgatgttgtcttaaggtagctatcctgttttcgcaatattctccctgactggcttactccctccgtaaaaaaaaaacgaatttagtattagatgtgatatattctatatatgtttagattcgtaatattaggatatgtcaaatttagtactaggttggtttttgatgggacggagggagtaggttttattatgagatagttatatgtatgtggagatgcagcgatagtttccgtttttatctgttctgttatcaattaaggtatttttttccccactaatgaacctgcaaatttgtatagaatgcttactaaggaaatgtcagaatagttttatgtttttcatgctagttaattgcatctccactttgatgttagctcatatttccactagacctgcaaattgttactttctttcctactttccttcactctatgtgtcaataatcaaaatttatatatgatagatggaactagagtctaacgttatataacattgttttcatgaactcgtagtatgacggtgcaaaacagtttgttgccgtcagaggggggcttctgtttggaacaaggaagcgtcacgaaattctctagaaataattcttggtaatagtagttcaactttctttcagggaagattcatggttagctgaactgctgaacatcgcattagttctacattcgctagattattaataaatgtgttcctgttctataagggtacagttgctggggatatctttaacagtcatatttacaagtacaaatctgaaaaaaattgcagttggtacttggtgttgaagaactgaaactgagatgcatccatgagtgcttatcctggattcctgataggctgcattcatacttggtgactctgggcaggctgctgatatacagaatcaccttatcgatctatttgcaatgttaagattcctttgaaaatacaagtcttcctttggtatcttgaacaaatgtagcctagtggctaaaatgacctgagtatagggatgaaaacggtacggaatatttctggattctgggcctgttttcgaaaacgtaatcatccggttggaatatttttggaaacggaaaagaattcggaaatttttttctgaaacggataagaattcggaaatattttgtcggaaacggaatcgaatatgataagagcagtttctgtcagaacaaacaatcggtcggactggaaactttttcggaatttctgaagttacaggtccatacaatacattagtccataatacgtcccaaaccagcccaattcagcataacacctcccatagtctataatacctcccgcaaacctagaaacttttagagtagagagtgagggactgagagagacatcgaagattctaaagccgggtggcagagtgacgcgtccagatctcacgtcgcctcatcccccatcgtctgtttgaagtttttgtccattgaagtttgaagctcagtttgagggttttttttatcccgataaatttttgttatcgtatctgcaccggctcgtttttgctccattttcggtttcaataacactcaattccgttttcgtatccggggtttccgattccgattctaattccgaaaaaaaaattgaaaacggaaacgataaaggtcgtttctgtccgtttccgtaccgttttcatccctacctgagtagtaccccaaggttttgagttgaaatctccatagaagcgaatttcagattggattgtttgtggggctaagttcccaatttaaatggccgcatatattcggtttgatgtagaggccaggtaagaaaataccattatctaaaaaaaaatcttgaacaaaaataatttgctgagtagaaaatgtcaatatgttggattctgtttttttccctgaaaagactattgacagtcaattctttcattggccccattgccactgtcacgtaaaactagcgacagaagttcataacctaagggagaatacatgcataggattggtagaccgattcagccaacaaaaatcaggctcatgaagctatagctagctagtttattatccttccctcctctattttaatatttttttcctaaactaattatttggtcgcaccgttgtattcgttgtaattaaatctttacaacaaaatatcatatgtttcatacgtgataaagacatgtttcagcatgtgtctaagtgtcttcattatgtttcgtaaaattcacgcaactaactacacctaccctgtctcctctccatctatccatgcatgtatgcatttagcaaccttcaaaacgatttttcttttaaactacttatctattcgatcacactgttgtattcgttgtaattaaatctctacaataagatatcacaagattatattttttatgaaacaaatatctttcaattctttaacactcaatgtttcatacacgataacgatatgtttcaacgtgtctccactgtgtttcacaaaaaaatattacttcatgtctagattcattaacatctatatgaatgtgagcaatgctagaaagacttacattatgaaacggagggagaaaatgtttcgactaaattatttgtctagccatgtataactcaatgtttcactagtggtcaactaaaatatttgaccatccgattttttaagaaacaatcaggcacccgatttggagtttcttcctaaataagctaggatatattgccacaactcaccaagcataattatgtgaagttcctagaatgtcaacaagctccttcataagagaggggaagctcctgctcagatgctcgaagctttcgctgccggtgacggcactcaggttcgccggcgacctgagaaaatcgaagcacgccttcttcagccccttgcagtggtgttgatcagccagcgcgaggatgtccatcaccgtgcctatgccaatgtacttgcacaatctttcctcgcagatcagcttcagcctctccaggttgtaccgatccgccgcgacgagcagatgctcgcacatggtgtcctccctctcctccatcgtctccggcaacgagtcggtgtacacgaagtggagcaacgccttgaacaccggcgccgccatgtcaccgatttggatggcatcgttggtggtggtgtcgctctccatcatcatgccaaagagctccgcgttgaagaccggtgaccgtgccgcgagcacgcaccggtgcgctgtgaacctctggccggcgacctcgaacactacgtcggtgcccttctcgttcttgaggaggtcgccgaggtggctatggaggttggacgggggcacggagacgaagccggcagcgccgctgctggcgtcctcggcacggtaattgtcgaccacgatgatgtcgcaccggatggtgaacgaatcgtccctgagatactccgatttctccaaatcttctctcctgatgaacttggggtaaccccaggaagaagacgaagaagtttgcttattgaacgctcgaacggtcttccatgccaaggacggcgcctgcttctcaacctggccggcgaagcaaatctggaactgagccttgacgttcctgacgacgatctcgtcgagcacgaggaacatggagatgtagtccgcggcctccaggacattgccgttggggtagtagcagatgcgccagcggtggccgccgacggcgaactggcaggagaagagggcctcgccggtgggcgtggccttggtgtgcgagtagccgtcgatcttgaggtagtggtaccctctggaggtattggcgacgatggcggacgcggacacggcggcggcggttgtcggagacaatgctccatggctcatcaccggcggcaaagtaggcccgtcgcttgttgctgctgctgctgctgatttgcaaagtttagcgtggggtggggaagattagctgcggaggaggaggaaccgaggaagccggaaggagaaggaaacgcgacgacgacgacatccatggttcttgatgccaatgcaggtacgcggtatataataacgtctttatccgctgctgtgtttttaaaatctcggaatttgcgttgtcgccttgtcgggctctgaatcatggtctcatgttatttttactgtgccctgatatgtttgcgatggaatatgagagaaatacgagttaagcttttgtatttacaagttttctatcccaatacctatacatctttcgaaagatttttatgatcgtatcacacagatttttaatctttggattaaaatctgatagatataataaaaagcaaaaagcaattaagaaacatcataatggacactaaattaccatatccttaataaaaagaccaaatccaatacaaaatttaaaatttacatgcgaagattcaaaaattacagtgtaacttacaaaagttaccgtgtaagtttcataaattacactgtaacttacaagaaaatgcactgtaaatttgagtgagaaaatcgagtgagagataaagaaaaaatctttcgagtgagatatagcaaaatcgatcccggtttatcttattgtaggtttaatggagagttggagactaatagagaggttggagggcaaaaactccccttttaagtccatgttttaattgagaccgatgaagaggccatatggactgcgggccgacggcccagcccatggcatggcgctttggcacggcccaggcacggcatggtctggcccgtgccagccgggcctgatagttggaccatgcttgggccgctgccttggcacggtgggttggcctggcacagcacgaaagtcaggagacgaataaacttactgtcagccacatgtaaagcgagaaatttgggattataccatcgcaaaagagtggtttcgctggaatcccatcgcttcaaactgattcactggaatgccagtttaggtgttcactaaaataccattttcttttcgttcttatctatgaatagaaatgtttttctcaattttattttcggagaagataaatcagttcaaagaaggtaaaaaccaagcaacgtgcagtctatgtggaggttcaactgacataactatctgttggctaatggctacagtaaagttattgctgatcaaatggcagagttgtagtctcgcagatatatacaatgaattaacaaaacagagagaaattttgatgactactgcataaagaatcttagaaacatgatatgtttgtcactgaactaagttactgtcacgtcctatgggccgggcttcaggcactgggctttggtccaggcaaacagggtgcatgcctttaaaagagaaggaacagcaacagatgaggcatcgatgaagaaatcaacagaactaaagccaaggcttcttcctcctccaatttcctctcatctctctgttcttccaatcctagtttctgttctcttattcccagtcccctgcttctcttcccaatctacattgctaattcctctcaattgtatccaaattacttgagtgattactgctatgaattatcggttgcttccggtgttgggcattgatcggtgggtgggttgaggatcgtgacagttaccgagcatggcaaccaactccgtcataagagaagggcagctcctactcagatgctcgaagccgtcgccggccatggcagctttcagattttctggagagctaaggaaatcaaagcacgcatttctcaggccatcacaatggtgctgctcagctagcgccaggacggtcgccaccgagctcacatcgatgcgctcgcatagcttctcctcgcacaccagcttgagcctctccatggcgtacctgtccgccgcgacgagcaggtgctggcacatggcgccttcgtctttctccttcatctccggcaacgagtcggtgtacgcgaagcggagcagcgccttgaacacctgcgcctccatgtcgacgacgcggacgacggccttcctgcggctctccttcattgagcctagcagctcggcgccgaacaccggcgaccgggccgcgagcacgcaccggtgagcggtgaaggtcttgccgccgaccttgaacaccacgtcggcgcccttctcgccgaggaggagctcaccgagatgccggtgaagatcggacggcggcacgctgacgaagcttccagttcccctcgcaggggttcttcttctcgccgccgtcgcggtcgccgcctcgggcatatccttcgcgacgaactcggtgatgacgacgacgtcgcaccggacggtgaaggaattgcccttgagatgcctcgatttctccaattcctccttcttgatgaactttggttgcccccaactggcatggctgaagaacttgttcgcatccagcgacggcggcggcggcggcggcggtaatttgtcacccaactcgtcgtcgagcagacgaaactggagctgcgcgtacacttccctggttacttcctcgtcgagatgaaggaagagggatatgtaatcgccgcagttgggcgtgttgccgttggggtagtattggatgcgccatcgatggccgccgatggtgaaagcgcgggacttgagggcagtgctggtggggaagagatcccgggtgcgcgagtagtcgtcgatcttgaggaggtggtacccgctggccgtgccggcgacgatggtggaggcggatcgcgacgacgacgacgacggcgtcggcccgccgccgctgccggcggtggtgccagagcgtgcgggagacatggcgcactgacccatgattgctagtgctactcgcgacaagggtttgtagctttttaaaaaaaaaatcaagaaatattagtaacaatgttcctttcttagattagattgatccgtgactatgcttcttcttttctttaattttcaccagaattatatgtgtctctgtttaccgtgtacaactgcaacattggtgatttttccgactcggccacgtgaattttccgactcggccacaaagtttcccttgtgtattactcccttcgtattttaatgtatgacgccgttgactttttaacaaatatttgacatttcgtcttattaaaaaaatttatgtaattatcatttattttattatgatttgatttatcatcaaatgttctttaagcatgacataagcatttttgtatttgcataaaaaaaattaaataagacgaatggtcaaacattggttaaaaagtcaacggcgttatacattaaagagataatccatgaaatgcaattgacaagcatccaaatcccagaaatgccatcgacaagtgtgagttctaagaaatgccatcgtacaaacaactttgtcccaaaaatgccatcgccggacaaaatcgtttgtacgatggcatttcttggaactcacgcttgtcgatggtatttctgggacttagatgcatgtcaatggcatttcttggattatctctacattaaaatacagaggaagatgtagttagtccagcatattcccaaccaaatcctgtgtctttcatctcgttcgtctcgagcaggcggttaaccttgcctgcctgcctgccatggctactgccgtcagccgcggcaccgcctcctccattgtggccgacgcggtgaccgggtaccacctcctcaagatcgacggctactcgcgaaccaagggcactcccaacggtgcagccctcacgtccgaccagttcgtcgtcggcggccaccgttggcgcatcagatactaccccaacggggacatcgccatgttcgccgattacatatcatttcacctcatgctagatgaaaatgccaccagcacgaagggtgtgaaggttaaagcccagtttcagatttgtttcgccgatcaggtacggagagagattctaatactcaggtggacgtccactcgagctgttaaaatagttttggtgacgagtaagaacttttggtgacgagtgctgtcatctagaccagtaagaacttttggtgacgagtgcttgacttggggtcatgtgaagttgatcaaaagggacgaatttgagaagtccgacgatctcagggacgattctttcaccattcggtgcgacatagccgtcgtcggcgagatccgcaccgagaggacgacggagatcgccaccgaaaccttcgtcaccgtgcctccgcgtctgacctgaaccagaagctcggcaaacttctggacaccgagaagggtgcggatgtggttttcggggtcggaggcgagacgttcgccgcgcaccggtgcgtgctcgctgcgcagtcgccggtgttcagcgcggagctctttggtccgatgaaggatagcgacagggcaggcgttgtccgcatcgacgacatggaggcgcaggtgttcaaggcgttgctccgcttcatgtacaccgactcattgccggagatggaggaggaggaagacaccatgtgccagcatctgctcgtcgcggcggatcggtacaacctggagaggctcaagctgatctgcgaggacagattgtgcaagcacgtcggcgttggcacggtggtgaacatcctcacgctggctggtcagcaccactgcgacgggctgaagaaggcgtgcttacattttctcggctcaccagcgaacctgagtgctgtcctcgccggcgacggcttcgagcagctgagcaggagctgcccctctcttgtgaatgagctggttgccatgctggcgcctccaatccctccatcgagtcatgcttaatgtgttcttggctattagcaacggagcagtggtaattagtggtttctgtttaggcttttgttctcaggcaattgtagtatatactgataataattatggagacaatgtccctggattatattggtaagagcttgcattgtggaacatgggtgttatttttgtaattcttttggtattcggtaaaaggtagacaaatatgttgccgtatattcagaatagtgtttgcaatttcagcccaaagaaaaagagcggactcggccccgtatcgtcctttagggcgacacgggcggcaaccctcacccgcgccaccacccccacccttccctccctccctccctcgctaccgcctaagcatgccaccagaaaactgcgtggctacaacaacggcagcagcgacagggcctccttctcctcgagttcgcagaggatccagctgcagtggctacaacggcggcggccgaccatatccagggggccatggcgcccgggtggtctcttaccaccgacagtccagctacgatggctgcacgggcacgaagtttcttcaacgcggctgcagctagggtagcttcggtggtggtggtgatggggggtgacggggacgacctcgatggcgagtttcagtgtcatacaatggctggcggtcgaatagcctcccctccattccctcccctcatgcttggccgcctccagtagggagcgcagcagggaatgcgtgtgggctagctaaatccaagggtttttggcgactgcaattctgcggtggcgatggcgtcagctaatggtagtgtgcagggaagcagttgagtttggtggtgacttgtccccctcttgttagccaggcatcattctctcctgggagcacctccccttcaatgtccggactaatctagatctggtcgtggggagctccaagggaagggtggaggcacaactgacacagcagggaacaacgatggcgtggaggcggcagcttcctattagcccgcttgtgatagcgggtggtggcttgggctttggtggaacgattttttggtttgtcggtgataattttacggattggttgtgtggggctagacggtgaatcgccggcaaaagccttgctaggccattggctagcttgacaacgacgaagtctttaggtgtcgttttccttcttggaggcgttgttcttcctccccctacatcgatctccaggtgaaattgttccgatttccagacaagtggtggtgatgtttcacgatgtgtcctccatgggggcaccactttggagaaccttactcatggtggtcattgtcggactgttgcatcggctttgaagctcttatgccctagcatgcttgacgatgcctttatcttctttgctctgcttctttactatgcggcggacggtcacctccctttgtttcactctgctaggtggagttggagctattgcattgggtgtgacgaagcttagaaacgatgacaccctgcaacctctttctaagtattggtgcccgtagtgtgtaggaggtggtgctttgggtgctttggctgatttccaatggaaaaggccggatctgcttgtctatttacacgcctattgtgaagtcgaagttgttgtgtcgctaggtggcaaacttggcaacgacgacactttcttgcaaagtcggagcagccctgtcgcttatacaacaagcttagcaacgatgcccgcattgggttccgtcgttattttagttgttagcaggctagtgtgggtgttgttggtggagtttcgtggtagtcatggttttcactcagttttccctaattaactgtgcattgtgaggttgggtctcgtttctccttaaaatgggacatcttcttttatataaaacgtctgcaacggctaaaccgttcgacaagaaaatttcaatcaaaaattaattttggcaattttggacgccctatgaggctatgccccctctcctgtgcaagacactatttcgcccaaaattttcaatttttttcaatattttgtgagtttagtcaaattttagtttgatttgttcaaattttttttaaaaaaaactctaaaatatgcaaaacgaaattgcagaccttgatccagaatagctgcctacctcgtgcctacctcgtgactcgtgaggtatctatactataccccactaagtgtaaagctcaacatgcatgtaaccatgccacatcgtcactgactagccataattacatatttacttccataaaagcatatccaatcatcacccctcacatatttgcacaatattttaacaaatctatctataatttttataatatttaacataaacttttcaatatgtttcccataaaagcgtggatttcatttgtttgtttcatgataagttgataaaccctgttggttcttttttttcttttttactcctaacttgattgtcgaaaaaaatatattgagaattgctgagtaattgtaacaccctgaaaattcccaacaataaaaaaaatcactaaaatttcaaactctttaaaacttttgcatcatgctggttgttatgattgctattgcttgccaaactgtaaataattacaaagaaagcaaatccaaacaaagggaaggttaattactaatttaatttatagatcaaatattaaatattcgaaccatgttgatagcttgatgtcatgattagctaaaagaaacagtaaaatcaaatctaattcatttgagtccaatctcacatgaaatataggaacacatgaaatgatgatcaccactataatgatcgtgtttataaataagtaattcacaggaatatatagattgatacttagaacatttcaccgagttcctcatgacatgaaaatcactcatataaaataatggtcatgtagataaattaagctttatatataaataagaatatgtgagtgtttaattagacaattagattaatgttgtaccgagtctcaatttatatttatagaattactagatccacgtaaaatatattattgtacaaataagttcattcaatgtactattgtaataataatggccacattaggatattttaattaattttggaaccctcaaagcctccaaaattatctaggttaattttggaattatacctcatttaaataatgcaatagaaaaatatatataaaaataaaatatgggtaatattagaaattgagtaaactttcatctaaattaacacatctattgggtaaacatcaattgtgtgaaatttagaatttatgggacaagatttgaatagcaaatcaaccaaataggaaaacccaggaaaatatataataataataagaattaaccctaattaaaaattcaaataaattatataaataaaatatgagtaatattaatctagaataaatccattggttggaatgacacaaacattgagtaaacttcatttatgcaagatttagaaattatagaatcaaatttatatgggaaataaactaaaatcgggataaataggaaaaagacactgttcattgcactctaggtgttcgacgaggctccctagccccttcccctcccctgccatgcgcgcctcgtgccccgagccgtcaccatcgccgcctgccgccgtgccgctgtcacctgccgcgccgcgcgccgctcggccgtcgccgtcacgcctcgcgcctcgtaccaccgcgcgccatcgccgttgctgccgctcgtgtcgccatcgtcgtcgcccgcgccgctgccgcgcgacagctcgcgccccgcgccgcgcgccatcgccgtcgccgtcgagcagtcgccgtcgccgccttgagccccgcgcgccatcgtcgtcgccgtcacgtcgtcgcctcgcgccccgcgcccctgccccgccgcgcgcccgtcccacctccctctgccgcctacgcgccctcgcgccccgtgcactgccgcgccacgtgccgtcccatcgcgccgctgctgcgtcgccgtcgttctcgccgcgccgagccccgcgccgacgtcgcgctgtcgccgtcaccgtcgcgtcgccgcgtgtcgccgtcgcgtcaccgatcatctcgagccccgcgccgttgccgtcagctgctgcgccgtcgccatcatcgcgccgagccccgcgctgcgcctgcgctcatgtcccgtcgccgctcgcct

SEQ ID NO: 83531 - DNA, 1316 bp, Oryza sativa
  unsure (1)..(1316): unsure at all n locations
agctccaacgagcaggcgcagctcggcctcgcgcgggaaagcgggagaaggcgcgacgggctcgggaaatttggggaaatgggagaggagagcccgaggatcgtttttatgggctcggggtggtgagatcgtggctgtggagggtggaatcggccggcaacggccgacgacgtgggtgacattgtgggcgaagtggggactcgatttggcgcaaaaaattgcggaaaagtgggggatttggtggaggagatgaaggggaaccgatttcactcggtttgggcgcaagggcgcgggtggaagggccccgaattcggcggaacgtgggcggcaacggccggccatgggcggcttcggcctgggaagccgaaggtagtaggaggacctgacaagtggggtcgccgggcccacctgtcggggagggagagaaggaggagaccgagggggttattcagactttgtgcgaggggaagtcgatcgcgccgagaagggtggggtcggcccgagagggaggagggaaggagagaggggcgagcaggctaaggagggggaaaagatctagggccgaaaatggcccaaggagaaaggggagattatttgattttctttttatttaattggttaaatgatatttgtaatagtaaaattagatattgagcttcgaaaattcgcgggaaatttcagaaagttcattagggcacaaagaatattacaaaatattctcggccatgatttttaaaggaaaattttaatttcctctataatttcacttgattaaattgatttaacttttatttaatttctagaaaatgcattattaaatgatttttaatcccgacgaaaatcggggcattacactatactattaatatatggtcccacctgttatacatatattacgtcttggagtccgcgctgcagctggctatatatctgtaacccactgctcttctctctctttttttatctttttaaaatatatgtttatagctggtttatagcatgctattgtacatgctcttagagcaccacaccatagctaataagtgttcctagaaagcttaataaattttaataaatttttatcgtatggtatatactccgtagatagaagataaattccgtcgaccgatatctcgactcaccagtatggaaacaagagcgtatggtagtccatcattttctccgtgtgagacagaagtgtgacacccttgtttaaacctagggcaggccgtcataaagtcctgaaataacattccacttnccaaactaatagctaactttctgtctgagctaggaatcccaaactcgtattacct

SEQ ID NO: 83532 - DNA, 601 bp, Oryza sativa
gtttgtgagtggtttggagttcaccaccttcggagtgaaggaagaactaccccgagtgatcgaggcttgggtagtcctctccgtgggccggctcccgccttgcccaccccttgacgaaggggacgtgcggtggcttcgtggttgagcggtggagttgggctcgcctcaacggggagtaggaaaccggcgagtttccgaacctcggtgaaaaatctcttgtctcattgtctcatttgattgtcgcatttacatttgtgcaatttatatttctagagacacacttgagatcatatcaccctaggattgcaaaacatcgacataggagcgtgatttactttcctagagatatatttgagccactattaccctaggtttgcaaaacataacttagttgcttagttagagttcaccctcaccaagcctagcaacttaggttagatttgattaggtgttatttagttttaaatcgcctattcaccccccccccccccctctagtcgacatctcgatcctacaatgggtaacatatataagaaaattatatgaaaaagggagtatagtaaaaattaaaatgcctacggttaaagggggtgcaaagtgc

SEQ ID NO: 83533 - DNA, 1397 bp, Oryza sativa
  unsure (1)..(1397): unsure at all n locations
cccccttcttggggtgtggccccgcccatcggcgcgtgaacggtggtcttcggccccggccgtcgcctcgggccatgcgccgccgcctttggccgtcgccccgctttcccgcacggtcggtcaccgccgtcggtggcggtgcatcgccgccgcctcgctttggtcggccggtcggccttaggccgagccgagcccggccggcgcctcccttgcctcccttttgagccaccgcctggtggggcccacttgccaggcgccacctccctccctttggagccgctgacccgtggggcccacgtgccggcgccccccctttggctgacgtcagccctgggctttattgcgcaataaagtgattaaggctttttctttattagtaaaaacacagtttatcttctaaaattcataagtaattcatccgagctccgtttaagtccattcaagtctcagtaaatcaagaaaaatgcaaagaatccattaaaaatagttttgtttcctgtttcagtagtcttatagcatgttttgcttgtgtgctttgtttgtcgcgtagatttcggccgtttcgtcgatccgcggtttctcgaagacgttgctgaggtctcatcagtgcgagagcaaggcaagtcatgcaatacgtttgatcatattgtacccaatttacaaatatcccgcatttctattaaatgttgcattcttttacaatatcatgtgggatgggtcctactactcatccatatattgtttaccttatgccattgacaacttgggtattaaaatgactagatgttgatttaggaaatgcttagccatgcttagttctactagtacacaaaaagggaatcacattaaagcatagactttgattattggcaatagctttggattggtgccaccgcaagggtgttggttaattaaaatacactgaatggtgggctgtgggtgcatggttttgctggtcgcacccatggcaattaaggaccggttcacgggaaaccctgggagacttaccgtgcttaccccaagcgggagtgggtaactgcttgatctgaagtatagctcgaccctttcctaggcaccggtggcgagggtgggcgtgatggagttgggtcggccggggtgtccggttgtccagctgccggattcactgcggcgcaagaggggacccgctactgccttttgaggggtgggggtgaaaccttagcgtggtgtggatggttaggggagggttatgtggagggtcttgtcacgattttccccctttgcagtatcatggtgatacttcggggcatggcgacatgtgtggaatcgtgtcttgtgggtacagntgtacacctcttgccagagtaaaactattcgaatagccgtgcccgcgggtatgggcgatcaaccagattcac

SEQ ID NO: 83534 - DNA, 7408 bp, Oryza sativa
caagatatcccataaaatcaggaaaagaaaaaggaaagagttcttaatcttaggtttgccggattttattgcacactgtgtacctgactctcatgaatcttgcaaactttataaaagattaaccggttgcatctttcatctacattttatggagatcaatatgaagtacctaaaaataataataatccttattactatgtgatttttccagaaaagcatcagttcattagataagatttctaaaaagaaaacaaaggaaagcatcccaagattccatttggaatacaagtctagaggatgagctgaaaatggataattagacagatttctgaaaagaaaacaaaggaaagtatcccaagattccatttggaatacaagtctaaaggatgaagtgaaaatgggataattagacagatttctgaaaagaaaacaaaggaaagtatcccaaaattccatttggaatacaagtctaaaggatgagctgaaaatgggataattatactttttaggcttcattcggcactaccatttcccagcttatattccctcattttccacgcgcgcacttctgaaccactaaacagtgtgtttttttttttgcaaaaattttctataggaaagtggctttaaaaatcatattaattaatcatacgctaatgagccatttcgttttgcgtgctgggatgagcagatcctgacctgctcatccgaacacacccttacttggtagagaactgcgagttgatatgtgttcagaaagagtacacgcaacacaagataataagatggaaaagtgaaaaccaaatatgtgtacctgatgcccaatgaacctggccctccttaagcattcacggtacagctacaacatgaaaaaaaacaatgttcaacagcaaatgacatttttgcctcatctgacattatttcatttcattgcaatggtatctcataaataaacacaacgaaaaatcaggctacacgggcatgacagacatgttttggaaaagcttttgtaaagttttagggtgattcactgatagagctgctctaactatacatgtaaaacatttacaagactgactgtagaactgttctaaccaaagaaccatacatgtagaaattagggaccgactatagaaatgctcaaaccaataaccatagatgatacatgtaagaaaattcgggactgactatagagctgctcaaaccaataaccatacatgtaagaaaatttgggactgactatagaactgatccaaccatacatgtaaaaattcaggactgactgctcatcaccacacacaggtcgtgttgatgtcgtcgatcggaaaaggcgtaacgcagaactgagacttactctgatcacattatcagcaagctctggaggcaaagccttttgaatcgaaggcatctccttccacccactcttcagtctctgaaccagtcactgaaaacatgtaaccaaaaaaaaaagatcaaacctctagttaacccacaaaaatatccaattctaccacaaccaatcgccctgccgggcattcttccccacaccagaccaaccatcgatctgaaaacttccccacaccagaccaaccatcgatctgaaaacgaaggttaacctaaccatcaagccaagcccccaatgaactaggacagtgggaatcttgcagtgcagctccgacatggaatcgaacttggcgaatcccatgttcttggccccgctagcctgaggccttaccagctcttcgtccgtcgtcatcggaggaagaggaggagcagggacagaaaagggcgcagacggggaggggtgtacctgtgactgccacggcggtcgccgtggggagggggagattgccggtggcggtggcggcggcgcacgggcgggaggggacgagagcggcggcggcggcgtcgtcaagctgcggcgcatggggaggaggcgttgcagagatggccgatgggatgtttatgggccggagtagagaggcccagcccaagagaaaatttggcccatgggcctctggctctctgaaattgggcttacacgaggagacatagccccacaattgtatatttgtcgacacatgtaattatagaatattatggagggatttttaaaagtaacaatgtaattacaccacaattgtattataattatatttgttaaattttaaaaagaaaatttgttgacgaatgtataggtaatatctaggtgacatatcgtgagttcgggcctaatagtgaatgttcaatttggtaatgttaaattttggcacattcggcattactgagtttcggtggtgctaggatatgttttagttaaagccaaattttggtagaattttcaagggggagacttaaagaattatcaaaatttgctacggtgacattggtaagaatatgtttagtttgttgccctatcggttaacattgaaagtgtcaagaaaaataaagaagccttaaaacttaactttagaactgatttcaagtatttttaatgtgcatttttaatattggtttttaagtcactaaaatacgtatataaaaattttacttataaattattttttatcgctaataaagccgatttagcttataatcaactcctagttaatcgatgggggcatttgtctttctcttgctctatttcaattgcaacaaacgatctgttttttttttctcatgaacttcatttcgatggcttgaactaaatttgattcctagatcgtcaatctcttcagttcaatttttacatatatatttccaaattgattcatgtgcggcaatggcaattcttttcacttccaatatttctgtaaaattattctgtattgggaataatttgctctttcttttttgggaagggaataatgtgctctttctttaatgcaaatgttagagtatatggtagttagagttatattaggataggatttgtttgtttggattccttccatgtctgtaatccttcattatctcctccccatgtactcctatatatatcggccccccgagtctcaacacaatgagtcccacgttacgcagtatacctctcctatactatccaacatggtatcccccgaggctcaatacaatgagtcccacgttacgcagtatacctctcctatactatccaacatggtatcagagcgggcgatctagttgcctctctcacgcttccgccgctgtcgcccccgggagggttctgatctcctcccgaggattgtcgccgttgtcacccccaggagggttctgatctcctcccgggggcggccaccctctcctatactatccaacatggtatcccccaaggctcaatacaatgagtcccacgttacgcagtatacctctcctatactatccaacatggtatcgagcgggcgatctagtcgcctctctcacgcttccgccgctgtcgcccccgggagggttctgatctcctcccgggggcggccaccgttttttgataccatattaagttgcatgcatcgcctctctcacgcttccgccgctgtcgcccccgggagggttctgatctcttcccgggggcggccaccgttttttgataccatattaagttgcatgcatcgccaggccaccgttttttgataccatattaagttgcatgcatcgccaggccaccgttttttgataccatattaagttacatgcatcgcctctctcacgctttcgccgctatcgcccccgggaggtttctgatctcctcccgggggcggccaccgttttttgataccatattaagttgcatgcatcgagttgcatgcatcgcctctcacacgcttccgccgctgtcacccccgggagggttctgatctcctcccgggggcggccaccgttttttgataccatattaagttgcatgcatcgcctctctcatgcttccgccgctgtcgctcctgggagggttttgatctcctcccgggggcggccaccgttttttgataccatattaagttgcatgcatcgcctctctcacgcttccgccgctgtcgcccccgggagggttctgatctcctctcgggggcggccaccgttttttgataccatattaagttgcatgcaccagccagttgtacctaaaagcctaagctgataggaaaaggcgggcaattcactttatacactccaacactccccctcacgcgagaccccctcaagtctcaagcgtggaatattggagtgggctgcaattattttttttaattgcgcgccagccaggattcgaactcgagacctctgactctgataccatattaagttgcatgcatcagccagttgcatctaaaagcctaagctgataggaaaaagcgggcaattcactttatacactccaacagcaaagaatcatgccatttgcaaaaattgctccatggaagacatgaattagtgcttgtacctttttagcggctcactgtttgcaggcatgatatgttgacatgttgttacctataaagaagttccttaatttgataagttggcatcattcacttctttgttggctagcccacaaatcaataaagtgtcctccataaaagcaaaaaatcaggttgggtctcttgattaattgtagtaacagtacctgcttacaaaaagtccaagaaagcacatactgtccattttcgcaggttgctatgtgaatgatgagatggttcccgtgaagagaagagctagctcttacctctcatgtgatcggtttagagcaaatttaaaaccaaacgatcagacaaaggtttttgttgcctagtttcagattataactttacaagaaagctagtagtaaaaagatgcttaattagatgcatgcatgaaaaggaaagtgcatcaggtgatgagtgtttctcatcgaagttcctttatagcttcctgtctagatacgatggagcaattgcttgaccacgtcattagcaagctaaattcaattatatctgggtcccacacctttacccaagttgtagatgactctctttagagtaggtacaatagcaggctattagtcagccgtaaacatattttaatgagataaaagataagagagaagagcagcaaggtacaaatctgtagccagctgcagcgcggactccaagacgcaatgtgtgtatgacaggtgagaccatatattaatagtatagtaagcacttattagatgaattggctgttaaattggctatagatgaattagagctagtagtgggctatactattaaacttgctcttaggtggccaaaggaaaaggtttatctttaattgcatagcatggatcatgccaattaactaatgagttgctttgtccataatttagtagatagatttattgtaaaaacatgaaagtacataaaattattctaatgtacgtattttgtgttagttttactaccattggagtgccatattcattactgaagccattatattggctattcatcatattgcaacaaaatcgttaagctccaaccacaacataccgtgagtaccgtccaacttatcattctattagtggcttgattcacctttattctctatttcggcgattggacccaacttcttccttcactatgatggtcggtcggatttagacttcccacactcgtggaagcgtcaggaccctctagaaacaaaatgtgcgccggagatgcccaaggcaccagcccggatgatcccacttcacttctcttgctatcctcaattcctcatgtccccatatcccttcatctccctatcctctctcctatcaacggccacctttgcacctacctccacactcgtcatctttctctcctatcccagtgcatctcagctctccgctacgacaaccatgtgcttggtggtcaagtcccttggtcatttggcgctcacatgtcgacgctgcagccgattggccccatgtagataattagtaggccaaggaggaagctagagcttatgccacatgagggtcatgcaaatgtgtaggtttgcagctgtggctcgatgatgacatcgcttttcaggacgatgcaaagggagttcgtttgctagggcaacggacgcaggggcattcggtttttctttttggctcgaacgcctagtggagaccgtttcccaaatctaattctctcatccaatcttggctcatccttgttcagctgctcgggaaaatcctatcttaattcccatgtatgttttatgttggatgagtcaaatttatggcaaatttgttttgcttgagctaaaaataatgggattagctacatatatctttatatagaaattctctccaaaaaaaacttttatgcataactatatataatgtaattataaatttgatataatttgaatataattgccttgtaactcaacaaatgtgttgtaccacagtgggggatagcgcccgtcattccaacaggatcatccataacacatatccgacgggtgaaaatttgaaagtttatatcctctaattttcttgcgacaaaagaacatcagttatgaaaataatttcgggtccacaaatataatactacttgaaaataatttcgggtccacaaatataatactacttccgtttcaaattataagactttctagcattgcccatatttatatagatattaatgaatctagacacacatatatgtctagattcatttaacatatatatgaatgtgggtaatgctagaaagtcttataatatgaaacggaagaagtactatttagggtatgccgttaatgccaagaataataagatttaaaatcgagaagaaaatacgaaccggagatcgagttcaattgcctcttttcttgaggcatttgcaaatttaccacatgttttttcaatattacaaggatgccacttgaatgacagttctagtggcatttttgtaattttctagtgacagttttatgataacgattcaaagtagtactccctccatttcaaaatatttgataccgttgactttttagtacatgtttgactactcgtcttattcaaaaaatttaagtaattatttattctttttatatcatttgatttattgttaaatatactttcatgtacacatataattttacatatttcacaatttttttaataagacgaacggttaaatatatgctaaaaagtcaatggtgtcaaatattttgaaacggagggagtagtaaatttgcaattgcctctcttctttctttttttctttttgccgttgcccgttgctagctgtatatacgcatgtatccttggctcgcacgacacgaaacatcaggatcatctacgccgcgtagccacaccaaacaccgaaaaccacctccactcaaatcccgccacgcgtccggtcgcggactgacagggtgggcccacgagccccacccagtcacgccccgccacgcgtcccccctcccttttattattatt

SEQ ID NO: 83535 - DNA, 13686 bp, Oryza sativa
atggaaccctcacacgtcatagatgctcacgcccgcaccaatttggtcggaaaccctccgtatcgccctagcacctagctacccgtgcccggccatggcggccgtgcggcgccgctcgcccccgcgccgtcctacgccgtgaccgccggcaggtggacgccggagccttgccgctccctcccctggtcgccgtcgggtcgccctccgccggccttgccgcgcgcgctgcgccgcccctgctgctcccgcacggtctggaggtagaagacgataggaaaagaacgagagagagaaagagagcagccgagccactgacaagccgggccactccccatttttctctaacaaaaataattcggtagaaaagataataagacccctgaccccacccgtcagtgactctgagctgtagataggtttcggattaaaataaatcggatgtgaacagtactgtttcgcaattattcgaatttgaatccttacactagcataacttattcattttaactccgatttgaatgaaacttgatcctaaattcatctaaattcataagctttccaatggtatataattcattatttaagaaaatatattattaattactaaataattaatatcaagatgatgcatagtagtcaacttaaaaatgtgctaataaatatatttgataatgtacaatagagtagatgtaataatataggcctttaacatgctttgtcactgtagcaaccacacaaactaattttaaataatgtctcaaactaatgtattggaagatactagcactatttaatggttgtattattaaacccatgacttatagattatttaaataataaagttagccttataattaggtaaatcaaacatgaatacacatagatgagtctttaatttatttatgaggaataggaacagagttggtatgatagaaccacccaaataaggttgagtcggttaacatccaataattacccaaacagtaaaatcacttgtcaacccacttagatcacatatactgtacaatccatttaaaatcatacataggaacaataacccatcttttgacaaacatgtatattagataaatactagttatatattttgacctcatataattatagttcaactgtaaattaggattgttcattaagggataatatgtaaccacaatatgattaacctaaacaactctaacatagaaagcatggataattattaaccttttataatttattgcgacaagtgaaatatgttcataattaaagtaaagcctccatcaattaaataataatacaaatgattcattatttgattgatcctaaatccatccgacaacagaacctctagtatacgaccattttatttagatagatgcatgtgtagccataatccttccatagccattagctagactacaccacatattagccagatacgtatctcatttatactacattggctagctcctgaataggccacgttgacaatagaaagattaagaaaccttagcccctagcgagattggaatccattagcagacatgaatagtatattttgttgtgcatatttggttgttatttgaatattggtttttcttgcgtattatagaatttatgtatcggttagtcgtgaggcaacgtcagcaacttccaggaggtgaaggttgatcaagaattatatcaagaataaggactagactgagcaaggcaagtcatcactattcctcgaacatgctgatcctaattgcgaaattgttttgtttacaaataaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgtttttgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacagccgttgaggtagggccaagaggcgtgccctacatcggtgtcgccattggtaggactgccatgagtgtgtgagagagagaacttaacttgaaccataatttaatatgtttgtgagacttctctttcccgggagcgccagaactcctctcactgctaaaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattgcacttggctagactccaaattcttaacttgtgggggatgggatattgcatgatgaattttatgctgatggagccacatcccgagaggagggaaggtggacatcctcagaaaaccatgacgattcaatggcgggaagctatccttgggatcacaatggatggtggacagaactgtcgttgtttaaagtgaacactggtactaaaatttgatcagtctatgctaggttttaggcttgtgaaaagaattgtaaaaattagctttatgcaaaagaacctgaaaccattccttgaataccctctatcatatgcattgttgttgtggttgctgagtacggttggtactcacccttgttacttatatatcttttaggagagtgttgaagagaagcccttgtcggtacgcttgcgtatcccacaagatgatcggagtgcggtcttgttctaggtctcgttccccagtcgactgcctgtggcatgttaaccgggcccttatattattttgtcttccgctattgttctctgatagttgttggcctacctggccctaatgtaagtgtttaactcttttagcctaaattcattcgtgatatgttgtgatccaactatgtatgtgtgtaccaactactgatccagggattggtacggataaacacagaagatttccgattttcaaaatcgggggtctacagtaatttctgcagcaaagcgcagggaatagagctttgtgtccaactgctatcatagtaatcgtttgattgtattattgtaggattataaattatttacgcaaatatgttggcagtatatctatgagaatacacaaaagccagcgctaactaatatagctatattatgagtaacaataaagtcattattcctgatttatttttgacaaaaacaagtcattattctcgattaattgggatagttgtagatatgccatgaaaagaaaacagagaatttcttaatacttctactgaaacaggaatctatttatctatctattatattattaagacaacttgaaaggaggcaccacattcactgttgaggctagaaattctcacgttaatcgaaggaaaacaaaaaatattaaccattagattgtgtttgatctagatttaaacggttaagatttaatagtacttgaaaagttttggaaacttgtaataagtttgacatataagaaacggacacacgtattagaaacggacaagtacgttagtccattatttacaaaggtagactcacttttccatgtcagattatgtttagacatggctacagcacaacagcatgacactgatacaattcgtaaagataaaagttgacagtaggagtaaaaaacagtcaatttgtattcgttgcacattatgtcaccctaatttctatggactatggtgatttaaatattctcatataaataccaggcatcaataaaattgtcaacacaatatataactattaagaaacaatacaatcagcaaccgacaaaataaaatcctaatgatgattaaaaggaaggacgatgggcgggtcgtaaagcaatcggtcaaggcggttggtggaacttctagaaagtaaaaaataaaccctaattacaattatatatgatttttaaaatttcaatgacaatataaatgagaggcagtgggcaggtcgtataggagtacaatgacagagctgccgatggttggtgggacttcttgaaagtaaaataagaatttcaacgatagttatgtttaactttttgaatttcatgataataaagagtaagcggcgaacgggtcatagaggagtatattggcagcgtttgacgagatttctaaaaattataaaaaatgaaacccaacgagacaataaactcaaaaaactataaggtccaatttttaaaggttcaggcttctaaaacgtaaaaaataaataaaccctaatgataatcatgtttgattttaaaatctcaatgataataaagaagggatacaacgggttagccgtagaggggtacagtgacaaagtcgctgacgttttggcagaacttctagaaagtaaacaatgaacctaaataataattatgtttgatttttaaaataccaatggtaataaagagaagaggcagtgggcgaccatagatgagtataatggcagcatttgacgggacttctagaaactataaaaacgaaacccaacaggataataaactctaaatactataagattcaatttttaaagattctaaggagaatgaatagaaacagtgagaaggatatgacagaagtaaggggtaataactggtgtgacttttaaaaactataaaattagaagcacggggatgataaggtttggtctttcaaagttttaagataacgagataactatttaataaattttaagtaaaatcatattaaaaatatataattttatatgggtgctagccgcgcaattgtgcgggccacccagctagttatctgatgatgacacaaatgctcagaaatccattgacaagaatactgatgtcactgaattaagttgccgagcgtgccaatcaactcattcacaagggaagggcagttcctgctcaaatgctccaatccctcaccggccgtgacagctttcagattctcctgagagctgagaaaatcaaagcatgctttctttaggccatcacaattgtgttgctcggccaactccagtatagtcgtcaccgtgcccacaccgatgtagctgcatagcctctcctcgcacattagcttgagcctctccatgttgtacctgtccgccgcgacgagtagatgctggcacatggcatactcgtcctccttcttcgtctccggcaacgagtcggtgtacacgaagaagagcaaggccctaaacacttgtgcctccatgtcgtcgatgcggatgaccaccgtggtgtcgctctccttcattgatccaaacagctccgcgctgaagaccggtgaccgggccgcgagcacgcaccggtgagcggtaaaagtctcgccaccggcctcgaacaccacgtcggcgcccttctcggcgcagaggaggtcctgaagatgccggtgcagatcggacggcggcacggtgacgagcctcgccacctttggctttggagaggtcctcaccaccaatggcgtctcctccgagcggatccgcttggtgacgacgacatcgcatctgacggtgaaggagtcgttcttcagatacttcgatttctccaactcttcccttttgataaacctcagtcgtcccaacccaatgttgttgccaccaaaggtactgacctgcccgaggtcagcgatggaggaaggctgcagttcatcatcgtcatcattatcaccggcaaactcgtcgaataaacggaacccgtgctgcgcgtacacgttcttgtcggtgacaatctcgtcgagatgaagaaacagggagatgtactcgccgcactcctccgtgttgccgttggggtagtaatggatgcgccattggtggccgccaatggtgaacgcgcgggacttgagggcactgccggtggggaagatgtccctggtacgcgagtagtcgttgatcttgaagaggtggtacccgctggccgtgtcggcgacaatggcggaggcggaggacgtcggcggcggcgcgatcggcggcttaccgccggcggcgccggcggtggtagagcgcgtgtgagacatggcgcattgacccatggacggcaaggtgggctcgtcgtctattgcttgctttgctgcttgacgctatagctgctggattcgcgtatatggttaagcgctggagataagaaaggaactaatgttgcaaattaaggtggaaggagacgcaacgagagagacgagacgacggattcacgacagcaaaagtttttcgatatccactgtccagtgtgtccacgcatcgtatcacaactctcaggtttcccccttttgtttatttaaaaaactcctctcagctttccgggttttttctttttttttgttaaacaactcctctcacgttgatcggtaactctagttccttttcatactacaaaagagctttctatgatttgtgaatgcggttttaccactatacgtaaacaatgtgggaatgttgattttcaaaggcagttcagctgtaaaagtccaatttttacatgccgtccacctaaggaaccgttagggaaaaatcaatttttatgtgcggtccggcctaaagccgtccgtctgcacaaattacttttgagggatgggtggcttattctggaaatgattttagcaagaaaatagttccatcgcaattaccaattgctaaaaaatataattcaacaactttaattcaattcaaacacacaacagtttggatcccgttacacaaattcaattcaataatttggatctagttcaacaatttttggttcatacgtatataaaatcagatcgcaaactcacatatacaatcgtggtggaaaaaagggaagatctatgcacccaagcccaccgtcgtcacggcatcaactgctactggagctctcgaggcctgctgccaccggatccatcgctcgcagtgcccgtggccaccagatctgacctcctaggcctcgctacatcccaaccttgcctttcttgatgtctcttcttcactgctattcaacccgtcaacaaagttggatctgcctgacggttgaacaggtggaagaaccccgccatgcgaccctggtccattcgccgctgttcgtcctcatccgcacccatcaccatcgtctctctccccacctgcttctcgcctccttcgtctcctctcctctcccgctagcccacgactttgacatcgatggctgcgttgcgcacgaccatgtggggaggaggagcgacactgaatcagctatcagcagctcaacgtcgaacatggcaacgacctcctcgatggtgtcgaaggtgccgagccacaaccacttctggctaagttcacggatctatgccgagaacctgcctcacagacgccgccacacgccgcattttccgtttcaggatgtataaattatttaataaattattaatagaatttatattaaaagttcattaatttacaagtgaagttaaataggggaaataatatttcctaaataaaaaacttggctggacttaatttttattgaattctccatgattaattatactatctggaattttctcggattttttagagcttaattattaattttaataatacaaaagaagagttcagcaattatttcatcaataaattaatcattaaatgatctggttttaattttgttaaatactttgagtgtccaattattttcaggatttttcttgaaattatttgagtattggaagtatttttaacaattgaaaaattatttcattttggttaatttaattggaacagttaattaaatatccttttccttttttggctgaaactggaaaagtctatatgtaatcctcagccatccgtcctctgcgccgtctgctctatttccgggacgattttgctatatatttgtcgacaaattttttctcaaaaatttaacagatgtaattgcagtacaatcgtagtgtaattacactgtaacttgtatgtaattacactgtaactatagtgtaacttgtatgtaactttcaaaaatctctttgtaacatattattttggtaaaatggaggtcgtgggaacaaattcttttacatatgtgtgtgctatgatttgttttcttcctcaccaaaacaaatcgtgtaatagatcaacgattcaaaattatgtgaaacttacatataagttacactgtagttacatacaagttacagtgtaattacatataagttatagtgtaattacactatgattgtactataattacatttgtcaaatttttggggaaaaatttgtcgtcaaatgtataggtagtccctttccgggaagtctatttcttattcctccacttctttgcttttcagccagacaaaagtctgttttgcctccctgtcgctacagtaccttcttcaacctcccgccgcctctctctcccgtgcgtgtgctgtgcagccgccgatctccttccaaaatccggtctcctcgttgctcctctttccaaattagttgcgggaatggaatcctctcaatctcctcttccttttccccaataaatccccaaaagtttctatggaaatcctttctaatttcgcggatcaatctttccttttcccgggcgaggatcctaaactttcccggagtttttcccgtcgatttgggcccggacccgagctcgcgtgcctatataaaggacccgctagtcgtcctctgcctatcccctcaagtcccgtccttcgccgagccctagccgcccctgcccgcgagctccctctctctccacctccggccgccgctccagccgccgtgcgccgtcgcctcggccgtcgccggtcagcgccgacacctccctcggctacacaaagtcgagctctaccccggcctctggttgttttgcgccaaatcccaccggaggttgcccgtcgacgtgaagtggagcaccgccgtcgccgccgtgcctccagccgcgccgttcgtcgtcgtccgtcgtctccactggattcgcagctgcgaggagaacaccgtccaccacctcttcttcgccaaagatcgccggaacaccgtcgccatcgttgaccagtaccacgtcgcccttcggagctcatcgctggccatctccttcgcggtccgtcgtcgcgtaagtgttggtaagaatagccgtcgccttctctacctcatggtgctctccatttgcatcatcatgctgtggttcgccagcaaccgctgttctcgtgctcttcgattaagatcaatctaagccattcaatcttggtcactttatgtcaagagtagtctaagccgtccaaaatcgatataaatccgttttttcttttcagtggcatattatttcttcttaataaatgtcatgtgccagcatctactcgtcgcggcagatcggtacaatctgcagaggctcaagctgatctgcgaggaaaggttgtgcagatacattgctgtaggcacggtggggaacatcctggcactggccgatcagcaccactgtgccggtctgaagaaggcatgctttcattttctcggttcacaggcaaatctcagtgcagtcatcgctgccgatggcttcgagcatctgagcaggagctgccccactcttatgaaagaactggttgctgtgctgtcacttccactgaatcatgcttagtgacatagtgttcatgtgttctaacaatggtagcatttagtttctgaatctgaacctttgtcatcaggtatttctgttctcttttagcacgtgggcatgcagcttaactccttcagataggcttttcttaccaacttatgatgtacatatcaaattatgactacatctatcctaagcagaagctaaatcaaaatcgattgtcacttgttacctggttttaaacttccatttggcatgcttgatttggatgactggaagggataatgaaggagtagccaatttcatctctgttttgattttaatttatgttatctatatgattattttgatattagatacctattctcagtttttatattagagacctgttctcaggtactgcttttgtctgataatttcaataagttctcctggtcaggatgggactagattcatggtaggtccataaaaaattgtcatgctgatttaccttctaaatgttagatacctgttatcggttgtatctgtttgatgatttaaataagctctcctggtcaggttgggaccagattcatggttcagtcttgtacaggtacatataaatgagtcatgctaatttcctttttaactgtatctgggaaaccaaacttccttaaaaaataatggttttgtcatggtttctacccaagagtagtgtatcgactagagataatttgaaaaaataggctagcagaatcccggcacttgtgtcttctgtggttctgaagacagagtatggatcattcattctccaggtgccctgtatatgttggaagatatcccctccatcctaaaaaaaatccaatcctatctacaaatttggacatatatgtttctagattcgtagctaagatttggtttttttctgggacagagtagtagcttgcaatgctttcgatttttgctcactttctaaagtgtggtaaacttgtcaggatcctctttctccaaaacaacataaaaaaacctaagttatcgttggctttacaccaatttgctttggtcaatcggaacaaagaaacggttattttttttcgtcctaactttttttagggagattaatctgatcatcaggttgtatctcccctctgcacgtaatatttttgtcatgctaactactacctccgtcccaaaataagtgcagccatgagtttccgcgcccaactttaatcgttcgttttatttgaaatttttttataattagcatttttgttgttacaagatgataaaacataaatagtactttcctcgtgacttatgtttttaatttttttcaaaaaattttcaaataagacaaatggtcatagttggacgctgaaaactatggctgcacttattttgagacggaggtagtattttgtaaccgtcacttcattaattgtcttatgctgtctatttctccctctggtcattaacatatgacgtgcagacatcgatatattgttgtccagacatgtatgggagaagcttcttccaatctgagatttaaggggttcttgattttggaaaagcctacacagaaccaaacattggttttcagggggatggggacttggaatttgggagcttgaacacatataatattcttgtggtctgataaccggttgggctcttgctctcttaaaatccagtaccctgccatttatctgatctgcaatcagcaaagcatcctgtttgctgatgccctttctctgtagcctgatagcctttcttttaggagatcatttcttttagctgggtaacattatttctagggcttccctttctagtgagggaaaaataattctttggtccctgacaaaaataattgcgacaccacaaaacccaatattgtgctctctgcttccgtggggctgaggatggtagacagcttgacatttggctggctagtagacacaggatcctgtcctgccttttgcctgatttgcaatgacctggaaagtgacttatcttattatctttgatgtcctattgatgttttcttgggtttgttaagagatgcaatgggggtgggctcagattcccagctactttgaaaagtttgatgttgacttctactcttaaaaatcctaagatttttaaaacaaaaactgctttttactccactaacaattgcttttcgtgttgtcttttattttaagcagagtagcatgttgaaacctggagaagaaactgtgatgaatgaagtggtcaacaagatatttcgggcaatgcagcaacttcagagaggtcagtgttgttttgtcacgtcagcttgccggacgtgggaaatttaactataaaccactcttgtgacatggcaattaacgatttgccacgctctgtcaatgacacgtgggccctcatgtgtctatgacatgtgggcctagtggcaaatcgttaaggaccattcgtaagagtggcaaatagttaaaagccccgccggacgtagctgaaagattcagattttgaaaataagttttggagggtttatttttaaaattaaattttaaaaagattaaaaaaatcatgtttatcagctttttgcggtggtactgataactagctgatggacactagcgacattgttttataatatccaaataaaatgaagagagaaacagtcgcaaaaatacgatattgcccttgcatgccaagtccagctcgcatacagctccgacaccaccaccacacccgccgccgcacccattgtcaccgtcaccaatgaggtggctcttccggggggtttgagggtggcccacgccgccacgcgcctgggctcgtggctccgtgtcattcccgcactcgtcgctgctacagctcgaggaccgcgccgatgctccaccatacgccacgcttgcaagcgagcacaacgtcgaccacctcttggttcatgtcaagcagggtgtcaaagagcgcaggcggtcatagtcggtctggccatggcgccgctgtcgccagcgaggtggctctctggggattcaagggggcccgcttgcctaggcccgtggctgccccattacataggcccgtggctccatatcgtttcagcacttgtcgttgctacagcatgagggccacgctggcgccggaaatgtcgtcgcctccatgtcgtcggagctatatgcgagccgcacatgacatgcaagggtaaaatcgtactttcacggctatttctctctatttccaacagctaattaccagttttttgctgtgggacagatacatggtcttgcactgtctcctaactaattactttgctttttcgatgtcctgtaggaaattttgccatggtaaaagtccataatctgatagaaaagtgcccgcatatcttaactaataaaaaaattgctatccttcctatcgtcaacaatttttcgtccgtatgtgcgttttttttcactttccacctttttttagcgctgctttttttaatcatccaatcggacagaaacacagatcgagaaccctagaaaaaaggggcaaaagagaggaaaaaatcacacaaatgggcaagcttagagtcgccagatacggttgttccgagctcattgccatcgtcgtccactgcgctcgtgtcgtgcccgaaccagccgggcacgaccacacttgccacctccccaaccgcgctggcacccctttcctctaccacgacgccccatcctctggcgctctcctcttgctttaaggcagaggagaagaaagaaggacggccgtcgccactgtctccgtgcctagccctgtcatcgaggttgatggggagac

SEQ ID NO: 83536 - DNA, 4483 bp, Oryza sativa
  unsure (1)..(4483): unsure at all n locations
aggcgtgtgnttttgtagaacctttgtcttgtnnnnnnnnnnnnnnnnnnnnnnnnnnnnnnnnnnnnnnnnnnnnnnnnnnnntatgacttgctgagtacagtgggtagtactcagtcttgctctcttttctcccacaccagagctgaagatcttcctagttggagctgttttgtcaaagttggtttcttcgctgccgtcaaggattgcctgtggagtggagtcgcccgctgctgaagtcaaacttcccggtttagctcgcttttatcttttccgcagcatttgtaatcttttctatttttggtagacgtggatctgtatgtaaacaaattgtggttgtgtaccctggctggtcctggatagggatttaatgcacattcagcttagaaattctagttcgagaatttctgggcgtgacaccgcggggtggtcgtcgtcgtcgcgcccgacctcgccgccaccgcgctggatccaccgcgcctgacctcgctgctgccgcttgccgccgtcgtcgtcgccgcggggaggtcgtcgtcgccgctgtcgacgggtggtaccgcgactacggtatttggatggtatagggatcgtcgataccaaggtatatgcgagattgaggtaaaagagatggagacatggatttttatacaggttcaggcaccttatctaacaggtaatagccctacatcctattggccggaaccggtgttgctctttatttatctggatcacacaagtagaatatttgggaaaacctatctagttgtcgtcaacttggtggcagggataaccaacacgtagtcaacgacagggtagtcttcctcctcgagcatgaactcgtcgagatcagagatagcgctagatccctctagccggcctccgtaggcaccggatgcggtatgtctaggctaatctctgatgtcgagatctggcggggtgtgttggcttatgtatatgttgtgtcttgttggtcttgtggcttgctttttctcctcctggggggcttgtatttatacccataggtgtccccttgtccaagaagaactagggagaccaatatggatacaatccaggtagtccttgtcattttcatatagaactctatttgtccttccttatccgaatctccttctatatacgaggtatgattccgtataagatatggtatgtggtgggccttgtcgtgcttagtcaactactattaggtatgtggtatccataacactaacagccccgcccgtgtgttggtatttcttaacgacattactagaaatataattcccagcaatggcccagaaatactcctggtatattatggttacagagttcatccacaagcgcatggatataccattgtagcatttcacccgagaatattccaagggtatcgtatttattttatcccgtgggaagataatgtagagagaacttgactaataatttatatattacttgtgataatcatattctaagcaggggttaagataatccaagggtagagtgacacacaagcattaactactcattctcataataaatcatctaaacacacaatgccgcgtcgccgcccacgcgtcgttatcgtcgttgcccactcgttgtcgtcaccgcccactcgtcgttgccgtcggggtcaggctcattgtcgtcagggtcggcgcctcctcgtcgtcgtcagggtcggtgatgagaacatcaacaccaacgatatatccacgcctccacaagtacaacttcaacgtcctattactcgcgctcgtgcacgtcaactcaactatcaggtgcattcattcttaaattcatatgattcttatttattccccggagacacgtgcactcttgttttattcaggaacaatggagagaatcaaatgggtgaggattcgcgcggggtggattcggactgcagcacagtcccaacttttgacggtcgccatgacttcatgcgaactctgatttgggcgtgcaagtactatcaagtctaccttcaaatggatctagcctcttgtccatatcagttctggagcagccgcaatcttcatttttctaccgagttcttttctgtccacggtgttgcgtcacctcttcgggcccaatgggccgtgtatcaagttgggtccattagggatgcgtcctagggttagagaacgaccccagcatccctgtggttgtccccttcctcttcttatagctttctccgccaccaagaataatcgggttttgtttagatcaaagtacagcgtcgctactttgccgagttgatcccgtggtcgattagattgccggattgcttgttactgaaccccacttgttacttctattgattcaatcaaacatctttgattcgcaaatttagttgcttgttcatcttgttcttgctggttctcgattgcttacaccgcctctggagttggtgtaacgattgctaaggcgcaacatccctggatagttgtagtcggatcgccaacgtcactccatccaatctacttatccctctcatcgaaatatcgggacaccctcaagcacatcagtcggcgccgccgcgaagggggcagcccgagcgacggggacgacgcggcagccgctagccaccagcacgcgcacgccgcccactcgtgctcggtaccgagagaggaagagaaagagagggagaggagagaaagagtgagagagaggaagagaaagagtgaggagaagggaaaaatatcagggggggagagagagaggaggatgaaagatgaaatattttgaagtggtgaggagggaaaattttcatttgaaatttctaatcgatttttatggcactaaatcaactcgtatgaaaaagctgtcaaaaacaaagttgtagaactcatttaggtgtcctgtttttcttttggtcatttctctatctgagttttattgaactatagaaaattttaatttcacagtcaatttcacaaactacaggtattttgaccaaattatcacaaaactacagatttaaggagttgtatcacaaaactacacatttagcaccaaatttatcacaaaactacagattttagattaaatatcgtaaaaatgcatatttaatattgaatttatcacaaaactaaaacttttggagtttaaatccctagcaccattgttatgatggagctataaacatctttactttttattaaattgattctaaacctgtagttttgtgataatttagttactaaatatgtagttttgtgacacttcatcttaaatgtgtagttttgtgataaatttggtgttaaatgtgtagttttgtgatacaccgagttaaatatgtagttttgtgataatttggtcatagtatctgtagttctgtgaaatttacttttaattttaaaatataagaaattcaaataaattttcgggtagtaaatgatacaaatgaaaaaattgtcaacaacaaagttgtaaaatgcatcaagatctacaacttttgtttcggtcatttttctatatgactttttttcgacagtttgaatttgaatttcaaattatgacaatttcaaacaacattttcaaatactaaatgatttcaacttaaaaagttatcaataacaaagtgtcataacttatcaagatctataacttttattttggttattttttcatccgacaaaatgatttgtaagattgttcacaaaatgcacatatctctcttataaagttttataaactatataagagatatgcaaattttgtgaaaatgttactatcactttgtctgatgaagaaatgaccaaaaaataagttatagatcttgataagttatacaactttgttgttgatgactttttcagctgaaatcattactgcttcaaaattttgaaattcaaaattttaattgataaaacaaagtcacaagaaaaaaggccaaaataatggcagtatgaacataataacatgacagagcatgattttagaaacttttaggaaaaataatcatctaatttaaagttcatatgagtgagataaactagttttaaatttttcaaattttatttttgcatacggctccttaagtggtccgtatggaaaaatcgatttttccatgcggtcgcttaagtgagccgcaagcgaaaatgatctcatttttgcatactgtcctcttaagaggcctgtacgggaaaatcgatttttccatacaggccacttaaggggctgcatgcaaaaatgaccatcgatttttataaacgccactagttatggtccgtttgcaaaaaatcatggggtctcgtaagataaatcacttttgtagtagtgcgcgcgccgctccctcctgccggtcctcgtgcaccgccgccgttttccgccgccgcagaccccgcgcacctcgttctctctcgtggctgccttanagctcgttnctacctttgagcgctcttgtgttgaccttccngcgcacgcatgcgccgttgtctttccttccaccttcggncagctgcccgttatccttcct

SEQ ID NO: 83537 - DNA, 1646 bp, Oryza sativa
  unsure (1)..(1646): unsure at all n locations
cttgcccttcctcggaacaccgaccccgtgcacggccgctcctttccctccctcccgcgggtgggatagcgccgccgctcctcccacgtcagccggcccgacgatctcgcctcctccctcgtggcgttcccgtctgccctctccgctagcgcggcgctcccgacagtggctggataacatatagttgtagaagcaaaagaggaagaaagaatgaaaaagtagggaggatgacatgtggggccacatgggcccatcatttttattacttttttgtgtatagctgacgtgggtcccgtgggttttattattttttcggatcaagttaccatgtaagcgccacgtggaacgaagacctagtggagtgccatgtaggcaacacgtgaaacaatactacgataggaccttatttgcgtggttttataagtttggggatgcgttgtatccagttttgtgatgtagggatgaatttcgaactcggtgacaaattgagggacctaatatgaacttattccacagcatgagaactgcatgaggaggaagaaaagaaaaacaaccaaaaggagtcaaagtctcaaacaaaaggaaaagagtgtgtaataaaaagagaaaatatttttttagagacatagcacaaacacattattgtcagaaaactttccgaaagaagggtatttagaaaattttaaacatagattaatgaaacacatgataaacaaaaaaaaccaaaaagcaaactacggtgcagacaaaaaagtttaaatagttaattattgaaattaaaccatttttatttaggaatatccataaagctagaattatttaattaattaaacatctaaccatttttttatcgtggagtaaccatctatcagacattttatttccttaaataatttcttgcggtacaatcttaaaccaaatttcagtctcagaaattttaaacactacatatctaccacatacaatctctaaaagattttaaatattaaggaaaaatatgtcccaccataaaatctactctctctctctcagcagtcgattcgtaacagaggcaaactttctaagttctcgttgggaggaagggagcccgaccgtatccgagtggttctctcctctctctctcgatctctctctacgcacacagacacgccgcaaaaaacgcatgcaacacgcacgccgctatatatataattaaccatcactgcgtcgctgcggccgcccacagccaccgagcggattagtggaacaaaccctagcctgagtagattcttcctctagctttcgcgagccgtatcgtatccattggatggagccctagagcaacaagaagaagccaagaatatttgcgccatggagggtggtaattccagcaagggcgccatggagggtggtcaccgctgccgccccccaaacgtcgacgacgatgaccagatcgaggagggagagatctgctacgactgccacgtctcgggctccgagaccgacgacgacgagcaccacagacgcgccgtgctccctccccgcgacaatggcgatggctgcgcggagcacaaacggtgccggctcgacaatgctgctaccgcgcccgcaccctctgccgggccggtgctgaccaccagcaaaacgagcgncatcgtcgncatcgc

SEQ ID NO: 83538 - DNA, 1378 bp, Oryza sativa
  unsure (1)..(1378): unsure at all n locations
aggttagatgttcgtacgtgnnnnnnnnnnnnnnnnnnnnnnnnnnnnnnnnnnnnccgaatgtcgctggcaagcacatctctcttggaccaccacctttgccggaccttactccggccgccgctgaggtaacttcgtcggaaccacttgatcagccaccactactgtcaatggtggtgggtgcagaagttgcagcaccggcgctgcttgcgctggccaacgaggcagcggcattgccgccacaggatgatcaggcagaggaagaggcggctgcagaagccgctgcaccggccgaggcagcggcattgcgaccggttgaggcaggggcagaggcggccgatgttggagcagcaccagaggagccgctgctggcgcctattgccggcatgggaaccgtgcgtattttcggttttttggttgagaagccggcacctggagacggcagtggaggagagggttcagcgcctgcatagatcgtcctagttatgatatttgattttgtgattttctttagctatcttcagagccattaggatacttgatttagaggctttctttattatgttcaccgcatagtagttaagataatttttgcttttcgatagcagaagtgttttcttcgttgtactagctagttggccgggttttcgaggttaaagactataagaaacttacagttatatatggtgtgcaatgtggtctcaggtgttcggttgacgactggcaactggcaaggctgttttgtttggggtaatcctgatcctgaaggaaaacatgaaaagaccatgggaagtgaggggtactactatgtcccggacatctgacacgaggcatatcatcagacaaactgtggatcatccactgcatttgggcttttcatttgctctctctttgttacttacgaatatatacctctcacattttcttttagctgaagctctatgtatgcatcatctatccctctcacatttacatcttttagctcaagctctatttatacatgtggatgcgtgcatgtcctccatttacaaaatttaaataatttttcggatgaactgtttatccaatcaataatttgattacaccaccatattcatttcaagtaaatctttattaaaaagatacgtcctctgttcatattataagactttctagcattgcccatattcatatatatgttaatgaatctagatatatatgtgtgcttaaattcattaacaactatatgaatgtgggcaatgctagaaagtcttataacttgaaacggaggtagtattatataagtgtattctcatacaaataatgtatatataaagttttaaacgatnnnnnnnnnnnnnnnnnnnnnnnnnnnnnnnnnnnnnnnctcacgaatccc

SEQ ID NO: 83539 - DNA, 11142 bp, Oryza sativa
ctgcccgttgctcctcctccgcctcggcgccgccgccgccgctccggtcctgtaggcgcgctgatccgaggttgggagcccagtctcaggacgaggcctagggtttcgtacaccccctcggctgctcggcggtgaggaggggggccgcggcgtcgctggagatccgatctccccgggctcggcggtgaagggggggcgcggcgcggaggttggctgcgctcgatttgggcggtacccccggaattcgagctccctataggcgaggaggacgaggaggaggaggaggagctatggcgtcgagcctgctcacaacggacaagaggttcgcgatccctcatcacccgccccgagccgccgccctcgtgcggtcgggcgattcaatttaattttttatttttaatcgtcgcgagcgggatgttggatgggttgggcatgtagaaatctgtgcattgttgcgaacggagagtttggttatgtttgtgtaatagcctgaaattataggaaaattttagattatttaccaccggtttgatagggtgtcacttatgctggtatatgaagctttggtttcgtttgatttgtgtggatagtagtttctggtggtgtgtaatataggtcatgtgttctttgggtggattggtccgatctagtgtttgtgggggcaatgggcaacggttgcgagatgttcagaagatggttttaccagtgtggtggcatgagaatgatatttaagaaaatgattgtagttatctattcgtctatgaacagagtgttctacttagtatttattcagtgtggacaatttagaaatgtgcagtgttcagtgttggcatacgtgtgttgtacacgtgcatgcatgaagtttgcgataactgaggtttcgtaccatgttaggtttcgtccattcgcagtaagcatgtctgaggaattccaaagcctatccaactgtccagttctataggtctactgatttcacttttgcgccttggtcaagtggcttttacgtaaagttggaagatttgttgtgacatatgtcgtcaagcacgatttggcatattgctgtcgtttggatttttggtctcagacacaattattcatgcgatttaaatgaaatcatcatttcttgtgtatgtgcttctttgttgatggcattttctaaaacgcctttgggtattcccgcggtttctttgcatagtagatgattatgcgccatcagtttaccattcaagactgtatattttattttatttttcaatagtattccttttatgcttgtgtactcaaggtagttcctttaattgttactccctccattcaactatataaggcatggtttacttgtatgcatgttcaactatataaggcacacactattttcagagtaatattttttttgctccatttcccctgctaacttggttctgcagcatagcatttaatacttcaaatgacaatttagtttctgttttgacgtgaggatctggctctttgcgatgaaatgcatgcagttgttttggcttcatagttattgcattgaatgtgcatgcgtgccatagtagttttcgcggtaggagttatgaagttgcatgtatgtaattaaggcactaattgggggcagtttagtcctttctgctggatcattgttctacgtgcaaaaagaaaactcaccttatatagctgaacggagggagtacatggttacgtcagcatttaagcagatgaggtactctatacttcattctttgatacattttgcagatgggctgcccctgcaaggaaatctggcatgaccgttcttggaaaaattccaaaacctattaatttgccaagtcagaggtattcgatttctatctggcctacccataacttgactttattgatttgtttatatgtgaactgattcacgagttcctcatgaaggttggaaaatcatggtcttgaccccaatgtggaaattgttccaaagtaagcagccctctttgttatacttatcacttgcttatgatttaatatttttagatatgcaatatgcttatttggagttctcgatgtttcttgtgattgctattgtgatgtgtttatggtatgtattttaggggcacccttacatggggtagcaaacccacacctacaaccccaaatgcatggaattcctcttcactcctttctcccaagaatgatggaagttccaattcacccagccactttaatggccgaccgtcttctggtggaggatcaagaccttccacagctggtagtgaatcccttgactcacctaatgcttggggttcaagttctcgaccatcgacagcatcgggcacacttccatccaatcatttacaaacaacaacaaatcgtcctcgaagtgcagagacaagaccaggaagctcacaactttcccggtttgcagacaattcttcagagaatatgaaagtatcaataagaactattgacaaatcggtaataaccacaccaaaacctattataactggctgggatgtaacatgtttttcatattattgatctgaactatgcagggatcttcatcacatggacatgggtttactctaagtaccggtgatttcccaacacttggctccgagtcaaacagtcaacgaggtaatctgcatcgtaagatgtctcttgttatttttcttttggatttataacattgtgctctctgacttagcatgttaaattcttaactatattgagcatgtggaacatagacaaaagctattgccattagaacagaactattttggccaattgcagtatttttacgaatgcgttgatgtgcgaatgttctctttacagtttacatccttttattctaggtcatagctctaagggccgcccgacttctagttctggtaaagagacagcgcaaaatgaacaaggaaagagcataacagctggtattactaattaaattgctttttcatcgatgataatgctcattgctgttggaaactttcaattgccttactgtgtggttggtaatgttttgtgtgctaggacctgctgaagaaatattgtcctccaatagccagtctgcggataacataaagacagatcagcatgtgtatgatggaggtgctcccttcccgggtacaagtctgccaaacaaagctcagcagccacagccttaccctggcaacttttgtgtggcccaccacattttgattcatggcatgcgcctccaggtcatcctcctgatggaatgtggcacagaggagcagcaccaggtgggccatacagaccactaggcccccctggtggtggtttccctgttgaaccattcgcttattatggtcagttccagcccagctcagaagcagcagcaaggcagggcccaggacacggtggatatcaacctaaaaatggagacgcgtatctttctgtgcctcctagttcctacatgatgaaccagcctgtcattccagttagaccagtttaccaaggtccaatgtcttacgacggatattatggtcctccgcgagcaaatttcaacaatcccaatgtgagagatccaccttttgttggaggtctcatcaacctggaatattaaatcaattccccaaccagcacgagaagttccatcctggacatcctcagaacagacctggcaaacatgaaacagctcccaatgagcatttcgaatctgatagagtacatgttatccagcgaggacagcctaggattttgcatgataacttaagaggtccccgtgaagtcgagaggaatgctcaacctgcaccaccacttcttccacatccaaatggaaataggattgatgtgaacaagaggtcagatataagagaatcctttaatgagaagaataggatccttatgaagtcagcacctgaccatagaggtccagctggtacaagccatttatctattccagaaaatgtacattcccacccccgggaagctgatgatggtactctccggaagaagttcaaggaagataattcagttgttcctgatcagcagcctgtcattaagaagaatgtggcattaatagagaaaatagagagtttgaataacaaagctagaaatgttgatgcacgtaatattacagaaccattcccatccaaacaagccaaggagatgcaaaaaagtacaagttcaaaggaagatcaggtgataaaatatggtccatctgctgtcaccactacaaattttgccaccatttctgtctgcctgcttatgtttcttatatttctcctatggtgcagaaactaccaaatgaacctgttcttgaaccttcacagtctgaattaactgaaatcatcacagctggaaagcttggcgaatcaactcgtgatcgaacacataggagaggtgattcttcaagaagcagtcaccatggttcttctaaagacaggttagttaataattttgcaggagaggggctgagagaaaattctgcagctgattcttcaccaattgttggttcgaggaatagccaacatgaacaacctcctgaggatgctttgaaactggcacctgtgatggtcactgatgacacttcactagattttgaatctcaggtatattgctgtagatttcttacttattttttcaatattgaagagcttatctagtaccttcctagttttcaatttcttaccatcacaaaagtatacatccatcattctactccagttttcaatttattgctgtagtttttaacaagctttctcaagattgactgccaatcagtgtagtatctttatatatctgttaaaaggattataatacttcatactaccttgattatcttttatttatagtaacacattccattgaaaaagagttgcatttttttgttcagttgactgtttcatcaagtttccagttcattaacctgtactgtcaatgtatttgagatgctggtcattcttcattttgcagtttaaacatagaaatatagaatcattgtctgatagctttaaattaggacatttactgctctactgtttgtttccaatttgccatgttacatgcttaggttaatcttttcattgttttgggttcaaattttatttgaaccttgtgagtacaaacataaaataatatatttaaatatataggatattctggacgctggcatggttctccaatatcaaactgtgatcattatagttttaaaaaatataaattatcatatcactatggaaatatttttttttcatgttaatctaatgaatgatgttttcccacggccatctaaatagtgtatatataattaaaattaaagaaatttgactgcatgctttctataatgtcatatatttctgaacagagcgcaatacaaagttatgtaccaatttctggcgacttgaaggcttgtagctatgcatgtcgcaaaactttgtattaaagttttttttcttgtccttggatgtgaactttttaccttaaaccgcctatagtgttgttgttagttacctacttgtgctgtatgtttttgccataattagatcagcatttagcaagctaccttgactgtagagttttttaatagaatgtagaattatttatagggatgcaatggatgaaatgttgaaaacaggcaactaataatgtaatatctagtgcaaggtaggaattcataaccatgttcttactgactatttttttattggttcttccattcagcgtgcaaaaatgagggagctggctgcacaacgtgcaaaacagttgcaagctgaggaggaggaacggacaaaacaacaaagagcaaaagctcttgtgaagttggaagaactgaataggcgttcatcagtacatcagaagagctcaaatgatgtaccaccagatattgctgatgtgcaacaaaagcaaaaggttggatttgaagagactgccaaacctgctaatttgtctgctgaatcttgtgatgtggcatgtgatggtcacaattctcttcagccaccaaatgatcctaagcatactgaattttctgtacagcccaagcctactgtgctaacacatactctaggtgttggtaaagaccctactattcataatactacaacgttggccaggaactcagagcatgaagcccagaaaggtgtagcgcaatcacatgacattaatgttccaaagcctaagcagggctacagaagaaggcaagctgtgtcagaggaaaaaaatcctagtgagaagtccagtggagcgataagcacggaaagtggtaagaaaattgctgaggccttttcaaacacttcaactgctgttgttacatcacatgatgacaccctggcccacaacaagaagagtgcccgtcactctagaaataagaaaaaggttgacgaagctccagttacttctaagcatccaccagtagcgctcaatgagcagaatgcagtcaaagtccctaatgagccaaaaccacaaactgctggtgttatcatcagtagttccatagttcctactgaaggtactgttgtcactgtgggaagtataatggtgggtggtatttcatttggatctttgaaccaggagtgtgtcaaaccgcaggagagtgtcaaaccggcagatgaagttcatagtagtacctcaaacagccacccaaaacgtcagcaggcaaaaagatcaggaaagaaccagcagtccatccagcctattgagagaccacatgggaatgagggcgctgtatgggcaccagttaagccatcaggacacagcgaacaatctggcgaagccatgtggagcacaggagtagttgctcccactcaaccagctgggctgaacaccaacgatggagagaatgttacaaaaacaaaaagagctgaaatggagaggtatgtacccaagcctctgtccaaagagcttcagcagcagaatttgaggcaaattttaccatcagaaaaatcctgtgaggagaacaagattcgtgacaaggaaatagttgaaaggtctactggtgctaaacctgagactgcacctgaggccaagaaatgggagggcaagaaaactagtaaggggcatggaaagtctcatccttcatggcgtagaaggaatacagatgaatcaactttggtaggaccaaaagctactgagctagcagacaactatcaagagtcacatgaacttcagaagcatactgtgcatcagccacctgaacctgacaagcaagcagatgctcctgccaggaacagttcagttccagctgaaacagtttcatcagtagtcactgttgccaaagaacatggtgcagctaacaagcaaaggcgtcagcatgttaaggctcagagaaatgagggaagtaactacccgaatgagaataaggatcaaatggcagcaccaccagcaccgggcattgattcaaactcatatgaacgtagaaacatgtcaagatctgatgtgaagcacagtggaacagtaccacaacctagatctcattggaaacctaaaaccatccctcagtcccagggaaattcgcatggcaataatgctaaggatgggcatgtggatagtgctactccacaagacagcagcaacaacaaccttgctgaaaacattggttggaacgatgaaaatcatgcacacagtgaagaagttaaaggagaaaagaggcatgtagacgattaccagaagagcgagagccatgaaaatgcagaacagcagcagcagcttagtcatgcgccacgccgacagggccaccacaatggtgggaggtaccacagaggaggtggcacaaacaggggaaggggttatgatgttgggaagcccagccatgtcacaaacgcagaaaggcggaggggtggcactcatctcgaataccagccagttggatcctataacaaaacagcagacttccagcagaacccaggtaccgatgagcgaaccgaaggggctccactgcacatggagcgcgtccacaacaggggtccacgccctgctggccagttggtcaataggaaccctgcctccaccccagctgctaactcttaccgagatgaataaataactatcctccaccctcaagatcgctaaaactgcaagctatctttagttgggtgatttacatttcgcagatgaatggagtatttggatcacaacctgacgccagtgactggtgtgatgcccgatgtcatctcgaccccgtcgtgtctaacatgttcagagattagcaggtcaaaagctatggctgccgttcgccgtctttgacggcggagagtagtagtaggatgtaatggattttgtctgtgcagggccgtttggccctttacgtgtgattgttaattgttctcaggagcatccctcccttgcttcggtgagatgtgatgtgatgttgatgttggaatgtactaacttggagttgattgagaaccggagttgattgagaaccggggttatattagttagtagtatgtaaacagaaaaaatagttcgttttgggcgatctgttgtggggattctgcaggacagactctgatattatcatatcatgttcatatcgtgtttgtgttatctggggaggtcagaattgagatgcttggttttattctcttaatagacatatggttcatgatcctggcaatttgcccaccagtctctgtggtaatataaactcattctgccaaatataggattgagtgggatcggaaatgatcacgtagatttgaactatcgtgatggagactatcttgacaggaaaagtattatctgcttgtattaaacgcaaaggtgagaaattttagttccaacctacaacacatacccaacctcctatcggacacaaatatttgtgcaggcaccggtgtctgatcctccttaaaaacgaccatcatccgcttagaaagatgacaggctagcagatttcaactacattattattactaaaataaatttatgttaagataaattggtttagattggagcgtaacattttaggccgcatttgcaaatttaccaccggttttttcaatattgcaaggatgccactcgaatgataatttcagtagtatttttgtaattttcgtggtagttttgcaataatgattcaaagtagtggtaaatttgtaattgcctctaatttattttaacatgtattcgggtctccttattttatttttaaaaaagtttatctctttcttcttaaataattaagctataacaggcttgttttcctcggctcccgtaaatgttcaatgattacttcgcgttcattaaagattcttgtaattttttaaggaaaactgagtcacggtatcaacacataattcttctttctactagtactgtacaaatttaggtagatcgccaccactgttggctagtgagcttttttgacataacttttagggcagtcccaatccatagtgtccataaacagtgtctatagtgtcatgtcaataagatatcacaatagaaactacactctacaacccatgatttcttaaagtgggccattaataaatacatcatctcttttctctaccaattatatttattcttcatctattataaagccactattctctcccaatgcaaaacttgatagtgtctagtgcataggttctcgtgttgaagctgtgtcttgcatgagacccaatttcttcatctattcactctctctcttaattaatatagtgtcacataagctaaaagtcctacatgacaatgtagttaatgccatagacaccatcctagatagagagttgagactgcccttaactattgtttttttaatggaacagttctaactaatgttagttgtgcaaaattactacttgttcagctagaggagcatgtttgtcagttgtcactatctctattgatatgaatagagtaccgccggctgtgatgcggatggagtaaaaagtattgacgataaataccctgcaatggactgtaaaatgccaagcatcaagtaaaaaaataggtctagctttggtctattatatgcaaatttaatcaatatatatagcatttacattgtttaagttggcttttttaaacaaaaaagcttcattttgtattgtacaccaaaaccccaatttttatggacggactttgatctcccatgatttaaccaataaaaaaaatgcagtgtggaatgtagtgaaatccacctagttgtaggaatctctattgtttatgtattcttttggccaaacaagaaaaaaagtttttccccaagatataatattttagacattaatcgattaacacagagtacaaaatgctcttacatttctgaacacagtgaaggagtagtaatatactttttttttctttgatgtggaagagcagcaagtaactatgatgtttttcacatgttgcctgacactagtatatggatacaatctctaactaacaacataatgctactttattattacttgtcaatatgtgattatatctacagaaattactctactaccttaaaaagctaagtcgtcctatctaatattttatccctaatctgctcatagcccatcgctacttatatgagttactccctccatcctaaaatatagcaacgtagaatgagatattaactagtacaatatgtccagatatattttaaatattatacagtaaggttctatctagtttttatgttgttatattatgtgacggagagagtaaaagttaaaaggataactatctgaaaatgttttttcatgaaaaagaattatgataatataatttttcacatataaataaatcccacaatacactttcaagattttaagtatacgctcagtatcaccaagcaaatatttcgagattcatcagagactttcagatattcagagcaatcagatattcagatccccatccatccaacccacccccacccacctcagctgccgccgccgccgctgcctcactaacgcctataaatacacccacccacatacgtcagcgcgcacgcgacccaagccgatccgcccgcacccgcacacacatcgctcggtcgaaggaggaggttctagaaacttctggaagcggcggaggtgtggggagagagagagagagagagagagagagagagaggcagagagccatggcgcggaagaagatccgggagtacgactccaagcgcctcctaagggagcacctcaagcgcctcgccgccatcgacctccacatcctctccgcccaggtacacca

SEQ ID NO: 83540 - DNA, 1706 bp, Oryza sativa
  unsure (1)..(1706): unsure at all n locations
ttttaaacccgcgaaaggaatcaanggaactacagngngggagntntnggatnaagcttangatttccaacccatggcttgtcatggatcgatccaaatccctccttacaaacctgtttatgggcatgtggctgttttgccgtgggaggttagaatcggctctcgaagaacggaattacaaaacgatttaacagccgatgagtattacaaccttatggccgatgagtgggaggatctggttcagtcacgattgcgtgtccttgcaaaggttaccaaggacaaggaatgtgttactcggcactataataagaaagtggtgcctaaagatttttcagaaggagaacttgtatggaagttgattttgccgattggtacccgtgattgtaaattcggcaagtggtcgccgaattggaaaggaccgttccaaatttataaggttgtgtctaagggagcatatatgttgcaagggcttgatggtgaagtctatgggcgagcgctcaatggcaaatatttgaagaaatattacccaagtgtttgagttaatgcatgacagccgatatgttttcatcgccttgagatggccgatatagttatatcacccttagttgtttttatggtgtaatcggttgtggtttgccgatgaccaatggccgatattgttatatcgcccttagttgttttataattttatcaatgcttttgacattgtaaaattaggggggcacatacatatcaaaatgcaatgcagcttacaaattttttgagcacatatcaaaatgccatgcagattgtcaagacagtaaagtattataacgtcttagccgattacaaaatttgtaagttctattacatacaagttattgagacaagtattgctggatagccgatatagccttctgcctaatctgttccacttcttctatggcttgggcatcttgagcgtcagttccagggataactttcaaggacttggtcatatcagcgacattcttgatagccgattttagctttgccttttgttcttcaacagcttgcgggagatcggctagctttttgtgctccatatccagctcggcgttgcattcttgaagttgtgccatgagatcaatcttacgagcttcaagccgatcgatatttgacttgattatgccttcagacagctgatcaagcttggacttctctacatgcacaagctaccgattgtgctggattgtagcttcaatgtctttgcgttcccggcgatcggctaatctctgcctagccttctctagtttgaatcggtgttggtcaaggtaaacggctagagtaagggcatcggctaagtcatctgggagtagagcttggatgtctgtgaacctcgctcggatcgagccacaattggtcaccaagttatctagtgatgcttctagccgatgagaaatatcttccagtatttttctcacatcatcggaaaggggagctaatgctttgcttgaagtatcttcttctgcttcatcaaggtaatctctgatgtcaaaagagaagagatcggctagaacctgtagagacggtttcggaaagagtaagagctgggtgaatatagccgatctaattggtaagacaaaggaagacttactgggatagcaggagcaactagtcacagccgatgtgatgacttcccacagccgatggagtctagtcacttgatgattgcccaccagaggaat

SEQ ID NO: 83541 - DNA, 4841 bp, Oryza sativa
  unsure (1)..(4841): unsure at all n locations
ctcccgtgatgaatgccgactggaagnatgcatggggtgattgcagataagaagatttctctaggcttttgatatctgtcattgttgatgtcttcgaatctgaagtcccgtggattttccagaagtgttgagtctccatagataatccttttggaacccctcataaaagctacaaaaccaatctttgagcagatcggccgatagttttgctcctgcatcagttggtgtagaggcgtactctccatatgatgtgcatctccgatgagtgagttcctctccgtcatcgttaacagtcggctctaatcttgggaattcagtttctgttacagatggctgattgacaaccttaatgactatcaggtttaaccaagtttgcagcagctaccatggtccacctgctccaactattgagccgacggctgttttagccgatgcattgttcaacatttggtacagatagccgagaaggattttgcccaaaggaaattctttctttgattctaaggcttcggctagaaattgccagttggttgtagggccacaactggatccacagaagaggaacttttctaaccacatgagcaagaaagctacatgctctcgaggggtaacggatccttggcccatatatgccgccacatagccaaaccagccacctatgcttttggtcttgaagtcaaattagttcttggtgttcatactcatagggttagccgatgaagttacatctaatccagtaatcatggtgatatcgattaaagttggagtcatcggcccttgattaaacaaaaaggcattgatggtgtttgaccagaagtaagaggcagttgccatcaggggttcatctttggccgagtttactatagtgaggtcaagttcttggccgattccaatttcatcccagtgaacccttttgcttgctgatacacgtttgaaccatgtggtccaacttttttcaggtggaactttctctagagacggccaagatttgaaggtattcttccagtgacctagatctgggttggttaatctgaaggggatcctattggtttcaccaataataaactcagtggaatcagggttgtcgactgggccgagaaagtagtagttttcgtatgagaggcttggaatcgcgactagattggagagatgctacaaatccaaaacaaccgagaaaaagagagggatgtaagataagagaaaatcgatctgctgctaagaaaggggatctagccgattaggacttacctcagcatactcggctgatggcgtatcagatgggttggtggaggacgacatcactgcgggcggaaatctcgccgaagatgaagtcgcctggaagtcgcttttgcgttggaggaattgccggagagaaagaggacaaggtttcgcttgagcggtggaaatggaagtcacggtgtgagatttctcgaaggtgacggttagtatttaaagcacggcaataacggtcggaaaacagcaaagtgcgaaatttgctcggagtcgatttgcagcaaatccgaaacattaccaaatattctggacttggagggcatgtgttaacaaccagatttggtaacatcagcatcaggaaagaagattagatcgaagcaaagttggaggcggagatcgagttcggaaacagagcaggaatcggctggagtccggatcggctacgactaggatcggctgggtctgagtcggattagaaaagccgatacagctgattctgataatacaacttgacgtgtgatgtcgggttggattgaggtgcttcaaggagattgccgcacatggatagagtcctgaggaggcaattctatctattaattaggatgctttatgtaatttctttagagatacgattgggcaaaagtctgccgtaaagagttatagtatcttagagtttgttagagatggtaatcgtgtccgttatggacatatcttgtaattctcgggtataaatagacccgagccctatgtaacttaaaaacacacgttcaatataattcgggtgcatcgccacccttttttactttagttttgtttcgacgagttcttgctttcgggttgagctgcatcggtttcgatcttcaacaagaggtaaaccttgttatgacggcttgcgttcttgagattagcgcttccatctttatgatactctaatctggtttatgtgattcgtcaagttgtcatatatcttacataatctctagcaatatcgctatctaacctacaatcggctaacatctatcgaggaaggtagccgattaggttagattctgacgttgactcggaatatataagatatctaccactctatgaaacttccaacggcttgattgtctagatattgttcttcttttcatatttagtgctgcatcagttgagtttgatctattaagtcgtgcttagaatatcaatctctagcctgtcttctggttgtcgattagggtagcatcggagtgtcagccgatcttatctgatttaattatatttgctctatatgcttcattgacacgttaaatctgccctttatgtcaagatattactgtatttaagtatattaggcttctgtttgatatattttacctgttttaatatcctaatatagagtagtatcggagtattagccgatacatgctcgatctatctgatcggctatgctataaacatatatagtcctgttattaatatatattttgatctaagtgatttatacagtctcggcatggcgaccgatctatcccaatcacttgatttaagtatatatcgatataagaataatacattgaaaatatctaccgcccatcgaatagatttagtcctttattgtttatttgcaactgccgatcgattcacatatgacattggctcaaagataaatgatatgtcatcggcaccctagccgatcggctatcatttatagatttaacccgggtttcttggcttctatttcttgtggattacaggatcaaatcaactggcacgctagcgcacccgaaggcgagctttggacctgcactggagttaagcaaatctcctaggcctcgtgttttctgtcaacaacatccaaagaggaaaaagaagaaaccaaagcattcgacttagaatcaacttttcgagaaagaacattcatctcatgtgttttcagttttgtataaagtgaatccaaagtcaaagtagacatgttaacagactcctgaatagatgtaactttcatctcccaaatagacatgtcgagaccattcaaaaagtgacgagaaatctcagattgtggataattagcttcataagaagaatcaacagatctaatatcactcaaaattttattaaacctagaaagatagtcatccaaagcttctccaggtttcatctcaaatttaatatactcctttttaaaaagatctcaacgaagctctttaatgttatttgttccttgatgaaaattactcaaagcaacccaaatctcatgagcagtttgaagatgagcaacacgatcataatccgaacgagaaataccactcaaaagaatgttgcgagctttgcaattttgttcaaaagcagttttttcagcagcagtattaatagcttcaggaatcacataagcatgagaaacttttctccaaatatcataatcttcagccataatgtaagattgcatcctactacatcaatgagaaaaatccgttccatcgaaaacataaggcttagttgaaaacctagcgggagtagccatggcaaaaactctagatcgataaaaatccaaagaagaaaacaaggctctgataccacttgtaggatcgaattacaagaactaagccaaccagaggggggtgaatggttggtatacccaaaaaccgaaaacttttagcggaaataaaagttacccttaatttcgatgagatcggtctgaccaaagtagattagccggtctgaccgtagcgagccgccggtctgaccggtgttgatctaccggtgtaaccgccgagatcgcctgctgcttgctgtcgccgccgctggtctgaccgccgtgttcccgccggtttgaccgccgcttgccgtcggtctgaccaccggtgagttgccggttagaccgccgaaacccggtaaacacaaatcgaagaactcttaaagtagatgacgactttattaattctctctgtgcttacaaagtgcaccaacagcactccttacaaaaattttgactaaactcgaaaccctaactcaaaactcaactcaattgctctctaaagcgatacagggaagcctcacgctccccctctggttggcttagttcttgtaattcgatcctacagttgcaagccctattccatgacagttgataccaatgctaagctatcctccactgatggtaatcctgtgattgatctgaccgtctatcgtagtcttgatggtgccttggagtacctcacctccactcgatatattagatatctcttatgttgtccagcagattttataccgccataaagcgtattctatgctacctttgctgtactctggatcatggcctttacttccaaacattcctccacatttgacttagtggcatagtatgcagctgactaagctggttgtcccgacacgaagatgtttacttaaggctacgtcgtgtttttaggtgataaccttgtctctttgtcctccaaacgtcagaactatgtctcccgctccagttccaaggctgagtagagtgtcatggcaaatgctgtggccaaaatatgccgggtcannnnnnnnnnnnnnnnnnnnnnnnnnnnnnnnnnnnnnnnnnnnnnnnnnnnnnnnnnnnnnnnnnnnnnnncaaaaaacatcct

SEQ ID NO: 83542 - DNA, 3177 bp, Oryza sativa
gggggggagggggggtaagggttggagttctgaggtgttttggactcggaggtgtgctccgattaggcgaaattctgctcaaagagggctcaatttcgtgttgtcaactggtgattgtagctgtggctgtagctgccggctgatgtggaagtatatgtgatttgttagaatggttagtacctggcaacgaaatctgtttgggtgattgggcaaaatacatttgaattggataaaatgagaatggggaattgtttacagcaatcgtacacttccactgctgctaagcttttcgcatatttgatgcaacctgcgatcatcggagcatcctttgtgctatgggatctcattagtggtatgatggtatgatgcttttgtttgtgggttggatgggtcatgtgatgcacaaggtgtgtcttagatctgttgcgatgatggtgtaaactctgtctgaggtattgctttattgtccttaccaaggttttggtttcggtgtctggttttcctaatgaaattccactgctggtaggtgaactggttggtagcttttgacttggagtgctctgcttttgatatttggttacctttcttttgatttttaaccataatggtagacgtttaatgtgcgctaccgaggtccaaagcttcatcttggatctgagattcaacatctctagtttgggttaggataatcttgctctgatggtgtaggctcatgttgaatttcagtaccatctatgaaaagctaagtgttgtcatatttctaaataccagataggaacaagcaatctattctgatttcctttgaactcaaaagcacactcagctgtgttagaatagctacgcttatgggtgaaaaagagtgaagttagttttgatatattcttgactgcattagcttttgttctgcagtagtttgtgtttaatagtgccgcaatccatgactaatttgaactgtactttttcttaggtcacggaatcaactgatttcacagagctcgtcaaccaagagccatggctctcgtctatgaagttggttgtgaaacccgacatgctgtttggcaaacgtgggaagagtggccttgtggccctcaacctagatcttgctcaagtccgccaattcgtcaaagagcggttgggagttgaggtagttatacattttcccatgctttgcctctaaaaccttgttagttataactattctaagctatccggtatgcctgttatgcaggttgagatgggtggctgcaaggctcctattacaacattcatagttgagccatttgttccacatgatcaagagtactatctttctattgtatcagagaggcttggttccaccattagcttctcggagtgtggaggtattgagatcgaggagaactgggataaggtcaagacagtttttcttcccaccgagaaagcaatgacacctgatgcgtgtgctccattgattgccaccctaccgttagaggtacgcttatacattgtatcaccttccccatgtcacgttgttttttttttaacatgttgacttttctcccattctggactcaattcctctagtgttagaacttattattgatgatacctattttggtctgcattagccatcttgtgctcatgtcattcacgtcttctgtctgaatttcaggttcggacaaaaataggtgatttcatcagaggtgtatattctgttttccaaggtaattcacagttgaaaaataaaaataatctggaattgttgttttccaagataactcagttcattctattgatcttctggcagacttggatttctcattccttgagatgaatccgttcaccatggtgaatggggaaccatatcctctagacatgagaggagaattggacgacacagctgcctttaagaactttaagaagtatgattcaggcttttttttttctagcttacatagtgtccagttcaatcctttcaccatgcttgtcatgctaaccagagcttccatggcataggtggggaaacattcagttccctctgcctttcggaagagtcctcagcccctctgaaagctttatccatgaactggatgagaaggtaacctcatatttctttctttcccctctgaagtctgctgcctgttagtacatatcacttaaatttggatacaaattgaatttcactgcctctgcatgcaaaatattgaatcttgaattgaggttgatgtaatttttcagacaagctcatcgctcaaattcacagtcctgaacccgaaagggcgcatttggacaatggttgcaggtggtggtgctagtgtcatatatgctgatactgtaagtctaactctatccagatcttttttaggttaagttttgaagtttatcagtgccattcacacactggacaatatcaccaggttggagatttgggatatgcgtcagagcttggaaattatgcagaatacagcggcgctcccaacgaggaggaggttctgcagtatgctagagtggttttggatgtaagggctccagaggaaccttttcggctgacagtttgatcattatgtttccgctctgacaaaatgatatttgaatctttgtagtgtgccactgctgatcctgatggccgtaagagagctcttctcattggaggtggtatagcgaacttcactgatgtcgctgctacattcagtggcatcattcgagctttaagagagaaggcaagtttcgattggatcgttgttctgtccccaaccactcccacttgttgccattaaaatcttcatccatcttattattgtctggcttccaaatctggtggcaggaatccaaattgaaggctgcacggatgaacatttacgttcggagaggtggtccaaactaccaaactggccttgccaaaatgcgtacactaggtgcagaacttggtgttccaattgaggtatggacctactggctacttactatgttcttccagcaaaccttagctcagccatttcctacactatttatcagaattcgtcagagattaactttattagacataggacaccattggaccatccccatgatcataacggacgagctgaattcactgaattgcaggtatatggaccagaggcaacaatgactggaatctgcaagcaagccattgattgcatcatggctgaagcataattcagacaactatttgcgctg

SEQ ID NO: 83543 - DNA, 2259 bp, Oryza sativa
  unsure (1)..(2259): unsure at all n locations
agaaagatcgtattgttagaataaactacatctgtaagtttgtaacgtaattacgcaataatgttaatgtttgtttctagttctgaattctctgtgccttggttggtggccttatccaccaaactcaaagagggttcttgattttgtcatgtatgagagacagtgaaatggagggcttagtgacaggaactgcgttgttgtggcttgattattgatgtagtcatatggtcatatattcatatacttcattctttttgccggacttttaatccaacttttggtcactgttagtgtttcaaatcacacctttgcctaaaggtcagatgtggtaaactggtaagagcaagtataataaaaggatgtgcataatatgtataaataagatataatatcatgattattaaaaccaaaacaaattaagattgcatggtattatgagaaaaaaaaaagaagagaaaatttaaaccatatatccatcattaaaatgctaaaaataattagggtgatgtggcttaatagataagaaagaaataagagtaactacacttagtaaggatgaactatatatatatatatatatatatatatatatatatatatatatatatatatatatatgggcatatataatgtagcaataggagggggtcttaagcctctaaagtagtccttatacactataaaaatagtccatacggtagtatttaggataagctctcaatatgcataatgcctacccataagaataaaaaataacaatactttctcttctccctcacatgtcatacaattaagtgggacaagtagaacccaggctaatgccttctcttaccatatacattgtagcaaacaccataactaatacgggtctcaccttattaccaagtactcgtggacataatacatcgagcatatgccctaactatataggattcccaatattttccgagtcgaagatccccaaacgttccggaccgttagatgacacaagcaacggtggatccgaagggataccgcagtagcccttcttcttcacggcagaggaatccaacatcccccggacgggacgaactgcagatcgagtcgcatcgcgggcgagagagagagagagagagagagagagagagagagagagaagacccggacgcggcggcgcacggcggcagccggagaagagcggggcgtggcggcaggcagcagctcgcgggcgtctcctccagtcttgctaacctcgccgcatggggatcggccacgtgctcggcgtcctcggcggcgccctcctcgcccacgccgcctacgccaccatccagtgtatgttgactgattcgccccccccccctccccctgcggttcgagtgattcccgccgcgggcttggatccgggccactgaggatgtggattgatcggatcggggcagtagatcgggtagggttggttcgcgtcgaaatttgtggcttgtatagtaattggtagtagtagttggggggatgaattggatggagaagggttgctgtttggtgggtggctaagttccacgatttgattttttttttgtttgtgcccgtttgctgcagatcgcgccgtgctgaagatcacggaggaggagttctcgagtccgcctatggatgtaagtgttcccccttatcccttcgcgatgctttcttttcttttttttttcggggtatgaatggttgattttctgttgcgtaaagctgtggtggtcaaaacatgtagtatttgggttgcttgatttgacagtgagtttgggggtagggtagatgatggccatgaattgtgtataactaaagtttccagatgacaaaaacaaaaagaaaagagtgatttaggttgtttgacaggagaaaagttgtttgttactatcaccgaatttgctttaagcatgccaannnnnnnnnnnnnnnnnnnncaagttatgggttgaaattgcggttggatgtgtatgagttgcactgtatgtttacgtaattacatgtgacccggttccaaattcgatcctggttgttctgatctagctgcctgttttattggcaacttgactctaaattcgataaattaggccttggggtgtctttgcgttgcataatttatgcttttgattatgcaggtgatgatgcaattgctcctggggttggccttatgcatgtgggcaggtcttgctgttccagcgaagttcctttcagtgctccctcactctgaggagaataggtaaacctgtttggagctaatttgttttcctt

SEQ ID NO: 83544 - DNA, 17554 bp, Oryza sativa
cctctcttccgccagtccgccagaagggaggcacggtggtgccgcacgcgttgaagcggaaaggaagccaccaacgacgtattgcagcaggaggggaggcaccagcgacgtattgcagcaggaggggagccggcaggcgggtgacgcccatggagcggcggtggggggcgcctcccctcagccatatccaatgactgccctccatggttacccaacggtgagtcttcaatttctttccgtgatttgggtggagatgaattgatgttgaatttatgtgatgcttctgtgatttgtgtggggatgaatcaatgttgaattatttctgtgatttgtgtgcggatgaatcgatgtgatggttctgtgatttgtgtggggatgaatcgatgttgaatttctatgatggtgagatgttgatattgatgaattgttgtatgtgggatggggagctggctcgtgcatcgagccggtttttttgcttttgtgcctctcaaaggtgccagttgtgacctagggtcatcagtgccgcctctgagatgctggttgggaaaaccggcacccaagggtttttcaatcagcacatttatacctttatgtagtagtgttgttttattaaaactgaatatattttgatagttttgttttatgttaaaactattactatatttttctataaacatgatcaaaataaagaagtttgacttgaaaaagattaaagtgatttatagtatgaatcagaggtagcacttaacattagacattatcactcaaaatctttgatcaaatatttctaacggatggcaccacccttatgattattgtatgaacagtgtgtgcacacgaagtgttgctgtcgagatgtacgctccccgatccaacgtcatggatattttactacattatgacgtctctgttattttctgtgttgaaacaccatctcaatcccttaattatcgttgtcgacatatatacttgccccaacacatttttctcgccctgaactaccgccattgacagattagacacaccctggtcatcgtccgttggccacaaattcataactctcgcctcgccatttcaatttgtcgatagagggtgtgtttggatcccagccattgaatgccaacactcctgtggcgagccacgccatggcgtggcattccaaccgccaaccaagcagccctagaatatttgtggtgtgcgactgatcgactaatgggccttgcttgtcgttaatcgaacatgtggatatattcagtagactgttaacggaaacggatcctctgcagtcgaaccaatcatatctacttccttcgtttcacaatgtaagtcaatttagcatttccacattcatattaatgttaattaatatctatctagatttattaacatcaatataaatgtggaaaatgttagaatgacttgcattgtgaaacggaggtatattctttttggaataattctattttgcctccctcaagtcttgcctctgattgattagtatccctcaactgcaataccagatgtaaggcctcctccatcttcaaaaaccggagcaaatcgaatccctcgactgtttggatagcggttttatcctatgtggcactcatgggacccatatgtcagtactaatctctttttttttctttttactcacatccctcttttcctattctctctcctcgccgacgagcagcaacgcaatgacgacgacgacaaggaccagcattgccaccgccacaacatcgatgactgcgacgacgacgagtgcatgcgtcatctcaccggaggcatgagtgcatagccatggtccgctgttattcccagcggtccctagcgtcagctctcgaggtcccagcatcggcggctcccgtcagaccaaggtcccctcctctcccccaccccgtggctggtcggcgtggagaagggtggcgagttgtggctgtccatccgatgctgtgaaagagaaggagcaaataaaggacagaagtggaagaaaaacaatgaaggtgggacccactgcttttttattttccatcgggcactcaatgacacgtgggtcccacggtttttcataacttaagtgccacgtagatgccatgtcagccgaaaccaccgtccaaaaccgccttgggattttatttgcactggttgcaaattcgatgacaaattaagagacctaaaatgaacttattccttttatttttggctgacgtgtgtgcagtatgtgcacacgaagtgttgctgtcgagaagtatgctctccgatccaacgtcatggatattttactacattacggcgtttctgttattttctgtgttgaaacaccatctcaatcccttaactatcattgtcgacatatatacatgcgccaacacatctttctcgccctgaactatcaccattgaccgattagacttgtcatcgtccgttggccacaaattcagaactctcgccaattcaatttgtcgatagaatatttgtggagtaccgtgcgactgagcgactaatggggcttgctagtcgttaatcgaacgtgtggttatattcagtagactgttaacggaaacggatcctctgcagtcgaaccaatcctatctatatcttttatgagtcttttgcgttgctactgaaagcaatcgtctaagacttcctcaccatcattcccggccccgaaagatttagatgaagatttgaaagcaaatacacatcgggcgcccgatccgggggtgggaaaatcgggcgcccacagtcatgctgatgtcatacccacgtcatgcatgtaaaactactttaaactattttttttcttaaattatttatctaaatcataatccgattgcaccattaaattcgttgcaattaaatctttaaaacaaaatcacacgcgtatatattccgatgaaaaaatattagcttattattgaattatttttaaatgttgcacgttgttccaccaagtatatcggaattgtttcactaagtagatcgaaaatgtttcgatcgtttaaatcgggcgcagtttcaccttatataaaaaaaatattttagcaaatagtgaaaaaaagttttagttcactacaacatttaatccatacatagtgaaacattataagtacactaggtgaagcatttttggtgaaaaaaaatggaacgaattcccttaatagagggtttccataagatgtgggtgatttcttgcaaaagaatgtttcaattcactgcaaattagatctatacgtaatgaaacattgtgaatacactaggtgaaacatttttttgtgtacaaaaaatgaaacgaatttacttaatagaggttttccaaaatatgtgggtgatttgtttttttactagaaatactgccaggactttgccttgcagtgtgattttataaaaggaataaataggttatttacaaattacgagagaccgagaaggaaacaaaatgattacactgttcgtaaccaatcaaaaactgtgtgttttaggggatccttttttctacacatatgcagaagaaaatcggccttgaataaaggcctccaagaactgaatgagggaagctcatttcgaaagattttcccattcctttgcttccaaatgtgccaagcagcaataaataaaatttccaaaaaaaacccttccggttgaactgaatgcgggccgaaaccaccacctgaaagaaattaagactagagttccacacaattcccaaatgctgccagcactgctgactgaaggggcagaagaaaaaaagatgctctcttgtctctctgatattattcaggcataactcacaagtgagatcatcattctcctttgcatagtgacgtcgatcaagcatatcccttgtgttaagtctatctctaaacaaaagccaagcaaaaacttttatcctcattacatatcttgttttccagatccaaacaaaaaggtcttggcacttgctcattcgagaaagtgagcttataaaacctcttagttgtgtacttgtcagagttccagatgaaagaccaatcatcacccttgtcattatgcaaagagagagaggacaattcttcctctagaatgatgaattctccataggcttgggtgttcagaggcagcaagaaacaatcctcaagaggaatagagcacatttgattaacagagagggatctatccaaagcaaccatacacaaagctgggaatgcagtgcacctaatcttgtcattccaaaaatcatcctagaaaagagctgaggatcctgtcctgatgaagcattttgaaattcccctgaagatatcagatagagccactatatctttccaccaaaaagagcctttattccaaactaaatggggcaccttggagtcataataagaattccagatcagttgaacccatggcagatcctgcccttcgtaaaatttgaccaggtatttaagcagaagtgatgtgttttgaattcttaagttaatgactcctaggccacctttttcctttggtctacacatctaatcctaagaagcaagagatcttcaagttgagtttgggttgtttcccctccagaggcagtttttccttgcagtatcaatagctttaaccactgaaacaggcaactgcaaagaacagatgtaatatgttgggattgaggaaagcacagagttgatcaaagtgagtctccctccctgtggcaaaaattgtgagctagctgtcaatcttctctcaaccctgtctaccaatggtgcaaagtccactacccttggtctagttgtccccataggcaaacgcaggtaagtaaaaggcattgtacctatggtgcacccaagcagactagcaaaaagctcagcattctcatgagacagattgattgggtagagacaagacatatggtaatttactttgaggccagtagaaggtgcaaaagagttcaacgaagccttgaaacaaaacacctctctctatgatgttttgagaagaattaaagtgtcatctgcatactagattactgggaaacccctttcatcaagttcattaattggcttggacaacaaaccaagggagcaagcttagttaactattctctatagtaattcagcaccaagaacaaagagaaagggtgaaagtggatctccttgcctaacccctctcatgcatttaaaagaatttccaggtaccccattgagaagaactgaagaatgtgccgaagaaaaaaccatttgtacccactgcagccacttatcatgaaaacccatacttttcataatggatatcaaggcagagtgctgtatagaatcaaaagccttctcaaagtcaagttttaacaaaattatttctctctttgactattgacattgatggatatactcaaaagaccatgctaaacagtcttaaattgttttacccttaatgaagccgtattgattctcatgaaccagcttaggcattacactctacaaactatctaccatcaatttggttaatacctttaaactaatacccatcagagagattggcctataatcattaactgtttctggagaggacttttttggcactaaagttatgaaggatttgtttatcggctgcagatcagtataacaggcatggaagtgtgctgctaaccagtaaaattcctgtgatatgatgggccaacatttcttaagaaaatacccattaatcccatcagggctaggtgccttatctggttgaattaccttaattagattgtccacctcttgagtatagaactgatccaccaagcaatccaggttcaccggattgggaaaaagatccatcagattaaagtccatttgaggcaaaagaaaaatccccattctgtttttgaaactatggaataacatatcagctttctgattgtgtaaagtgactacctatccattctgatccagcacctgtgcgatagaattcgatctgaacctttaagtcgcaatggctttgaaaaaattagtgttctcttcacccagcagcatccacctattcgtgcaccttttttcgcaataaagctttttaaactcaaggagcttaaaagtttgcgacttgacaatttctctgaaattccattcaaacatggtcaagggcctatgctcttctattaggtctaggaaattaatcacagcattacaattgaccaagagagcagttaactgagacaagtttttactcaattgcagcaaactttttctcaaaaattttagcttgaaactgatgcatcttgccggatcttcataactagtgtccattgaccaaactctgctgacaagctcgaagaagccttccatttcaacccaataattctcaaatctaaaaattggagactttgggatatattgtgggccaggggatgaacagtggtgtttggaaaagccaaagtccaagatggacttgtaaaaacccaatcaagccgctccaagaggggactgctctgcatattactccaagtaaatcttctttcttttaaagggatttctagcagaccgagagaactaattatatcattaaaaatgaatatatcattcatatcagctcccggcttgtttctgtcctcaactaatctgtagaaattaaagtctcctaggagaatcatgttatcaactgacccaaaagaaaaattctttagccaagcaacaaaatctgaacgttctgggccactacatgggccataaatacaagttagggtccaagcttctgaagactgccttgaaacaaagttaactgtgacagaaaaactgtttatttcccctggagttcccaaaaaaacatttgaaacccataccactaggattccacctgaagcgcctcttgaaggcgagaatgcaaaagcatcaaaacgtttaggagcaaaagtctttatatcaggaatagtgaaattttgtttcttggtctcttggacatagaaaacatgacaaccactttcctctatcttttgcctcaaagataacaacttcgtgtcagcattcatgcctcttatattccagcacagcacattccaagatttaaaaacattacgcatgataaaaaaaacatatgggagtgcacaaagaagaagagctaaataaattagcctgaagaggcccacataacataaatccagaacaattgtaaagtccactcacactgtccaaagtccaacagcactgaaagacaaaagacatagttctgaacaaattaacactattcattcttaatcatccatgtctgcccggggaagcgtctttcttttctctcccgctaaactcgattcagccacgtcctcaggatgtaggccacataggtccacccccaacttttacaataaagacaaagaacaatcagaaggggatgaatctaaatttatatcatcatccagagcagagaaatcagattcattaatcttgctgccaggaataagaattttcgatatacctaccaactcgttcaactttttagcagatatcccccttggtttgccaattcccattcgatgatcaatcttaagctcttggctggcattaagaatcctggaattgtgccttctggtagggttgtataaagtagtcttctcatcccttttcttcacatgagccttaggaatcagaatcactgcaggggtgacttctggacttgatgactgggcttgcaaagtcatggcatctaaaatctcttgatgagtaagtccatcatcaggagaggaaggcaatagggcccagctggaatgtgctcttttaactacaggaggggcatgatcaagttcatgaaagggcttccatagggcagagctgaagggccagaattcaaagttgtatgcatgatttctagctttgcacaaatgatcaatcttttccaatagaccttccataggataaaaggatggatgctttggcccttccctgtcagctatctcctttgagcctagccaggaaaagctgcacctgttgatccttatccatcagattatgttcttctaacacttgattaggcaacacaatcagttgcctagggttttcctcaatctggcccattgggtgatccttaccccaagcatcctctatttttgcttctgcagcctactgttgctgcacaaagttatcccaatcaccacccccctgattaccagggtgtcctaactgccaaatatttccatcatctgggtcattagcatcatcatcattaggccctggctgcggcccagcagtaggtaaatcctcttcaggtggaatatcaacaaaatctccatccaggacaaaaaccgaaatagtccaagattcacctccaccgccattacccaaaggatcctgcaacactatctttcggggcacagagtcaagatccctaaattttgctcgcacaaacactctctatctagccagaaagtgagctaaccaaaagaggcaaccgctagatttatatggtgatgatcaacgaaatccagcagcaaatccaaaagaaggaaccagccttcccggttaaaatggcaagtacgccagtttggcccttggtcatgtttaacaaactcaacagtcgtcgtaagcagcaggggtgaattcaccaaggcatctctatgcatgaccgaatgaagctggaacataccaaacggggcggccgaacgcacaaacggcaaaatcctagaagcactaaagaaaaggcttgagggggcatcgaagggcaaatggccagaggaaatgctgtctgttctctgggccctgcgaacgacccccacaagaccaaccaagttcagcccgttcatgctactttatggtgacgaagcaatgaccccaacagagctaggggctaactcaccaagggtgacgttctccggggacgaagggggggcgcgaggtgtcgctcgaactcttggaaggggtaagagtcgaagcactcgaacacatgcaaaagtatgccacaggcacttcggcaacttacaacaaaaaagttcgaccaacggagctattgcctggtcatcttgtcctaaggaaaaaggcgaacccgatagccgttggcaaacttgaatcgaaatgggaaggaccgtacctcatcaagcacaaatccaggacgggatcctttcgactggcgacactggaaggcgaagagttcgaccattcctggaacgctgcctctctcaagcgtttctatgtttagaacgggtggcacccaaatcgccaacttgtaaaaatgtatatatcgttatgtaagcccttcggcactatgtaagcctttcggcatgaaaaaaaaagaaaaaaaaaagaggaaaatgaaaaaagacaaaaaaaactggatgtagggctattatccacaacggaggcccgaaccagtataaaatctttgtgtcctctgcctcatttttatttgtttgtgcgattgacaatttgcggaaaaaccccaagacaaacgcctgatcagcgaaaaaggccacggggcgaaacgaatcagccgaagcatcgctcgccgaacgattgaaaccgcaacagcttgtttcggaaaacaattagccgaacaccgtcacactcgatcgaaaggaaagcacgagtgcttcctgcaacatagaacaaaacggatcgaaaacggaagccgaaagctgaatagtcaaaacctatttcgctaagatatgaaaaggggccgacatgttcggacccaacgaaaagcacgtgaagtgacaatgcaaaaatagcgaaaaggaaataaaacgcacctttattgattttaaataaaaatgtatcatcacaatggtgcaaatgaagagaaaggagcaatggcgttacagcctggcttacagataaattacatcttcgccccagcgctctctctctctctaaggagcgatcgggcgaactaggttcgtcatcactactaatatcatacacaaccctaagaggagaagggagcgaaatagagactagactgtaacgacgctgggagatcgcctcctgccgatcagtcttctgatggtttcgccaaaagcgagccatgtcttccaaacgtcttgaatgaacaaaatcgtagtcttccaaggttcgcccagggtgcgcccgaagccacccggcaaccttaaaaaccttatagctgcgtccgtttatcaccatttcacgataaacaggccgaaatgggcatcgcacctttggcaaatcctttaatgccacaaatttctcgttttggtttcgccaactcccagaagggggccgaatgcacaacttttggcgaacaccctggtagacagtgcaaaaagggcaaaagacgaattgcatagtaagaataggcaaagaaagaaaaaagtaatgcataatgagaaatgggcgtaatcataaatacgccaaagattttgaccatcaaaaagtggctaagagtgagtcatatatatttaaaatgaccaagggcccctttttcagctacaataaggaggattggcggcagcccgccaaatacacttcgttcgccacatctggcgaacacaaaacgaaaaagaaaaactacaaaaatctaaggaaagggcggagggcatcacacctctaggtgatcctgggcatcgcctccacccccttcagccaccgcgtcctcttcttcgcaaaggtctgccgcctctgccttcgctagttgctccaaaaggcgcgccttggcggtagaacgaccgtccttctgccagaactgcttccgccatgcacgaagtgcgggcgaaatgtcctgtgcgccaatctcccaatcccccttcgcatagttagggaactcggcgacgtgctcgtagctgaactgttgcaggagacccatagtaaaggccgctgatacacgcgcacagcaatcgccgtacgtagtggcgcagtccgaaaccgaaccactaacctgttgggtccactcgaagaagttgaaggccgaggcatcttcggcagggacccctcgcacttttgcacccatgtcagtaagggcgaggcgaagcgtttggcacgccgttcttgcggattcggtagttttcgccatctcccgcgaaaaccgccgcgacttcttcatagcgctcgcttcggccttgctgacctccaggcgaagagcctccatcttcggctcagtaaggttataataatccgtcagcacggcggaatgggccttttctttctttaattcggtctggaggcgatcaacctcagctatggcttctctccctttctccagttcggccttgaggcgatcgacctcggccgtagcctcacttcctttctccaactcggattggagccgcttgttttcggctttcgcctctttcagggtgttggcgagggcctccatctccaagttcttacggcctatttcgtcatccttgacccgaagacggttcttaaatccatcaagacgagcccgcacggttcgctctgtcgaacagtgagctgcaagaatctggatgcaaaaaaaagaaaggaacggcgaagagagcaaatgttaattatgggacatgtaaaaaagcagaggaaaaccaagaatagagaaaaagcatactcgaactgccaagcttttaatagcagaacacacctcatcgaactcattcagttcggtgaacaagctcggggtgctggcaggtaagacaagattacttactccctccacaaagggaataaggtctgctcgggtctcaaaatcgccaggggcgaaacggggcgccgcaagagaatactccgaaacagatgtctcgatggccgcccccttccccttcgccttgactagcggcgaaataacccgctgacgcatagggctgccgaagaccctcgccgcagctgtcacgatccgttccgcggaggctgaagccccggcggcggcgctaccgcctgctccatcggcgccaagtgaaagaacgggggcggtcgaaaagtctaggctgcggccagcaggcgaagtcggagtctcgtcagaagactcgtcgtcgctgaagacgcgagcgacatcgacaagtccttttttcttggaaatccttttgaccgaacctcccttcgccgccatgcctgccgaaaacgcaattagcgccttcgccccatccaactcttttcagcgaaggggggagctgttcgactccaccccggtctcattgtgacccgggcttggagtaggagtatagccaggggtgtcgacgcggttttcgaccgcctcatccacggccttttggacctcaacctcctcctcttcctccccttcctcttggacgtcgtcctcgtcgtcggcgtcggaatcggacgaaacaggaacccttcgtttcctgggcgcaagctttacttgtccgcgcgttcgctttcacgaaggtcctgcatcgtcgttggccttgtgggggttcgcccgaggaggcagttcgccgtcgtaaacccggttcgctcggccagccgcttgtcgcgttagcagctggctatactcgacgaccgacacgtcgccgatcatcctacaggcttcggcgtcagcctggtcaagggtcaacactataaaaataaagggagtagccacattaagcgtcgaacaaagcaaaataacaaagcacagaagtgcattgcgaaagggcagtcttaccgttcgtcccttcagggagaaccaacttcggcaacccatcaacctcttcgccttgctcaactgcgatttgctacgactgggagaggggaaagatgcgaagcatgcagaattcctccaccaagtcgcggcagctaaggcgggagcagaccttacgcagtagagtgaaccgcgcctccatagcgccgtccacggcgatcttgggctttcggtttggcgcaatcgccctacgccagctccgaagggcttttgcggagtcagaactagcctcgaaggggatggtgtggtaaaaccacctcaacatccaatggcgatcccacttcgacatagcggcgttcaccggccagagatcggaccactcggggtgaacattaaagtttacgctcccgaacactgtcttcatcgttccagcttcggtaatcaccgtcttcgaattcacggtggcgaagaatatggcgccgaagagttcggcacttggctcaaacccggaagtccggcacgcccagtcgaagatagcgtccggaccagcgccgacgggctcaactgcgggagctcaacctggaaaaggcgaagaatctccggcaacaacgtgttgcacggaaaccagagccccgcctcaaaaaatacggcgaacaccactgtccggttgtcgatgggtttcggtacaacggctttccccgaggcgaaagcctgtccctcgactaaagccccagagctgaccaactttgcctgctcgccatcgtctatgagagaaatccctaaacaggcggtggtgtcgttgtcaatccggccggggtcgggccctttcgccgaagaggggttaggcttgcggggagccatgacgaaggatgtatgaagtggcgaaaggtgtgtgcagtggcgaacaaggggagtgagcgagaagtctaaggggccaaggggtgccgtgagagtaagaacggaggaagagagcgcgagcggtgaaagtggcaagtctggcagtgaaaaggtaacggggaagcatatatagcccaacaaggcgacgtttcgcctacccaccagtaataaagcgccacgtgtcgcgagggtaggcaaaacggtaaattcccatcgaccgagctgcacagtaaaaagcccacaaagggaagacccatcactgttcctttcggcccgataaaaaatatatatcacagacaacgaactttatttgcaggaacaatgtaggtttcggcaggagcatcggtcgaaggggggcgccacatatcataccacataccacatggtttgaatggtctcggccgaagctccaatctcacccttgcccgtgagaggcttgttggcggtatggcatgaggcccttcgaccaaaatctgccgaaggctatgtgaggagtggggagccaagcccgagacgtcaaaattagtcggggagaagccccccccatggcgaagactatggaacaaggacggcgcgagaggcgaaggatcgtgcgggtactctgctaagccggaggcctcttgggcaaaggatgcagggcgaagagtacatgccgaagggagacgacttcgccaaagcaagcgcgcccccgcgagggccagagaagccttttccggcccatcaagcctagaggccattgggccggcgatcgcctaacggcccatcaggagtccataaacctctattacactatatacccatgtaaatgtccctttcataagggtaaccatgtaaattcccctgtataaccaaaaccctagtagtaagaacctataataggggctataaatagtccttatagggccatgtaatggggggatcccaagtaaaaattctcaaattaatacactttacttctgtttcaaccactgttgagtaaccacgtctttcgacgtatgcggttgtcgttttaacaaaactttgatatgacatcactcgcggtggatgaagtggcagaggtcccgctgcacatttgtaatgcatgtatcgtcaaagcttgttcgatgttctattctaggcaactgcatgcatgaaagataatatattagtatctgaacgcgctgatgaagcctagagggggggtgaataggttgtccctgaaaacttaaaaacaaatcgcagcggtaaaattgaaatagactcgaaacttcctggtaaggaactccggaacttccggcctcccaggcccggaacttccggtgttctaagacaggaacttccgggtaacagaacagagatgaaattcaaatttcgaaacaagagactaagccaaacttcacaagatggtgcacaggtattctaagcagaggatatatcacagaatcatccacagaaacatcacagaaagagacaagagcgattttttcccgaagttcggatcttgcaatcctactctccgttgaggagctccaaagagctgggtctcaattaaccccttgcctcacttgtgcaaaaatcccagaggaaatccgcagccttcaaccccaaacacccctaggcaaatttctagaattgagtgaccaccaagatccaactcaacctactaatagaaatccaccacaagtgtgggttgctctacttggaagacctctagaatctcagcacaagaacttcactaacttacctcgttccctttcggaggaaaggaaatccttcacaaacttacccgggacatccacaatatgcaacggattctcgcgggtgatacctaaccgtctaggagataataagcaccgagatgacagcccacgagatattcaagtgctcacacaagttcctagtcttcacaccactccaaatcttcttctctccctctcaatctctctatctcacaagaattaggctctagattgagtggagaaggcaagaaacacttgggagaggctagcaacagctctaggttcgaaaagtgaaagtggaatggccaaagaacgagctggaaacgagctgtatatgtataatgactaggtgacgtcatctagccgttactcacaattttgaactggaaactagacaggaagttccggacctggaagccaggaacttccggataacactttggaaaaattctttcatcagaccggaacttccggacctagaagacaggaagttccggacctgcacttttggacagatgcagtataagcagaaatgactcctagggaatcttgacacttggttcacactaagagcacttgacatatctcagagcatcacctggaacccctcttaatagtacggtttttcctaaaaactcgatttcaaaagataaactatcctatgcacttctcgagttccagtccgctttgattttgtacttttggggggtctccaagcatccatcttccacacctttggactaatgcacttgaaagtcactcaatgaactcattagtcccttacccacatttgtcattaatcaccaaaacccactagggggattaatgcactttcagtatcatctagctgtgcagttcttcaatgcacttatacgttgactcgagagacttacatcctctacgttaaccttgtacctcccattaaccgtgaggaattcgcatgcgtaacacccgtataggatagtgcctctaggttgcttgtgacacttaatgacaaatcataggagaaaagagttaaattttgtaattagtaaaacaattggaatacattaagtgtgtggagtattaccgccaatatgtatgtactagcagcttctgctttgtttgaatttgatcaacacccttcttcttgtagcagttgtacgcactgtatggattttttactatttcgtattaaggaggagatttcattataatacattaatagtagacatgcaagagtatcagtatcacttactattgtaagattgttagaaattgtttgttcgtcttgtgatgataatcaagggggtccaagatgtcacggtgccgtacttcggttagataatgaaacatatgtaatgatcgctacatgataacaacggtgcagttagtcacggatgaaataacatagatatttacaaaaaaaaatctactggacttacttaaagttgtacgtggctaggatgactcttttattttgaaagtgtaagaagtctcgtccaatgtactatgcgacagtaatcagcttctgcttgtacaagccattcttatattccgctatctctttaggcgtcttgtccttgagctgcttggaatttggtgatagcgtcatggtatgctgtttttgacagatccttgttggatccagatatccgatagattgctttgccttcgcagcatccatatattgtatcctataaaagcagcttgttaataataataacatgtttatgtattatatcaattttttgtatgataaatgtgcactcatactcataggcaccatgcaccgagaaagtttacatccatcttttcccgacgattgatggcatgcagatcagcgaaatttagccagaagaaacctttgctggcgacagcatcaggtggtgatcgaattgttaaattagttaggccttcaatgctggtgtcgatgtaccatttatgtaaccatgtcatctcccatggaccctcatcaattgcataatccggccttttctttccttggcacgttttttactcccactgaagtcggttaccctccacttctccttttgatcatccttagacttggagttgaggcttttgagcactctaggcacttcagacttctcggtcggtttccttgttatcaaccggggtttggtccatgacatcttttgcaagatttgggtcctcatagacgtctggttctgcatcgtcccattccaaacccgatacgacttcgatgtctactccaactgatgacagaaattgcacatcttcttgtggcacatcccggttcttgcaccactggttcatttttcggtgcaatttgcacctccttttatttttctgggccttcagtggccctaggtggctaatgttcttccaccttatcattaaaccgtttcttcataggaggtcttgttggtttccgtggagcatcggtgcccgtgcccaagattatatcctttttgtgccatagaatatgataa

SEQ ID NO: 83545 - DNA, 18440 bp, Oryza sativa
ggcatcggcatccataaaaccacaactcctgctcaaagattggttcagctagcactagctaggacatcggctaatcattcttgagtctcgactaatgaaccatagagtacccaggatcggttgattgatgaaccatgcatagagcacccaagatcggcacatcaaatgtgctccatggatgtactaccacaatacttgcatcagatgtactagtagaacactggcataaataatttcaacagacatgaatacactatagaaattagattttatcagatttcggatggtatcttaccataaagtttgaaatataaaagtgtgatgcattcttccccagtacctgtataacagactgccggtaggcactcccatagtgcaactttacatacatacgaaactatgaaagcataggcattagtgtgtccagccacataactgaaaggtaattccagtcgctaaatacagaaattgtcgatagcaaaatcacttcatgaatgtattttacatggctgtcgtgcaacactgcattgacaaacctgcccatgcatatcaatgtccacagcaaaagacatcaacctcctctgcatcaggtaacaatgatcttggccttgtcagacaccctcggcagagccaatagcttcttaagaactttactgcccaatgaaaaagccctagtgcaatccacatttatcttcacttcctctaaaaccggtgcccagctcagtagctttcctacaaaatcaacttcgtagtccaaacccaggaagtcattcacgcttacagttacgaggtggtccatttgaagggttagatctgcaatgctcgtctgatcttgatcccacaagctcattggcccaaaatcattatcccatgggaaactctgcacaatcaatttttaatcaacgtatcaaatgtaaatagtaccaaaatttcagtcattcaaggagataaggatagagattgacgaatatataaaaggcatacccatagctcaagctttttgaggataggagcattctgaaacaatgacacggccggtcaggatttccctttggtcccagaagcatatctctaataacatcatctcgaggtgatcaaacacagcagggatcttcgtcattatgcacccttttgatagatactgcaaccagaaaaatgaatgatgagaaataccaacacagcataatcaggacaacatcatcataatgctgaaaataacaatgaatcaccgtcaagaaatagccgttgatgacaagtttttcgatgtcacttaggcttcccaatgcctgcttgaggtaacttttcccaccatgcacaactggaacagattggtattcttgagctttgtgcagagtgacatttgcagtctccagattaggggcatccaaatggaagtcttcatacttcccatcaacctctagaatttcaagttcaggagctcgaatgttcagacagctgatgccttcaaaggatttcaaaaccagcacagacaactcagggcagcaggaaatcagattatcaatgtcactgtctgtggaggagaaattttccaggtccaaagtagttaaccactcaaaacctttgaacatttggggcaaactgatgatgcagttctttatgtccagatgctccaaatcactgatggagaagaagcatgatggtatcctataccttgacgcagaggtcaatttgattgtaactgaatttggtgacttcattgacagcttgtgcatccacctaccaaatacgtcgtggtaatttttgctccctaaaattgtaatcccatgcagaggtcccctgtggagtgataacgccatatcgaccaatgtaataaacttgggtggtgcacttgttactgaaccttgacaggaagtgtaggtgcaatcacacagcaacatctctggaatagtagtccatgtgctcctccaaacgcttgacaggatgttagttctgacagcatcttgaacattcagacgagagaggatatcggcttttatctctagaggtagactgctcaatctgtctgacttcgcggcacgtctagacttcaccttggccttctttgagctacccattactttgaaaatgccctgtcgttaccagaaagcagcaaacttagatgggtatgcattccatcgccagcctcggaggaaaaataaataatagaaatcacaaaatatagtacagtgaagttgattgaggacagagtaaagtactgatgactagccagcattcagagaaacaagactggaaaatttttttaaccgaacttaacacgccgactcgtgggtccttctctgaaagcaactctaattgtcagttaaagtgtgtataaaccatctggtaaggaatcattatcaactatcagctgcagagatcaaacttgtgcacagctgcaagtatggaaccactggatcggtaagcatagcacagtttctgctgttgagatgaacccatcagaccaaggatcaagtggcacagcacatgtttggggtatcacatcaaatacatatgagaaaatcccttatgtacccatgaattttcgcccaatttcttctgtgcccctaaattttgtcttatcccctacgcacccttgagttttcatttttatccctgatatacccattccgtgagttgactgtcaattgactgttagatttttccaaaaatgtctacattacccttgtgtcttacttattgcttagtacagagtagttgattaaaaaaacatggctctcaaggtaaaagttgattcatttataaaaccaaacatgccataattacttaatctaaaacatagatttttaaataggtttcaaatcagatttgatgaaatttattgaaaattttcgctgaaatttaaataaaaaacagttttggtttttcgaattccgaataaaacattttttggatttcattatctttaaaaaaatgtttgaaaaattaattttgttttcgaaatccaatgttaataatcatgtccctttttttatttttaggttaagctttttttattaacaagacttatgtttttaaattagaaagcatgaagtacaagcgaagggcaatatagtcattttgggacaattctaacggtcaattcacagtcaactcacaacatgggtatagaagggatcaaaataaaaactcagggacatacagaggatgaggcaaaattcaagggcacgtgagggattaagcaaaaaactcatgtgtacataaggaattttctaaatcagttgtcacatcactgagcaatttcgacggtaacctgaatggcatgcagatggcaaatgcatgagaatcaggaacggagttaaacaaaaaggggaagtctaaccctacatgaacaactctgcatcacaaatttcacccggtagcatttctttcttgcaagatccatcgaagaacggacaggttcttgattatggccacaacgacaagaaaactaaaacaaacccttcacagcccagcccccatggcgtctgaatcatcatcagcagatcgcatacgaaaattctctaaccaatcccagccaagaatcacacatctagaatgaactagcgtagaaaaggtgcaccatcatcatcatcatcagttcatcatcaccacacgaagtcacgaagaggagaaaggggtggttacctagaaggaataatcaatggaggatcggtgggtgaggcccttaccaggagagacgacgaagaggcaatgcgaggggcgcggccaagcgcagacggggagagggagggagggaggcggccggtcgtacggcgcgaggcggcgatcggtggcggcgacggcgaggttttcgcttccccctctccgccgagagaggatgagaggagagtgaagagaggctgggccggataggcgcattttgggcctcaattggatgggcccatatgtcggctttgattttttttttcaaacttatttttttggtttggttaagtttatagaaaatttgacaaaatctatatttcttttatttttcataatatttttgttttgtgctgaaaatattattatatttttctataaagtcggtcaaacttttaggaaaaagtgaaaatagtccctaatatgaaatggagggagtacaattataggccaaatttgggcccataaagtggtgggctgagatttcggtccatctaaaggaaggacacggatggacctccatcccagttaaaaggggccgactggacattgaccgtacgtccgtattgcagtcatgtgttagaatttgtttctcttttttttaagcaaaaacgaacaaggtttattatttttgtttcagaaaaagcaaaaaaaaagagaaaatttcataaaactacatgtattttgaataaattatcaaacaaactatatatttaacatgatgtatcacaaaactatagatttaacactaaaattattatagaactatagaatggaatatcacaaaactacgcatttagtaacacagttatcaccatattatagaatttaaatatcataaaactataaatttagttacaaagttaccataaaacttggacacctttaactctaacataacattattgattattgttaatgatttgaactcaaaaatatatagttttgtgataattttattattaaacatgtagttttgtgataaatttagtgttcaatctgtagttttgtgatatatcacattaaatctataattttgtaataatttgaccaaagcatatgtaattttgtggaaattataattaaaaaaagttcacaatcgctgccggctgccgctgtcatttttgcttgggatcacagctgcttcagatacacccacatctcaaatgcaaagcttcatcatcaaattaaagaaagaaaaaccttcgaagcatttcattctacaaacgttgggcttacctaccgttcgttcgctgtacaggtgatgaagaaactgagggtggtattgcttgtggttaccaagtggctggtgccaaccacaacatcgttttttaataactgtacctggaaagcgttgccgtctaaaagaaacaaacacagaaagcatgtcacccatgtcatgtcatgtggtggttcattatccgcaatcgcctcttgtacatatgtcacgtgcataccaccaatcaatgacaccaacgcatcaaagaccacagacaataatcacactgctgttttttttatgtgcatatcctggttgaccgggaaaattttgttccatcttgacacataagtaaattctcttcttaaggatatagaagggtaaactcactgttatcaaagaaaatagtgcttgagaatctatgcaacataatagcccaccaccaatcacttttgcacgttctacagattaatccctgatattttttatatcatgcgatagtcatgtgtttgtttgaatcaagtaaataacatatatttaaataaacataggcattttaccgatagcaaagcatgggtatttcgctagcattcaagaagaagagaaacttggaaagttaagccatcatgaactaggaaggataatgtgctagagccaacagttcaacacttgattgaactaactgagccaagggaaagaaatagtttgtcactctaatcacaccaataatttttatacatgagaaaatggccgagttaaattatttaatacaccaccaaattacctcactatatgctcctttagctacaacactgtcctccaactttgatcttctcccgtttaccatatactcacaaatcactgaaagctagtataaaaatacacttgcagagaagaaacctgggatggaaacaatatgcatattattgggactaaaattgcatcttggagttgaatttacccgctgggtgccgcaattactatttcttccatactcttctggaacattatttctgtaggttttaagcacccacgaatgtactcctgcccaagttgtgcgcgctcgttgtccccaaacccaaatacaatgcctctgtttgtcactgcaacagtgtggtacaggccagtgctaatttgtgaaacatagtgatcacgcagactatcgaggactcgaggcctcattactttgtcggatgatcctcggtcaggaaaccctaaactcccaaagcccatccatccgaatgcaaaaactgagccctcatcagtaagaacaaatgtctttcttttccttgcacagacctgtcaaaattaaaggaacatacttaagcctttatacatgaaactactactagttctgtttcaagatatgattgttattagaacaagaaactcctatatcatattagcatgtagcaatgcataacttttgttttaaatacgaaaaccatagcaatgccctatttcttgctacataaagtatattacctcagcctaatctacatgattgatgatagtttaaaccaggtttattcttcgatgcttaatgaagtaagaaggaaaatggtgcaaacatatggaacacacctgcacagcaacttgactcttcaaactgctgatcaattctgggctagttttgtcattctcatcaccatggcctaatgctccacagtaacctctgccccatgtataaacctaaaattttcaaaccttaacttctgtctgaagatacataacaatcaaaacatacaacagatagttccttgaacagtgtatacttacataacccagtgcatcaagagctacagcatgctcatcaccagcagacacgcgaaccacatgaatattcctcctcttgaatgactggattgcacgtggacgaagttcatcatgctgatctccatgtccaaggcagaagttggtacaagagccaaaggaataaactgttccatcatccgttacagcaaatgtatagctggcaccagcagcaacctgcactaccggagcaaggccttcaaataattcaacgatctttggagtagccctgtctattgtgtcaccatgaccaagctggccatgtgtgttacttccacatgtatatacttgcccatccgttgtaagaatgacagtaaaacttaaaccagtggcaacctgcaaaaaggggaatagatagaattaagaaaaagaggaagagttttgcagacttgactagaccagacatatgaaacaactacctataaggctataacagccttattgtctattaacaaatttagttacaaaaagtagggtcttccctccattttatatcaacaaataaataaatttgaccacaaaactaaaacatcgttcctgttgcatcaaataactagagcattgttctgtttttacaaaatgaaatataataattgaaagaggcatttattccattgtaggagatatggaacataaaaggataataaagatgattgggtccacctgtttgcaagaaattccttttagggcctttatttcggttggtcgaaatatagttcgccccacctcaccgtgaccacagcataatgatgaattatctccacaagtgaagacctatttgaacaaaattcacagcgttcaaagtattagaaatattacaattgacaatatacagtgtttaagatgagcatcaattacctcccctaactctgtgacaaaagctgcatggttgtgagaggcagagatgttgacaacacgagaaagtgatgggaagggaaccctgctgaatgccgcacactgggttgtatctgggccatgacctagcaccccacacaaactggatccacaagaatagacagaagagtcatggaccaaaagtgtgtgatatcttcctgtcgctacttgcatctggaaacatacagcatgttcacatatataagaaaccaggttggaaatgtcttctaacattaaaaagaaaatctaactttccagtttcatactaaagatagaattgttcatgagggaaactattcccaagtgcaacaatgcaacttttgttgatcatttggtcttcatattggcaagcatagcagaatggcaataagtaacatgtccaacatagagcatactctcaaactggtagagcagatgagctaggatgttaataaaagaaaaaaaatctagaataaaagtaaattaggcaccctccagaacaatctgatgcagtaggcacgccaaataattatgcgccatatatttttaaaatgtctgacttgaaattcaatcagtgtaagaaaaacaactaagatatgatggattcaaagcaactgaggcatcagcaacatattcccattcagccaagtgtgtcgtatctaaaagaaaatgaaaaaacacaaggtaccatatgtttattataaatcatttccaatgtccacatatcctcctcattcagaagcatgccaacttacaaatcaataaatcatagaattgttagtaattttgttcatcaggaatgagctggtcaacctctcttaattctataacaagcaaaaaaaaaaagaaaaagctcacaatagactacaaacgcatgccttaacttggtgttaagatgtttcattgtccctagtgtaatccaaatgtggatatccgattcctatcacgaagtttccgaattcacaaagtcatgcatgcatgatcaaacatggatccctaaaacgggcaaaggtgtgaggcaagcacaatcatctctaccaggctatcctacaccacacaaagtcaaactaaggttgcatttactagtatctcagaattcagatgcgaagcaaagaaatcctcacgttgccggaggaggtgtggacggtgccggaggactgctcgacggactgcaggaacctgagcaccttcttccagctgccgccgcaccgctccaggagctccccgcgcgcggcggggcccatggccgcgaacgccgcccgcgcggcgcagagcctggaggcggcgtgctcggcgagcgggcggagcgcgcggcacgtggcctcgagccgcgcgaggtccccggcggcgaggcggccggaggtcaggacctccccgatgaggtggccggggagctcctccatcgagaaagcccgcggcgccttctcccccgtcgccatggatccacccctcccgccgcgatccccgcctccgcccgacgaaatcttggcggccttgcccctggatcgatcggaatcatccaaggacgacgccgaccccgacgccgccgtacggatcgaaatggcgacgaactccgcggcgagctccccccctcccctccggcggatcaaatcgaatcgaatccaatcgaatcgaatcaatcgctcaccaaatcccgccaagaaacactaatccagcagcagagcagagcgaggaattgggggagtaaatccggggtgcgatttgagggcgggggaagcggagaagaatccctccaaatccgaaaatccgcgaggatttatacgctctcgcgcaagcgcatcaacgcacgaacacgagcacgaaccgaaaggaggacgaaaaataaaaataaaaaataaaaaagaagaggaggagcaggagaaattttcttcacgcaagtaaagactaaagaggggctccggaaataaaaaaaaatgcttggatccagaggctcctccactagtagctggcgccgtcacccactgaccagtgggcccagcggcaggtggcctcacctgtcagaagtcacactcacccggtggtggcacgtggcctcgcggtgactgacgaggtggggacagtggagggtggggccggggggtcagtggggttggagggtgcgcgcgggggaaagaaggttcgagatcccggggggaggaggagaggaagaggacgtggcgggcactatcgcctacaggggtgacgtgtcaagccgggattgggcgcgagttggcgatggggacccggcacggtggcacggccaggcgatcggtttcctcggcaactcggcgccacggctggacaaggcgcaggcagcgacaggcgaggggcaatgcaaatggcatggtggggttgcaaattgcaattttgcattattagcggagcaaaagcaccaacggctcgttgattttgttcgctcccatctaatcacattattttttcgtccccagcccgggtggtgttcggtcacaggagtttttgtccaatcccttgtcaacatagtgtggttacagctcgagacttttattgtgctgtgattctttcttttcttattacattatttccgttacacggcggacacaccattatacgtgaaacatgatacacaccactgcgcatgcaacaccacgctcacacttccacgagtgcgtctcttcacacacgctcagagagataaaaactggctgtatatttatgatcacactaaatcctattgatatttacttacgtacgcgtaatatttatgggtagcaagatttgaaccctaatgggtaaagtcatgcactcactaatgactctatcaccaccccgtgctttccttactgtgtagtgattctcgtggcatcatgtctcgatgtttttatgtttatacttggagcacatcctttagtgacataaccttttattgcacactccaccgaaaaccaactatcacatgttcattcttttcaaacactagcgaagtgacaattctttcgtgataggtgatacccctcgagaatcataccatggtccattcttgatgctaccaccaataaattatgagagaatttcttttatgtccaagtcttcgctgctcataatatttctatcaccattatacttacaagagtgaggaagagatgcgggcgacggcggcacgagaggaagacaaaggcggaggcgaaggcggcgatgcgaggcagaggtgacggcgtgagaagaaagcggatacgacagcggcggcgagagaggtaaagggcgagatgacatggaagaggggatgcgggcggcggtggcgcgaggggaagacgaaggcggacgcggaggcggagacggcggcgcgaaacgatactgacggcaccagacagaggtggcggcacgagaggaaagcaaaggcggcggcggcaagagagggagagagcaagagacaacggctagggttttggatctgtgagagccactttgcgaaaaaaaaaccttcagttttgacaattttaagcacagcccttattcacttttttctcttcttcgtgacgaatatctggtttatgtaagggcttaaacgtaaaatatcagttcaaagactgtttgggagggacttagatcgaattaaactcaaactaaagggttttttcgtaaaacttcaagcgcgtactgttcctatcctacgtggatactggatagcgcgtctgcgcgcctaaccggacagccttgaagagtaaattttcatatatttttttttacccacgagtctcaaaatgccctctcgcttgtgaataagtgttgccataaaaatcatgatcctcaaagtgaaaacgagttcaacttaaaattatttgacccttaatttaaggaaaaaccagttcgaaaagcattaaaagttccctttttgattttatagtaccagaagttctcaactcaggggcaacccacattgaaggtatatacaatggtacaacctagtataggctcctaattaaaacacattagttatagattggcttttgagacaacatagcctgcacaaaaaaaaattacttttctttcctcttctctacctccatggaacaaaatttccttcattcaatgttaagagtcgatcttgagttgagttggtgtcatgcgtatgaaagggtcaattaggcctagaggggggtaaataggctaatttacaacttaagaaatgcggaagcagtaattttcagaactaggctgggaattttcggaacttccgaaaggattttcggaacttccgaaaatgcacagagcaatgcacacaaaagaaaaatctagatctagaagtctattacagggaatacaaggcacaatcagcaactagaccaatagtggcacaagcaagcaaagctagaggagagggataaagaaatatcaccaagatgtagctcccaaagttgttcccggagttcaaatccttgaggggattctactctccgttgaggagctcactaagagccgggtctttgctaaccctttcctcaagaggttgtactaagtactcctccttccactaagaggtatatcttcccttgcggaggcgagatccggccttcacaaacttctcccggccaaccacaggtagatcggtggctcgggagtgacacctagccgtctaggagtcctcaacctccaagagtaaaagatgatgtaaagaactcccggagatgatgcaagtgctcacaaatcttcacaaagaccacaagtagcatccacacaaactcgaatccacactctcacacacacacaccaaatctgaatcaaacacgagtggagagatgaatcgaggaagcaaggctcaaatgaactagagaaagagagcaagcaaagggcacaaataattggaatagaaccagcagccctcacaagtgaggggaggtgggtatttatacccacagcacaaatctgcccattggagtgcaataaaagtaattttcggaacttccgaaacaattttcggaacttccgaaaattccagatctgagaaaaaaatcgaagtcaacgcaatttttggaacttccgaaaaacattttcggaacttccgaaaatttccagaacgcttctgtgtattttcggaacttccaaaaatttccagagagctctcaaacggttctgtgtattttcggaacttccgaaaatttccagaacgctcaaaaacggttatgtgtattttcggaacttccgaaaattcttttcggaacttccaaaaattttcagaacgctccaaaagagaaatgcttcgaagaaaaattgattttgagcacacgcgtcactccttatatgtctatgcatcatcctccttaatagtacagctttcctacgacacaatgcgaggaaaaagatacaatatactatttgatcattgccgcattgcatcgcgatgtcgcattcacgggatatgcattgtattacaacacgttgaggacttaacaaacttcacatttgcttgaataaaaatgttagtcctctctaattgtattgtaatcaatcatcaaaatcattaggggcctagatgcactttcagcgtagcaacaatgtttctctttctcctatctctctctttcatgttaccaaatttacttagatggcaacaaagagagcccgctaataaagatcgttgtatatgatgaaagtgaatgacttacaacaataggatgctcctgtcatcaagttcatcaagcgccgcccttgagcctatctggcggttgcctatgcaccgtcacaataccataacttcgcctatgaaacttgacgaaaaatgttgttccaatacatatcttgctggctagctaaccaatcttgattttatgtataaaaatgtgcacatgcaaattcaaaatgacaattaagtgttttaagaaaaacgaggtgattttaacgtatgattaattgaattttaattattacaaacttgaaaaatagattaatatgatattttagagtaacttttatattaaaagttttcgcacgaaacacaccgtttagcagtttaaaaagcgtgccacgagtatccaaattttcatcccattttttagtggaaacgaacgggaccgaaagctcatctgcttcaatacctgttggcacccctaagcttacacaggcgcaccatcatacacgagctcatcgattgcacctgatcgaactcacttggacacgtcgtcctgtagctcatctactagcaccctcaatctcatctatttgtgctgcccatgagctcaccctcctgccctttctacaactcttcaatggagctcatttgctgtggtacgttaaggaggaagacatggtcacgctgtgggaagtaatggtagtttgaatagaatgctaaaatgagtattagagggaactttcgatactactaaagctaaaatggactttttttccctataaaactaaagtgggaatgtttggcgttgtagaaccaattatccccaagttaaaaactgaaatttaactattcaaatgaactatgatcaaattttacgaaaatttagaagacacttgaccccttagtggaattttcttgaaatttggttgaagttgataaaaattacatatttttgtttctagtagaggaaaaagggagataaaggtgttttgtctaattcccctatgaaaatttatcaaatttgattgtacaatgaaatttctcataatttatatatatccaaccatattatgatgaatgaatattgcatgattatacccatatagcataatcaataagtttattattgaagtgtggttaaagtttaaatataaatggtggcgtcagatgacaagtttcgtaaaaggaggtagtaattagttgaaaagttcagtttagaaaaataaatactagttttgttgttaaaataagtggttgtcctaggtttgccggattgcttgattgcaacaagcagcaactgtgctattctccagatcccagtgacatggcatttcatttcgccaatgctctatgcttcacatatggctctcaagtaccaccatcatgtcagcatgtcacgaagtcccattgccagtggccgcaccaatggttagcagttgctctgcctctacacaccaaatgcaccatcattagtcgtctcctctcacgactacctcatccgctagtatgcccatgattatgtgctcacgaatcagttagtcgcaaattaaagctagctcacatacttgttgcatcctcacccgtgattgaggatgcgtggcacacacaaaaggagaagatgcaacaaccaattaaggtgatgttggcctgcaatgctgacgggaaactatttttcgttttaatagtctattatagtgttggttcaaatagatctactaatgcccagtacaaagaaaaatatgtaacataggatatagattaagatatgcccatatctccaaacaaatatttaacacactttgttcaacttcacaggcatccaaaataattaaactaataaatattataagtaacaaactatattatatttgggtaaaatggccctaaggtttatagtattaggttgtaacttcatcaaatatctcaacaccttaaaatccaaataaccaatactccctccatcccattttaagtgcgacaagtttccgcgcccaactttgataattcgtcttatttaaaattttttataattagtatttttattattatgagatgataaagtatgaatagtactttatacataacttatgcttttaatttttttttaaatttttttcaaataagatagatggtcaaagttgtgtaaaaaaatcatggctgcacttaaatggaacggatggagtaccttttaaccatttttaattcaatggatagtaatgctgatgtattcacattagtttcactagaaaattattattttttcaacgtaccaggtacattcaacacatgtttttgatctcacatacaaaggctaacatccaacggagcaattttacaagaaacaatctgcttccgcccaatacttttataaaaaaacccctagcaaagctttccttttcttctcctgtaaccaccttaaatatggatccctcccacgacgatagcgataaggaagttacttaattacagcgacaacaccaccccatttaatgtgtttctttttggagtctaacagatgacgaggttggaaacctaaccgcgatggcaaaagcaggataaatgcgcgctgttcaatactacatttgtctcaaaataagtgcagccgtaaaaatccgtgtccaatattttactgtccgtcttatttaaaaaatttatgaaaaaatttaaaaaaaatagtcatacataaagtactttttatgttttatcatctaataacaataaaaatagtaatcataatttttttttaaataagacgaacgatcaaacgttggggataaataatacaaaactgtatttattttgggacgaaggtagtagcgttttacaggagtctgatttggtcgatcgcatggcaattggcaaccgatcgctcatcgcctattgctaaccaaaaaaaaataaaaaaataaaaaggaatttctaccacagcagtttttgtgctgggcttgggccaaccgagccgagcaactgagcagctagccatggcccatgggccggccatggcgggccgcggcgcgagcggcatgctcgccacctcgcctcgctcccccacgtgtcaccgcttcctcccaccttttccattttttttctctctctctctctctctctcttctccctccccaagcaaagcatcggcatctctcctccctaaaaccccacctcccgtctccccggggcggcggagccgatgagatcccggccatggcgggccccacctcgcgccgcctcctcctcctcgtcgcccgccgcgctggtcacctctgccgccaccaccaccaccaccaccaccgcgacggactcgtcctggcccgctcgctccaggccgctgccgctgccgccgcctagtcgccaccaccgcttcccgcctcgcccccggccaggaggtaatcgaatcccacaggcgcttgatctctgagccgccaccatcgcgtcgttctccctaggtcgcaaacccgttatctaccgagagcaggtccattttaggttcttatactacatcgaagtaattgtattcttaacaatttgcactaacggggaggagagaagtgggagatacactagcaaaaatgcacaatgacagcactgatttgcggagccattttgtaacgattattgggataatagcagagaactatttttgcttctcacaagttacaactatcaagttttctctgcctgtgcaatcatgtactagccatgcacgcatctgtttcttggttgtgtgatagtttggagtcatcgttgtcaatccattttaatcttacataccatgtactgtattagataacactgcataaatcataataggcgaagcaaacattttgcaccgtaatggtgctgaatttagctattttaaatgtagcaaacttttaaccatatcagctttctggctgattccttctactttctaagctctcttatgtttgcattgtcatacttgtgttttgcctccatgagtacaacttgatacagttcaactcgctaattcaaccagtcgtaagttatgtaaccatccaatcacgtataagtgcaatatgcactgttttacaaagatcttcaacaaatggctacaccgttgtgctcaatatcactatgaatcaatatgtgttctccctggctctatcttaagtctgaactgaaatttcttcatttgggtaaagtatgtttgcctactcatctcaaccttaattaccacccattgtatgaggtagctgtgaggcaaacgttttgtaccttagtggtgctggatttgtctattttaattatccttatgctagaacgatttgtggcttattccttccaacttttaacttatctagcatacttttgttttgcctccattgacataccttgatacagttctattcgcatgttggaccattgtaagttatttaatcatctggtcacttataagtgcatcaacatataaggtattgctcagatctccaataattcttttcataccaatatatccaataatgactatacactgccacgctcaatcatcactctgaagcaaagttttactccctcagcttgtctaagctcagctgaatgttctccatttgataatccaaatgctcatgccatttcaaagttctttttttttcaggaacatcaagttgaataagtgagtagatatattgttcttaggaggtttattttctgttttgtagcttttctagtgcattctcaagtgttcatggggagagaccgtcctcagaatatgcaaagatcagaaaggagtcgttagaaagccagtttggaaggatcttgggttcaagctcacgtacactatttgcagatcgtggctttggtccattccttgcaatgtacagggcagcaattatctcttttcatgttatgaagctcactatttggcatttattgctcagtgatgtgcacaaacgggctgagaaggtatttcttttctgcctttcttcctactctaagggtgtgttcggctgccctatttcagctgtgatacagccattttgcacagtaatttgtgtcactacaaacagctgtgtgactgtgttgcagcggctggccggctgcaacgtgcagccgaacacaccctaactctctacgagtacttgttatactttgagtttcatgtatctggttttcattttactcatttcagttccaggagaccttgatccggttggggcctttttacatcaaggtaggtcagagcaatgcattttaataaatgaccaacattacaatgtatctttactgtaacagatattcttatgcttattt

SEQ ID NO: 83546 - DNA, 1721 bp, Oryza sativa
caaatgagattgtttctgaagtgtcaatttgatttgtttcagaatcgcctgtctgttcatgattgttgtcaatttgtcagtgatctctgattctctgaattctgaaggaaaaggaaattccattaaagcacggcattgccataggcttagcatgcaattaccctatatggaaatgaaaacagcattggtagactgtatcactataatggcaattaatcatgtagatctgaccaaaacggttcattaatccgacaaacagaagagaagaacaatgaagccggtcatggatgtcagacagttcagcaagttcggcatcaaactagtcacagatttcagaagagcatcatgcaagaaaaaaatgcagcatgaataatatatgtcattatgctacctgatacgacagatacctaagtttttcttccaagaactgtcaaatggatggcatatgctattctcatcaagaaaacattgtttactctgacaatcatacgactattagaggaataatctaatgcccataccttcagaaattatattaatatgatcattagacaagaatattcctctaatatctggaaagttatgggcattggattggttgaagagaaaatactaaggatggcacataacctttgtgctgtatgttttttttttccaaacaaaagaaaattttgggctgtttgtgtctgagtgggaggggttatcagtgaattatctttcggtgctacattacatctctgagacaaatctaaaaaccttgtacacataagacaaatacacataaaagattgcatcaacatcaccatatgtcgatcttttgctctatctccatcatcatggggaaatttcttccatgtttgacagtactacatgaagttgaatctacaggatgatgaaatactttttacttggcagcaactagatctaatgatgaatagcaattcttataaatattgatgcgtgaaatagtcaatgcccagctcatagcttcattggttggctactacgatttcaagttctcaacagataaaaaaaatatgaaaggacattgaacatcatctataatctttacgttaaaaaaatcatctataatctttaatatattatcttgttcataggctatgctgggaggcttaggtgatcctatgaggggctgagggcagtttagtttacaatcatatcttagactgattgtacctacttcgctgtcgatccaatgaacaaagatgtatatattgctctagcatgaatctgcttaagaaatcatgcttccatatatactccctctatattttaatgcataatgccgttgactttttttaccaatgtttgaccatttgtcttattcaaaattttttgcaaatataaaaatatttatatcatgcttaaaaaacatttgatgataaatcaagtcacaataaaataaatgataattacataaatcttttcaataagatgattggacaaacgttgataaaaaaaactcaacgacgtcatacattaaaatacggagggggtaacatttttctaaacacaaacacttcacatgccaatttattaagaagggagattttgcagtaatctagtgtcacagtcaaactgtaatggttagtccaataaatctaataattcaaatcaatataaataaatcaatgcatgctttgcatcgaaccgattcgcgatcatctatccttgcctgtggcacttactctttgtttttg

SEQ ID NO: 83547 - DNA, 1093 bp, Oryza sativa
  unsure (1)..(1093): unsure at all n locations
gttcggaaagcataatttggggacaaacanaccgggtggcatgtggtatttagcgtattgaacaaaattatatctttaaaaaatactattgggttcatctgttgtttgtcaagctaactgtttttttttctaatggatatatcacttacatgtcacaatttttgttaaggtgaaataaacagtgttctaactattttcaataagaaattaatatactttagtgcaaatcttagtaatacataaacacaccaaattataagctaggaagatgcaacatctggattaataaaataaaatcgaaaagttacactaaattatacaagagttgtgatctttcggattaagggtttaataagctatttaatgtgctacgttttagtcgatggcaattaagaagaaaatatcagatgactgtaaagctaaacaccatttgaccatccaagtacattaagaattgaaaagttttcctacatttaatgtgagaattccaacctaattttgctatatgtcagatgagactaaagtggaaattgtaagagaaagaacataaataattaaatactatttacgaaagtttgtaactaggacatagtactacttattatgaaaaagtttatagctatgacatactacttattatggaaaagtttataactatgacatacttatatttctcatatatattgttgctaacacatggtgcctgcactgcatgtgtatagttcgtggccggcaacgatttcgcacaggttgagttcaaccgtcttcctttgggccgtctcggtaaacctgaggacatctcgtcgttggtggcgttcctgtgcatgcctgcggcctcctacatcactggccagattatatgcgtcgatgggggccgtatgctttcttaataaactctacatatacaaaataaagatatatcatgtatcataatatattctactgaattgggagacactcacgtacaaagcacactcatattcgctttcactttttgagggatcatgttgagaagnnnnnnnnnnnnnnnnnnnnnnnnnnnnnnnnnnnnnnnnnnnnnggnnncgtcgaggggttcttaantcaagggcgc

SEQ ID NO: 83548 - DNA, 2541 bp, Oryza sativa
aagtaaaggagcacacttctgaacatggaagcaacaaattttcaggattcatttggagttgtctcaagagaaaaataaagactcatttggagaatgggaatattcacatgttcgcagcggcggagccacctcgcgggctggttgggcagccaaccgggctccatgcaaacgtttccactatccttttgtcagcaaaacatgtaaaaaaattatcaatctctagcaaacgctcgttggccctgtttgatttagattattgagcgaggaattaccacagattatttagtcaattataaaagtaaattaaatattttaaaaaatgaacttaacaaataataaaaacaatgcctttggcttccggactcagatgatgccgttggctccgccactgcatgtttgcatatataattgaaatcgaagtagtatttcttattaaattcattagagaactccaatgtgtacttaggccttatttagttggggaattttttttgtttggttatcacatcggatattcacacatttgaagtattaaacgtagtctaataacaaaataaattacagattccgctaataaactgcgagacgaatttattaagtctaattaatctgtcattggcaaatgtttactgtagcacaacattatcaaatcattgcttaattaggcttaaaagattcgtctcacattttatacgcaaactgtgtaattggtttttttccatatttaatactttatgcatgtgtctaaacattcgatatgatggatgaaaagtttttgttttggaactaaacaaggccttaatagctgagagaaaaacaaatatacctaggaacaagcacatgtagtagatgttaatatttttttcccttgataaaattttcaaggaagctagttggttccttccctcggacagacagctaaagctggactggcactgcaaccaaaaccaaaccaaaaaaaaaaatcctcctatgtttacagttactaggaccagttattacagcttaaacctctaacttatcttacttctccaaaaaaaaaacaaagaaatgtatctttcacacaaaaagaattgaagccatgctgcattgctattacttgctgcgtgtcatcccactcagccgacctcgacaactccctcttgtgcttttgcttttcttttactcctcaagccttcccctgatcagttcttgatctgcactttttacattttcttttagctgcaaaagtttcaaactttctttttttttcccttttgtaccatggatttctcatttctctatactaaaaatgttagtagttgtggtgtccattctcacgtcacacctctactactgacatgtgggccctataatctatgctattacatcacctttcaatgcatgacccgtttcactattggttcttcccaaattttaaaatcacctacttattcaataaggaaaatcataatattacttaaactacataaatgcttattaattgattcaataaggtagaaattcaatttgttttccgttgcaacgcacgggctctaggctagtctttttaagaggtcactagactgatgacagtgaagctgcctcttctccactccactgcctatatatctgctgccctctatctaagtccattgccctctgagtctctgaaatcctgaagcttcttcttcttcttccttcctcctcttgctctcttgctcttcctatgctagcactctccatgctcttcttgcccttgtagcattggctccttggtttccatccatggatccacgctaaatgcattgcgaggctgcaaattggtagcattcccttccccgttgcatgtgctgcaactatgtaagcaggagtgtctgatttgacacgcctgaatacagcttctcagatcttcagttttgttgtttgtctgagaaaaggagagagagagaggcctcttttgggtccaagaagagaaaaatggaggagagcttcgtgcccctccgtggcatcaagaacgacctccatgggaggctccagtgctacaagcaggattggaccggaggattccgcgccggtatcaggtaaataaataaataaataaatcttatcttacattgtgttcttgatgaggagtaggattcctgtccggccatggtcccaagatcttgaaaagttactgtaaaagagggagaatatttttcgttgtttaagcactaggttcttgccccaagatcttgaaatgaagcaaatatttgttgtatgttttgtgtttaggatccttgcgccgaccacctacatattcttcgcttcggccataccggtgatatcgttcggagagcaattggagaggaacactggtaaatggagcagcaaaaaatagattgtttcttgtgtttgattttggttactggtaatgacatcaatgagcagaaaacattttaaaaaaagaataagaagcttattttgggtggtaatggttgtgtgcagatggtgttctgacagcagttcagacattggcatccactgcactttgtggcataatccacgggctgcaggaat

SEQ ID NO: 83549 - DNA, 721 bp, Oryza sativa
  unsure (1)..(721): unsure at all n locations
aatggctnnatgatgataatacatgccnctgacaacnnacnnnnnnnnnnnnnnnnnnnnnnnnnnnnnnnatcgtggagtactcacagctgatagtcgagccttcacaacctaccggggagccgtcatgcattatgccgcgctgatgtaaatagtattaatagttagcgtaaataatatgacaatataaattattccttcgtacgttaccatggcataagtgaattagatgtataataaaagaaagaaaaaaacaaaacctatattatgtttgcgaatgatggttgtagaccagtttacatataatagtgacaaagtgatttttgtttgcatgtgatagacattaacattcagtatattaaagtctatgttctatttcacgttataaattaatattttcttcttgcataattataacatattcttcttattgtgtatatgatgagaactggcttcttttaatatactttttacaaataactagttgggtggccctcgcaattgcgcggttagcatccatataaaattatatatattttaatatgttttacttaaaatttattaaatggttatcttgttgtctcaagacattgtaaaaccaaaccttatcatcctcatgtttttaattttattggttttaaaagtcacactagttgctaccccttacttctggcatatccttctttgtttgcttgctcgaactaccactggttttatttat

SEQ ID NO: 83550 - DNA, 6581 bp, Oryza sativa
  unsure (1)..(6581): unsure at all n locations
aaagcagtcctatatgcccaaaggtgcatcagatagcttgtttttccatgccttccccatctcattgacagtcttctgtagaatattcttgatttgtttgttactcgtttctgcctgtccacttgtctggggatgatatggagtggcaatattgtgctgagcccaaagttcttgcaataagttttggaaggtcttatcgatgaaatgagaccctccgtcacttatcaccatatacggagttccaaaacgagggaaaatagtctcgtggaacatccggcgagcgtgcttagcgtctgcggtcctgcatggcattgcctctacccacttggacacatcatcaacggccactaggatatactcgcagtcataggactttgggaaaggtcccatgaagtcgatgccccatacatcaaatagctagacttgaaggttaaaattcagaataaagataagtaatattgaaaaaatagtccatgtataacataatacgagattaattagaactcaaaataaaaataaaataaattttgaaaatagaaaaagaaaaataaacacaattttgaagtaactaaaattcttactactccctccgtttcatattataagactttctagcattgcccacattcacgtgtgtgtttagattcattaacatctatatgaatgtgggcaatgctagaaagtcttataatatgaaactgaggaagtacttttttttttattccaccttcagccgaccgctcctctccttgacccacaaacccaaacattgccgaccctctagatatgtctccacatgcgtttcgtcttcttatgaactgcaaaaataggtttcatctttgatgggcatcaatgcccaccgaattccccttcaattggtgcattaattgtctcaatctgcctaatcttttaactctggccaaactgccaccattgatgaccagccgagctccccctagaagttccccttccttctctgacctataaaggggcggtaacatcctccctaccctcccctttgccttttccgggctctcatgccccgcattcactctcattctctccaacggacacctctccccgtcaactagagcagcgtagcacctcaccactgtctccattagcatcgctccaacctcctctaccggggccacacctttgttccggctggcagaagcaagacctcgttggcgaccagtggtaacgtcgtcatcttgctccttcagcagctggcctcgcctcatcggagtgccataccgctatgtcgttgtcactgtcggcctcacctcatcatctttcccccagctacccctatgcttcaacccaagaccccaggaatgttgtccctaggatcgacaaaaagaacgccttcgtcttctccatctatcgttggttcctgctgttgaccgaggatgtaaaagccaccatcaccatatcaaactctgtcgtacgtcggctgcaaggatcctgaatatcgaacaacccgttgctgaactgttgcctctgccaaagcaacaacggcgcgctgcactgttcccttcgagcggaatcatcgactcgactagcacgaagaactccccatcctgatgcggcaccccaccgccgttgtccatcatcaatggcatggtgttggattcggagtcaagagggcttgccggcaacccccgcttgggcaagcttctatctcaagttcttcatgtcggacttgtggctatagattttcttttttctgtcacttacatgtgcgccccacatctattttttaatttttaaatgcttaggctgccaggtcagccaaaaccacctcgcaaaccaatgagctcggtaaaatgcttagtattaattaatagttgagtgagtcaatgtactcgatttttactattaagatacttgagggagtcaagatggagtttttccttccgaagcacttgctccctgcagctgggcctggtcgcttctttacagcagactgggctctctctggcccaatcatgtctgcccgagctgctaggcctattaattggacattttagaccaacacaatattgtttagatagtaacatttctagcgcacactaaaatatactatttttcacgcaatgttttatgaatatacctaaataaattataaaaatacaacatactcaatctaaagctcaacatgcaagtagaaataattacttatgcaagaattaaatattatctataatttattgaattatacaaatcaacatgtaaacatatccaatcatctcctctcacattatttaaacatatctatctattatttttataatacttagcatatatctatccatatattccgtgttagtggaatattgtttagtttgtttcatgaaaaaccctacttttcatttgtttcccatctttcacttcttgcgaagcaaatcttggtcaacaatataatatttaatctgcaatcttctaaagagtctattaaattcatctttcaacaaaaatgttttgacaaacagtttcatttgatgctaatatcatgtttattccttacttgattgttgaaaaaacatattaaagattatttagtaattttcacatattaaagattatttttgtacatcctgctgccaggcaaatcaggtaatttctgtatatattttttttcaaattttgtatatttatgcaaattcacaacaaatatattttcatttttttctggtatagcagaatgtaatatatcagtttggctatttccaccgggggcaaccgatgtgaccgaaataatcttggatattttggaatataacggtccaaaataatttagaatttgcacaaaattaggtcatatttgaactaattttgcgaaattcgaaagaaaaacaggcgaaacagcttcctattttgatgcggtctgaaattttggaaattctattcggcaatttttgaacctggttattagtagtagatgaaaactagatattacaacatttaatgatcttctcaataccatccgcatttaaagaggctacaagtattagtcgaagacatgactacgttatatctgtgcagataatcaacattttccaaaagataatatcgaatctactaagttacgtagaccggtgtctgatgatcctcctttactaacacatttttcagcttctatcctcagatttctcattctctgtttcacattttgaccttcctccccattcactaatttctcaacagcagtttgaacttttgccctctgcagaacactccctacctccatctccacacccaacctccaaacagcacaaacatacctcgcatttcccatctgatctccaaaacatggcctacatatcatcggcacgccttcagatatactctctatcgtcgagttccatccattatgcgtcatgaatgcgcggacagaagggtgacctagtaccttttcttgcggtgcccaagagactatcctgcctcgaccattgatctcttcctgcaaatcactagggagctcactggaatgcagccgtaacccacggacaaggcttggccgaaccacccatagaaatggtagcttggtgccagccaagccccatgccacctccagaaactcctgagcatcaatggtggccatggtgccgaagctcacgaacaacacagagctaggggcttgtgtgtcaagccacctcaggcaatcacaatctgggggaagaaagctgcttcttccgacgagtggtatgagtttgttgagtggaccaatggcaaacacagggatggagagctcgtcgcggatcctgcaaatgttgtcaccctcgatgaagtcgaaggtgttgagtatgagccctgatgacagccgcgctgcggcgactacattggcaagcacgttggcgaagctgtagaggtttgtcgtgtcaatgcgctgtagatccttcactcggaaaggggggagaatgtcgactagagtgtccttttgggcatctaaaataaggagaaatggatgaacagatagatggagtagaaccatttatatgaaggggttatatttagtatcagtaaagattttgcacataagggaaaataactctgtttgaattttgattgaaatgattgaatcagtgaaacaaccaatacgaaaaaacatattaggataagttctataagtaatttagaagataaatacatatttgtagttaattattttaaatatacatcatgtccaataaaagtagttctgtaccagttgtcagattttgatagaaaaacagagtataattataataatctactttcagaatcaacctattcggttttgcttttgattctcgggcaaaatccacatcaaacgaaaagcaaacggggctaacactgtccatatctcaaggaagattaaaactagaactgcagagacggttgaatctgttcattcttacagaagacccaccgatcccagaatcatgcaagccacttgctagctaataaggcttgctttgagtctgttttcgatttttggctcggtgattctcgtaattttatttctcagactgtctgtgctgacgccttagntgagtaatagatcattactttttccccggaaaaaaaaactgttctttcttttctgctggattgccaagtcttgactgttagggtgtgtttggataatgagaaatgggagtgggattgggattgggaaatgaatgaaagattatgattaaatgaaagagggagaataaatggttaggatttaaagatgtcttttaatagatgggaaatcatttccctatatcattagccaaacaggaccttaaatctatatactctctatatctcgttatctagaaaatctacctaatatgttgaaaatatttctaataacttgatgatcttcataatttccgcaaaataagtagggagaaaaacacagagctccaagcgatggacacatggagtaaactcaccgtcgacaggcaagaagcccctctcaagcagaagagggtactccatgaacgtccggaagctcgacgcgctgctcgtcatcagcagcatcagcggcacgccgagctctggcgccgccgccgccggcgcgtaccacatcacgtcggcgattacgcacaggacgccgccctcctcggcgagcagcgcggccagccggtccgcgaacggcgcggcgcaggtctcgttgagcgaagtcaggaccgccgcggcgtcctcggacaccacgagctcgggcggggtgccgtcggccacggccacgaagcggtactccggcggatgcgccgccgggtccggcgctctgagctcggtgtggaggacggtgatggagaagccacgggagcggagcacggcggcgaggtggaacatggggatggtgtggcccgggtgcggcatcgggaaaaggatcacgcgcccgcgcgggggcgccatcttcgcctgtttcatttagtgagataaatatatatatatatatatatatatatatatatatatgcagaaattttgagggaatcagcggcggtcaagaaataactcagttctaaaaaatacctgacaacacgaagtccaatttatgcgtttttgttatttatttatcggaggggactaccgatcgggcatgacgtcagcgccacacatgcgtacaaaactactttaaactattttttttcttaaattatttattcaaatcatgatccgattgcaccattaaattcgttgcaattaaatcttcaaaacaaaaccacacatggatatattccgacgaaattttctttagcttattattgaattatttttaaaagttacacgatgttccaccatatatatcggaattgtttcactaagtatatcgaaaatgtttcaatcgtttaaatcgggcattgttttaccttatataaaaataatgtttcagcaaatagcgaaagaatgtttcagtccactgcaatattagatctatacatagtgaaatattctgagtacactgggtgaaacatttttggtggaactatcgtttaaatcgggcattgttttaccttatataaaaataatgtttcagcaaatagcgaaagaatgtttcagtccactgcaatattagatctatacatagtgaaatattctgagtacactgggtgaaacatttttggtggaacaaaaaataaaacgaattctcttaatagagggtttccaaaatatgtgggtgatttgttgtaaaagaatgtttcgttcactgcaacattagatctatacatagtgaaacattgtgagtacactaggtgaaacatatttggtggaacaaaaaatgaaacgaatttcattaatagagggtttccaaaatatgtgggtgatttgttgcaaaagaatatttcaatatactacaacattatatatatacatagtgaaacattgtgaatacctttggtgaaacatgtttgataggggcacgtggcaggtggaggcaagataaatggtggggcccactggcatgcgtgtcgcatgggggaagagtgcccgatttcgctcccccacgccggtcgtccgaggcgaagaattttcgttatctcaggtaataccggtgtgggattcctagctcagacaggaagttagctaattagtttggg

SEQ ID NO: 83551 - DNA, 1333 bp, Oryza sativa
  unsure (1)..(1333): unsure at all n locations
ctttgccgtcccaagggcaagctcggccaccgctcatcctccgtgaatcatcgccgaaaccccatccctatcactcaaggtgagctccacctagtactgtcgctaccggccattgttttagctgcaccgctccggtcctcccctccttaatccctcattccccttccgcaggtcgcggccaccctcgtccgtttcttcctaagcgccgcccgtcgccgaagcaacgccacctcccttcgccagagctccgccggcgcccctcggtgaggaacccctccatctcctctccctttcccctttttccgccgcctcccgcgtgtgtcaccacgccagtggtcatcgccggcgaccatcaagccgtgcatcgtcgctccccggccggccagccggtgagccggctcctgctcgcccgtggccgcccgatccccctacaggggcgatttgggccgtccacgtggccctccccgtgccgcctggtgtcgctgccctgtggtgccacatcggcgccacctcgtcctccccgtccgccgtggccacctcgtggctgccatgtggtgcgcccgcgggcagtgcgcacgtagaccgagtccaccgtgtgccgaccttctttgagccaccgacaggtggggcccgcttgtcggcgccacctattccccttggtgacgtcataaaccattattaattgcgcaataaatcattaataattctagaaatccattaaaatggttcaaaacttctaaaattcatatctaattcatccgaactccgaattgagccattcaacttgcaaaactcatctaaaattgagctctacatgtttgtttacttttatgtactatttccttggtatttattagagattttccttgttttgcgtgccagcgtgtagtatccgtcgtttcgaaagtccgcggtcgcgaagaaaagagttcggaagattgtttgaaagaacaaggcaagtcacacattccccttgtgcatgttgatcccaatttataaatgttttatcgtttgcaaataaatatgcatgttttgctaattacatgggaatagggtttacctatctgctcgcttgtgccatgtttacttgatatctgttctttgcaaccctggatgataaatcgactagctcatgttacttatgtgacatagctagaactatatgctnagcccatgctaattacactagctcagtnatgggataatgcagtttagacctttagatctgatgagctgctgctcagacatccggcatgttattgccatatttatcactaaatgcgactattgtgggctggggtgcatgttttgctgccacacaatgcatgaagac

SEQ ID NO: 83552 - DNA, 690 bp, Oryza sativa
atgatagttaatgtgaatttttttgtgcgagaaagagacttcctactgacgttaactcaattatgccccctactactgcagttttctgttttaatttagttgatataaaatagattcagactgatacttgcattttgtgcgagaaaacgtctatcccttgttttaaaaattgtaagagggctataaaaaactggagttttaagagggctaggcttgctaagatacatgagttttggcttctcttatgattatttcttgctgagagaattgcatttgcttcttacttcatggtttctgtttcttgtcctaactgcttatcctgcatggttctggcagatttgttaatgaaacttgcaagcgcttgaaggagaagaagtcctatcttgtttggaatgctgttggctgccttggtgtttctgctatcagtgatcttgttagagaggtatgcaatttttacacggaatagttaaataagtatactgatcaatgtttagactagtaaaacttggtgcaacattattttggtgtaagctactgtctaaacctctcaaatgtcccatcatgcctccatgatactcctagattggtaggtattggccaaatggccttacataggacatctgtttgcccactactcttacaaatatcactgccctgattctttgcagttacatggagggctgcaggaat

SEQ ID NO: 83553 - DNA, 1350 bp, Oryza sativa
caataaagaacattgttgacgagtgtggttccttgctagtaatttctttgatccaaattatgcatggcttatattggggctttaattaattggattcaccatttcattctattctttttttaatactagcaaaaaagcatgtgctttgcaacgggtaaaaactattttaatattattattattattatatggtttagttacaattaagtttaccgtctaaagttagcatgcgagttttcttatatgactatttctgtatttccaaaagcgaacgaatttaaaaaccgactcaaatacggatatgtatttccaaaagtgaatgaacttaaaaaccaacttatacacagatgatgtaccaaagtaccggcaaaaacatctttattttttatatattttttaataattgtaagttgtgggcatcctataattattcaaacaaggagcctgtttttttctcactctccaaccgagatcaccattttttaaaaaaagtgaccggacacgagatgtgaagaaagcaagaatcattattcgctcctaccgtagattattgttaatgatcctgggataccagaactcagaagcaaccggtcacacacagcgcacatgccacaccgcattaagccagcacgaatctcatgaagatatgatgcatcgaaagaagggctgaggccctgtttgatagagagctccagctcccagctccaccttaagctggagctgaaccaaatggtttagattcatcggaaaggggagcggagcgggatggagcgctcaacctatttacagcgctactcgttatttttcaatgaaattacaagcagaatgccaccgggccgattcacacatccccaagtcacggtcacgcatcgcgtcttctccacgaggccgcgaagagagaagggggagggaggattgaggtggtcgcggcggtggcagtgacaacacacggcgcacggcggcggtggtggtggttgcctcctcttttacaacacctacagctcctagtggagctaccctccactggagttggagtttggagttaggagttggaagctggagctctaccaaacaggaccaaaaagccaaaataaataaatggcacaattaatttaaatagcaaaactgaacaagaattcattggaattgcgtgagcaaactcagacccttggattggatactacatatatatacccctcatgtcccgttagtgttgtggatattttcttcccaactcttgtagtatgcatggctgtttatcgagcatgaatagactttcatgtgttcaaattaatcgggaagtgatcgacacaatcaacggatgagaataattaagtaggaaatggtaaa

SEQ ID NO: 83554 - DNA, 1005 bp, Oryza sativa
  unsure (1)..(1005): unsure at all n locations
agtgtgattgttgcctgnagaatctctggcnnnnnnnnnnnnnnnnnnnnnnnnnnnnnnnnnnnnnnnnnnnnnnnnnnnnnnctgggcgagctggatcgggccgacggcccaagaaagaaaaagaggaaaagaaaagggaaaaaggaaaaaaaaaggaaaaaggatttttcctgggattaaaatattgcgcttgctcatttttaattggttaaaattatttccaaggctctgaaaattccactaaaaatcttgttaatgcattggagcatggggaactcaagaaaaattccaccatgcatttccgattattaattgcatttattaattagagaattagctctaggttaattaagataatttcttcggacgatttatttagccaatttttaaagcaaggagagggggaaacttcagggcgtgacacgcggcgacgacaatggcggcgggcggcagcggctaggtcaggcgaggcgaatccggtgcggtggcgagcggcgtccacgagctcgggcgccggctggtagggttttttttttggacttttatttttttcgcgattttttctttttgtatgcggttgacttaagtgcccgcatgcggattttcgcatgcgttcggcctagccgcatgcaaagatcgccatctttgcagacgatttggcacatgcggttggcgctaccgcatgcgaaaatcgctcccgcccgtatgcaaaaaccgattttgtagtagtggcggcggccggcaggagaggatcagcggttcacggcggccggagggcgggagggagaggagcggccgtgcccccgtgctggcgaagggggcggccgacgggagcaccgcgagggaggaggcgagctcgtcaaggcggccgacaggagaggagcgacggcgcgtggggaccaaccggagatgaggcagtgcgcgccaatccaccggagggagggagaggagcggtggcccacccgccggaaaagagcaatggttccccgccctctccacctg

SEQ ID NO: 83555 - DNA, 8677 bp, Oryza sativa
atccactatcaagcacccaatggctcccaccggtgcggtagttcacctacaaaagaagatcaagctcttttaggtacccaaacttgtttgagtccttggaggttagagaccaaagctttgggcacccaaatggcattctttttaccaccgagtataggggaacccacatatctagcaacaatgctaccatcatgagccttactaagcatataatgagaatcaaacatacatgtcttaggaggcttaccttcggggcaatcactcaccaaatgcccaacctcacgacacttgtagcaatacttaccatttctcttgacaaaacgagtggcatggtgagaaggtttcttacccttctttggaatgaatccaagtccctccttgttaaggatgcaccgttgctcactcaaaattttgtcaagagtgttcttacccttgaagcatctctccaaactcttgttgagcttagccacttgctccttaagctcattgttctcaacaacaagtgaggcatcacaaatagaaacacacgagctagaactagagcaagggctaggcatatacataagatcatcacaagaggtagaaatactagatgatgcaacatgagcaatatggcaagtagcactatcatcaagcaaatcacaagatatgccaacatcaatgtgagctccatgttgagtagtggaaaggagattgtcatgagcttccttaagcttctcatgagaaatggtgagtctctcatgagagatctttagctactcatacaagacctccaaagaagcatgatccttctttagggccttgaacttgacaatatccttctcactataagcatagagctcctcaaacatactcacaagctcatcataggaaacatcatcacaatcatcatcactctcactatcactaagagatgttaccttagaggaaccctttgccatgagacaaattggagcgaagagtgatggagcctccttgatggcaacaacgaccatcttcttcttcttggagcttgcatcatcaccaccttcttcctcggacccggatgaggcggagctctcctcatttgagtcccattccccgatgaaagcctcaatcttcttcccttccttcttaagtttcttcatgagcttgtagcctccactcttcttcttggatgacttgtctccatcatcatccttggaagggcacttggaagcaaagtgtcccttctcactacactcaaaacacctcaagttggagagagtcttattgggtcttctatttcttctcctattggagttggagccccttcctctctcctttctccttcccaagagatcattgaaccttctagcaagaaggatcatctcttcctccaagtcctcattgacttcattcaccttgctcttgctcttgtcttcaacttcggcttggagagcaatgcacttcttggagggtgaggcttcctccatctccttcttcttcaacttgtacatgtcattggtgttgatcttccccaagaggcttgcgggtgtcattcttgacatgtcggagttgatgagcatggtgacaagggtctcatacttctccggtagggctctaagcatcttttgggcaacctcaagatcggtgtagtttgccccaagccccttgagatcattcacaatgacattgagcctcccatacatgtcattcacattctcatgaggcaacatggagaatgtctcatattggatcttgaggaagtgaagcttggcatccttgtactcacttgtaccctcatggatctccgccaacttgttccaaatctcatatgcggtctcaaggttgctgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaaaatctaagcagcggaaaaaataagataaacgacgcagacgactccactccacaggcagcttgaccagggctacacctaatcctccacaccatcagcatcactatagaactcctcctctgatgaatgattgcaaggtgagtatatgacatactcagcaagccacgcagcaaatatgcaagtgcacaggataacaaaggatggcatagtagggtttcatttgcataaacagcatttaataaacatttcagaatttaataaaatagttaagtaataattaaacaatattaatccaacgctatacaacataccctgttgcataggcccaaccattctgaacaaccatcccggctgcacagttctatctccaaaccaggaatataccattccaaaccaggagctaatcaaattattactagttatagcatcttttattatgatgagaagtgtgagactaatcacgaaagacattgtttgacccgcccttaaccgcgggcacggctattcgaatagttttactctggccagaggtgtaccactgtacccacaagacacagccccacaacatgtcaccatgtgcctcaataccaccacggtacctcggaaaggagctgtgacagtacccctcgcacaacacaatccaccacagcgcacctttcctggatcataatcacccccttataaacaaggcatggactccccagcgacccccgtgggcttatctccgccacttctcagtctggtgctccgcaatgaaccatgctatacaaaaggtaaagctgttgcccacgctggcttgtggttggcacggttaatgtttcacaaccgaaactcgtgaaccggtccttaattgtcatgagcacgactctcaaaaccatgtgctcacaacccactattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaagattgtgtttaggatctgtgtgacttgccttgctggccttggaactcctcaaattcttctcctgcgaaaacggactctccggaaacgtcggaatctaaacagaaaagagcaaaaacaccaaaacaacacataaacaagcatgaacagtacatgtggatatttttaacatgtagatctcaattttagaaaaatttagagacttgaaccaactaaatccgagctaagatgaattagttatgaattttcaaagattaaatcggattaaatcaattatatgggttttaattgaattatgacgcaataatgaattatttttgaaaaggaaaaaggggtttattgcgtcagcggctagggtttgcggtggaccgggtgcacggcggcggctcacagaaacgaacggccgagatctttccatccaaaacggacggccgagatcgaccggtccacggccggaccacgagagacgacgacgataacgtcagcggtgacgtcaccaccggcggcggctcgggcgcgcaagctcgtcggcgaacgagggcgcgacggcacgaacggagggcaccagcatgtagagagcgacgcggcgaactcaccggtgaccaaaacggcggcggaagatcaacggacggcgacggcgtcgaggaaaaggcggcggagaagatcggcttgacgacgacggcggtgctccggcggtctacagcaacgatggaggggcggacgaggacggcgacgcgacggcgaccacgacggcggccttccagagcgacggcgacgactggagcgacggcgacgcacggctggagcggcggcgacgacggcggcgcaaggctacacggtgctagggcgctaccaacggcgagaggcgaaagcaagggtggcggcgggtagcggcgggcttgggggtccttttaaaggggcaaggaggcggcggcgaaggcccacggcgatcggcgacgcgaaggaaagtttagggttcggaggagagggatcgatccgaatcgaactcgaatccacggatttccaaacgaaattagccgacgattccaaaagagaaaaggtagaggagatctcgggaaacatttcccctcaattgatttcaccggagaaggaaaggcgcggccgaatttggaaggagacggcagcacggctcggctagggttcgggcggcggccggccggaggtagacgacaggccccccacctgtcagcgggcggacgcgcgcgcgcgagcggacggctcggctgcggactgggccggcttgggccagggagagagagagaaggttttgggccgactttcggcccaaagccaaaagagacttttaaaaacctttttcaatttaaattattcattaaatgcaattccatttattaaaaatacttccttagctcaaataaatcccagaaaaatctaggaattatagagttaagcaaagtatttaatgaaattttatctggccccattttatattggaatttattaattaaaactagatcttcttttcaaggcttttaaaatcatttctaataattccaattaaacaacaatttatatatttaggatttttagggtgtgacagttgctcactctatcgaactcctcttggctcaaagagttgaacaaggcattcatggcttgggcattgagttggaggttgcggtgatcaatctccgtcaagggtgtgccagtgatggcaaagcctacatccacaatactccaaatatggaagctcatagctttgaggtgagtagatattttaattttccagtggagtagtttgtgccattaaacatgggagccttccctacatggttcaccttgttcgacatcttctctctaggcggtgaagcccaatcaagagagaccaagctccgataccacttgtaggatcgagatgtcgactagagggggggtgaataggcgatttaaaactaaataacacctaatcaaatctaacctaagttgctaggcttggtgagggtgaactctaactaagcaactaagttatgttttgcaaatctagggtgatagtggctcaaatatatctctaggaaagtaaatcacgctcctatgtcgatgttttgcaatcctagggtgatatgatctcaagtgtgtctctagaaatgtaaattgcacaaatgtaaatgcgacaatcaaatgagacaatgagacaagagatttttcaccgaggttcggaaactcgccggtttcctactccccgttaaggcgagcccaactccaccgctcaaccacgaagccaccgcacgcccccttcgtcaaagggtgggcaaggcgggagccggcccacggagaggactacccaagcctcgatcactcggggtagttcttccttcactccgaaggtggtgaactccaaaccattcacaaaccggcgccgggcctcctccacaatcttctcggagaggtcaccgggcaactcctccacaagccgcctaggaggcggcaaccttcaagagtaacaagcaatgacccggtgtggagatgatcaagtgccacactagctctacaatggaagcaaatgcacttaactcttgcctaaacaaccctctaacacactagatggatgaacacaaagctcaagtgagtgtgagagaggtgcaaggagtgtatgcaattgaattgggtgccaagagagcccccttgctgctggtgggggagtatttatactcccacccaccaaaactagccgttgggggcgaaatcccccaactctgtgctctgccggtctgaccggaggtatgcggccggtcagactgtgctactctgcaacggctagaaaactagccgttgtagccctgtcagagggccccatcggcctggccggtcagaccgacatggggcggccggtcagaccggcctcggctcggtcagaccgccatcggctcggtctgaccgactacggctccgtcggctctgtatcggccatcccgagcagcatcatctcggcctccaggaggccggtctgaccgggaaagtgccgccggtcagaccgccactatgtagccggtctgaccggccagggcacgccggtcagaccgccacatagtggcggtctgaccgcccctggtcaggccgaacccagtgaatttgtgtaatgaaaaagagagcacaaatgaaaatgcaatgatctaatgtggcaattaaaatcatctctttgctaggtcattacccctcttaatagtacggcgaaactaaaattaaactagcaaatttgatcgccctacacctcgatcaattctaaattaaagcgctagttttaccgtcttctttccctttgctttgcgccgtcaattttaatccatcgataatcatccatgcgcgcgtatgacgtggacctaacttaaaatgtatagctcaaagacaacggttagtccacaattagtgcttgtcattaattaccaaaattaacaccgggggcctagatgcttcacccgtgagtagttagatgggttcagttttgaaattaagtgattgagtcatttatgtttaaataaggtataaaatatgcccatcctctactaaaataaatcggaaaagttggataatattgaatattgagttgaaatgcaaaaacaatggtgaactcactatatgggccttttgtaaaacctgtgttagttgatgccaatttttagaatggttatggtaaaatgtagagcttttttaaggaaaacacctagcaacaccacggtccacgactgcgaaccacaccctccagcgtgaaaccagtgtttgcaatttcgttttcggtgaaaattttggtcatttcggtagagattgtagtgagttggtactcaatttgtgacttttcatcttttcaaagtaaaatagtatacactcatttgtgaaattatttggtagtttacattgaaaggatttagcaataaggattacttccaaactcccactgatattattaaagtgccaaattcaagttttttgtatggcaaaacatatgatgccttgttttattgtctatatgctcttggagccatattgaacatttgaaccttcttttgttttcaaaacataacatatgttggtttgtaatctagctacaatgaaagccatatttatacacacatggattgttatcgacggtgactatttggtctcatttgctatcgatattggttattcggccttatggcttgtcccccagatctcaagtcctggcttctgggtgcaatcgatctccgtgagcatcatttgcttagtgccaaatgaaacaagaattcactgaaaacgcatccaaaaacctggcccattggattggatacttatatatatacttatatactcctgttcgtcctgctatccgtattcacatcttagtcacaaactctacagtatgcagtatcgtttatatataagcattctaagcctgaacaaattctttcatgtgtttccaatgagagctgcaaacttgttcaactatacgctcaccaacattttcaaccaccagcaactttgccacacctatgttccatatggatgctttatcagggactgattaaattaagagtaaagtctatcaccggtccctaaacttgtaccgttgtgtcatcccggtccctaaactcgcaaatcgactgttcaggttctcaaacttgttcgaccgtatcatcccgatccttaaacttgcagatcacttgtttaggtcctccaatgtcacgcccagaaattcccgaatagaattccaagcagaatgtgcataaaaatccccgtccaggaccagccggggtacacaaacgacaatgttgacattcagatccacgtcttacaaacatcataaaagtcttacagaaatgcagcggaaaacaaaagaaacaggagctaagccttgacttgaactgcagcgggaacaccactccacaggcatcctcgacggcacggacgaagcctactcctcggggaaaccttcatctgacacatacccgtcctctggggttgggaaaagtagagcaagactgagtactacccactgtactcagcaagtcataccggaatagaggtatgatgcagggaattacaaagaagagctagagtggttcatttgcataaatactggcatttataaacaggaatttaatgcgaaaacagttgtaataattaagcagtattaaacatccgctgtccaacgctaacccacgttgcgacaggcccaaccatccacctaaactatccaagttcaacaaattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacatcccggaaagaggctgtgacaggaccattcgcataaccccctctaaccaagcacaccacacctcaggttcacccccactcct

SEQ ID NO: 83556 - DNA, 3800 bp, Oryza sativa
  unsure (1)..(3800): unsure at all n locations
aagaatgaaattgaatcggtgatatagcaccaactgggcatctatctctatgacagaaatcatgacgaagtggcatggttcaaatttccaaaaatttcaatggcacgcactatgtttcacgaataatactggcattttttttatatatgacatgtttgcaatggcatttaatccaattaatcctattaaaaacacgacatataaaaactgccatctctctccaccttatccttatcgcttcactctccccaccgctcatcccttcactccccaccgttcccatctttctgggtctctctttgtcacaccctaattttcgttcgggatcaaaaattattaaatagcgcatatctagaaattatgtaaaagttaattttatcaagtaaattaatgagggaattaaaatttccttttaaaatcatggccgaaaatatttttgcaatatcctttgtgccctaaatattctctgaaatttctcttgaatttttggagctcaagaagtaattttaaataaaacaaagttcattaaatcaattaaattaaattgaaaaccaattaaagttctcccaataaaggtgcagtgttaggggtaccccaagacgatgaaaagatggatggaatatttgagagtgatatcatatatggattattagaactctataaccttgaaagttatgtggaaaatagtgaccggaaacaacaccctagtggtgtgaacatggatcaagaatggttttacttaatttaaggcaacagttatagcttccagaaatcatttcaatgcctctcggaagttgactaagaaatcattccatacatgggtcagaaagatacaagggtcaggtccggaaaggtttagccagcagagtgtacgacagagaatccttctcgataaatcatcccaactcaaggtttgaaagtggagttattatgatcaaagagaaagagcagaaactcttgatagcgccaaagtcagtttccaacagtcatacagattgcagtatttgttggaaagcaactttagagcttatagtctatcaacccagaggagtcaataaaggataagcaaagaagtgaaatgttatatcgaggaaataatcttttgagcttgatctattaagtgatcagtgcttatttcaagatatcaactaagcagcccgttcaaccagttgacaccgaagtcagggcagaacagaacagtcatgcagatggaaaggtcaatcaagagtctgtatgttcggaaactgaatgagagtcacttttgtggaacttcctgtcaacaactgatcagtgttatgttccaagccctcttggaatgaaagtgcaccggcatcaccttatttgaactgattgatgaagcgatgagttctccaagtcagggttccaggaaaataaccgaagtttggttattttcaaggatagcagtttaattgatcacggtcaggcaaatgctcaaccacttgttttaagggtaagtctcgaagatgatttttgtcatgccccgtaaccgtttcaattggatgttcagataagcagggaaagaacagttatagctcaaagaagcctattgccaagttaacagatttaaatctaacgtgtacacccgggctgccgtgtcaacagttcagcctacagaagaacagggagaaatcgtaatccaggtgaaatgccgatcaagcaacttcttcaaatacttgtttccgggtcaagagtagttcaaagcaaagtaagcatatgaggattcacgaaagtcagtgcaaaagatgcaccaattccttgtcagcaaagtgagttatcagtttatcaagtatgtcagcactaacagttcagtccaagatcgaaattaaatggcacaagaaactgcattatgccgctctcatgtaaatagtattaatagttagcgtaaataatatgacaatataaattattccttcgtacgttaccatggcataagtgaattagatgtataataaaagaaagaaaaaaacaaaacctatattatgtttgcgaatgatggttgtagacgagtttacatataatagtgacaaagtgatttttgtttgcatgtgatagacattaacattcagtatattaaagtctatgttctatttcacgttataaattaatattttcttcttgcataattataacatattcttcttattgtgtatatgatgagaactggcttcttttaatatactttttacaaataactagttgggtggccctcgcaattgcgcggttagcatccatataaaattatatatattttaatatgttttacttaaaatttattaaatggttatcttgttgtctcaagacattgtaaaaccaaaccttatcatcctcatgtttttaattttattgtttttaaaagtcacactagttgctaccccttacttctgtcatatccttctttgtttgcttgctcgatctaccactgtttctattcattctccttgcaacctttaaaagttggatcttatagtttttaaagtttattgtcctgttggatttcatttttataatttctagaagcctcgtcaaacactaccattatactcctctacggccgtccactgcatcttctccatttttactttctagaagttccgccaaaacgcccgggactttgtcactatactcctccacggctcgcctgctgccgctcttctttattgtcattgagattttaaattcaaacataattattattggtttttttttactttttagaagcccgaacctttaaaaagggatcttatagtttttagagtttattgtctcgttgggttatgaacagtgtatttaacggcgcgggatggacagaaccctaacggcgatgttatttttagacaaaatcatttgtacgatggtatttcttggaattcacgcttatcgatagtatttcttagatttggacacttgtcaatggtatttattggattatctctaatttaaattagcagcttgatttatatgttataattttttttaggttttccgttttttacataatcaatatagaaagggcggacaccgggtgtggaacaggagggagctagggagtacgtatgtacgtttgtacgtatgtgtataggacggtgatttagtgatttagtgagagatcatatagcatgaaaatagaaactaatatagcatggaaataagagagatcatatagcatggaaataggtgagaattaaagggatagaggggagggagggcgtgtatctctgatctcccgtacgcacggaccaagcgggatgtggatttttttttaccaaaaaatagaactaattccatgtattattgggtccaccaaataagtgtaaatctaataactaaaaatctgaaatagtgggtccaccggtttattagattaccacgtggcggcttaattaggagcgtttgtaggagtccaatgtggcggcatgagaacgtttgtaggaagtttaatggacttttaatatataataataatagatagatagataaataaattgcctacgtatctatccaggcttccttcctagttttgttaattggagggaagaaatttgccaatcgactaggttgtgtagatacgtgtagaaaaatggggttttgatatttgcatgtcgcgctttgtttattaatttcgggtcatggatgtaaatgtccctttcataagggtaaccatgtaaattcccctgtataaccaaaaccctagtagtaagaannnnnnnnnnnnnnnnnnnnnnnnnnnnnnnnnnnnnnnnnnnnnnnnnnnnnnnnnataggttaacaataaacatcct

SEQ ID NO: 83557 - DNA, 7287 bp, Oryza sativa
ttagatttgcataacaaacattttttaaaataataacagacaaacaccatggtattcactatttagtgcttaaaaaaagaatccagggtatttcgatcacaaaatttctagtaattccaagaaaatttccggaaagtttccgaccgattccgagttccgacggaaactacccttatcatttccgattccatttccgagaaaatatttccaaattcgtttccgtttctgaaaaattccgaccgacagattccgttttcaaaaataggtctggaattcggaaagtttccgtaccgttttcacccctagtaattggtaagtattatttcttttcttttcaacgtgagtgtatacaagtatagattagtcaggattaaagattcctacttactccgtttaactatgtaagacttctatataaatgtgggtgatggtagaaagtcttacattatgaaacggggggagtaatagttacgctttaaatacaattttcaatctgccaaagtccatgtattcgtgcgtgctttccattggttcagccgatgattgcgcggagaaaaggtcaaactgggtgaaatatacttaatcacactattatgataagctgtgctcattggcaagcactcatgggccctgtttggaagattagcccagggctaattttgagagctaatgtttagtcatgaattggtaggctaaacattagcctaacatgatatgtttggatccataggctaattcaagactaaaaggtggagagagagtagaaagagatgagagagaaggagagagagagagctgcttttttatggtccccacacaaaattagccctattagcactctttggaggggctaatgttttgaggggggctaattcacattagctcaaaattagtccacctgtttggatccttgagggctaatttgagactaaaagatgagagctgaacattagcctatggaaccaaacagggcctggtagcctggtacacatggcgatcgaggaaatttggtggttagtgccacgccttcgagtacccatagtcccgtatcatgatgtacgcaccgatttggcatgataatatagttaatgtgttcagcatttttgcctcctttaattccgccgtccaagtccataagaatggtttgcaacacgctttggtatgaccaagaagagatgtacactattccagcattaactcatactccttacgtactagtaaaggaagtcgtttaggacagcggcatggtctccaaaacacaactttgacttcttgtttctataaaaatatttattgaaaagtgatatatgtatacttttatgaaagtatttttcaagacaaatctatacatataatttttacatttttaaactcaacaacttgagagttatttatgatttatattcccaaggtttgacttaaacattgtcctaaataactttctttatgagtacggagggagtattccattatttctataaaaaaaacttctagccgcatcataactagaaattggatttttataggatggagggagtagtcacgtacttatatacagccgcacctgagcgttgacatcctgcatcctgtgctcaacatgaaactgatttgattttggagaaggaatgtcagatttgatctcgtgtgccacactggaaactggacaaaattttgtctactagctgaagttttcatttggacccgaaacatttttttgctcaggaaaggaaaatggaacaaagtagagtccacagtgtccactgcattggtatgtgggatgaacttgctgtgctttgcaaggtttagaagaatatataaacctactcacctgcgtacgtgttgatggcagaggcataaaacaaccatttctgtctggaatagttggcaaggatcattcctgagtccaaacgctccagcgttgaggtctgaccaagataagaagattatttattattcagataacctatcatatttctcgaggcttgtttcaggctaaacacaacgtcgtcagttgacaaggtctgatttctaaacagcaactgaagctgcttgcaggaccatcatctgcttcaatcccactcttccctcagtcctccaccacgccttccccttgttcatcatctgcttcctcatgcctctccttcatcatgtcctccttggcttcctcctcatcctcctctacctacggactccgacgagctctaccgccacggacaccgtgtctcccggccacgcactcgtcggcagcgacaggcttgtctccaacaacgggaagttcgcgctcggcttcttcaagccaggcaatgagtcctacaccaaccacaattcctaccttggcatatggttcaacaaggtccccaagctaaccccactgtggactgccaacggtaataacccggtggtggaccccacttcaccggagctcgcaatatccggtgatggaaacttggccatcttggatcatgccaccaagtcgatcatatggtccacccatgccaacatcactgccaaggacaccattgccatactgttgaacaacgggaatcttgtcctacgaagctcctcaaattcatccataatcttctggcagagcttcgactacccaacagatacacttttccccagtgcgaagattggctgggacaaggtcaccggcctgaaccgtcgtcttgtttctaggaagaactcgattgatcaagctcctggtatatactccttggagttagggcccaatggggatggtcatctgctatggaactcaaccatagcgtattggtccagcggacagtggaacggccgatattttggcctaacaccggagatgacaggcgctctcatgccgaatttcacatttttttacaatgaccaagaggcttacttcatatacaccttggataatgacacagcgatcatgcacactggaatagatgtcttcgggagaggtttcgcgggtacgtggctggaagggtcacaagactggctgatacattacaggcagccgatagttcattgtgatgtgtatgcaatctgtggaccattcacaatctgcgacgacaataaggatccgaaccttctgcgactgtatgaagggcttctctgtaagatcaccaaaggactgggagcttgacaatcgaacaggagggtgcatcaggaatactccgttaagttgtggcagtagaacggacagaacaggcctcacagataaattctaccctgtgcaaagtattaggttgcctcacagtgccgaaaatgtgaaggttgctaccagtgcagatgaatgctcacaggcatgcttgagcaactgctcctgtactgcttattcctatgggaaaagtggctgctctgtttggcatgatgagttgtacaatgtaaagcaactatctgattcttcttctgatggaaacggggaagttctttacattcgccttgctgcgaaagagttgcaaagtttagaaaggaagaagagtggaaaaataactggcgttaccattggtgcaagcaccggtggcgctttgcttttgattatccttctattgatagtttggagaaggaaagggaaatggtttactctcacactggaaaagcctgaggttggcgttgggatcattgcatttagatatattgatttgcaacgggcaactaaaaacttttctaagaagttggggggaggcagttttggttctgtatttagagcaatgctccggtgctttctaccggtagtatatactaccagtagaactaatctgaaccgtttatttttaagggtagattagtaaagtactgaggtagatttgggataaatttggcacttaatttatttttgtcgtggatcgctcggatgtttctggaaaagcagtgctgccaccgcttcctcatccatcgcaatcgagcggaggtggagagagcgactccttccgccgccggcgcttgtgcatcacgttcccttccgccggtggcaatactctccggcgccccctcttgttcagttccccttctctgccggcgtctacccgcttccccgccgcaggagcttctggtgccaccctgaagacttccggcgtgcgcacaggggcagcggtgcagaggagccccgcgtggttccacctcctctcgcacgacaccgccggcggtggtggcagccgcgacgacggctacaggcgtgcgtggagccggctgttgaggaggctggtgcaggagagcatgagcttctgtagcctcagcatcagcaggcacggtaatgttaattttcgtggatgacttcaccagaatcaagaatctgattctgaatctgaatcaagaatttaatttggagatggacagtatgctctattgctataccagaatcaagaatctgaatttgctatgaaaagaagtagctcaacttctgtgagcctgatccattaaatttgtgctttgcttcctctttacccaagctaatgtaatgtgaataggcccatcttgttggaattctgcgtgaaacccattccagcaatccagtccacgaaggcttccccttgcgagtcgtcacggcggcgagcgggtggcggtggcgccatggatggccagcaggaggagcagcacgcagggcggcggcagctgaagcccgggaaagacaaaagtatccctccgcaaatatttttttttggacaaaaatatccctccacaattctactaccattaagtgtgatggtagtagaaatagatctgaaccctatgatcaaatgagatcaacggttcagattattttctactacaattagagggcaccggagtgggtatcctgtatttaagggctacctaagcaactctaccatagcagtgaaaaggcttgatggtgcccgtcaaggagagaagcagttcagggctgaagtgaattcaattggaatcatccaacgtattaacttagttaaattggtcgggttttgttgcgaaggtgataataggttacttgtgtatgaatacatgccaaacagctcccttgatgtgtgtttattcaaggctaatgatatagttttggattggactactagatatcaaatagctattggagttgccagaggccttgcctacttgcatactagttgtcgggattgcatcatacattgtgacatcaagccagagaatatacttctggatgcatcttatgtgcctaaaattgcagattttggaatggcaaagattttggggagagaatttagccgtgctatgactacaatgagaggaacttttggatatctggctcctgaatggattagtggaacagttgttacatctaaagtagatgtttacagctacgggatggttttttttgagatcatatcaggaagaaggaactcaagtcatgaaaatttcagggatggtgattattcattcttttttcccatgcaagctgcacgcaagcttctcaatggagacgttggaagtcttgtggatgccagtttggaaggcagtgtgaacctcgttgaggttgaaagagcttgcaaaattgcatgctggtgtattcaagataacaaatttgatcgaccaacaatgggcgaggtggtacagtctcttgagggtctacttgaactcgacatgcctccattaccaagactactaaatgctatcacaggaggctcacatccagtgacaccacaatattttgattcactataaatctgtatgttgatttgcaatttccagttgtctgacagaacattataattcatcttgccttttaagaaaactaggtataacatgtaagatctctaggagatcatgtcttatactcgtattaaataaactcagtaccgtaacatgtaattaagatctctgtacccaagaaggagattgtgccagccttattaacaaattatagttggtgtctatgtagtatctttaggtattagtgtaccgtatacacttttcatgttgccaattgagatgttttcagaaatacaggggcgattgcctcgtcagttgatagtggattgtgagcctaacattggcaaatgtgtgacagcctgacagttctgctcatgttatgcaaacatggcctatatgtggcctatacatacaagggaaaattgttcactggcaaacaaaagggagaagcctggctgctaacctgcaacttgttttttcaagggtagccacattcttaaactacaacacaagaactttgcaagacggagtagctcataggttgtaacactaactacctgaactgcaaggaattcaagctgtggcgtaccgtactgtggttaccaatcactgaaggttgataatggatgagcacgtttgattgtctcatgttcttcatgtacagttgttgctgctgttgatagttgcggtttataggccgttccatccaccagaggcaacctgtatacttcatcagtttccatcaaaacttaactggttattgatctgaggaaggtaagtgccaagatactgatagaacatagggcctgtttggtagagcttcaagaggtggagctggaggtggagctgtgacaaacagacccataatagaagaatagaactgctgctgctatatattttttacaggaaaggttgaaaagcttttttgaaagcataagagccttacaggtttactgctgggggctccagcttgtctatacatcacagggcaccgacatccccaaagcacctgcatgctcaaagctacattatagacatcacaaaacacctggctaaggctaaagtgacaaccacaaataaactttcaccaaagactgatgtcaacccactccagatcttgatagtcctcaaattttgtccagtgccttggatcaccatgatcagagcttccatttcttctgcttcagatgacttcagtaagatcttccattgcataaggaacagaattcgaaaaacaattattaggggtgaatgtaaactttctctctaaacataatgtcattcctgaataaccacaactgccaacagccaacacacatacaagaattctatttcttttacgcccagctctcccaataacaaggtgaaagaaatgatcaaaagagaaaggagaactttgccaacccaaagcatcgctaataacacaccatttgctgcagatcaactggagataatatgttgcgaatcctccagcacttgcatagcatgcaatgttctgaaccctcctaatttcttttttttttcaattgtacagcagactggattctatctctactagccaaccgtagaaagtgttagggcaaggagctctataatttccatccctttactataatgtacccccctaaatgtcaaagcatacac

SEQ ID NO: 83558 - DNA, 1190 bp, Oryza sativa
atgtgcccccccccccccgaatttttttatttttgttttatttgtttgatatttttttcacgcttagggacatacaagaaccaaccatagaaaaattgaactcaaatggacgtaatatgtgacatgtagaatttttcctctcctctcctctctccgaactagtgcagaggagagagatgtgcaacttttttatttttattttacttttttgatatttttttcacacttaggaactcacaggaaccaaccacgtaaaaaataaactcaaacggacgaaatatgtggcatatggaattttccaaagctccaccgaaaaacttctctcctcaaaaacacaatcttgcaagcggaatttggaggttttaatatcgccgaacccggcaaagcgggggagaattggatgtaactttttctgtagatgtccgtgcatatattatttgcctgattccgagtccgtatgagaaagttacgcctattttaatagatggcatattttgttcgtttcggtagagttttggaaaattctacatgtcacatattttgtccgtttgagtttattttttatacggttggttcctatgttctcctaagtatgaaaaaaaatatcaaaaaatgaaataaaaataaaaaaattgcatctctatgtactgtttaacttatatatgtcatttcatatggttatattttgaatatggttatattttgaattagattaagtaatttcatatagtggtagagtgcattatgtttaacatgctgatcaaagggttttactaaaggagttatggtctaattttagtgaaggtgcaaagtagactaagtggtatgctagatattttcagacttagctaagtggtagttcgagtttaaattttttttatggttggttgtatcgtgatcctgagtgtgaaaaaacatccgaaaaaataaaataaaaatgacaccgttgcaactccatacagagaaacaggaatggaggcggcggcactaggctggggcggcgccagcatggctggcgccctcctcctgccacatcggttcgcgtgcgccacggtggcaggaggacggcgccagccatgctggcgccgccccagcctagtgccgccgcctccattcctgtttctctgtatggagttgcctcggtgtcatttttattttattttttcggatgttttcgcacactcaggatc

SEQ ID NO: 83559 - DNA, 9485 bp, Oryza sativa
  unsure (1)..(9485): unsure at all n locations
cgggccgtccgcgaggagcgagcggcgccggcgacagttagctagagcggtgacggccgtgggctggagctgaagcggcgggctgagtgccatgtcgcgccgctcaccgttcctctcacaccaccaccacccgcacctcccgccgaggaggtcacctcacgccgtcacccgagaaggtcacctcacgccgtccaccgagaagagaagcgccatgatccggtcgccgccgtcgccgcttcctctcgtcctccctctgccacaagccgccgccgccctcgcccgcccgtcctcccgccgccgcccgctccctatgtcctcccactgccacaagccgtcgtcgccctcccccgcccgccctccctccaccgccgccgactcccgcccgccggcccccgtccctcagccaccgctcgcactgttgccggctcccctcgtcctcccactgccacgagccgccgccctcacctgcccgccctcccgcccgccggttacggcgtcgaagacctagtcggcggccgccgagctcgccgtaccccgccacatgtgcctcccgcagtcgctgatgtggtcttcgccgcagtgcagctcagcccgggcgccgccgtctccacccgccgcgggagagagagggagcggcgaggagagagaaggaactgagggagggggagaaaaaagggacacatgggtcctacaatctattttatgtgtcaatgacaaatgggtcccacacatattttttaattctaaatgccacctaaacaccacgtcaacgtcacgtgtaaaggagacccggtcaatactgccacgtcagcgaaaccgtcctccaaaaccgttgagggagtcaaattgcaccggttccatagtttagaggtaagatattcggttttgtggtttagggtcatggattagatttcaattacttttgagggtcaccaagtgaacttattccttgttgcagtggctgcatcagtgcagcccagcccagcccagcgatgcgccctctctgtggaaatcacgagcgttccatcagtaatatgaggtatgtagattaagtagatgtgcgtaaaatgggaaagttattagcacataattaattaagttttaattattataaacttataaataaatgtatttaatattttaaaacaacttttttataagaaagtttttcatgaaatgctccctttaatagttaaaaaggcgtgctaacagaaactgagataaaatctaaatcttataatcagaaaataacagggccacttgaaccgattatcgcgcggagaaaggtcaaactggataaaatactcaacgacaggctgaaatcattagcaagcacttctgttacacatggtgatcaaggaaatttggtggccttcgagcacccatgattacgcaacgattttcacatgataacatagctagggcccctttgatttggaggaaaaacataggaattttagggcccctttgattcgtaggaaaagtttaggaaatttgaaggatttcaatctaatggaaaaaattcctatgaaaacatttgaaacaaaggattgaatcctataatatcctttaaaattcctatggaatgggtaatcatagagagattttgtaggaaagttagcaagaggtccaacctcttggaaaaattcctttgagcctatctctctcatccgaatcctgcgtttttcctttggttcaatcaaacgatcattcctatgtttttcaatcctttgttttacacctgcattcctgtcagaatcctacgtttttcctattcctccgtttttaccttcctgcgattcaaaggggcccttagaggatttcaatcctataggaaaattttctatgaagccttttgaaacaaaggattgaatactatccaatcctttgaaattcctatggaatggacaatcctatagagattttggaggaaatttagcaagagcttcaacctcttgctaactttcctttaagtctatctctctcatccaattcctatatttttcctgtggttcaatcaaacggtcattcctgtgtttttcctattcctacgttttctcaatcctacgattcaaagggcccttaagagcatccccagcagctcgtccaaatttgatcatccatatggctatatagatggtcatccaaaaaagattcctccttcatatttctccccatatttctccccactccaacagatcatccatattacatcatctatatcacatcctcctatatattaatagtatccttcaactaccatcaattaatattatttttttcttttttcatcattatcttctctttcactcccttctctcactccagagagctcgagagacacgagctggcggaggagcggaggggcgacacgagcggctcgccgccggccggagcggagggtcggcgcaggcgaagggtcagcgcgagcggctcgccgccggccggatcggaggggcggcgcggggggctcgccgccagccggagcggaggggcgcgcgaacggctcgccgacagccggacaaagtggcggcggcagcggaaaggcgacgcggccgaaggtaccttcactcgatctaccttcactgcttcacctcttcctcgatctcgatccggatggggacgggagaacaaatggcagcggtggttgcgggatggcgtgaggagagagaaacaccaaatctagcgtttctctctccgggaatagcgcatgcgccatctatggaggcccatatggcgtatccgttggagccggattttctccccccatacgccatttcctggatggaagatgggatgccggaactgctgggatgctctaaaggccaaagtcaatgtgctaaccatttttttcgtttttgcctccattaattccggtgtcccactgatcggttttcaacacgcttgtctgcaagccccagccacagttctgttccctttcacgcccttttctcagcaaacacatactacaggcgtacagccgcacaccctgagaaatatatgctccaacaagtcctcctcaatatacaaatgaacctgatgacattatttggaggggatcgatcagccaaatggggaataatactctgcaagacgtacaaatacaacatgcgatttcaaggcacaatcaagttacaacaaattcaatgttctctggcaatctgaagcccaaccgaaacatgtcagactcgttgggtggctcctgactcatcaggcgtacaaggtcaatcaattcctatgcttgcttcgtttcagaaattcttgcatcttacatccctcggtcatggtctgtgcttaaaatcagaccgatttgcttttggagaaggaatgtcggatttgatcatactggaaactagactaaaaattctgtctcctaactgaagttttcatttggacctgaaaccatttcttggtcaagaaaaaaaattggaacaaagtaaatccactgcattggtgtgaggaaagaacttccagtgttttgcaatgttttaaaaggagttcacttaaaataatatacctactaacctgcgtgttgatggcagaggcataaaacaaccttttctgtctgaaatagttggcagggatcatttctcagtccaaacgctccagcgttgaggtttgaccaacatgagaagattattattcagatagcttatcatacttctcgaggtttgtttcaggctaaacacgatgtcgtcagttgacatggacttagtgattgagacaaagtgcccacaccaccacgttaacttgccaatctgcgagctgaactaatcgctggtctgatttctaaacaacaacagaaccggcttgcagaatcgtactgtgtgtgagctagcttcaataccattcctccttcagttctccacttctccttcccttgttcatcatctgcttccacatgcctctccttcgtcatgtccttcttggcatcgtactcctcttcctgcacactctggcgagctccgccgcgacagataccgtgtcacccagccaagcacttgccggcagcaacaggcttgtctccaacaacagcaagtttgctctcggcttcttgaagccaggtaatgagtcctacaacaaccacaactcttaccttggcatatggttcaacaaggtccccaaacttaccctgctgtggaccgccaacggcgataacccagtggtggaccccacttcaccggagctcacgatctctggtgatggaaacctggccatcctggatcatgccaccaaatccatcatatggtctacccgtgccaacatcacaaccaatgacaccattgccgtgcttctgaacaatggcaaccttgtcctacgaagctcctcaaactcgtccaagatcttttggcagagcttcgactacccaacagatacgcttttcgccggtgcgaagattggctgggacaaggtcaccggcctgaaccgccgtattgtttctaggaagaattcgattgaccaggccccaggtatgtactcattggaggtggggctcaatggggatgggcatctgctatggaactcaactgtgccatataagtccagcggggactggaatggccgatactttggcttagcaccagagatgattggagttgcattgccaaatttcacatttgtttacaatgaccaagaggcttacttcacatacaccttgcgtgatgacacagcgatcgtgcacactggaatagatgtcttcgggagaggtttcgcgggtacgtggctggaagggtcacaagactggctgatacattacaggcagccgatagttcattgtgatgtgtttgcaatctgtggacctttcacaatctgcgacgacaaaaaggatccgaataacaacccattctgcgactgtatgaagggcttctctgtaaaatcaccgaaggattgggagcttgatgatcgaacaggagggtgcatgaggaatactccgttaagttgtggcagtagcaaggacaggtcagacctcacagataagttctaccctatgcaaagcattaggttgcctaacaacgccgaaaatgtgcaggctgctaccagtggagatcaatgctcacaggtttgcttgagcaactgttcctgtactgcatattcctatggggaagatggctgctccatttggcatgatgagttgtataatgtaaagcaactgttggatgctgcttctgatggaaatggggtagtcctttacgttcgccttgctgcaaaagaattgcaaatttcagaaaggaagaagagtggaacattaattggtgttgccattggtgcaagcacaggcactttgtttcttattacccttctactgatactatggaggataaaagggaaatggattattgctcacccactggaaaagtctgaggatagcattgggatcattgcatttcgacatattgatttgcgacgtgcaactaaaaacttttcagagaaattggggggaggaagttttggttctgtatttaaagggaacctaagcgactctaccatagcagtgaaaaggctcgatggagcccgtcagggagagaaacaattcagggctgaagtgaattcaattggaatcatccagcatattaacttagttaaattggtcgggttttgttgcgaaggtgataataggttacttgtgtatgaatacatgccaaactgctcccttgatgtgtgtttattcaaggctaatgatatagttttggattggacaactagatatcaaatagctattggagttgccagaggccttgcctacttgcatactagttgtcgggattgcatcatacattgtgacatcaagccagagaatatacttctggatgcatcttatgtgcctaaaattgcagattttggaatggcgaagattttggggagagaatttagccgtgctatgactacaatgagaggaactattggatatctggctcctgaatggattagtggaacagttgttacatcaaaagtagatgtttacagctacgggatggttttgtttgagatcatatcaggaaggaggaactcgagtcatgaaaatttcagggatggtgattattcattcttttttcccatgcaagctgcacgcaagcttttcgatggagacgttggaagtcttgtggatgctagtttggaaggcagtgtgaacctcgttgaggttgaaaaggcttgcaaaattgcatgctggtgtattcaagataccaaatttgatcgaccaacaatgggcgaggtggtacagtctcttgagggtctacttgaactcgacatgcctccattaccaagactactaaatgctatcacaggaggctcacatccagtgacaccacaatattttgattcactataaatctgtatgttgatttgcaatttccagttgtctgacagaacattataattcatcttgccttttaagaaaactaggtataacatgtaagatctctaggagatcatgtcttatactcgtattaaataaactcagtaccgtaacatgtaattaagatctctgtacccaagaaggagattgtgccagccttattaacaaattatagttggtgtctatgtagtatctttaggtattagtgtaccgtatacacttttcatgttgccaattgagatgttttcagaaatacaggggcgattgcctcgtcagttgatagtggattgtgagcctaacattggcaaatgtgtgacagcctgacagttctgctcatgttatgcaaacatggcctatatgtggcctatacatacaagggaaaattgttcactggcaaacaaaagggagaagcctggctgctaacctgcaacttgttttttcaagggtagccacattcttaaactacaacacaagaactttgcaagacggagtagctcataggttgtaacactaactacctgaactgcaaggaattcaagctgtggcgtaccgtactgtggttaccaatcactgaaggttgataatggatgagcacgtttgattgtctcatgttcttcatgtacagttgttgctgctgttgatagttgcggtttataggccgttccatccaccagaggcaacctgtatacttcatcagtttccatcaaaacttaactggttattgatctgaggaaggtaagtgccaagatactgatagaacatagggcctgtttggtagagcttcaagaggtggagctggaggtggagctgtgacaaacagacccataatagaagaatagaactgctgctgctatatattttttacaggaaaggttgaaaagcttttttgaaagcataagagccttacaggtttactgctgggggctccagcttgtctatacatcacagggcaccgacatccccaaagcacctgcatgctcaaagctacattatagacatcacaaaacacctggctaaggctaaagtgacaaccacaaataaactttcaccaaagactgatgtcaacccactccagatcttgatagtcctcaaattttgtccagtgccttggatcaccatgatcagagcttccatttcttctgcttcagatgacttcagtaagatcttccattgcataaggaacagaattcgaaaaacaattattaggggtgaatgtaaactttctctctaaacataatgtcattcctgaataaccacaactgccaacagccaacacacatacagaattctatttcttttacgcccagctctcccaataacaaggtgaaagaaatgatcaaaagagaaaggagaactttgccaacccaaagcatcgctaataacacaccatttgctgcagatcaactggagataatatgttgcgaatcctccagcacttgcatagcatgcaatgttctgaaccctcctaatttcttttttttttcaattgtacagcagactggattctatctctactagccaaccgtagaaagtgttagggcaaggagctctataatttccatccctttactataatgtacccccctaaatgtcaaagcatacaccgtacagggacctggatgagtagcccttgttcctctccatgcccaggtcaaggtatctactccctcctgttgaggtgtcatctctattaccattctcaatccccaccatgcattcatctcttcactcccaaaagatcttctaaaagttaagcagttaatacctctctctagaatttcagccactaggatatctttgctggttgcaaatatcaaataaattaccaaaactaactctcagtggccaccgctatactcacaatcgatttaccggataggtacaatcgatttttcagcacctatattcacagcatttactggacaggtataattcctatgatattttttcccacagttctgcatcatttactgggtacctcttgtcaaatcaagattgcacccatctggctggaacggacacctcacaggattggataatgtattgtgcagttgtacggtaccaacaaccaaccacaaagattgaaacgatatctatcctacatacattcctactgatagtagcagttcttccacaatctaacgcagcacgaaattggtcgatcttctctagttcttccacaacctaacgcagcaggaaattggtcgatcttctctagttgcaaacgagcaataatggtggccgacctcgtgcagcacccataatcgaacaggagtacagttaagctactacgcgtgcagctaaatgcagggcaggttgcatcccccaaatatatatatactccctccgttttaaaatgtttgacaccgttgactttttantntntgtttgaccattcgtcttattcaaaaaattcaagtaattatttattcttttcatatcattggattcattgttaaatatattttcatatacacatataggtttacatttgaataacacaaatgggcaaacatgtgctaaaaagtcaacggtgtcaaacattttgaaacggagggagtatttgtgttccccttcagtgctctgatttctaccggaatcttcagcttttgcggcgaaagggagatcaggagatctattcgacgagatgttatccccccaccacaaaacgtagaagagcagagacaaaaaggagtaggaagtcgagaccttaccacggggagagagagagagagagagagatcccccgccgccgcgcgtgtgaccatctccgtcgagaatggcggcgccgccggcggccgctcgccgccccgaggttccgtcgtcatctcgcccacgacgccaacgaacggtgcggcccaaatgaaacgcggaaaagaggccatcggcgccgacccgacccggcctggcccggcccatcttcccttccaggcgaattttctgcgctcgcggcccatgctttgttgcaggtaataagttcacttggtgacccttaaaagtgatcgaaatctaatccgtgaccctaaactagaaaaccggatatcttgacccctaaactattgaaaccggtgtaatttgattccctcggcggttttggaggacggtttcgctgacgtggcgcttgcgtggc

SEQ ID NO: 83560 - DNA, 14577 bp, Oryza sativa
ccgccgaggcctacctcgtcggcctcttcgaggacaccaacctctgcgccatccacgccaagcgcgtcaccatcatgcccaaggacatccagctcgcccgccgcatcaggggcgagagggcttgatgccgttattgttcgagttcatggcttgttagatctagaagtgttaattaacccatggatctgtgttatcctgtaatcactcgcttgaattgggttcgcattgatggaatacaatctgttcttggcaaactgtgggatttgtttgtctgtttcgtgggttgtttgatgctagtatctgaagatggtagctaggcaatacgtttctgtcagtctgcatgtcgatgggtatgcggatgatttgggaatcaaccaccctatatttcattttatttgtaggcttgcagtggagccatgaaatttcatgtgtttggtaatttttctctttgattgtcagatattgcaattttttttttcagattttccttttgaagtaaaacactatacgaaagaatcctacagtgtcatattaataaatatataatatttacaaagtacaatttacaccaaaggtgattacaagttctctagccattgtttaacttttgggaaataagattgtttcgccctttggataaccacggcaaattcttgtcttaaagagaaactgatctgaagaagagaatttatgtttctgaagattctattgttcctccagatccagatactccatgccattgttatgactatctccatatactcaattttttcagattgaatgcagaaaaaggaaaatgctttatactaccagtgtgttttgggtcaattcgatcgacacattcactgttaccaaatctgatactaactgataagcactgaggactgatatgttatgggcttttggatcaattcttgggcttgttcttccgcgaagggccaactggccatgtctgaactcacaatccaaaaggaagacaattattaggagtatcaattatcataaccatccaaaaaaagatcatacgagggaagacttgcagaaggtttcagagcaatgatcactgtccgtcaccaactacccttcatcaaattgtttcataaaaacaaagactagcagtggactggtaccaggttacagctttgggattgtcggcaaagccagttcatacttcgccatgcggctccgaccatgtactgcaatcacacaaacagcgagaaaaaagaatatgagcattaaacaaaggctaatgcaggtgtgagcctgcgccccacaattgctttcatctgcacgactgactttaatttccctccagtaatcaaatcagtgggaatatttacaaccagtactccatatctatctatacacgtacagtagttgatgaactaagatgaccatatataggttcagtcctagttcatgctcacactctctgctctgttgagttacccaatttgaatagagtaaacttatctctacagtaaaggattcagatatctcaaactgtagatgtaaaaacaaaatgatttgaagaactaagaatgaagaaacttttaagaggcacaggggtatggcctcctgaggctctaaaaggttcaggcaaggaccatgtgaagttacaaccgatgccacattttctagtaggcagtcaggatccctggaccagcattccattcattgcactcatgaccaatcggcaatcgccatgcgagtccggggtaaatgattgatcaatattccagcacaagaataatatttgtcggattctcgatcacctttgctctagacaacaacttcatccctttcccaatgaaaaaaaaagaagaagatcactgtacactagacaacaaaaatatgtcatgccttttccaataaaaaaagaacccatgccatcctgctcaattccctgataacatttgctacccctttttctcatgtgctcctcaccatttcctaacacctatttaagtgccccaagtggcaagaaacttaagtatccattccaacattgtggcagctccctctgaaatcccctcttccaatcatatccaccagctcacagtttgtgatccactatgactatcctccttgtcattcttgggcttcatctctgcagcctacacctccctgcaatctctgctgcagcagacacgctctctcccggccaatcgatcgccggcgacgacaggctcgtctccagcaacggcaagttcgcgctcggcttcttcaacaccggcagtaagtcctctggaaatgacactctcagctactggtacctaggcatatggttcaacaaagtcccaaacaaaacccatgtttggatagcaaacaggggtagcccggtcacagatgcaacctcatcacatctcacaatctcccccgatggcaacctcgccatcgtaagccgagccgatagctccatcgtttggtctagccaagccaacatcacaagcaacaacaccgttgccgtgctcttggacaccggaaaccttgtactacaaagctcctcaaactcatcacacattttgtgggagagtttcgaccatccgaccgatgttttcctccccagtgcgaagattggtctcaacaagatcaccggcctaaaccgccgtatcttttcgagaagggatctagtagaccaatccccaagtgtgtactctatggagtttggacccaagggtggttaccagttggtatggaactcatcggtagaatactggtctagcggcgaatggaacggccggtacttcagcaggataccggagatggtagtcaagtcaccccattataccccattcattttccaaatcgaatatgtgaacaatgatcaagaggtgtacttcacataccgcatacacgatgaaaccataccactgtacaccgtgctagaagtaactgggcaaagaaaggccttggcctggttaaatgacacacagggttggcaagcagtcttcacccatccaaatgatcagtgtgaagttgctgctacctgtgggcctttcacaatctgcaatgacaacacatttccatcttgtagctgcatggaaggcttctccatagaatcacctgacagctgggaactaggagacagaacaggtgggtgcaggaggaacattccattagattgtgttagcagcagaagtgacatcttcaacgctgtaccggccactagattgccctacaatgcccatgccgtagaatccgtcacgactgcgggcgaatgcgagagtatttgccttggcaagtgctcttgcacggcatattcatttggtaattacaatggttgctccatatggcatggtaaattggttaatgtgaaacaacaaactgatgacagcacctctgctaatggagaaacacttcacattcgccttgctgctagagagcttcaagctagaaaaagcaataaagggttagttgtaggggttgttgtatctgcaagcctctctgctttgggtatcttaacacttgtcttgctactgatcatgatcaggaggcacagaaagaagttgcactgtcaagcattgaacagcatttatgctggtactggagttataccattcagatatagtgatttgcaacgtgcaactaaaaatttttcggagcaaattggggcaggtggttttggttctgtgttcaaggggttgttaaacgggtcaaccgctatagcagtgaaaaggcttgtctcctattgtcaagtggagaagcaattcagggctgaggtgagttccattggagtcattcatcacaccaatttggtcaaactgattggtttctcttgcaagggtgatgagaggttgcttgtttacgaatacatgtcgaatggctcccttgatactcatttattcagaagcaataacagtgtaaccctgaattggagtactagatatcagatagctcttggagttgctcgaggactggcttacttgcacgagagttgtcgagattgcatcatacattgcgatatcaagccacaaaacatacttctcgatgatttgttcgttccaaaaattgctgactttggaatggcaaagcttctaggaagggattttagtcgggttatgactacagcaagaggaactattggatatctagcacctgaatggtttagcggagtggctgtcacgccaaaagttgatgtgtatgcttatggaatggtactcttggaaattatatctggaaagatgaactcgcatagagagtctaatagttatgctgatcacatcgtttgtttccctcttgaagttgcacataagcttcttgagggggatgttctaagcttggttgatggcaaattaaatggcgatgtcaatgtcgaggaggctgaaagagcttgcaagcttgcatgttggtgcattcaagagaatgaacttgaccggccgacaatgggtaaggtggtccaaattcttgaaggtctactcgaacttgatttgcccccgatgccaaggctacttcagtctatagtacagagctcatggaaaacagagacccaacactgatttgtaatgccaaaagaagtgctaggataaaataatgtctttccatggcttttttgtggcatatgttggtatgaagagagttttagcttgtaatgccttgtgtgctatgttgatgattttggacatgttgtgccataagatgttatatgctccgtttataaacacgcagttacaagtgtacacaatttgctttatttgttttgctatatataatgatgcgcatgaatgatgtgaaatatttttcggtcgacccggcaaataaatgatgtgaaatacatatttactctaggcctctagcttaataaaaaatattccgcagcaaacacagagccataagccttatcagccttgcatggagacaatgctagtttcagggacctttcagaattctggtattgtactaggaaatattactctcttgagtcataaatatactctgtttgtactaggaaactttcagagcatgtcatttgattttttttagcttttctcaagaaagaatgttgtaggttttaaaaatactactttgaccacaattttatactccctccgacccaaaataagtgcagttttacactattcatgaccaatatttgaccgttcgtcttatttgaaaattttaaatgagtattattttttttattattagatgataaaacatgaatagtactttatgtgtgactaattttttttattttttttcataattttcaaataagacggacagtgatcaaacgtttggacacagatattcacggctgtacttatttgggacggatgtagtaccatattacaaaagtttgtaattaaaatattgcaagtttatagtataatcttctaaggtaaatctacctataacattttttatgtttttaaactaagcactttttaaaaataaaagtttgcaatgttgatctaatcaatgataggcgatgtacccgtcgacaacaacaaggtgcccgtgatgacttcgtcaatctcagatatgctggcttagtttttcggagatacacatagagatagagtgtgcatgtatacgtttataggaggtgagtgtgtgtatgttgcgagcgtctgacgtttgtattgtgtttctcagaaaaaaaaaatatgccagctaaccaaaacactctaccgcgtaaaaattagagtgcatgtggctgccgttctccccggtcttgtagcgttcatgtgttccatgctttccatgatcgatacatcgattcaaactaagctagttagagatggtacggtttttgtcacgccctgaagttcccctcccttgctctaaattcataaaataaatcgtccgaagaaattgtttaatttaacctagagagaaaccctaaagtaataaatgcaaataataatcggaatcggcatgtggaatttttcttgggttctacatgtcaaaatacgctaacaggatttttagtggaattttcagagccttggaaataattttaaccaattaaaataagcaaagtgcaatattaaatccctgggaaaatccttttttcctttttatctttcctttttccccctctttttcctcctttgggccgccggcccatctctcccgccccctcccgaagtccaggtcgcctccccctcactccctcgggcgctgacaggtggggcccacctgtcagccctttccctaacctccggcagccgccaccatccgccgccgaaaccgccgcccacgccgccgcttcctccgccttccgcgtcccgggccacgtcgcccactttccccgcgcgccccgccctccccgcgcccacgccccactcccgctcaccccccgcgcccgcgagatggccgggattcaaatttgaatcccgcctctctctctctcctcctccacctcctccactactccggcgaaattgcgccgttcccggccacgactcgccgccccctctccccttatttaagcatcgccggcaccccctctctctttttccccatttcgccgacccctcccgtgctccccatcgtccccgcgccgtgcaaccacccaccgccgcttcttcccgctactccggccgccgctagccgtcgctaggctcgccgccgtcttgcgccgtcgccgccgttcgattcgcgtggccgagatccaccccgtccacccctcctccgtcgaagttcgtcgccggagccctcatcccctcgcgcacgggtgagcaccacctccaccgccgccgtcggccatggtttccgatcgccgtggtccatctccctctctctaacccctcccaaccttttctctaggtcctcccggagcccgtcgccgtcgtcctcccgtctctcatcgttgctgttcgccgtcgctcctccctcgcgccggccgagcccctcggtgaggatcggtctccctctcttcctctctctccctttgccgcgccgcccgccgcgtagcgtcgccgctagggtcgctcgcgccgccgcttcggccgccgccgccgtctttgcgccgtctgccgccgcctcccgtcgccggttgccgtcgctggcaaccgtgcgcgcgcgccgccgccctcgccataaccggccggccggcttgaagccgagccgagccaggccgccttcctcctttccccgtgaaccgccgcccggtgggccccgcttgccagccgcgcccctcccgccttgtgccactgcccggtgggtcccgcctgccagccgcccctctccctctcttagtgtcactgacccgtgggtcccgcatgtcggcgccgccccaccccttggatgacgtcagccctggggcaatattgcgcaataaattgattaagggtttttctttattagtaaaaacacagataatcttctaaaaatcataactaattcatccgagctccgattaagtccattcaagtctcagtaaattcataaaaatgtgtagaatccattaaaaatggctttgttatctgtttcagtagtcttatagcatgttttgcttgtgtgctttgtttgtcgcgtagatttcggccgtttcgtcgatccgtggtttctcgaagacgttgctgtggttccatcagtgcgagagcaaggcaagtcatacattgcaattgatcatattgtacctaatttacaaatgtcccgcatttctattaaatattgcattgttttaccatatcatgtgggatgggtcctattactcagctatatgttgtttcccttatgccattgataacttgggtattaaaatgactagatgttggtttaggagatgcttagccatgcttagttcaactagtgcacaaaaggggacaacattaaagcatagacttgattattggcaatagctttggattagtgccaccgcaatggtgttggctaattaaaatacattacctggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactggttagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccactgcaggagtcaagtcttcaggcttagctcgcttttctctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaagttggtatcagagccgaccttgaccgtaggacaagccaaatggaaaaacctaagagccctctgaatccttttcattgcatatattctttgcaattggatttgtttcgggaaaaatttggggttttgcctctttggtttgtgggaaaaatcttggtcgttcattcggatcggatccttaaaattagctcggtctagggttttagaaaaattttatttggagttatatttgatagtcagttgggaatttatcgggtgatatgcattaggtcgtgtctatgttcgatggggcaattttatgcgcatcattttccatgcaactagtttatgcattaagctatggtttagtcagtcgcattagtgtctttatccgggttcatgaaaaatgttctatgcataaaaatcatcatgctcggcaagttacttgagtcatttgttgctttatttaatttggttttgagcatgtgttggttcctatccctctgtactctttagatgtcagacctattctccgatcgcaagcgccgctccaagcttcagagtcgccgcccttagctttatcgtcttcttagtctgtttgcgtgctagtttttgtgtttaggtttgttgcttgtgggttagtcggcggtcgatatcatgtgtgagtggtatgacagcctttattaggagttgtgtgcctctttttcagtgttttaatcaagattaagataatggcacttaatcttataagaaagattagtttccgagccgtctgttttcttcctttctcttatttctacctatcctcctccagatggtgaagacaaggaatgatccccgtgactccaacgacgccagtggcagcgaagagcagaccgatggagctcatgtcagtggtgcatctggcagcagatcatctccaccgcccgaaaacccaacagtcactcaaatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaatgactggctccgtgctattgagaagaagctgaacctactgcaatgcaacgaccaagagaaagttgcttttgctacacaccagttgcaaggtcccgcttctgcctggtgggataactacgtggcgacccgtctagatgcaacggaggttacttgggcagagttttgtcaaagcttcaggaaggcacagattcctgaagggattatggcacaacagaagagagagttccgtgcgctccagcaaggaaccatgtcagttacagagtacttgcatgagttcaaccgccttgcgcgctacgctcccgaggacgtgcgcaccgatgctgagaagcaggagaagtttttgtttgggctcgatgatgaattgaccaaccaactaatctccggagtctatgaggactttgagaagcttgtggacaaggctatccgccaggatgagcaacgcaacaaaatggaccgaaaaagaaaggcagctcagatcagctttcctcaggggaacaatcagaagcctcgcttcatgacgggacagctaggtgggccttccaccctgatcgtctgtcagcaccgtccctatcacccgagtaacttcgacaacgactacaacggtggcagtcacaacaacagtaagcagcacaaccacaactcgactccacccccactaatggcaccagatcagtcagatccgccagctgtgtcagttcagtcagaacaacccaagaagggggctgtaggaaagccaggaccctgcttcaactgtggcaagcacggccactttgctggcaagtgtccgaagctgaatcgcactggacccaggttcatccaggcccgcgccaatcatgtgtctgcagaggaagcacaggcagcaccagaggtcgtgttgggcacgtttccagtgaactcatatccagcaacagttctctttgattcaggtgcctcgcattctttcatttccaaaagatttgctgggacacatggattatcggtagtggaacttaaaataccgatgcaggttcatacccttggaaatgatatgaggacagcacactactgcccctcggtgactatagagatcaaaagatcaccgtttctatccaacctcatccttctcgaatctaaagacctggatgtcattcttggaatggattggttgaccagaaacaagggagtgattgactgcgcaagccgcaccatcaccctaaccaacgacaaaggggagaagatcaccttccgttccccagcgtcgcagaagtccgtagcgagtctgaatcaggctgctattgagggtcagacagaaacagtggagaaaagtcccaggaagttggaggatattcctatagtacaagagtatcctgaggtgttcccagaagacctcactacaatgccaccgaagagagaaatcgagttccggatcgatttggcacccgggactgctccaatttacaagaggccgtacagaatggcagctaatgagttagcagaggtcaagaagcaggttgacgaacagctgcagaaagggtacatccgaccgagtacttcaccttggggtgctccggttatctttgtggagaagaaagacaagaccaagaggatgtgcgtggattatcgcgcccttaatgaggtcacaatcaagaacaaatatccgttgccaagaattgatgacctgtttgatcagctaaaaggagctaaggtgttttccaagatagacctacgatcaggctatcatcagttgagaattcgggaagaggatattcccaagacagccttcaccactcggtatgggttgtttgagtgcacggttatgtcctttggactcatcaatgcaccggctttcttcatgaacttgatgaacaaagtgtttatggagtttcttgacaagtttgtcgtggtattcattgacgacatacttgtgtattcaaaatcagaagaggaacatgagcaacatcttcgtctggtacttgagaaattgaaggagcaccagttatatgccaagtttagcaagtgtgacttctggttatcggaggtcaaatttctgggtcacgtcatttctgctcaaggcgtggcagtggacccatcaaatgtggaatcagttacaaagtggaccccaccaaagacagtttctcagatccggagttttcttggacttgcgggttattaccgtcggttcatcgaaaatttctccaagattgccaggcccatgacacagttgctaaagaaagatgaaaaattcaagtggtcagctgagtgcaaccaaagttttgaagaactcaagaagaagttagtctccgcaccagttctaattctgccagatcagacgaaagacttccaggtctactgtgatgcatctcgccaaggattgggatgtgtgttgatgcaagaaggtagagtggtcgcatatgcttcgcgacagttgcgcccacacgagaccaattatcccactcatgaccttgagttggcagcagtggttcatgctctgaaaatctggcggcactatcttattggcaaccgctgtgaagtatacactgatcacaagagtctgaagtacatcttcactcagcctgacttgaatctccgacagcgaagatggctggagttaattaaagattatgacatggggatacattatcatcccggcaaagcaaatgtggtagcagatgctttgagcagaaaaagctattgcaatgccttatgcactgaagacatgtgtggcaaattgcaacaagatcttgagcacctaaatttgggcatcgtggaacacgggtacgtagctgccctagaggcacggcctacgctcgtggatcaagtcagagcagctcaagtaaatgatcctgaaatagctgagctgaaaaagaatatgagggttggaaaagctcgagatttccatgaggatgagaatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggtcagcatgaggagagaaatagctgaattcgtcgcactctgcgatgtttgccaacgggtgaaggcagagcaccaaagaccagcaggtttactccaacctcttcaaatcccggaatggaaatgggaggagattggaatggactttataacaggactgccccggacatcatcgggtcacgattcaatctgggtagtcgtggatcgactcactaaggttgctcacttcataccagtacataccacgtatacgggcaaaaggttggcggagctctacctctcgagaatcatgtgtctgcatggggtacctaagaagatagtatctgatcgagggagtcagttcacttcaaagttctggcagaaactgcaagaagaattggggactcgtttgaatttcagcacggcttatcatccgcaaacagatggtcagaccgagcgagtaaatcaaatcttggaagatatgttgagagcctgtgcgcttgactttggcggagcctgggataaaagtctgccttatgcggaattctcttacaacaatagttatcagtccagtttgcaaatggcaccgtttgaagcattgtacggacgaaagtgccgcacaccacttttctgggatcaaacaggtgagcgccaactgtttgggacagaagtgttaaccgaagcagaggagaaagttaggactgtcagagaaaggctaagaattgcgcaatctcgacagaagagttatgctgacaaccgccgaagagagcttactttcgaagcaggggattatgtgtaccttcgtgtcactccgcttcggggagtacaccgcttccaaaccaaaggcaagttggcaccacgctttgtgggaccatacaggatcttggaacgcagaggtgaagtcgcttaccagcttgagctcccatctaatatggttggtatccacgatgtgtttcatgtatctcaattgaagaagtgtttgagggtacctgaggaacaagctagctcagagcacattgacatccaggaagatctgacttatgtggagaagccgatttgtatcctcgagaccagtgagagaaggaccagaaacaaggtgatcaagttttgcaaagttcagtggagccaccactcggaagaagaagccacctgggaaagagaagatgaattgaaggccgcccatccgcacctcttcgccagctcttctgaatctcggggtcgagattctgtttaaggggggtaggtttgtcacgccctgaagttcccctcccttgctctaaattcataaaataaatcgtccgaagaaattgtttaatttaacctagagagaaaccctaaagtaataaatgcaaataataatcggaatcggcatgtggaatttttcttgggttctacatgtcaaaatacgctaacaggatttttagtggaattttcagagccttggaaataattttaaccaattaaaataagcaaagtgcaatattaaatccctgggaaaatccttttttcctttttatctttcctttttccccctctttttcctcctttgggccggcgggccatctcttcccgccccttccgaagt

SEQ ID NO: 83561 - DNA, 51968 bp, Oryza sativa
gggagcgccagccaatatggcgcactccccctagccacctcagcatcaccccgccacgtcggtggtgggacggcgccagcctctttggcgccgtcctgttgaacgacggcgccagccactctggcgccccaaaaaggaccatttttgggataagtttttctagggatctacttgcgaaataagtttttcaaaaggaccaaaatgtgaaaaatccagccgcattcatgcagacggctggcgagttcgagctcgccgggtctcttgccaccctcctcttcttctccgctgccacgaaccaccagagcccctcgtcgtcaacctcccagtcgtctcccactgtcactgctgcctccagcggacgggctcgccagccaccgcccctttccctgccagctagctcccggggaagagaggggataagtggaagtccacttacatgtggcccctacatgtattttttttctaactagaatgccacgtcagcaaaaacgaccatccatactgtcttacaccgttattcaacccagttttgcaaaacatcagggttcgaaatttctagtatcgcggtttgaggatacgattcaaaacgttaacatgagggacctaaagggaacttattcttccccgacaattataccggctctcatgggcctacatgagtcgccaggtggtgtagttgggcctgcattgagtggttgagccgcgaaaggaagcccataccaatggtagcgcgcgaaccaattatacgggctttgttgggcctgcaatagcggaattaatccagctcagtgacgtctctttcttctccgggattgatcgccggcaaattaaacctcgatctagcggtgagctagcgccatggggcatgataatggtcgcagaggtgaagtcaaaatgggtgtgcctctcattcaacgatcaacttcagatctagactcaaccaaaccccttaatttgaagccacatagcatgcaaaacaagagatcagtattaggaggcacatacgcgtggcgtgatctagcaaagtgtgttgatctctcttgttctctttgtgaagcaagggcatatgagtgcctctgctgcccacgcttagttctctcaaaataaaccgtcgcaagtttttttctaaaagctttgaaatgtacctataatataattttagttcaactacaatataattgtactatggtggtgtttgaatctcctgaagatgaagatgaagattaagtgtttcacgtaaaacgaggtggtaataatgtgtgattaattaagttttaattattacaaacttgaaaaacggattgatttgatagtttagaacaactttcatatagaaagtttttgcacgaaacgtaccgtttagcagtttgaaaagcgtgccacgagtatccaaaatttaatccaaaagttgttggagaaaagaacatggcctatatataactataccataacctctaaataatttatgtatgaagttacaggtatttttttttgatacttgtatataaattagataaaagttatttataatgtgattataatatagttatatagtgtaattacagtacaattacattataattatattgaatttttttaataaaaaactcgtatagtccctaaataaatcgtcgagggttgtcaaaaacacacttaaatctttcttgtttaatcagtgatggagccagaaagttttttaaactagtatttgcttatttgctatagaaattttatcatcaatttactgtaaatatattgaaatttaatgaagttttcgtcggtgagcctgggcggtggctccgccgctgtgtttaataaagaacgatgtgcaacaaaatctcatataaccatggatattcggatgacaaaaaccgggccgaagagtagtcatattcatccgtccacgatcgatccattcgatcgatctttcgtttttggtgtctttgctattatctagcggtgaccgcgatcttcatcatgcccttgtcgcagtcgcccgggaagccggagacgaagaaggtgacgccggggggcagcgcgacgcggtcgtcgccggagccgtacgccgtcgcgttggccggcgccctgcacagcgcgtagtccacgtcgcccaccaccaccacgttgtgcgcgctcgcgtcgtagctgaacactgcgttttacacgcacgccgcccgccgccgccgccgccgcgggcgccattagcaccggccatgacggatcagtttcagtaaaaagaagaagaagaagaagaagaagaagaagaagaagacagatgaagcaagcagagggagagcaagctaagctagctagacatggatggagcaattagctaccgagcacgtcgcccgccttgaagggcttgtagttgggccacccgacgacgccggggctccagccggcaccgtcgccgacgggccactccctccgcgccgccgccggttcgacgccgcattgcagcgccaggatgacaaggagcaggagcaggccgaggtgaacggagcagatggccttatcgccgccgcggccgccgcgtgccagcgccattggagcaggagtagtctcgagcgaagaacgcggaagagcttaaggctataggcctcggtaaaagtccttgggtcaaaggctctccttttgtggcaacaacaggcctcctaccattcttgctctctccattttataatataagatataatttttttctagatattttataatataaaacgtccatacatactatatagaattagctagcacatcctccttattgaaatataattaactagtacattctctaattttattgggtacatatattgtatttattagagtgatttaagctaggaggtgatagtaattgttttttaatgtttggattaaggataattatacactatattttgaaacggagggataataatttaaactcttaggcaaaacaagggataagtgttagcaggtattaattcttggcttcttgcctttgtgattgctcattgctcatcatcaacaccgggttcacattctctaccataatgatactatcattatagatactaacgtgtgggacaatagaagggtagaatccatatgtcaatgattgtaatggtagtaccaccacaaaaatgactctggtcctactctcattccaaggctttcttcgtgacgcttctagcatgagaggaaaacctgatattcttagagtgtcatttattttagaacaaattttgaattttaagattgtacttattttgaggtggtgtgagtatatattttgtaaaccaaacaacatttcacattgatttgtgaatgtattcagagctttaaatgcacaacggtttatacaagaattgttgaaaagtattttaatagaattcttgattttttagtgcgtgggttccatgtgcccacttactagtatatatggagtgcgttcatttcacttcaaactatatgtaaatatcattctcttgatccgttacaacttacaagcatacaaaattaatcatcttgaccaacttccttcctaattggtcgaaatgcatatatatatatagggcaggaaatcttttttctgccgtgaggactaatttcactacttgatgcatatgaattcattttttcttttaatccacggtcgagtgcgacgtccttcaccggcgagcatgcgttgcgtatagcttgttaattattgttacgacattactagacagtttgcatctgtacattagtggtttcttgatcatcatggccgtgttgttgttgcagcacaggcacagcttccttggctggatgagatgatgatgatgatggtgatgcctccttactctttccccagagaacgaaatacaggcccatgataaccaaagcagaacctatcacactgcacatatatagctagtgtcaaataaaacatgatcaatatgatgacaatagtaattactcactccatttcagattataagtcgttttaactttgtaatattactctatttatctaaaacttggtcaaactttaaatagtttgactttaacaaaagtcaaaacgacttgtaatctgaaacggagggagtaattaaacatgacaaatacacataactataacgtactaactccgttttaaaatataatgatttttagaattcaaattttataccataatataaggattcgatcatacacttattgtcatgattccaaagccaatcacatgcttgcaaagggaatataagtaattcaaaatttaagaattgacaactgaaatgactaaaagagaattttaaacaagctaaaaaaatattatatttttaaaacggagagagtacttacgttccaaggtgaagttgctcacggagaacgatgacgttgatagcagctgcaatgatctggattagaggcgtgaatgcagtcgtgaacaccggccctctctgctccacacaccatgacattgccaagaaccctattcctgacccaactatcccctgcatatatagatatcaattcatccatccatcagttgcaattaattaataacaattgttctaattaattaattaaggtatggtacgttaaaacgcactaagaatgcgcaataactaaaacatgctccttacatagtaaaatttttactgcgagttatatcgttctcagatatcatattcttcctccgtttaaggttataagtcgttttgactttggtcaaagtcaaattgcttcaagtttgaccaagtttgtagaaaaaaatagtatcaacccgagacaaatttattttgaaaatatatttaattaactaatttggtattgtaaatattactatatttgcgtataaacttagtcaaacttgaagtagtttgactttgaccaaaatcaaaacaatttataatatgaaacggatggagtagtaaacattttactactaggctcaataagagtatccgacaaatttgactactaagctcaataagagtatccgacaaatttgactactaagctcaataagagtatgacaatgattgctctcgcagttaaaattatacaatgttaagtttgttttagctatattgcaatataggtgtagtatagcacggagtatatctatagtcacgtaccacaaagagcacggtgatgatctgaagcttggtccttaagatccatgggggcaagctaaccctgtcgatggccaaggcgaccacggccatctggaggaagctgaggaagaacatcagggccgtccccgagtagagagccgggtacttcctggcgatcctcgactgcaggatgaaccacagcgaccagcaggccgacccacccagcaacgccaccgacccgatcgcccatctgtgcgcgccgccgacatgaccggcggcgatcaccgccgccgatgccatcggagaggaagaagatgatgatgaagaagatgaagatgatagcttggtgagcgatgggccctggtagagagcaaggaccattgctccgctgaatcctaacaccgtgcctcccactttagctatgccagctatgttcaggttaactttctccagcctgcacatatttcaatcttaaatttgattagaaattttaagtatctcaagatatttaaattttacactattttttttatctcgggatacttagtaccgaagatactaaaatctaagtaattttatcatttttgaaaaaaatattagaaaatagcatattttctagtgtaaaatttaatacatatacttaagcaccgtaaattttctatcaaaatttacactagaaaattcggtacctatcgataccttctcaaatatggtaaaattaccctaatttgttcttctatactcatttcatattttcatgcataccaattaaaaagtcctgttttccatgcagatgtatgtatgttttgagttagttaattattatatattctagctagggggaaattaatgaatgaatgaatgaattgtaattacccataaggcagagctacaaggaaggtgaagatgggagtcatgttgatgaaggcgcaggcgaatgttgcggtggtgtactgcagccccaggaagaagagccactgggtaagggacgctctgcacgcaggtacacatttgatttaatcaattcatcatttgttagtgcatatatatacacatataatgatctttcatcacgttaattaaactatctatgtagtgtatatatgaaaaatgacttgcccgagcaccgcactgaagaagagatacaccaagatttcagctgttagctttggtcttgtcttcctgcatccattccatgcagcacaatatatatcagttaattccttaaaacatacatctatatgttactatatatacagctacaatatatacaataacaattgtcgctaattaatctatcaattggcatgctaatatatactgatcgcgaattggtgaagaactgaatcgatcagaaattcagaatgcagatatgctatatacctctcccggaagtaggcgatcggggcgaggaagagggtggcgatgagctgacgaagcgtgatgaggacggtggcgtgcatcccctcgttcagggccatcttgatgagggtgttcatcaccgcgaacaccaccacaaccccaaccattgtcaatgttggcttccaactattgcagctacccatatcgattcaggatcgatcgatctctatctagctgatcaatggctagctagctacaaagctaatctgaaatatgtgtgtttgtgtgtatatatatatgtggttgttaattgctttggcactgctaagtatattggcatcaaggatgctgcaggtggcaagaatttatatgcatgcctgccctggcctccaagtgatgacaatctgacaatattccgttccttgcttaattacatgtatcacgcggtacgggcgtatttgccctttgctttaattaggtgcactcaagaatgatgccaataaggtatggtacgaacaaatgtattagttattaattagctttactttaattcctacaccactcaagatgaacaatttataattaattatcacctgcatgaccaaaatattttttttaaaaaaagctgaagaatttgttcatcaactttatgcaagcattttttttaaaaaaaaagaggaaagagaggtttggattctttggctagcttggaaaaggtacgcgttagattacatatataattaacaaggagtaatgatcctaatatatgtatgtgtcaaagacactgatgaggagagatcttccaaattaacacagttgttagtatatgcaaattaatccggcctgttcttaattttctcctgccttagatcgatcatatctatctaatactctagcagtggttaattttgtcctgcagctttaatttgatcacagggagagggatgctagctgtagatatatatatttatcaaaggccgacagcatatgtacagggagattgaaaggaaaagagatgctttctttggtgcgtcatccgtcgttggtcagcaaggtgacttgaggggaagggaaaaaaagagttaaaggtcatatagacttaatagtatatgctccaacaaggaaaagaatgatcgttaaaaaaagaaaaaaaatatgtacacctcaaattgacacaaatatatagtccctccgcttcatattataaatcgttttgacctttttctaagtcaaattttatagaaaaaattagcacaatcttaaacatcaaatagatgtttgttttgtgttaaaagtactactatatttttttaaaagtttgattaggaaaataattaaacgacttataatataaaacaaaaggaagtagcaaactatataaatcagataccatgcatgcatatatagctgggccagctcttttctcttcagggcatccaatgctcctccattgttgaacaagtattgatcatttagaacattcaatgctcgcatgaaagaattgatgtgccattttttttgccagattgaacacatgggccggccgggcgacccctaacaattctgtttacgttagtcatcttcatggcatcttagaccgttcttccctcgatgttcccaacctcactactctcattttttatgtgctctacccaactgctaaaagatacgtttctttaacaagtgtctatacaaaagttttattttttttcaaaaacatgcaaaaagatcgcatgccaatatattaaaacgagagtttagttacacactgtatataaaaggtgctataatttttaaaattttttaaagctaatacttaattattcttgtgataattcatcgatttttttacatgcgaagagaaagggttttcaatgcctccaaaagaacacggtctttaaagaaagagaaaatcccctatatacctatgaaagttcacataatcccttctatacccctgaattttgctcaatcctttatatacccctgaattttagtttggatccctttcatgccctttccgttagttgaccgttaaattcttttgaaaaagtccattttgccctttgctatgaagaaacataataaattaatgaagtatattgttggaatgtaaaaatttattggatgagactattatatttatgagtatgtgatgcaccatattatttgtgacaaatttagttttacatatgatataaaaagttgatacttatttattagttattaaaagttcttttatgtagcatatgtgttttcaaagtaatacaacagatttgtttattacttcagaacacatatgctaaaaaaatcttttaataactaataaataattattaattttttatatcatatctaaaagtatatttatcgcaaataatatggtgcaaaactatctcataaacataatagtctcatataacaaatttctatgctccaacaatatactctattaatttatatgcttctttataccaaaggacaaaatggacttgttcataagaatttaacggtcaactaacggtcaactagcggaaaggacatagattggatccaaactaaaattcaagggtatgtaagggattgagcaaaatttagaaatacagaaggaattaggtgaactttcaaggatacataggggattttctcttagagaaaccgagtgtaatattactctaatattattattttcttctgcttgaattcttccttttgctggcgaaaggaaccgtgtgtcacacgctggcacttcgtgtcggccatatatatttagcctcacatgtgcagcattagtgtgcattaatatgctgatttgtatgcccctgtcatatgtaagagtatatgctaaccgaccaggcatcatatcagaaacagtaaatattcaacctttacgtacgtgcgctgaataatttctctgcttttgcttgctctttttttctaggaacaatactgttatgatgtttcattaattaagcaatattaataatattccttcttttctgaaaaaaaaggttgcacgtatatgaatggaggggccctcgcatcataatttaaagaaaatacctctgaaacttcacccaatccctcccatgctcctgagatttacttatttccttccatacccctaaattttagtttggatctcttctatacccctttcattagttgacctttagttgaccattaagtttctatcacaaagtccaatttgccctttggtatcaagaaaatataaatttatgaagtatattgatgaagtgaataaatttatggtatgcgaatatttgcaatgtacgatcagggatatgaatcaaggaatgaccaatatgctcaattttcatacctgcaccatttgcagtgtggaagttcccttgtatttctccttagtcgtcagcttgtccaactcacttgtgagatggtcagttgccccagtgtgtatataccaattggtatcaacaccgtaggcatacgcagcagccgccacatgcctctcatccggcacataatttgcatcaaacctgtgccagcattcagcagcaacatggcctcttttgtagcatacctgacacacgggacgggtatcaacacactgctgctggttgccacctcgccctcgatttgctcgcatgttgccgcggccacggctaccaccatcaccgcgaccacgtcctgagttgctcccgccagcagcgctggtactgccaccacggggagcaaagttgctgcggcctccactgccacgaagtgctgcatttgccgatccttgttgcctcaagtgcagcatgttctcaaaattaagtagttgtgcatataattctgtcatggagatgggttcaaccctcatcccaagagcagaaacaaaggaatcataatcgccatctaggccatttacaatatatgcaatcatatcttcctcatctagaggtttcccggtagatgcaatctcatcactataagccttcatcttcccaaaatattcagagattgtcattgtacctttacttgtagtttggagcgccagccgcacattcaatgtgcgagcacgggtctgcgatccgaacatatcaccgatcgccttccatgccagcgccgcagaccttgctcctgccacttggttgagtatatcacgtgacagggaggagaggaggaagccaagcacctgctgatcagctgcaaaccactcctcgaaggccggattatccaccattactgtcttctcccccttttcgccttccttccgctcgatctgagctgccggcgccatggttttgccggtgaggtagccctccagtcatgccccgcgaacggccgccaggatctgtgccgtccaaatggcatgattttgtttggtgagcttttcagaaacatggacgccgaagagagggttgccggtggaggtggaggatgaagaggaagccatgacaatctatgccaataggctctgataccatgaaagaaaactaatatggagtaacgttatcggtgcggagaaaattgacatttagccactttcaaggatgggtttcgctgtaatgccattccgccaacttgcttcgctaaaatgccattcccacgctcgcgcaacacgctgcttcgccgtttttccaatttcaccggattaacacacaaaatcaggagtgttgtgaccaatgtgcccttgggtcattctttaggtcagtgagagaaaggggatcgagatgcgttggctcttgctcacggcggcgccctagatcgatctcgtcggcatcgccattccacccgccgccgcagtcacctctcgccctcacccagctgtagctcacggcggcgctgccatcgccattccacccgccgccgccgccgccgtcgccgccgtcgcagtcccaatctcgcgctcaccaatacttcaatcaaatttatcagcttatcaatctttccatcatcaactgaactccacttcatctctatagaaccatcaaccactgcaacatcacttggaccttcatcaacaacatgctcactcattccttcaaccatcttcctataactttcgatccacttgaaaaacttgcaacaatttggcacctatacatacatcagtacaaaattagccccaataaccaaaagcaagcaaatgcaacaaattcaaccactcacatcttgttcgttttcctcgcatttgaagaaaacctttccaccatgcctcatcgatctgcactctactactgcagcgccacacctagggcaacgaatgagaggaaggccgctagatcctacgggtagccgagcaggaaaggagctaccttgcgacatcccgaaatcctcgcttccagctgcataccttcgctgcatagcccccctagggttagggtttcctctcatctccgcaaatcagcgccggcgaaagtggcacagcggcggtggagcaaagcggcacagcggcggcggcagataagagcggcacggcggcggcggcgaagtagagcggcagcgttgtggcggagtagagtggcggcggcggagcaaagcggcacagcgcggcggcggagtagatcggcagagcggcgacggtgtagagcggcagcgtggcggcgcttgctgcttcatttggcacaaaaggacccccaggggcaatttggtcagcagacaactcacttacgggattaatccagtgaaattggaaaaacggcgaagcagcgtgttgcgcgagcgtgggaatggcattttagcgaagcaagttggcggaatggcattacagcgaaacccgtccttgaaagtggctaaatgtcaattttctcgtcggtgcgacggttcgtgttaattgtatcgtagcaaaacggcgaggaggagaagtacatatatgtatgcgtcagagattggttagccgggatcctatttacatgtaatcaaaacaaccttagctaaactaccggccacctaatctccaactcatatggtttacaatggataagcacatactctaacaggcggtagccatgaacgccagccctacacaagaacgctctgagcaaaacacaagaacacaaataaaaaagactacaagaatatggattctaatctcttggtggacgtccacccgttttttcgtgtcaactaaatggttatgaatttttttaaaaaaaattaacaagatagattaatatgtaatatatcactttacaaatatgtaagttcatatttgacttctacaagttgtaacaaaaaacttttttttaagttgtaacaaatatgttacaagaaacgggtggacgttcacccaagtgtttaaaacagtttccccatcttgctataatacttcacaatcggtgataatccttgttcttgttgatgcttctagttttgcaatcaccaacaattttttttttgttctggtccactgtcctcacaagttcagctgctagagaggccggtcagtcattttggtaattttaggcaggaaacaactgcataaccagcattggaatccatcaacacattggtgattttggtaattttaggcaggaaacaactgcataaccagcattggaatccatcaacacattggtgatctagtacactctgttgacacaccatgcatccaatcaaagtgatgagtatatctgtgttccttcctttacaatattgcttgcactggatctttcacagccacaggagccatctgtttctgcagaaccagatcgaaggggacaaaaaactatctgaatttccagctcaatccacagatcctagaaaacagacggccaaataaaactgaacaccatttgtcagcattttggtaaaggctctgaacttttcaggtgtaatgcaattcatggaaaggaaaccagaaaatgtccgtagttttgagtgaagcgaggaggaaggaacagagatgtgaagaacactccaccgacaatctgtgtacattttccattcgggtgccaatatatacagaactcctccattgatcatcttgctggtggcttaattaatatacgcaagcacgatcaatgcctcctgtcaacgcgggcacggcggcgccggactccggcaccggcagcattgccgcgaacgacggcgacggcgacctgcacggcgagcagagcaagctggtcgcgatctccgacgaggcgccaaacgtcgacagggcgctcgccaccagccgcccggcgaccgccgacggcgcaggcggcggggacgacgtctcgccgagactgcggcggcgtcagcggcggcggctgctggagatcaagaaacgtggtctggaggtcgaggagcagacgctggcgctggagcagcggcggctgaggtgggccgccgcggacgccgaggcgcgcagggaggaggacgcggagctggagaagatgcgggtggagaacggcgtggcgagggcggagaacgcgcggctgtggaggcggctgctccggcggcggcgggaacgggagctcggcgtcggcggcgtcaggtcgaacaagtgtcgcgacggcgctgcagcaatggaaggagaagagaaatctgtaccgtagtgtcatatgtttcttttctcaatttttttctttttcttttttctctgaattctagaaaaaaattgttgatgttttttttctcctcgaattcctaaaaaaaacaggtttaaccatcaccattataataaaatttgataactaaaaaaaagtactcctaaatctatgtcagaatttgatatatccatattcatttaccctacttaaaaattggtagtaccgaaattcattaaggccttgttcggtttagaggggatttattccacaccacaggtgtggaattattcccctccaatccctctctcacagagattaaactggacaaggcctattggaaattaaacatgccatgtagctatagagtaactctgggtgaaataattatacaagcttgaatgtgcaatgatgctttataaatgctactacctccttgtacaaatgtatgacgaaccaacgtcaaacgtaaaaaaatggagggagtatttacttatgttgtttatatgtattctcttgtggaatctcttagcatgtaggttcaatgtttccttcttcttagggatattgtttcccactttgtactttgtatgtagtttgtttgtgtgaactactccttaaaccataaccaattttaaattttaagttcaattttataattaattttgttcattgcttcatcaatcaatcttttttttgatccctaagagtaatataagtacaaaagtttgtactgaattatggtcggaggagataactgacctttagggacatacatgaaaatcattggtacagctacacgaaggcctttttaaaaaagttttaagcccatggatcatctgctaccatatggagtatttttcaggacacattccgtgtagtttattcggcccagattccaccaaatctcttattaatggtgcaaagttaaaaataaaacatttgctcacaatcataaaagtaaaaaggaaaaaatagacaacatgattataagccataatcatatgagaataagtataatgtctacgaaacactcttcccaccttcaactagtattacgtgcttggttcctagagcttgctagaagtaacaattgcgccaacgtcaaccgcccacccaaaataagccagaaaagaagcccgcccacccaaaataagccagaaaagaagcactcatattttgtggtcacgacaagaggtgtccacctgtcgacctagctacttctaaatgatcgccatcaaccttatatcgtaacaagttcaataacttgctacgtaaccccaccccctcccatctagatgaaaggggctcaataccgaagacctagaactccggtgaaccaatcaccgtttgttactaatccacaatcattgaggagagggagtggacctatgacgttgaccagatccaatctcactttgacttgccataaggagtaagccatataatagagaatcctccaagaagccttggaccctcggtttggaatagttctccctcacagttctcctcatgcgccattgtccgacagttgaatagagaacacactagctggatatcacaaagttgtcacgattcttcctttttacccctacgagttaatttatattacaataaaacttgtgaaattcagcctcttgttataggtggaattcgtttatacctcgcgtacatcgtgcttctaaaattctcaccaattaattactacattcgtcatccgttatattttgagacggagaaagtaaattttttaatgtaatccttgtatctctgtaacctttgttcttagcacagctaattttgtccgttagctctgtgtacattttttttagaggaagctctgtgtacagttggtttcttgcctacccgtttttttccaggccgtacgtgaaagttgcaactcatctatatatcctccatttgcacgcaaaaagcatacatactcgcacacggttcctctttcgtcctccactagtagcattttctatttatgatcgagtgaattcatccacagataggactttctcttttgtctctagccttagctaaaagtctaaagagcctcatcttttcgtttatgcttatacttatttactaaaatttaaattttcaaccttaaatttaaagatgattttgggcattttctatttatgatcgagtgaattcatccacagataggactttctcttttgtctctagccttagctaaaagtctaagagcctcatcttttcgtttatgcttatacttatttactaaaatttaaattttcaaccttaaatttaaagatgattttgggttctttcatcgaagtttatttttcagcctttatttttagatcgctaagacatatataaaaattttattcacaaattatttttcgtttacaaatatgtcgtttgggggtgtaagatcgatcgagtagttttttttaaaaaaacaaaaaacttgagtaagctagctaggcaggtggatgttgtattgtaccggtgtttggtgcctgacgatttaatgcgaaagctagcaagacgaccaatccttccaccctgcttttgtcgccatggatgatggtactacttagatgacgatcactgatattttgtcccagctcaaattttctacgtgctctattcacggatattgtttatgtcttatgtctatcacgccatggatggagtacgagtaccagatattgtttgtctagtactgattatagtttctagccatgcattgtttatcatcttcaggccccaattgatttttacgaaagacataaaaatttaaaggattttaatcgtttagaaagaaactacaataaagatctttgaaacaaaataactgaatcatatcatttcctttataactcctatgaaatagataatcctacgaatattttgaaacaaagttagcaaaaacttcaatctcttcaaagatacccctccgtttcaaaatgtttgacaccgttgacttttcagtacgtgtttgaccattcgtcttattcaaaaaatttaagtaattatttattcctttcatatcatttgattcattgttaaatatactttcacgtacacatatagttttatatatttcacaatttttttttaataagacgaacggtcaaacatgtgcttaaaaagtcaatggtgtcaaatattttgaaacggagggagtattcattttagtctttttctctcacccgatttttgtttttcttttacctaatcagactataattcttatgtttttctgtgttgtagataatcctacaaatattttgaaagaacgttagcgaaaacttctatcttttaaaaaaatatttattttagtctatttctatcactcgatttctgtttttcttttacctaatgagactataattcttatgtttttctgtgtttgtacatttatattcatgtgtttttttgtttaaaagagcacttagttttgtagctacagtaacatgcattctcccattaaatgttggccggtcaccaaaacggaatcgagcttcatgccataagaaggaagccggccggaagcgtagtaaatgtgtacgtgcatccatggacttcacctgtagtgctagagcgtacggtgagaaaaaccgggtgagatgttttttttttttgcgatgaacagggatatattactcatgctcagcacccaacaggtgagtgataaaattataagccagaaagtggttagagcctcgctacgccctttataagccagggcatggctgacactattttggttacggtgaatcttcatgataacaatatctctattcccagccatgaggtgccaatatccctattcccaaccatgaggtgctttatctccctagctaggaaaactagctctgatcgttcctcctcctttgactggatgagttgaattgcctgtaagcagtcagattctatgatgagatggtaacagcggcgaatctagaaattttaatttgtaagcctgagcaagcctaagaagatataatcatgtatttccccgcaaaaaaaatataatcatgcatataaaatccacacaactacatatagatagggttatatcgattaatatatatagtatgggagacttaggctgtgtttgagaaaggagagatagagaagattgggaagatacgcaaaacgaggtgagctattagtgcatgattaattgagtattaattatttcaaatttcaaaaatggactaatatgatttttttaaagcaactttcctatagaaattttttacaaaaaacacaccgtttaatagtttgggaagcatgcacgcggaaaacgatgtgtaatctatctccagtctcccagaacgaacgctgccttaatatattgttgcgttagcctctaatcactttgctaattgctttattaatcaagcagggtacgtgctagtacagagggcggagcccgggcaagtgcccgtacgtggttccacttccgcccctggatgtacacttgtacgtgcagaaagctggctgcccatgcgtaagattgctcatctccgctagctttggctaatcgcccccacacgcgcgcgcccccgcccgcgccgaagccacaagaaacgtgtttgcatgcaaggccaggccaggccaagcgaggccgcgcgcgcgcatcagctcgcgacgcgagccacctgtgccgctgtgcgcgcgcgccgcctggcgccacgcacgccatgcacgcgcgcgtggggtggaagggtgaactggagaggagagcggcgtcgcactcgtgaaaaccgaaacggagacgagacgggacgtacggcttggctttgcctactactgctgctgctgctctgctctctcctctctctcgtgagcaagcgtagtagcctcgctctctctcgcagccgcgcgcttggtgggagggggggattggggatgatggggagcgagtcggggagggcggtggcggcgatggtgtcgctgcagctgctcttctcggcgctgcaggtcttcatcaagctggcgctcaacgacggcatggacgcccgcgtcctcgtcgcctaccgcttcatgttcgccgccaccttcctctgccccatcgccttcctccgagagaggtcaggtcacatcccatatactactatgcccccactgtcctaacctgctttcttgctcttgttcttctgggggaaaaaagctcgaattaataccggaatgcatgtgcatgctctgtagtgtatctgtgtatacttgatgattgttagtatttgataatctcatgtctcacatgattattagtgctttcgtttacttgatcgatgatcatgggcttattgaagtttagttacagtgcacttgacgtctcagagtagactaagcttggttaacgatcaagggtttttttaagttttcttctttcttgttcataaatgtatttttctttcttctttatgtactattagttacgtgcatgtagttccaaataaaagggctagctcttagacgtttctcaactagatcgatctggccttgctgaaaaaccaagcgaactaagattttatctgaagtttggtgaattgatctctccatgtaaatatccaatgatcttttctggcttgcttccttaatttgtactctgctttcttgtttacttgtaccaactatcttacaatttatagtcacctgcaattttcttatctttcttctgtctaattttgcacatcacttatccttagttgcagtgctgattaagtagtatgcaattttttgctgtctttgttgcaattttagtttgtgtctaaagagatccaactaggttttcttaacgttttctgcatcatgtaaggggttcaacaatccatttctaggcctaaatatataattcatgctgatctcatcactaacaaacatattatctgagttgttggctgttaatgtggtagttgaaaatgatgagtggttgaaaattatgactagctatactgaagtagtaaagcaaacatttttctttctttttttatcatcctgcggaataagaatgaaggaaaagaaaccattttagaaattctatatgtaacatataaaccactccaagattaatagaacattgagtaatcatgtatttgacttttacatggcgagttaaaggcacattgcacctaacgacttttatttgtttgttagattctgcaattagtaatgataaatgttctgttgttcaggaagaaacgaccgcctctaaccatgaaggtggtgctgcaactattcttgtgcgggttgtttgggtaagtacttgctattataattcctaagttaaactcttatttcagaagttatctttttgtacaaacaggtcaatatccccccccctctttttttttgcttgtaattgcctctaactgatgtttttcaacacaactacatgttaattcaaagcttctttattagaagctctgtcatgttgaaggtatataaaagaaaagtcatgctgattgatcagaaacagatattgaatatatatgagtgttcacttttccttctttatgtttccatgaaaaaaataaattatgtgttgtgcattggtgaaaggcacttgcttcatgttaatccagttattagccttactgtgtaagtagtagtagaacaatgaatgtttatcatttgacagcagtgtgcccccaattcaccatatactgcatcacaacttatatggtatatcaactcttaaatatttcttggtactccgtaaatatttttccagtgattctgataaccaaagttcaaatgcagagttccataaacatttgtgtaaaatggatatattagtagtcaggaggttcagggtctatgttcatatttccttggtactcgctatatatttgactaggagccaaatgaagatcttacactatgtcaaaaattgagtagccgagttgcctcaacaatttcatccagatgtaaaatcttgaaacaaacgaaagaaatttataaactacaccaagaataataaaacttgaaaattacttccttcaaaataaatgatgcatttaccaatttttttttctgtattagatgtgttgaccacaataacttttgtgtccaactgcatacacaaggatcatgttgatctcgaagccgtcacctgagaataactagatgacatggcacacgttgcagcaggaatttttgtgccacggcaggaatttttttgcattgcataaagtgcgatggttacatgaaattggaactaaagcaaaaaagtataaccttttagaggaatagaataaaggaaatggggatttttgttaggtacaaacaaccaagaggttgtataactgctaaatctggacacaaagtgaaaatcacatatagaaaacaaaaaatgaagttacttaccttcattgatcaagaattatcctaacaaaatatatgcaggcatgtagcaaaatgaataagtccactagcacggactatgaaagaccttgatcagatcggtggtattgggctgtctaaagacgaggcttgaggggattaatccaatggtgaaattcttatggtgacgtggcttcatgtggtgcttgttttataacaataaatgacttgtagtgggtaccaattatataggtagtaaggataggcccgcacaacacatcacaattagtttcccttctaaattccataggaattgccatactctgactacccatgaatcgtgttgaattcacaattcacatggtacgcacaggttgtcatgaagatggtaattgctggacacactcatcaatttaggggcatcatactacaacttgtgctctactaacactagatttcagcaaaggttggtatacgcattcactccctgggaaattttggttgttacatatggccttcgattacatgtttatgtttcaaccaatcaattagtagaccactggcttacattttgaagctatatcgaaacgaaacaagcttaacattgtttctcatgcctaaatggcccaatagaccttcctaaagcctgagcacctagttatgtccttgacaacctggctagattgcctaattgggataggcatagtcaaggcaaactgttatcacagaaaaaaactttggttaattcaaaatatctccgaatgtggaagggtccctttgttgtgcaatatccttcatcttgaatggcattacttacctttcaatgtttgtgatttccaataatttagtgtagtactcattatatttaggaatttaaagcttcctgttgctcaaccgaaaactcatcgaacatctttagtacagtaaaagtgcatgagatcctctgtgcaatcagtgtggaacacaaatattgaggatgatattaaccatggcttggtagtttttctttctttctcttatgtagattactctggataatatgtgctacttacagattttctttctttctcttatgtagatgactgtttttctgattacacacttgcagattttctataaaccagaatctctatgtgcttgctataaagttgacttcagcaacatttattactgctatcagcaacctgacaccagcaaccaccttccttcttgctatattgaccaggttacggatttaccacttatagcttatatgtttaatttcaaggcatacagagatactccagcttatatctctgactatttctgtctaatattatcacctttgaatatatattacttcaagaactggctaaaagtatgttgaatttcaactacaacagttatgtaggagtattctttcagcagccagaacagtttatattttccgtcttatttgtaaaaaaaatatggatataacaaagccataatttttaagggttaacattagtttccatactgaacaaaacaacaggctcgagaccttaaaacttaagaaacctgctggacaagcaaaacttctaggaacacttgtaggcatgggtggtgcaatgttgcttacattctacaagggaccaaagatcatggtactcgaccaacttccccatcccaaatttgcccacctcactgaaaatccccagtcgcacccaatatcgacgggcaatcaaattataggatcgttccttggtataatcagctgtttcacctacgcgacatggctagtcatccaggtcataatcttacacttagtttcttctttcaacagtgcgcccactcaactgttgcagttctaatgtttggtattgatgcattttttttgccatttacaggcgaaagtgagcaaggtttacccgtgccactactcgatcgctgcaatggtgtgcctcttcggcgcacttcagtccacggtaatggcactttgtgttcacagggacatggagcattggaggttaggacttaacatcaggctctactcatcggcttacgcggtacgcggttcatccggcatttcatatttttcatggtaacagcatgatcgatccttacatttgttccgagtctaatgaggttagcacccttgttgattcaaccagggactcatagcatcaggctccgcgttccctctgctgtcgtggtgcctgcggaagaaaggccccctgttcatctccgtgttcagcccgctgatgctcatcttcgtcgcgctgatgagctcgatcattctcaatgaggcgttgcacctcggaaggtgatggccaccatttcctttctggattcatgcattgcagttcaatgtgtaatgtggacaccaattttctcatggcgagttcttgtgttgttctgctgtaatgcagtgtgcttggttctgtcctgattgtgggtggcttgtacatggtgctgtggggcaaagcgaaagaggcggctgatctgtctgaagatgaaaatcagggcaaggaatccatccctgtgaccactggcggtgagaatgaaatgaagtgaagagagcattgggcctacaggttgctatttgacagaaatgacagaaagatatgattctgaaattctgatagaaatatagaatgttcggtttggatcaggcattgatgtttctacatcgattcatctcgtgtattgtggacgctatcatttgtctgaatagtctgatactgttaatctgttattgccgtggatttgctgctattcccagatttgccttttataccctgtaatcttattagagctgtgattttcatgctactctcttgatcaggggcggtaccacccattaggcggggttgggcggccggcccagctacggcccgcgccgctctaaccctccatatccttcttgggccgcctaccacaacatccaattcacaactggcccataaataagcagcctaagtgtctaaattaatcctgcgtatatgatgctttcctgagtcaattcctcgacgctgctcacccccgccccctactatagttaggtgcctaatgtttttttctctctctcccttctaagcaaaataataatcattttattctaggtatgcgatatcttctcatatatttatgtggcggtatgtcatgagatccttcaaccagacctgccgaaaccatgcaaccagtaagggttcaagcccaagacgtcaagttcatcgggggcgaagccccccatggcgaagactgtgaagcaaagacggcgaagggtgaagaattgcgctggtatcccacaaggctgaaggcatcttgggcgaagactatacggcgaagagtgtatgacgaaggaaggtgacttcgccataacgagtccagcttcaagaagacccaagaggccatcccagccgctcaagcccggtggccattgggccaacgttcgccagtcggccctttagaggcccatatacctcaattacactgtatacccatgtaagtgtccctttcataagggcaaccatgtaaattcccctgtaaaacccaagccctaatagggaacatgtaataagattataaatagacccctaggacatgtaagagggggatccccaagaaaaattcaaaagataatacacttcaccgtttccaacaactgttgagtaaccacgtccttcgacgtacgcagttgtcacttcgacaacaactggcgccgatcgtgaggaggcgaactggcgcctgggtggatatattcatatatttattttttaaaagatatctatcaaccatgctttatgaattgactcatatttgcaaattgatatgtttactagtatctttttatgtatgatgaattatgtatggcgcaaaaattattactttattttaatatcatttttgttttttgtttgttttaatttattgattatactatatgtttatatgattacaaacataaatatggtatttgttgtgtttagttgctctttatcaagcatttttttcaggaatctcagaaagggattcagtgaacagagagcactagtctctgacagaatgcatggggattactgtttttacaaacgcatggttaggacttcgagcaatctacagaggagaaagcagtaaacactagtgattacaatagtaaaaaagaactattactactagttgtacttctactctactaccagagagccgaaaagaacagcatcatgacgagaggaacggcgagctgcacctgcaccgtcctggctcgaggcagggtgcccatccccacggcctgcaaaaggcgtcaccaccaaccaatggagcaaattgcaaaagttcgtcgtcagtcagagagcgagctactaggctagaaaaaggtatgatggatgcaaagggaaaaggaaaagtaatatgagctcgcaaagatgcagcaagaaagctctgagaaaaaggtttttggggagttacaagaaactaaaagaaatgaaatgaatcagatgtttgctgggttgctttggagtttatcagaggaggagatggcattggcatccaaagaggtgatgaacagttgtttgattggttggttggttggttacctgctgctgttcctggccgggggtgggcatgggcaggacggtggcggagtcggtgacgccggcggggagcggcaccgccgggctgctgctgatgaaggccgtgctcgtgcttgccgccgcggcggcaggcgacggcgcgccggcgttggcttcagcacccgcattgcctccgggaagcgcgccgcgcgggctccgccgctcagacggcagcgtcggcatgtcgccgccgccgccgtcgtccgagccaggcaacggcggtatcgccggcgcgggcgcgggcgccccgaacggagccggccgcggcgagtagtccggcaccacgaccgtcatcggtaccttctcctcgccgtagccaccgccgccgcgaagctaacggcaaacgcgacacggcgcggtcagtaagtgtgactgcaagtgatcagaacacccaaaccaacacaacactacacgcacgcgcgccaacgcgcacttacctgttcgacgtacgcgcccgcgccgcgcaggtggaagagcgcgcgcgccggctgcacggcggcgagcgagcagcacagcagcagcagcagcagcagaggcagagccgaaccgcctcgcatatctttcctcattcctcgatgctcctccggtgtccggtggtggcgctcgtccgaaaccgcacggagggaaggacgcccgtgactttgtagcgcgcgcgggtggtggtgcgtgtgccgtcggccggtctgcccgtgtgcagtggacacagcgtcacagtgcgtgcaccgggtcgctgcaggctacagtacagtgcagcgcgaaacagcaaaagaaagcgacagtggattttaaactctccagagaaacggtattaccttctttgcgtatcaaaagtttggaagtttgcttgaaattggaactatgtgacagaaaagttgtttgggtatgaaaggtttgatgtgatggaaagttagaagtttggaaaaaaaaactttcaaactaaacaggacctaaatagttatgaaaaaataataaaaacatgtagatatactttacaaatagtatacaagtttaaattcagcttctacatgtaataaaaatagtattaaacgcctgcatagagtattaaatataggctctatgcggctaactctaatggtacatattgcgactaatttgcgagacaaatcttttaaacctaattgctccatgatttaataatgtggtgctatagtaaacatttgctaatgacgaattaattaggcttgataaattagtttcgcaggtttattgacgtattctataattagtttttttattagtgcccaaacacccctgcgacaacctatataatatccgatgtgacgcactaaaactttacatccctgatctaaacaccccttaggctcccagtatgtaaaacgaagcagcgtttaacgcgtgattaattaagttttaggaaattttttttcaaaaatagatcaatgtgatttttttaaacaactttcgtatataaacattttgcaaaaaacaaaccgtttaacagtttgaaaagcgtgcgcgtgaaaaaacgaggagaagaggttggtaacctagacaaacgagctgaggtttaatctttcttgttaaattttttcaatcttttagagcaagtttaatagtatagccaactaatagctctaatttatctataaccaatctaatagctcatttatacaatagttacatactacactattaatacatagtcccacctatcatacacacattgtgtcttaaagtctgtgctacaactggctataaatgttacccgttgtttttctctcttctcatttatcttcttaaaatatgtttgtagctgtcttatagcctgctattgtacctgctcttagggcacccacaatggttatctataagctatctacaagagaaccatgtcagcatattttcctacttggaagatattaaatggagagagggagcaaagctatctactaacttagagatagtctatagagaaaaacgagacaatgcataagagagctatagatacccatgtagacatgctattgaggtgatttattattaatctagtctattgctgagatgtatatgttttatagagagcaacttactttattattgcgggtgctcttattataatagaatagttaccatagaaagcggaaaatgcgaagcaaaaagggcaggaaaggacgggctacgggggctaggcggccggccgggcggtgtgtgttggctgggcgaaacaaaaggctgcgacagataaagcggctaccttttctcgggcgtggtggcggcagcagcaaaggaggaatccaccgataattgaagcatcgatgggtggggggtggtggcgcggccaccggagcacgtggcctccaacacgacctccaaatggtcaaaaccctctctctgtgcgttgccgttgttgccaggttccccctcgattcgatcgattgattgaccctcccctcttcctcctctctcctcctgtgcacaactgcacaccgcacagtgagccccctgtacagcttggggctctatgaaaaagatgaatcgatggcgtcgcgacgtgcttgcctccctcaactttggggctcttaagaataagtctactttgcctccctttacaaatgggtccggttaaaacacacccactaaccataaaaccgggtataacccatcctctaacttacaaaaccgttgcaaatcaactccctcagcgatttcggaggcagtttcgttctacgtggcacttacgtgacggtttgacttagtatttatcccatgtggcatcgacatatcgctcaagtggtactaaaataaaaacaaacctaaataaaaaaataaattttgggcacatttgtcagttcttcagctcctctctcttccctctttatactcgacgtcgattgagatggagagagcaggagcagcgagaactcggcggagcgacgggagcagcaggacagcgggttgatggcagcatcgacggtgttggtgtcagcaaccgggagctcggcagagtggcttggcgggaacagggagagagcagaggtgaggaagcctcgccgccgcctcctctcctctctccttgcctcccccccggtgtcaccggcaacgaaatgcgcgtcatcgttgtggcagggattgaggtggaggcggagaacaaggtcggtgttgggaaggagagcggaggagaggaggcaacgacagcgatatagggagctggtgaacatgagagggtgctgagccagcatggggagtcgttccctttgccgagatcgacgccgccgtgtttgcacgccatttgcagtggatagctcatccgctgacctagccgtcgaactcggcggcttccaccgttgtcctcgccctctaccatgctctgtctcgccgccgctgccatccactgtcgtctgccggttgatgccattcaccatccaccttagaaagagaaaggttaaagaggagaaaaggtagctgacacatggaccctaaatttatttttattattttattcattgacatgtgggtcccatttaaggtttgttttaattttagtgccatgtaagcatcacgttgatgccacgtggtataaataccaagtcaacccgccgcataagtgtcacgtaggacgaaaccgtctctaaaaccacttggggagttgatttgctatggttttgagttggaggatgagctatggttttgaaagttggaggatgagttatacccggtttttcggttgagggatactattcaaccaggggtatgagatgagggaagcaaaacagacttatttcgatactcttatggcggatcaatactatatcattagggagtttgggactttgggttcgggcgcagcacggcagtaatcatcttcctgatcatacagcccaagggaagaggagcccatgtgtaatcccctagcccaactaaccggccgggcctttgttgggcttggcatagtgtgatgggccagaccagttacgaccaaatccaaccagggccctcacatcctgttttgaacttaggcaggtttagcataattttctcgtaccctcgtagtatggtagtttgttcggataagatcacaagactgcatggttcgtggtgaatttgcatacaaggccaacaaaagaggaaaataaaatcatgcgagtagtctctcatgctaatgagccgtttgtgattaaaaaaaagaaaaaacaaatatcgatccatatggttcacgattacaaatgggaggttaattttctctaaaaaaaacgctatcatatactccctctgtaccaaattataaagcctatattttttatacagtcttcaatgacatattttgaccattaacttatgacatgttatatttttaacaaaaatagaatataaatctagtgatataacatgtataatatttatcatatatatggttagtataattattacacaaaattatcaagtttaatttttcttaaaaagagcgcgccatataatttgggacggaggtagtataatttcccaatttgatcatctctcaaaatcgatctacccggtacacccatgctgctccgcctcgtccgccctctactccgccgccatgcacgcggcggcggcgccggcgccgccgcgagctctccgacatcgcgtacgtacgcctcggccaccggaagcactagtggccatctctacttggtgctggatgactggaaggaggggtacagcctgcacaagctcgatctcaatgccaactccggcgacggcggcgacgacccttccccgccgcggcgcctccccgcgcctctcctccggctaggtttccggacgctcggctcgtggccgcacatcagcgccctaggcagcaagatcatcttcatgggtcagcgccgcccagatcagttccgtgtcgacggcggcggcggcgacggcggcgcctcatcctcgtctacgacacggcgacggcggcggtggacgtctcgcaccatctcccggacgacatgcacctggtgaccagctacgacgccgtggcggacgccgggaagaacaggctctacctgctgctgcctcagttcgagcggtcgccgtcgccgtcgccgtcgccggagccgccgcgccggcggccgccatggccaggggcgccagaacgcggcgtggacatggcgccctacccctacgttgagaaagtggagagggtgaaggccgggaccaggctctacttgctgctgcctgatccgtttgatcagcggtcgccggagccgggccgcgccgccgtgggcatgccctaccttgagaaagtggagaaggtgtaccccaaggaggaggaggagaaaccggcggcgcgcggcggccgtggaaggtcgtacggcggcgccggcgacgacaacgacgacgacgagaaggacaagtactaccgcaacagattgaccgagcggtggtcgtggcggaccagcacttcgccgccgccattctccggcgggaggcgcatcacggggcacgcgctgcaccccgacggccgcaccatcttcgtctccgtcgagaagacccacgcccgccgccatcccggcgacgaggacgacgaggaggacggcaccttctcctacgacaccgagcgcggcggcgagtggacgcgccgcggcggctggcgcctgccgttcaagggccaggcgcactacgaccgccacctggacgcgtgggtcgggatcggcgcatcctcctccggcgccggcggccacccccgcctcgtcgcctgcgacgtcgtccatctgtctgacgccgccgacgaccccgcgccgccgccgaagtggacggcgtgcgaggagacgctgacgttcctgcagggcggcgcgccgcgggagcggagggtcggcggcgatcccaagctggtgcccatgggtgggggcggaggcaagttctgcgtcgtcgagagcgcgccgcgcgccgggctcgagctgatcggcctcggctcgctcctcggcgacggcgacaagttcgagctccgcgtcaccgtgttccatgccaagtacggcgagaacggcgagctgctcatgacgacgacggcttcggcggcggcggcggcgtcccacacctacgcgctgtcccgctatctctcgaatttccatgcgcccgcgttctggatgtgagccacgcgagttagaaattaaaatgcgtaattgcttcaaaactgataggtttcatcatttttggtacgacagcggcgacgacggcgacgacgaggtcgaaacagcgtacgagagcggcggcggcgacgacgatgacgaggtggaaacagagtacgacagcgacgacgaggtggaagcatggtacgacagcgggacggaaacatcgtacgacaacagcagcgacgacgaggaggtggaaccatcgtacaacagcgacggcgaggtggaaacattgtacgacagcgacgattactacaatagtttaaaagagaaagccttaggccttgttcttttaggctgggtttgggggggggggggggggggaatgggccaaaatccccgtgtgctatcccggccgggtcgaattttcttccgtggcccatgtatgcgttcgcctgggccggggtgggagtaattctccaccgaatccacaccaatcccacggggagagaaaaatcgcctcggagacgattttttttccaagccagccgcagcgctcggcctcctcgactcctcgctgcgctagggtttggaggcggcgcgaggtccgggaggcggctctagggtggagatccaggagcagcatatctccagccgctgccgctctccatcccgccctcggtcgccgacgatctccatccagcttcagccgccaccggtctccatcccgtcctcagccgccgccggtctccatcccgctttagccgccgccaccgctctccttcccgctctccatcccagccagtcgccggcgctcgccatctctccttcctcgcttcggattcaccggttgcgggagagggcaaggtcgagggcaacagcccggacaccaagaagcaagtctgattcttgatctcctcttttcccactcagaaaagattttgtgacttatctagtggatgaatttgttgctagttgatgtattgagtggctgtatggattgaagtatcagtcatgttctgcttagaaggaggggtgatgtggtttgtagtagtagaacctgaaaccacagaaaattccatgcacatctctatgtgtgtgcgcaaatcttgcctatcagttgctctgtaatcaaggaaatatatatttgaattggcagatcctatatttctgaacatgggctctcttctttcttttcttttttttttgtgagggagaaacctggtttgttgattctccaggaattattgtagatgcagtgggagcacacctaaaaaataaaaactagtgcactctgttgttgctgtctagaatgcatcactttgcttttggccaaggtcatttgagcttcagattgaacgaccaatactatatgccaattgaatgagcaagaagatacaaaattttttaaagtcatgctatgaggtggtcaggtggacactgtagtatacattctagttttggtaattttttccatggctttttgtttagcaaaatgcccttgttaaaacttgagaaatgtagctgtccatcttttgttcgaatacctattttactcttagcaatcaatttagcatatttatctattctgaactgctactatgttcacaactagttttaggaaactgggtgttcagatatattactagaggtcataccatacaaagctatataaattgctattgaatgacaaaaatataatctgttgtgctgaattaaatttcaggagaggcacaggcgtgtggggttggcaaaagtaaagctgaaggagttgatattactcaaggtatttgagaaaaaactaaatacagttgtacttacatttgcctgatatgaagcatttaatcttgcccttgcatatttactagagtaacagaagtaatttgaagttggagagagagagagagagattgtaggtacaatgttatgtgatcttgctcaggtggcagatggtctcagtttttttttgctagtgaacaggaggttgttattttcaagtaaacatcctaccctagaaggatatcctcactttattaaagttgctatctctgaggtttaaacaaaactaagtacacaaagtacttctggaactagtcaaaatctgaacacattattgatccccctcctcccattgcaatctgtttatttgctgaaagtattaaaagtatttatgcatgtagccaccttgaatgcctctaatttcatgtttaataatattgtaatacatatgcatattattatgttctcacacatagtttaaagtatagtaattctatatctcttttagtgataaaatcagttcgagaatggcggatgaaattaaaaggaggagagaagaggacgatgatatgatgctttttgtttttcctgcgatgtatatgctgtgcggtacgacaaatagtgagaaaatacctagacatatctcaagactatccggtaaagagcggcttcaagaaatccttgaaggacatgtaatggattgtaaagttgcattccgcatggagcctcatgttttcaagacaatagcgaattatcttagagaggaaaagttgttaaaggatagtagaggcttgaggattgaggagaaacttgggatatttatgttcatgctcgcccacaatgcaagctttcaagatctacagtatgaattcaagcatagtgggtctacacttcattggcatattaagtctattttcaagataatcccagctctcacctatagatttctcaagcttcctcatgccgaccaaacgcattggaagattagaacaaatcctcgcttctttccttacttcaaggtgaatctggcactcaaactagaaatgaatatctattccttttccaattaaataactcatgcatattctgtccttttcttccctttttgctgcaaaattgcataggggctattgatggcactcacatttctataactatagatggagagaaggcaactccttataggaacagaaaagggactttgagccaaaatgtgatggttgcttgtgatttcgacctaaatttcacttttatctcatgtggttgggaggggtctgcaaccgatgctgggtccttagatcagcaatgaatagtggctttcaagtcccaaatggtaaattttttctagtagatggtggttatgccaacacaccacatttcattactccttatcgtggtgttcggtaccatctaaaggagtttggacgtggtcatcgtcgacctagagactacaaggagttattcaatcatcgccatgccattctgagaaaccatgtagagagagctctaggggttctaaagaagcgatttcccatcctgaaagtaggcactttccatcggataaagaaccaagtgcggattccagcaactgctgcggtgttccacaacatgatccggttgcctaatggtgatgagggctggttggacaaccaacctgataatatagaacctactaattttgtcgatctaccagaaggtgacagtgaataccaaaatgatgtgccatctcttagcaataaaatgatcagtgggaataatattagagatatgattgctaagaagatgtgggaagattatgttcgtaactagcaagaatagtatagataatattttggttttgcatgatttgtatttatttatgcaatcaacatttatgatatggacaaattaatagtaagcaacgtagtttgtattttctcattcaataaaatattgcaatatagttatgatgtttggaagactatctccgaaagcaagcctattgcagcagcaacaaaggcatctacaaaagaaggcatcaccaaagagctgtagcatacagaagaagaaggtttctccaaaaggtagtatctaacttgtttttttgtgaagtattttcctttcatattaatgattacaaattttacttactataatctaattttgtctaatagcttaacaatcaagagcttcatggaacccgggactagaaaaggctttagttgatttacttcatgagcacaataacccacattaccggtgccaaaacgggtggacaagtgaagcatggaacaaggtcgtcaaagaatttcgtgacagacatccctatgtcaccatgaataagcaacagatccaagataaggagaaggagttaaaacgagattataggttgcttaaggaggcaaggaaacagagtggagcttcttgggataatcaacggtgcatgattgttgccgatgatgctgtttgggcaaacataattacggtatgatattttgagcataattgttttgtcctcatcaaatcactattatttgtattcatgccataattatctgtttttgtatcttgtgcagtcaaatgagaaagtaaggaagttcagcaaaaacaaatcttttcctctctttgaatccttgggtgaactttatgatggtaaatttacttgatgccataattctttgattccttgtgcttacgttcagtgcagccaaccttgttatttgttttcttctctcgttgtttggcactgctaccttctttctttggcttcttcacatatcctgcacctgtactatgttccttttgtatgatgtagtcctcttaggaaacaacagtaacatagctgattagttatgcatagtgacatttctcatatccgcatattggaaatcaatgccaaattatttggttgctcatgatgtttactaagattgaggctttaaatggctgattctgtttgctagtgaacacattcttttttggtgcagtatgatcaatgttccattagttatgcatctcccttctcggatctagtattttccctaataggtatatactgaaacttttgtatgggtagtgaattgcaaccttttttataggccaaactgcgagggcaacatgaatttcacttctattgagccattccaacatgctactctcatacaagtgaatgaatatcttgagagaagtgactcttttcctgatgtaaattgggttgctgatgatgatgagaccactgaagttcaagatgaagataatgcagtggagcatgaaaatcagggaagccacattactatcacctcaagagctaatggagaaaagaatgtcaagaagaccaaatctactgagagagagagagagagagagagtagaaaagacaccgaagaggaataagaggaatgatgttgttgatatgatggaaagttacttggagatgagaaaaagacaatctgaggaggaggaagcaaagaagagggaggaggaagcaaagaagagggatgaggcaagcaaggttgaagattgctcaataaggaactgcatcactgttgtggaatcgatggaggagctctcaaatgaagaaaaggtcaaatcttttggagtattcaaggacgtgcagaatagggagatcttcatgagtgcagggcctatgactcgtcttatatggttaagaacgatgctggtaagtttgaattactattgttactagcataatcttaatttgtgcaattctgaaattcaattcttctacacttaaataggtgcatttttttagccacgttgcactttgtttatgatgcgattgtgtaacaatgcagaccatgtaagaatgacctttggaccaaaaggatattgtctttccaggtacccgttcatacttttataattttgacatgattttcatgttatatttatgtcaggtttaggctgaagttagcataattttgacataattcttgttagtatgcctctgaacttttataattttgattcttgtcagcatgccccctctcttctgtcatgcagccatgctagtgtgtgtgcgcgcgcaccactactactagtacatatctacatcgatctacatacattccttgcctaccaccttcttcctaaaatcaatctatctatctatttatctatcgatctatcatgcgtgcttgctgtaactgattaactggcagtgtgatcatctctctctactgctgctacatatatgcagtgctatgctgcaggtataatgtgctatgtctgcctaccacaaatctaagctaattgtgacatggtaataaagcaggtgctagagtgattctctctgtgtgtgtatgtgagtgtgtttgatgtgtaattgtatcattgcttgtgctcaacaaaaacttgagtacaagtaaccatcttttgcatatttatctgatttgattcaagttcattttacctgttgtttagtttacatattagcaatcaccattgtctagtgtctaagacttgtttctttttggttgtatagttccatggcccatttgctagttgtgcccattggaaggaatcttttgcaagatagttcatagagaccgcttgaattgtgaaatgcgatggatgaaggacaatttttcctaactgcttcttaattcatgtagctgtgatggttgcaggaaccatttttttctataggattaacacttgcttgatcagacatagatatattatttagtttgatcggatagagatatattacgttcaaagaacctattttgtagcttgctttgcacaatggcaattggatgtttactgcctgtagaatttaatctatccaaaattataatttttaatattctcgactatttttagaatccatctgtggtaaatccatgattttctatctttacgctttttagaattattttgcacgttgaatttctgttccattttcatgatcgttttttatcttgtcatttctgaattattttgactttcgtgaccttccagctttttaaattttatccgaattttgcatgatagtttctcacgctgaatttgaatggtagtaatcccttctaatctcacctctaatcccaccttctactccaaattgctagccaacagggaaatcccagctagcgaacaggggaatagaggccaggagattgggggaacaaggggattggggggaagggattgggtgtggggagcggggacaacccaaaccccacgtgggttggttttcctttggattatttcccacagctagcgaacaaggccttagggggtgttcaatagtagagatgagtatggtctaaacaataaaagattatttagaaaccgtgtctttacaatacttgagacgataaatactctaattattaactcaaaaaatattccttttgttaatattctttccatttttttaccctcatgcaaccatatttcaatattacggtgattaagagttgttgttaagccattgttctgcataataacgatgttttgtctctcctatttctctttcttccatgtcaacaagtattcctaattaacaacgctaaaagaccactattgataaccattgtacatgtcttattttttataatttctgataatttatagttgtagaatctccatcttaaaaaatagttatagaatccaatgaatagaccacaagcataagctaatttccttaacttttctatattttcgttaagctacgttcttatcagccgcttcttagaattaaagcttcccaaaagacgcttttcgtggccacatgttatgaagtaactggttggctgtagttgggctagcataaacatcagtcacgagcaatgttttaaatagcgggctaagacatttcgtgattaatttagcgggctaggttatttagtggttagcttctcaaacagctacagcgtacaatttagccgcaactaaattgtacatgagagcaaataactagaacccttcttaaaccctggtcacgagaaaatccagaggagcttcacattttgtttaggcaggacgttcaccgtaatttcctcgtgtgattgcggtttgttgggataagattgcaatttgtatttttttttgttgcgaatctccaacaaaggaggagataatggataatgtttcaccgtcatcggagattaatttccctccttaaaaataaaaaacacacactaatttttcggtaattgcacgggttaattagtttcacaaaatcgatctaagcttccatgctgcgatccattctccgccgtcatgcaggcggcggcgtgagccggaccatgtgttcgccgccgtcgcgttcgcgtgcgtacgccgcctccggcggcacaggtggtggccactaccgctcccgctgcctccgtagctgcagctgcgacgagcacagccggcggcgacgccatctctacctggtgctggatgactggaaggaggggtacagcctgcacaagctcgacctcagccatgtctccggcgacggcggcgagcacgagcacaaccccatcaacccgcggcggctccccgcgccgctcctccgcctaggtttccggacgctcggctcgtcgccgcgcgtcggtgccctgggcagcaagatcgtcttcattggtcagcgccacccagatcagttcaccagcgccggagacgacgacgacgacggcgacgacgaacaggaacgcggtctcaccctcgtcgtctacgacacggcgacggcggcggtggacgtctcgcaccatgtccccgacgatgtgcgcctggcatgcacctgcgacgccgtggcggccgggaacaggctctacctgctgctgctgtctgatcagtctcactttgagcgctgcgagacgaccgcgccgttggcatgccctacgttgagaaagtggaagaggtggccaccgggaacagggtctacttgatgctgcctgatcagtccgagcgctcgccgccgccgccgccgccggagtccggcagcccagacctcgccgtggccatgcgctacctcgagaaggtagagcaagtgtacgacgacgaggtggaaacagcggacgacgacggcgacgacgatgagtacatggacgcagagaagaagaagcacgtcgtcgtagcgtacagcgagaggttgacggagcggtggtcatgggggagcacctcttcgccgccgccgccgcccttcggcggcggcaggcggcgcatcacggggtacgcgttgcatccagacggccgcaccatcttcgtctccgtggcgaagagaacacccgaccacgacgacgtcggcgaccgtcccgacgaggaggtcaccttctcctacgacaccgagcgcgccgagtgggcgcgccgcggcggctggctcctgccgttcgacggccaggcccactacgacgccgagctggacgcgtgggtcggggcgatcggctccagggccggccctcggctcgtcgcctgcgacgtcgtcccggcggccgcagccggagatcgccgcccggcgccgccgccaccaaggtggacgttctgcgagcagccgctgacgttcctcggtgcggagagccatcagagcctgggcgatcccaagctcctccccatggggggcggcgcgttctgcgtcgtcgtcgagagcgcgccgcgcggcgccgactcggtcggcgacggcgacaagctcctgctccgcgtcgccgtgttccgcgacaagtacggcaagaacggcgagctgttcatgacgacggcggcgggcgggcgcggatcgtgccagacgcacacctacgtgcggtctcgctatctcgtggatttccatgcgccagcgttctggatgtgagcaagcgaatgagtgagcgattccttggcagaggctgtatcttgcaaatttgcatgcgtttcatgaatttttttagaaataatattttttaatagaaaattgtaaaaactagctgggtggcccgctcaattgcgcggctagcacccatacaaaattatatatttttaatatgattttacttaaaatttattaaatagttatctcgttgtcttgagactttaaagaccaaaccttatcatccccgtgtttctaattttatgatttttaaaaatcacatcaattgctatcccttacttatgtcatatccttctttattatctggctcgatctacatggtttttattcattctctttggaaacctttaaaaattggatgttatactttttagagtttattgtcctgatgggtttcgtttttataatttatagaagtcccaacaaacgctgtcattatactcctctgtggcctctccattgcctcttttctttattgtcattgatattttcaaaatagaacataattatcgttagggttcatttttttactttctagaagttccgacaaaatgtcagcggttttgttagtgtactcctctacagcttgcccgctgcctcccttctttattgtcattgagattttaaaatcaaacatgattatcattggagtttatttattttttactttttagaagcgcgaaccttttaaaattggaccttatagtttttataatttattgtctcgttggatttcgtttttttatagtttttagaaatctcgtcaaacactgtcactatactcctctacgacccttccaccgcctactctttattatcattgggattctaaaaatcgaacatacacatctttggaatttattttttactttctagaagtcccaccaacaattggcggcgctggcattgtactcctgtacgacccgcccgctgcctctcctttttattgtcattaagattttaaaaatcaaatatgattattattagggtttatttttttactttctataactcccgccaactgccttgaccggttgcttcacgacctgtccgtcatccttccttttaatagtcattaggattctatctggtgttttattaatagtttttagatgttccatcaaccgccgccactctactcctttataggccttttacttaattaatctcctcgtgtgtttgagatggtcttttcttgcaatagtttttattttttatcaccaatttagttatttataaaaatatttataaattgtatttctagttgaaatcttttttttctttttctaatttcagattttattttattttttatttcgaatttcaactaatatcgtattgtgttcttttaatttattttttattttcaatttcagtcgtttcaaaattgtatttctacttgaactctctttttagtttatccaattttggattttattttatttttcattctgaattttaattaatctcgtattaggtttttatatggattctatttcaaaattgtattcctgttcgaactattttttttatttttctaaaaatttttgaatttactttattttttatttcaaattttaattaatcttgaatgggttcttatatggactcttcttctaaaatttcttatttttaattccgaatttcagttcttttaaaattatattcctacttggactctcatttttttctctgattaatgtgggaatttctaacctccacggcgaaggtaatgcctcctttcaaagctgatttaataatatgtttttctaatttcttgttttattttattttatttttattttaaattttaattaagaaacggggtgatagaatcatacacgtctaatcatattcaatggtgttattctgatttgatttccacagtcaagttgtgtcactttgcaattggaattatcatgttgctgttaaatccatacacacgtcgattcgtatctgactcggtctgccattgcaaccaatgtgtccgtctctaattcactttacgtaaacatactataatttttttaagttttctatggactcttattatatctcagccactaaaatctaaagggaccacaatctaacggtcggtattttttctttttcttcgattaatgtgggaatttctagcctccacagcgaacgtggtgtctttttttcgagctatcttaataatataataatagatagaagctgataagccaaaatcacaagtttaatatcctgttgaacaaccgagcctgtcgaactatggttgttcaacagggtagttggtccactaaaaaaataaaaaagtacttgaacagtgttgcgcagtgttgggcaggggccaatcgaacttccaatgttcaatatgtcccgcatgaacagtgttgtatagtgattgttctcttttttaaaatttttttatcctatcgaattgtggttgtttgatatgtacccctatcgaactataggtgctaaatttatgattttagctgattaacttctattttttataattttttattagaataatattatttctctaaagtttcagtttcatgttcttaagggttacttctttcgtctcaaaataaaatagcatatttcattcagtactaagttgctttattttaaaacggacaaagtaaggaagataatcaattagtggatgttcattcccgacgtcaagtagatcgatcggcggtttcttcgacggactctgaagcggagcaaggcatcgtcattcatacgtacatatgtattattcttgtccataacacaaaagatacaaacacagagcaagtcatatactatatctactctctccgtttcacaatgtaagtcattctaacatttttcatattaatattgatattaatgaatctagacatatatatctatctagattcattaccatcaatataaatgtgtgaaatgctaaaatgacttacattatgaaacggatgaagtacacaataaacaaatacacgctgactattttttggtgaaaaatatggcaatatagctactctctaaacaaattaaacggcgaccaccgcacaagaccttgttggacccacccacccagcactatactaccaacggccatctccatcgcatgaaaacaacatagcatcagcaaagaatcaatgattgattgatcgatcgatggcactctctatagactatagactatagagggaaaaaatcttctcgatttctacttactcgtcatgccatatagagaaagaaaggaacaaagaaagatatttctccctctatttcatattataatttatttgatttttttataatcaaacatttttaaatttaatcaagtttatagaaaatataatattattttcaacacaaaacaacatattaccaaaatatatttaatgttagatttttttagggaatatttaatgttagatttaactaaactaatttgatattttaaatgttgctacattttttttataaacttaaccaaatttaataaagtttgattagaaaaaatatcaagttgacttataatagtaatcagaggagtaccatacacgggcaccgctagagtgaggctcaccgctcacacaacatcacgaaagaaagaatcgtgttagcctggtcgttctttcgatttgtttacgtccacatgtgcacaagttggaacctcgcttttgttgtcctagatctggcacacaccaaccgatgtgtagtgtagctcaacattcgcagcatcagtgtgcgtgacaaattttcaggagctaggtgacatgggcgacttgggcggcggcggcgagacgaaggacgtcatcgacgtggaggcggtggtcgtgggcgccgggatcgccgggctcgccacggcgctggcgctgcggcgggcgggctttgcggcgcgggacggcggcggtggcggtggcgtcgtggtgctggagcggcacgccgagctgcgcgccacgggcgccgcgctcaccgtcttccccaacggctggttcgcgctccgcgcgctcggcatcgcgcacaagctcacccctcgctaccaaccctacgaaacgtacgtatacccaagcgcgcgcacttgaatcgatcgatcgccacgatggaaaacaaaagaaaaaagaaaaagaatcgaatcgaattgctgctgctgctgatgctgatgaacgcgcgcagatccgtggtgaccaacctcgagtccggagcgacgcaggtgtttcggtttggtgggcacaagagcaggtttgaattgatgcaaattaaaacttttttgaattcgtgatttgatcatttgaaccggtcgcgatttggctcgactcgactgaaatttttgaaggagcggcgaggtgagggtgaggccggtgcaccggagggagctgctggaggcgatggcggaggagctgccgccgggcaccatccggttctcgtccaggctcgcctccatcggcaccgagcccgccggcggcggcggcggcggcgaggagctcgctgtcgtggggctcgacgacggcacggtgatccggtccagggtgctggtcgggtgcgacggcgtgcactcggcggtggcgcggtggctgggcatggcggagccggcgagctccggccgctcctgcgtccgcggcctcgccgtgtaccccggcggccacggcgtgaggaaggagctcaggcagttcctctcccatggcctcagggccggcatggtgcccatcagcgacaccgacatctactggttcgtcgtcaacaacaccgtccccgcaggcaagccagcccaaatgcctcgaataaaaatttgttcaaatttgatgataagtttgttgcaaatgtgcttaattatgaattgggaatttaagttgttgcaatttttttaagtggagaacttttaaatctaactatgcttacaatatcatttcattgtaactatactataaatataatataacttttatataagtatttaaaaaattggatgtgttcggctatgacaattcaaactgattgtgacgtgtaaccaatttcatttgtcacaaacggttaaaaccagcacgtccgaacataaccaatatatacaactttatacgtaagttatataaagattataatatatataaatgtatgtcattacattatagatgcactgttaccatactataattatattttaaattacatttaacgttttctacagaaaaaacttgaaactgttttgttagtaatttctaatttattttttttttgcagagagagaagctgccggcgatccggagaagatcctacgcgaggtgactgacaacctgggccgccacctgccggaggagttcctggacgtggcccgccactcggacccggacaacctcacgtgggcccctctgctctaccgggccccgtgggccatcctcacgggccgggccgcgcgcgggcccgtcacggtggccggcgacgcgttccacccgatgacccccgacatggcgcagggcgggtgcgccgcgctggaggacgccatcgtgctcgcccgcgcgctgtcgtctcggtcgccgtcgccgtcgccggccgacggcgtggcggcgtacgtcgcggagcgccgcggccgcgccgcgtggatcgtcgccggcgcgtacctgtcgggctacgtccagcaggggagcaccagcgcccccggcgtgcgcgccgccgccgtcaagctgttccgcgactggatcttctaccgcttcgtcttccccttgctcgccgacaccatgtggttcgactgcggcgacctcgtcgcgccgccgccgcgcgacggcggcggcgaggaggaagcagctgactgcaagaagagccatgtacactgagaaagaaaccaatgtactatcagttgtacagtcactgcaggtgggaccggaccacctgtatcatcgtgacaccatcagcagggtgatcgatcgatcgatgacatgtgtttaatggtttgctaatcgcaatagttaccatttcgtttcattttcagatgtacaacgtgctcaataagcttcttgtgtgttttttggaagtgaggtagatgagatgtagatgtgatgtcatcatttgcagtgatctacatctgcaagctttttaaaaatctgttggggatagcttgtttgtttttgagatcagccacaaagatagatgctcgtcctcctgtgcaagcaagaacaggcgcaatgcatttccaatgtggcaaccacttgaaataccagaaaacaaatatatatattaaaatttcagcatggaatccactagctaaaggttgtttgcaaaaccagggtattactagtagcccatagatttcgcacatatatttactgcagactgcagacttccccctgggtttcacaacaaaatttgtctcttattaacgcaatgtctgttgccttcagtagtaagaatatattcagggttttaatcctgaaaaatgatctgaacatctgatacatcttgatctacctgttcttctcacgtgccaattaaacctagtacctgatgaaaagcgatcatctgtcccatacaatacattgtccaattctttggtcattaggccagcctgttcctgaacaaacacgttctgaacacgagacaattgaattgtaccacaaagtacctgagcacgtacagaaaatcaaaactggaaggccgtgtgttggtacagtgctacaaaccaaagagaaacccaatccgtttcaggccaacttgcacacctgacgaagcacctatgttccttgtcagctttctctctgggatcacaccagaaaccaccaagaaatgcttgcacacaatctaaagaacggacacaggagaagatagtcagatacacgtcgttggatcgacatgtagacatgaccggcgagccgttgattgattgattgatgtggagtgcaaggattgaattgtccatgatggagaaacaaaaaaagagagagaaaaaaacacggcctaaggctggggatcaggaatggagatattggctccctgatatccaggggtgtcatccggggaggcagctaagattgttcagttttagttagcttagctagctaagttagcagtacaagacaaagcttgagatttttatctgtcagggtctaggggttcttgcgtataaaggcttcaggtgaggtccattttaagccaagccaaagccgcatctggataagagaggcgattcaacagtgcttgtcccaaaaagatcaaggaactccaagaaaagcaaacagtgcttgtcccaaaagatcaagaaactcgaagaaattcatgtgcccatcacaccaaggtaagatcagtagagagaagaagaaaaaaaagacagaattacattgagcttttcgtcatctgtttatctgttcttgtatttgtgctcataatgctgaggattttggttgatttgtattggagcagccatggaatccatgagcattgaggaggagtacatcagcacgctgcacacgcgatccaacgcgcggttcttctcgaggagcaagcagcagctgtccggggtggagatggaggcggcggcggcggcggagcagcaggacgccgtcgtcgtccccgcggagttgcagcggatgatgcaccggaggacgtcgtcggagatcgagctagcgatggcgggctacttcgacgccagcgacgaggcgtcggagatctgcaggcagctgctggcgaacatcaagaacgcgcagagcaactacctgtccatggacagcttcctcgccaccatcgtctccgacagcgtcgccgccgcggcgacgacggcgccgctcgcagccgtgcggagcaacccgttcagcgacgcggcgacgcggagcagcttccggcggatccacgacaggtactcgtccatcctccgcgccatcaagcgcagccacgggaaggtggcgaggaagctgaaggtggcgagggccgtccggaaggcctcccgggcgtgcctcgtcgtggcgtgcggcgccgcggcggccgcctccgtcgccgtggccgcgcacctcctgctcttcggcctcctcgtcggcccgccgccatggcgctctgccccatggcgctgaagcggaaggtgacgaacacgaacgcggcggcggtagcaaggccggcgaggcggtggtccacgacggggtcgctgctgcggctgcaggagcagctcgacacggcggccaaggggacgtacgtgctggggcgcgacctcgacacggtgagccacctggtggcgcggctctccgacggcatcgagcgggagaacgccatggcgaggcggtgcgcggagagggtggccgccgacaacgtcggcgccgccgccgccgccggcgggaggttcttcccggtgcaggagatggcgaacgagctgaggagaagctgctcgagctcgaggaagctcgcggaggagctggaggagcacgtgtgcctatgcctcgccaccatccatagggctcgacttctcgtcatcaaagagatctccaagcaagcatgaactgaaaattaattacttgatacatgattaattacatctaggattaatatagtttaatcatagtgtacaaaatttcatgtataattaggagtagttgatagagatgattaattacagcttgtacataaattgttttttcttccttatatttagtactaacaggattcagggtaagtgacatggttagaaataattttgagaagatttcttaagattgagggtctatacaaagatcacagagttttggtctcattggccatgcccatgactcactaattaacattctttcgaaatattagcagatcatacatcattttttctttatgaaacgaattgagacatatgaccacacactcaagctgcttaatcacaaatatcagacacctcctgtgttcgctccttcgggttgggaacccaagcttctccacaacaaaacagagcggtacattaacatgtaacatgtgattaattaagtatttactatttttttaaaaaatggatcaatatgatttttaagcaactttcgtataggatttctttttacaaaaaaggcatcgtttagcagtttgaaaagcgtgcgcgtggaaaaggagagtagggagttaagaatcagctcttccaaacagagcatattgcagtggcataattctgattggcacatcaaatttaatgagaaattagccatatattattctatcaatccttgacccagaaacttgggcttgtgggttgcacttgggtccttctacagattttgttgcttgccggaaatttttgtttttcttttacgcgattagatttccgctctattaaatagatcagatatgtatcaactaaaagtgtacacgcgaatacatcactctggcacgcgcttaaaggggcggagtcaaatgacaaatatctagtctcatcgtaatcctatttataagcacatccaagtgtaaaatgagcgtaactcaattggttcattttcttgtggtggaaccaacctatttggttcagtttctcgtggtggaaccaatccatctgtattaatggatagagagtatttaaagtcgtgtgtctgcatgtatattggcgagatatagttatgactatgtgggcctacatattagcgatcatatctctttgactgtaagttagaggatttcaatatctcaattagcacttctctttgttacaatgcaaagttatagatcggagaagtactcttttttttatgccttattgtttcttacatgtcattatatatatatatatatatatatatatatatatatatatatatatatatatatatagaaggggtcatatgcacacaggccctcgcgtgtacacaccgtgtacaccaactaaaaattatcacaaaaaattttaggaaaattcatacatgtactttcaatagtattacatctacgtgcaaagtagcatcttcaaattcattctacatagagaataacaaaaaagataaaattctgacaaaattacaaccttaaagctgtcagattttttgttttttttgttacggctaaaatataatgaatttgacgttaaaattttaaccctaggtgtaatacaattgaaagtatgggtatgattttttctagattttttggtgacattttttagttggtgtacacgtgtgtacacgtgagggcctgtgtgcataggatatgttgccatatatatatatatatatatatatatatatatatatatatatatatatatatatatattaaaattgttagtgctccatggtgcccatgctccaaaatcatcccccgttccatccgtgcaaataaaaactgagtattaatcaaattagcgggtttaacccgataagaaatatttgtatcaggttatctcgtacctttccattttttcatttgcatgcatgcatttccaaatgaattacggattttgaatgtgattgtatataattagttggattgattgctttccatgtatatgaatttaa

SEQ ID NO: 83562 - DNA, 1795 bp, Oryza sativa
  unsure (1)..(1795): unsure at all n locations
cgcgctcatgatgatacaacnnnnnnnnnnnnnnnnnnnnnnnnnnnnnnnnnnnnnnnnnnnnnnnnnnnnnnnnnnnnnncgagaaaaattgtcaacaataaccaacacataccactttcctccaacagattgcactctagctggaccaacagtgtccatatgtaatagctgtcccggtgcatccgtcaacacagaaacaataggagcatgtgaagtagaaaccatcttagcatgacgacacggtgtacaaaccaaatcaagatctttcttaagtttaggcaaaccacgaacaagatccaaaccacttaacctagtgagatgatcaaaaccaacatgtgcaagtctacgatgccaaaacatcacatctttatcaaacttagcaaccaaacatgttatcacaggtgaaacaggattttcaaaatcagctttaaacactcttctataacgagaaatattcagcacaaaatcaccacgagaatcaaaaactttactttcagttttcttaaagtgaacttcaaactcttcattaacaatttgtaaaaccgaaagcaaattgtacttcaagtcctcaaccaaaggtacattcttcaattcaaatttttcatttaccttaaccatacctgtagcgagaacatcacttgtagcagcatcaccaaagataattgattcagtcttagatgccttctttagggagaagaaccaatttttatcaccggtcatgtgccgcgaataaccggaatccacgatccacacgttctccttccttggcaccaaagcctacacataagcagaagtcgaagccttagtactggggttacatgataataaaaatataggaatccagtactgagacacatgaccagaagatcaaataggcatatatctacatgcaaaatcaattttagaattttcagaaaaattcctccaaggccggtctgaccgagggtgtgtagttggtctgaccgaggcttcaccgccggtctgaccggtggtcggtttgaccgaggctgttcagcccgtctgaccggtcgccggtctgaccgcgggacccactacggtctgaccggtttcctcgagggaaaactcgatttttgccactttgattttgcaaaagcaatctctctctcctttttctttttatgagctaatctaaacaaaaatcaacaatatgtccatcttttccacaaaaagaacaagtatatttttcacgatgattagacatattggtagcactagaagatttagcaacacaagcaacaacaggagattttgcatgcataacattggattttgaaaaagatgcactcatagtagacatgataccagcagatttaaacacagttttgttagtatcaggtttaaccaaaatctcaccacttctagcaccaacacctaacacaacaggaggatgtctagaattatgatcataaggattaaaacctaaaccacggttatgtgtgctaacctttgattgatctaaaatcatgttgaggttctttttaccatcagaaaatcttagcaaagaatttttcaaatgagaaacctctttttccaaattagcacaattttcacaatctaccatgacacctttgcttttacgacatttggggcaagaaagcagttcattgtttttcacaacatcttccatgtactcaacacgacctaaagcatcttttagtttcatcttattcaaattacatggtgagcaatccaaaacatcatgaggttgttttaactttttagcagaaatcatgttaaacataaactagcatgaaaggcatttgatattttg

SEQ ID NO: 83563 - DNA, 2511 bp, Oryza sativa
aggtgaatccggaagccgcataggccgtcgcagggcccatccaaactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtggttcattttatttaaccaacaccggagcggtggtactaatccaacattaccattagaaccaacagtctaaacattaatatgattttccccattgtgagctagttgaactaagcatggctaagcaattcctagtccaaactctaatcatgttataaccccaagctaacaaaggagcatggtatcaaaatagtatggctgtaataataggtaaccatcccatagtataattgcaaaacaaatgcgatatttgaaagaaaacattaggacatttgcaatataggatcaatatgatcaagtgacaagcatgacttgccttgctctgctgctggaggtacctcggcgactatttcgaagtacaccggagcgtcggagggatcggaatctaacgacatacaaagcaaacattgcaaacaggctataagactactgaaacagagaacaaaaccatttttaatggattctacacatttttcttgatttactgagacttgaatgggattaaacggagctcggatgaattagttatgaattttagaagattcactgtgtttattactataaaagaaaaaccttaaatcatttattgcgcaatattaaccagggctgacgtcagcacggaggggtgtggcgccgacatgcgggacccaccggtcagcggcccgggagagagagaaaggggtggcggcgcgcgggcccactgtcagcggcacgggagatggaaggggcggcggcgccacgtggcagccgaaccgacggccccgatctacccaagggtagatcggacggcggcgggagctcgcggccggacgcgcgggcacggcgcaagccgaaccggcgaccatggcgccggcggcgcagcgctcacgcggcggcggtgcgcatgcggcagcggcgcaaggcgacggccgacggcgaccgaccggcggcggagagcggcggctagaggaggagcggcggctacgcggctaagcggcgtgccacggctacacggtgcgggagagagagaaagaggaggagggcctcaccgacaacggtcgacgacggcgggcgacggaggacgatggcgacggcgggacgagctccggaacctcctaacgaacaaaaggagagggattagagggagagggaagagcgcgagagagcgagagcgccggccgaaggcggcggccatggcgtcactcaccggcgcacgacggggatgggtctccggcggcgaacctcaacggggaaggggcggccgaggtagatctcgaccccgcgaatctaacggcggcgacggcgcaagacggcggcgagcctagcggcggctagcggcggccgaagtagcaaaacggcggcggcgggtggttgcacggcgcggggacgattgggagctcgggaggggtcggcgaaatggggaaaaagtgagagggagtgccggcgatgcttaaatagggggagagagggccggacgtggccggaagaggcgggattcgccggccgacgtgggggagtggggaggagagagaggcgggattcggttttcgaatcccggccatctcgggcgcgggcgcgagcgggagagagaggggaacgggcgcgggggatgcggcgcacgcgcgggcgtggtcgacgtggcccggggaaggcggagacgtgggcgcggcggcggtttcgggcgcggcggcgcgagcgggatcggcgggaggagggagacgggtccgacaggtgggccccacctgtcggcgaccccgagagaggaggcggcgggcggcctgggctgccggactgggcctcggcctgcggccggcccagcaaggaggagggaaggaaaaagggaaacgggccgacggcccatttgacaaaaaggaggaaaaagaaaggaaaaaagaaaaagaaaaggaaaaaggatttttccctggaattaaaatattgcttgctcaattttaattggttaaaattatttctagcgctctgaaaattccactaaaaatcctgttaatgaattttgacatgtagaactcaagaaaaattccacatgtcacgtccgattattatttgcattactttcttagggttttctcctgattttacctgcattttcttggggtcatttgcaaattaccattttgacttgggaggaaaacttcggggtgtgacatccaacttgttcagttgtgtcaccccggtccctaaacaggacagtctaaaaactttatattaaaaaataattcataactttttcatgtgaactctaataaagacaaactttatatcaaaattgtagccctcgacgggctgcaggaa

SEQ ID NO: 83564 - DNA, 697 bp, Oryza sativa
gaggccgttccatgtatgcgaggagcaaagttgctgggagataaagcacggggcgtgctttgtcttctctgtagaaataaaggaactgtctatatccgttggcagaaaattttacctcttatcttttaaattttaggccacttttatcttttaaattttgtaccatcggatatgctttaagatttgtgcagagacattaaccctagctctcctcccgttcccctcgcatcgctcatttcgccgccaccatcacgcatttctccgctatgcctgatcccctgccgccaccgccccatcgtgccgccgactgcctccccaagccgtcaacgacgagatgccccgccaccaacatcagcccaccgccctcttccaacaccacagctccagcgtcgctgccagcgcctcaccgcccgcccgatccaccgcccaccgtcgggctgtcgtctcccccggccatctctatagagccggcgaactcctccccttcctcctccccctcccaccccaccccgggacactaacctgtagggtcctctaccggagtctaaagtgtcgccagcgtcagagaagaagaggaggtcgccggagttggaggagaaggccaggagcatgaatattgaagctaatccagtgtcccaaaatctgcaagatttggatatgtaatttctgtcgaaagaggttagcaatgggctgcagg

SEQ ID NO: 83565 - DNA, 2614 bp, Oryza sativa
  unsure (1)..(2614): unsure at all n locations
cattattcatagctcgagcanttcntgttagcaaccnaaacccaaatcctccctcctcgatttgttcaagttgatcatcggatgtggcattaaaaacagcaagaaaagatgacttagatgaagaagcatcaacatctgttaacaaccagatttggtaacatcagcatcaggaaagaagattagatcgaagcaaagttggaggcggagatcgagttcggaaatagagcaggaatcggctggagtccggatcggctacgattaggatcagctgggtctgagtcggactaggaaagtcgatacagccgattccgataatacaacttgacgtgtgatgtcgggttggattgaggtgcttcaaggagattgccgcacatggatagagtcctgaggaggcaattgtatctattaattaggatgctttatgtaatttctttagagatacgattgggcaaaagtctgccgcaaagacttatagtatcttagagtttgttagagatggtaatcgtgtccattatggacatatcttgtaattctcgggtataaatagaaccgagccctatgtaacttaaaaacacacgttcaatataattccggcgcatcaccacccttttttactttagttttgtttcgacgagttcttgcttttgggttgagctgcatcggtttcgatcttcaacaagaggtaaaacttgttatgacggcttgcgttcttgagattagcgcttccatctctatgatattctaatcttgtttatgtgatttgtcgagttatcatatatcttacataatctctggcaatatcgctatctaacctacaatcggctaacatctatcgaggaaggcagccgattaggttagattctgacgttgactcagattatataagatatctaccactctatgaaacttccagcggcttgattgtctagatattgttcttcttttcatacttaatgctgcatcagttgagtttgatctattaagtcatgattagaatatcaatctctagcctgtcttctggttgtcgattagggtagcatcggagtgtcagccgatcttatctgatttaattatatttgctctatatgcttcattgacatgttaaatctgccctttatgtcaagatattatttttttaagtatattaggcttctgtttgatatattttacctgttttaatatcctaatatagagtagtatcggagtattagccgatacatgctcgatctatctgatggggctatgctataaacatatatagtcctgttattaatatatattttgatctaagtgatttatacagtctcggcatggcgaccgatctatcccaatcacttgatttaagtatatatcgatataagaataatatattgaaaatatctacagccgatcgaatagatttagtcctttattgtttatttgcaactgccgatagattcacatatgacatcggctcaaagataaatgatatgtcatcggcacctagccgatcggctatcatttatagatttaaccactgtttctttgcttctatttcttgttgattacaggatcaaatcaactggcacgctagcgcacccgaaggcgagctttggacctgcactagagttaagcagatctcccaggcctcgtgttttatgtcaacacgcttttggcacgttcggtgggtccactaagaagtcagccaacaatccttcctcatggccaaaaaacaaccaccaccactatctagcaaaggctgtgttaaggaaaagatgctgaagttgggattgactgacgtcaatgaaggaaacgtcgtgccggtcgatccagaaaaattcacacctgagcagaagaaagagtttgaagcaatgttgtagcaagcacgggatcagttcgtgaactcattcatgtagacccgcaaggggacacttgttcagaagtacaaaataaaagtcgttgctgatgatcctgggactagttcttctaaggatggagatgggaaacaagctctagacggctcggctcagccgagtatcaagggtgctaccgacggctctctaggaaatcaaggtgacaattctcaaggagtacatggagtacaaggtgacggggtgcatggagttcaaggtgacggtgctcaggggatgcagggaggaaattttaatagtgaagtggcacaggactttttcaataacttccaagatcgggttgattacgctgtgcatcatgctttgatcaatcagtctggggtgttagtcaataccctatcaaacatgatgaagtcgatagctgatggttcaatagctgaacatcaggctgcaggcccggtttatttgcaaggaggtgtcttcccaaattatcagtctttgatcaccgatgttcagccatctattcaggcgattccctccgttgcacccacaactcagccggcggcgccggcatcaattcccctatctgctacatcagctatggcgccaggccagctagtgaaccctcggttgttaatgagggaacagccatagcatggcgggcaggctgccaatcggctgacccaagatcaggttgctgccatgttnnnnnnnnnnnnnnnnnnnnnnnnnnnnnnnnnnnnnnnnnnnnngacataccccct

SEQ ID NO: 83566 - DNA, 571 bp, Oryza sativa
ctcttttcaagcagtaagcagtgaagtaatcgatgtgaacacagcaagtaggacattgcactaaaaccgtaacaagtgttcttcaattcaattgttatgctagctagtaggccattactgagcaccatgatcgaagcgatttcccaaattttaaggacagtggtatgcgacgacgctacccatggaagctgtaagcacagaagggtggagatatccggtggctggacttactatggcgtgcggcaagcggagcacttgtacttggacggcgcctccttgcacacgtcgcagctcccaccagccatctccagccacctcccctagcccctagggattcctccaggcgcgacctgcacccccagacccgtctcaggtgtcctgtggctgctgcgggagcggcgaaaggagaggaaagggggaggggacgcgctgaccttttaggtgctttcagctcgtgcggctaggctcgctccacggcgcgcgacgggcgccctcggccggcggcgagcggaagagggcggcggcgccgcggcggcaaaggtaacgggatatgcgagtggaggaatgggtg

SEQ ID NO: 83567 - DNA, 2133 bp, Oryza sativa
gatttagcaccaggggtcaataagtgcatcggccgggtttgcaacgcctggtggtcagcctgtacaacaatttgtaaaccaagttgtcccagaacatttgtttcaccacgtacagccggacggcacagtaatgcctcaggttgttcctgagcacttggtgcgcaatatccagccgaaccttcataattaccaagggggtaacttgagttatcaatatcagcctccttccccgcaagcccagtatcagccagggggattggctgaacctcggtttgcatctcaatatggttagttcgagcccatgcagcaacagccacaaggagcagctcagcaacgaccgtgggctgatgtgattgctgatgtgatgagggaacagtttgggcttaaaccaaaagagactggaagcttgtatcggcagccttaccctgagtggtttgagacagttcctcttcccaatcagttcaaagttccggacttctccaaattttcaagacaagatgatgtgtcgacttatgagcacattagccgattcctggctcagtgtggtgaagcatcggctatagacgctctgaaagttaggttattctggttatctctgtctggatcggcttttacttggttttcctctttgccatatggttcgatcaatagttgggccgatttggagaagcaattccacagctatttctatagtggggttcatgagatgaaatgatctgacttgacggcgattaagcagcgcatgatgaacctgtgcacgagtatattcagagattcagggagatgaggaacaaatgcttcagcttgagtttaactgatgcccagttagccgatctggcctttcagggtatgattgctctgattagggagaagttctcatctgaagactttgatagcttgtcacatctgatacagaaagtaaccctgcatgagcataggtctgcggaagttaggaagaactctaagagagttaatcatgtttgtccatacatgtataggtaggatgataatgaggatgattctgaaatagctgcggccgaatgggtaaggagtaaaaaggtcataccatgccaatgggtgaaaagttctggaaaagaagagaaatacgattttgatattactaaagctgacaagatctttgatctgctactccgagagaagcaaattcaacttcctgctggaaatacaatcccatcggccgaggagttaggcaaaaagaggtattgcaaatggcataattttgggtctcattctactaacgattgcaaggtttttagacatcagatccaggtggccattgaggggggcaagattaagtttgatgattccaaaaaaccgatgaaggtcgatggtaatccttttcctgttaatatggtgcatacagctggccagacagccgataggacccgcgcaaggggttttcaagtgaattcggctaagattatcaacaaatatcagaggaaatatgacaagcagcaagagaagcattatgaagaatacgatgatggttttgatcctcattggggttgtgaattttttagattctgctggaatgaaggcatgaggttgccatctattgaaaactgccctgggtgcagtgatattgtcgagagctcaagccgatcatataataggggtaatcggctaaggcagacaagggtttttgttcatcaaagattaggtcctgtgaatcaagaacatggccaagaagacggtgtggttaggaagaatcaatggtgtccttctggtattttcacgaagaatcagaagagaagggttcaaagattgaggaacagagaacgccttcaggaggttgaacaagaaattaatcatcggctgaggaaagcaaaaccgaggcaggagtggcgtgttaagaatcaggttcctctagccgatgatgttgcagccgatgaggcaaaaaggttggcaaaagggaagagtgttgtgacggcacccattaacatggtctttaccttgccagccgaattcgggatcgatcaagtcgatgtcgacgaggtggaagaggaatcggctaagttggttctttcaccggaaccagcaattgttcgagaaaccctgaggggacagataattcgcatctttaaccattggttataaaccgctatgtcaatg

SEQ ID NO: 83568 - DNA, 8456 bp, Oryza sativa
  unsure (1)..(8456): unsure at all n locations
ttcctgcagcccaggcatctgggcatagtattaaaggattaagggattatgacaagacagaataaagttcaattaaaggagccattcatacatgcatatgaagcagctgttttgtgtgagaccaaatattttacctcatcctgtgcgaagcctgaagcttccagttcagttagcagttcccttgccttctcaaagagaccacctttagaatacacctttaacaaagtggtgagtataacctgcaaatttaatttaatttacaaattagaatggcaacagtagcagaacattttcggtgaacaaccaaagagcaatatatgcaagttcagtaaagaaacaaccaatcaagataacatgtagttatagttgatatgtggagacttaagaggctttttaaaaaaaaaatttatcctggagcactacattccaccttaacccaagctatcgaaagctctattcaatacatcacgtgccaagcggcaagtaaacatggtaccacaactttgatggaatttgatgtgcaagctttctctacttagtgtgagaatgttctttccaaccatggcatttgtttagtgcttattgatggctatcatagggcagtatttgtttttcatatacatcgacaggcatcattcacagacattacgcggtgaagttagaaggcactaccgcactagtaccaaataaattatgcagctggagaaaccaacttttgcaccaaaacaccaacaccatatactatgcaagctacaacctgtatgtgctatctagcatttcaagtcatccatagcaacaaactatccaacctgtggtgtaggtatgcattatatctaatgagaaatcaattctactgccataaccaaaaagtgaaataacaagactggggtctcctgcaaatcataaaactcagcaacagagttaattaatactccctctgttctacattataagacgttttggcctctccattcttcgtctagattcactaacatccatatgcatttagacacatatgaagtacatatatgaatccatgcataaatctattagaaaacaaaatgtcttataatgtgaaacagaggaagtaaataacaagaataagaagcaaaccttgttcggtgttaaccctgaggacctcaaatctttcatcaacagatcagccttttcataattagcattttctgaatatgcattcaacagagagctataatggaatagattaggcttgtgtccttcgtccttcattttctgaaaatattcctcagccttctcgcagcagttatgtgacgcgcatatagccaggagagtgccatatattacactatccatctgaaaaccacgggaattcagctcattaactaattccatggccttagtgtaaccctgcttcaacttcatgcaccctgacagaagctagaagtgacaagagaaacaattgaaatgctacaccaaccaaagtaccaaactaaatgctaatcagagaaaaagaaaaggtcatagtcccatacggtactgtaggtgaacagatcgggtgatagaccttctcgtatcatctcatcataaagcttgaagctgctatcgaacctcccgttcttcaccaagcacccgaggaccgagttacaaacggagacatggatccttgtcgggttttctcggatagcaccgtacacttgcagcgctcgggcagggttgcggctcaacccaaggtacttgaagtaactgctgtaagacgcaatgttgagcatgtcgtgctcctgcatccacccgaagacctgaaacaaagttcagactactcatgcctcactagtcccatcaatctccactcgcctgattgaacttgacaaccactgaagactaccttagatagctcatcccagcgcctggtttcaccgtagtggcgcaggattatgttgcagtcctgtgtctgcagcacatcctcgaacctgtacagcatcaaaggtcagaattcgcagaactaacaactccaaatcgagcaacaataatcctaccccaacacctcagtttctcttgttcctccctctgaatccacgtttcgatatatccaattcgcgcgaattactactacgaagacgaaaatgtagaatgctccgatagagctacggagaagcatatagtgggcggcgcacctggtgagtgcggcgacggggtcgggggcggccttgacctccgcgacggcgctgcgccgaggcgacggccgcggtggcggcctcgaggcctgcggggcttccagcgcccggggggcggcgcgggcgcaggagatgttccgtcgggagcagcacgccgccgccgccgccgccgctggcgttggatgaggaggaggggagaggaagcggaggcggggagcggcagcgacgcggcggcctccatctcgccgccggcggggcgctgctgtgttcgcggcgcgacgcgtctcgtccgttgggaattgggatagggccccgaggcggagggaatcgggggattgttttccccttctgggcttgcttgtatttgggaagcgcgggactgggcttatggagggataccgggcccgatccacgtggaatatttccccggcccgaccttaataatattggtataaagacaacagtttttgctacagcatataagagtatttgccaatattttttctcccaaaaattcgatggatataaatatagtgcaatcgtaatgtaattacatcgtaacttgtatataactacaatatacaagttgaatgcaactttcaaaaattttgtgatatcatgctattttcgccaagcggaggtctaagagaccaaatcctctcgcttgtgtgcgtgctgtgacttttttcatctcctcttgcatgaatctttaagcaaatttaaagatttcaaaattacataaaagttatataccagttacgttgtaattatgtgtaagttataatataattacaactattattgtattgtatttacattttacaaatgtttagaagaaaatttatcaacaaatgtatagatattctaaaaaccccaaatgctgattttcacggagggcgagagctgggcgattttagggtttatggccggatccaatatgcttgatctgtgttgatccgctcgtgattggtttggtttgttttcttgagttgattaccgctacgtattgtatacgggagcggatctaattctgtttttgactgggacttgacctgtggtcttgggcctggtatcgacgttttcctgttgactctccggctgcaaaccctagtttgttgcaactcgtcttgacggtggtggtctgttttcttccacaaacttttctcttcctgacggtgggggcgactaaggggattccagtgaggtttctgcctgcccgaagccgtcgggaagtttagggttttggaggtacatactgcggcggctgttctgagtttggatcaatggcatcgaaggagaatagatccgaggctatggtttcgggggctgacgggataaaccaaggcgaaaacttggatccaattggtgagggcttggatgatcatcatggcaacctagatcagggtttgtcgagcgccatggtgcttttcaaaaagaagctaactgatggtgaagaggaagatgacgatgtcttggatgtggaccttggtgaagaggtggaggagatgaaatctaagtggctgatcattgctcgcttctactcaggacaaaggtacaatgtcaaaggcttgtttgaggagatgagtattgcttggaacctgacacaacagagaaagactcggttctttgggggataatagattcttggttgagtttgcttgcgaagctgactacaaccgagttgtgtatgggggcccttggaaacataagggtgatgctcttcttgttgtcccgtatgatggccttgctagaccttctgaaatctgtattgaatcgctccctctgtggttacggatatacgatcttcctgagattatgatgactactggtttcgctaggagtttgggtggaaagatcggggaggtactggaggtaggaggagctatacacgacttcctgcgggttaaagttgcttttccgctatcctctcctttaaaacctctgttgaggatttggattaaggataaaggtgttatgtcttttccagtgaagtatgaaaatgtgccttttttctgtttctcgtgtggacgaattggtcatgcagagcgggaatgcccggaggtgggatcgtctagcgctcaggtgcgctttgggaaggagcttcgagcttcaccgttaaagaggaaacttcagagttttgctccctcttcaatctctaccccaaaagctgccaaggtgctgaattttagtggtgcccaacgggagaaggttcttactgcctctagttcttctaaagcttctgtgcttagtaatccaaagttgaacagcggtggcgcgactatgttcttggttggggagaaagcggatcaggaagagaaggcggccagtgttgaggcagaagcctcgttgtatccattgccgaagggaatcaccgcagctctagaggaaggtgtctctcagatgaagatgcagttagacgatggtgagctgaacttggcagctcgggggccatgcagtagagagcgagtgtccatgagttcagattatgggctgtcgggggaggaaacaccgcaacatagtgccgggattgtctctggtgtggtgaaccaagatgtaaagtcccctggcgggcaatccaaaaagaagcaatgggtgccaactagggagactgatcgtgcagttaaagctaagagcctatccataggcagggatattggcaaaccaaggaagataactgtcagattatcagcagatgcagtagaagcgtacgaacgggaggccaaatcctagagatcgagttccgaacggtctggtggaaatcctcctacaggagtcccggctagtgttgacactgatatggtgatggataatggtgtgaagaaggaactgtatgcagattcgggaacagctacctggtgggcggctcacggcgagccccaccaggaacaatgaatgctctagcctggaactggtccgtcttgtgcggatgtacagcccgaggctggtgtttctctcagcaaccagacaagatcaggagagagttcagggtctcagatggaggctaggtttgaagaattgcctggccttgaaaggagaaggatcaggtggtggagtggcacttatctgggatgaaactttatctgttcatcttttgtctatgagctgcaggtatattgatgttttaataagtgaagcaaacagcggtttccaatggaggggcacctttgtgtatggggaaccaaggatgcaggaccgccaccttccaatgctccctagttggtgatgggtgatttcaacgaaacaatgtggtctttcgagcatttttcggcacgacagcgccctgagcctcagacgagggatttccgtgatgtgctgtcccagtgtgatttacacgatattggttttgtcggcctgccgtggacatacgataataagcaaaaaggggaccgaaatgttcgggtgcgactagatcgggcagtagcctctcctagttggtctgaccacttttcgggtgccaagttgacgcatttagtgtcttcgaggtccgaccactgtcctatactgcttcgggtggagagagagaaataccgacctgtcaaatgtttccgctatgaaatcatgtgggaacgagaggattctttgggggaggctattaagctggcctgggagcaggaaggtaccgctttgaatcttggggagtggagtgtcagggtttttggttctgtgtcgcaggagataaaggagatcaaagctaaggtggaggaactatcaagtttggatccaattaaccatgacggtgagattaggaagttgtatgcccgcttagatgagctgttgtatagggaagaaatgatgtggctccaacgatcgcgggtgtcttggttaaaggagggagaccgcaacacaaagttttttcaccgccaggcagcttggagagcgaagaagaataagatcgattgtcttaaagatgaggatagtagatatgtcgagaacaaaggagatatggaaaagttaacgagggatttctttcaaaagttatatgcaagagatgagggagtggatcctggtgagttagtggacttgtttgatgtccgggttgatgcaagtatgaacttggagctttgtaaacctttttcggatgaagaaatttcggatgcactcttccagattggacctctaaaggcgccgggcccggtggttttccggctagattctttcaacgcaattggggagttttgaagcaagaggttataggtgttgtccgtagttttttctccgaagtggtgatgccagttggtgtcaacaatacctccatcatcttgattccaaagatccctcaaccggagcagctgaaggatttttggccgatcagcttatgcaacgtcatatacaaagtggtttctaagtgcttggttaataggatgagaccctcttncntggtatcatctcaccaaaccagagtgcctttattccggatagaatgatcacggacaatgcgttgattgcttttgagtgcatccataacattcaacgggaatcgtcgatggggaaacaattttgtgcttataaacttgacctaagtaaggcctacgatcgtgtcgactgggaattcctaaggtgtgtccggattaaagtcggcttctgtgaaacctgggtgagatggataatgacctgtgttacaatggtgaagtattccgtctctctcaatggtaatctgctggaaccgttttcgccaacccggggcctacggcagggagacccattatcgccatacttgtttctttttgtagctgaaggcctctcgacgattctgaaccatgaagtggttgctgggcgacttgaggaactgaaagtttgtcgaagggcgccgggggtttcccatttactctttgctgatgatagcctgttgtttgtcaaagcatgcccgcagcaggttactgtggtcaaacaagctttgtcgttgtttcagcgctgcaccggatagcttctgagcccaacgaagtgctctttgctaacaagtgctcactgtcctagtgatgtgatcgaggaaatcaaactgatctttcaggttgaatctgctaccttcgagagtaattatttgggtctccctactctagaggggagaatgacggcagacaaatttaaaacaatcaaggaacgcttgatcaaaagactgaatagctgggcagaaaagttcatgtcgtcgggagcgaaggatattcttatcaagttcgtggcgcaggcaatacctacctatgtgatgggggttttcaaactttcggtgtcatcctgcgaagcttacactaaactggtgagagacttttggtggggtgacgaggaggataagaggaaggtacattggacagcctgggataatttggttctccctaagtgcatgggtggactcggatttagagatgtcagaattttcaatcaggcgctactggggagacaagcctggagattaattcagttcccggagagtctatgtgctcgcattctaaaggccaaatactttccaaactgcgatctgattgatgcagtgttcccagctgatacatcgcagacatggaaaggaattgaacatggaccgcaacttttaaaggaaggactgatctggcgcattgctgatggcaagagggtcaaattctggaaggaccgttggatcccaagggagtcctcttttagggtgtcaggtatgaaaagtcgatgtcggctccgatgggcatcacaattcatcatccctgaggggaattgttgggacgaacagctaatcaggcgggtctgtcatccttttgatgccgatgaaatgttaaagattaagttgccccaatttcctactgatgattttctggcatggcactttgagaagtatggaatgtacacagttaggagtggataccgtgctgctctgatgaagcaaatcaatacggactgtgtctcttttagctcggctaactctggtaaaaggctactctggcgagccttatgactgctcctgtaccaccaaagatcagaatttttgcttggagactagcccgtaattgtctggcaactcannnnnnnnnnnnnnnnnnnnnnnnggtgagggatggtaaatgcagcctgtgtggtgtggaagatgaggatggttttcatgccgttgtttcttgtactcgatctacagccctgcgtactgagcttcgctgtgtctgaaatttgccggatgagcaacagtttgaaatgatggtccagactggcttctgattctgcttgatagactaagccctgaagagcgagcaaagctcctccttgtcctgtggagctcctggttcttaaggaatgacagcttgtttggttcaggttcatcgactgtccatggctctg

SEQ ID NO: 83569 - DNA, 2546 bp, Oryza sativa
gagattatgatcggacgagacgtaatcagggttgcatttaccgcggtaaaccgcgcggttaccgcggttaccgcgcttaccgcgggggtacggtaaggggtaaaccgcggtaaccgcgtcaaattcaaataaatttgaaaaataatttgaatttttgataaattttgtacggtttgtcgcggtttgtcacggttaccgcggttaccgtgcggtaaccgtgcttaccgccggggcgcggtaaccgcggccccggcggtaaatgaaaccctggacgtaatatgttgagatggatggagtaattgcaaagggccctgccaggatgccagaaattcaggttcgcacaacttgagcatgaagctgagggcctgtttacctcaatttttacaccatcaagtattaaacatagttttaaaaaataactaattacacagattgcgactattttgtgagacaaatcttttaaacctaattgctccataatttgacaatgtggtgctacagtaatcatgtgctaatgacagattaattaggcttaataaattcatctcgcagtttactgaccgatactgtaattagtttttttattagtgcgcgaacaccacatgcaacaccctatataatatccgatgtgacacgccaaaattttacacccctagatctaaacactccttgaagtaggatcatgttttgatggtgcaggatgtgcaaatgagactgacggtgccagtagttgatgaatcagaccatatggatgccgttgaggatggggataggaattgcacccctgaagcactctggtgtcattgacaagcaacacaaagggcaaaaggtgacctaagggaaataagccgaagaaaaattctagatatccaaaaagtcttaactcaaggcagaaagatttctggggctctgctggtaatagagtggttaatcctgtcacagagaagagattgctcaaatgatggatgctacattaaccaaaataattccattcaaagatgaaacctgtgaatctccattgtttagcagtaaactagaagtagatgaactctaagctataccgggagttaatgaaaagtgcaaacctattacatgtatagatacaactagccatattctccacactacaaggccttgtagttatacatgtagctcctcaaggtgttgatatcttgcattgactccagcatagagtggtccacatagaggctcaatgcagaagcactgcccaacaatatagataaaacgaacaatgttattaacaagaaatgatcctcttggtctgtgaaaaacagatagaaggaagcaagaaagcatacatcaaagggccaaacgggagccatgctacatcccatcgaattctcggtaacctgtagcacaagagtaaaaccaatcaaccaatcaaattacaagttctagccgttgatggttggttagtactgtttatgtggtcatgcataaaagaccattatcataaaatggtaataacaatgcacaaagcaaatagttactagtagataatgtgatacctcaagaggtagtatgtccagaagagggctactagtatgctgacatagaatgaataccacatccacttcttccaggagtgaagtaatcctttaattgagaataaacatgctagggcagctatccaatctgcaatattcaaggtaaggtattaatcatatcacaagggaagtaattttgatttagcaggacaaattttatgcctgtaagttccacattcttttatttgttttggtataaagtaaaacaagaattacagagggaatgagtttagatgatgattaaccaacaggatcaataaatgcatcttgtgtaatactatcatgctataagtgacatgttccctaaaactccgagtagaaaatgtttgcagactgctaagtcattggaaaagaaaatagtatgataaaacaaacaagagcaaattgtagtttgcgcattgcctttgttgcaatttggaccaccccaaacttatcttttcagcacatcaacgacctcgagcgttttggctccaacgtgccaatgaactctcacccatgcacaaggcatatttttgccataggagtggttagacatgagaagagaagagagttggggtggtccaaagtgcaaaaaaatatagcaaaggcaaacttgcatttgaagttgctaacttgagcaaataagaaagacacagctggctcagtgccatcagctatttcaatccaagtaacatgtagacatttcattatctgtacttgtatctaaaacttccaccctctctctctattttttttttacttttgtaacagagagaacctctggttcatttattgtgtgcaatgcaaatatgatgtaagcataattacctgcaactacgaccatcggtgatgacaaatcttccatgaaataagcatgataccgctgtacattagagaagcatgtgtcaaacaacatgacagaagcacagcgcaatgcaatcgctagacagtcattacaaagaaaatcattaatacatggtatagcagatagcaccagtt

SEQ ID NO: 83570 - DNA, 4641 bp, Oryza sativa
cagatcggtaacggctatgctccagtgctggactgccacacctcccacattgctgtcaagtttgctgagctggtgaccaagattgacagacgatctggcaaggagctggagaaggagcccaagttcttgaagaacggtgatgctggtatggtcaagatgattcctaccaagcccatggttgtggagaccttctctgagtaccctcctcttggtcgttttgcggtgcgtgacatgaggcaaacggtggctgttggcgtcatcaagaacgtggagaagaaggacccaaccggtgccaaggtgaccaaggctgccgccaagaagaagtgagcctcgttcaaatggtggtttgcatgtctgcagttgagatatctagttctagtatttgttaagttttgcccacggccatggctctcgtttcatggaccgttaatatctgctcgcaatgtgcactatgtcagtcgtttaatactcgtttatttctgttcggttaaaactgatgctctgagtccgattattgtccatcggctgttttggaatgcgagtatttacattgctacttcctgtgtcgttattttcgtttgtgctattccctgcttttgctgctattgataactggaaactgtctctgtcattgaatctcagacaagttttctgctattggaaactgaaagcctaatggatttcaattatgatgattgctttttctgcaactgccacctaaattgtttatgttgaagttcgttcggtcccatatttgttagaaaagggtcggggcctcgggggtttgcttgaatgatgaactggtcggaacttgtagtgcttcaattgttgtgattttgtttccaacaggatgtttacagcctttttaaattgagaaattagcctctcaaacaatctaatctgaaaaccttttaaattaagaacttagcctctcaaacaatctaatctgaaaatttgatcctactatgggaggctatatgtcctttcgtaagatgtagattgaacttttgtcatatacagggtatgaagtatcagatggaacaacgtagattgaactcaagtccttgattttaactctaaagatcaattaattcagtccactcaaaatgctgataatggaataaccctcctgggaatagatgttttgttgatgcttcttggaaagatcaattaggatttggaatgtttttgcatgatccacagactcgtaaagcgatttgtgtccaagctagttcaatactttatactaatgctctccaagcagaacttgcaagtatatacttagccattggcgtatgcagaatgcttaacattgcaggtatggttatgctttctgataatttgcctctagtgaagctccttcgtcaaaggaattttgcttcccagccacatcactggagtcttcatcctctgcttctgaaattgcaagattttactcaaggaaaatcaattagcatggtctggaactctggatataaagaaatctaaacaagatggcagatttttagaaaaagggcaagagaagcaaatgctcgtcaatctgtccaactagtttgtcaaaatgtatgacatgtctcgcttcaaagtagctgtgctactacggcagctcttcaatcagcttttatagctgacgatgtacaactgattcatgtactgtgcttctaagtttccaataaactttgttctaaaaaaaacatagattgaacttttgtcagatattgttcttaaaaaaaaaacttctgtcagatattgaggacacacgtctgaagtagtatcagatagcacaccgtttccacttctgttaagccctttcattagctctgaaattagttccattgctgctattacaataataacttttcatgagaaagtaatcaatctatttaaccttagcccccatcttgatgaagtttgggggccgtgagaatccactttccgggtgatttcagctgtatgcgtctgtaagtatatatgaactgtacaatacaacaaatattgttaacagaaaaaaaaaaggggctaacctgcttaaacctatatacgggtggacggttgagccatagttgttggtccctaatatgatcatgtccatacttagactgtgttctttcctaggtgatctaggtgattatgagtgagttttgtttcgttttccgcgcgcacgtttcccgaacttctaaatggtgcgttttttgcaaaaaaaaaatctataggaaagttgctttaaaaaatcatattaatccatttttaaagtttaaaatacttaatagtcaattaatcatgtgctaatgactcatctcgttttacgtatctttcccatctcttctatctcctctcctcaaagccttagagcagttcgctaattcctatcctatgtagttttttcgtctcgtgaaacgatccatgtagtacagctgtcttgtgaaacgatccgtgtagctgtacaagtaaaattgctgacaataaaaatcgagcacacgataataccaccaacaaaggctgcccaagttctcgagcttctcgtgcctcttcgagtcgtcgggatggcaacgaaagcacctctaacttgagatcgcagatgtgatttagttgctggtgctagggtggtgaaaaaacagtatcttattttaactccacctctccacacgaaaaaatgttacccattagtgcgtgattaattaaatattaaaaaaacttaaaaaattattaatataaatttttaaaataactttcctatagaatttttttaaaaaaataaaatgtttagcagtttgagaaacatacgtgtggaaaacgagtagaagttgggaaagtgagggaaaaaacacaaccacgctatacaatgacatttttgtgattaatggaataataactccttcctctacatcgtgggatgcgctcgaatcatacgagagagagagcgcgcgcacgtaacagtataacccttacatttctccctactctttcaactgtctgatgaatcctgatagtattaagtgtagcaatttcttcttggtggatcctgacaattaaccaaaaaggaaaaaaaaatcagtacttagattgtacagataggcatacaacataaactaaagttgatacagtcctttcccgcaaaagaagttgataatagtcctgtccataccgatattttcgggttttttttttacttattttctcctcgaattgttgggctagtttgcaaaaaaaaagtacttagattgttgggctagtttgaaaaaaaatcctcgtatatattcaaaacctttcatagttgtgtttatttttcgaaaaaaaccttgtctataatgcgaagagaaaatctcatttctagtctagaaataacgcaataaacacgaaaagtatataaaattttccgcaaaacaaccatcgttggagatatagggtctgtggtcgtgttgtagatgacatcaatagtgtcccacacacgcagcggcggtgtagccatagctgcctgcctatcgatcaggtccatatttgtgtttctgttgaaaagtttgagaaaataaggttaaataagttagcacggtcacgttaccttcataaaataggtccagcagaccagcttttcgttttttaaaaagaggagcaagtgagctacaactcgaagaggcatctaattcaaaatagggtcgaaagcgtagtgcaagaaaaaaaaaagtttgaattaggtacctacttgcgccctgcgaaacctccagagacgtaaagttaacgcaaacgtttgaacaggctgaccacaggattaaaatcgaacggtcaatactgccacgtaacagcaaccatcagacaaagatcggacggctaggaaggaaccctagcacccgtggctgcctatataagaagcaatcctctcgccccaacccctcccttctcccgtctcatcccagccgccgccgccgcagcctcctcctctcgtcttctccttcgaggtcagcttcagatcttctctcttctccatatttgcgcttgttcatgttcgttcgtagctgcagatctggtttagtaacgtgaggtttcggtgatttcgagctggggcatgttgtgttcgcccattttttgtaacttttttctgtgtattcatctcactgcaatgatcttcgtctgctgttcgttgacgcgacgataaacttgatttgtcagtgaatcatctgcataggttgaaaattatcggcagaatcggacgatgaacttgatttggtgcagaatcatttacataagttgaaaattatcggtggaatcactagaaggatttttatctacaatccgttcgcatagatctctttccgtgtttctgtaattttttttattctactactgctgagtagatgttatcgtctgtacccggtttggttgggtcgattactgcgcctctgtgcaaatcatccgccgattagctgcgttagcacttttatagctgcccaagtttgatctgtgagcttgcctgctatatttatttagagttgtaaattatacacttatctttgtttctaatatttgtttcgttctgtgctgcagttgttagctccctccttattcaaccatgggtaaggagaagacgcacatcaacattgtggtcattgccacgtcgactccggcaagtcgaccaccacgggccat

SEQ ID NO: 83571 - DNA, 732 bp, Oryza sativa
  unsure (1)..(732): unsure at all n locations
cacgcggttgtcatctgcctccacctccnnnnnnnnnnnnnnnnnnnnnnnnnnnnnnnnnntaatccagtataatatctctatatggacacgaaccgatgaaacggccggatggatatatatatatatgcaggtgaacaacgctgggacggcgtacctgaagccggcggcggacctgacgccggaggagacgtcgaggttgatgacgaccaacttcgagtcgtgcttccacctgagccagctgttctaccctctcctcaaggactccggaagaggcagtatcgttaatatctcgtccgtcgcttctgtcctcgcgttccattctcttcctatctactcggctgccaaaggtaaaaaaattaaactcccactctgtatgctatggacttcttgtcctattgcacaaaacaacaagcctagcttgcaaatataatttcactgaactgcacctcctccttcaggtcatatatttgacgacgcttaagattagattttgtttaacttttaaatttccaacgtaccattagtttatattattagaataaggttgtaaaatttaacagaaatttatggtatgatggtatagtttgaggcaaatacatgtataccgtataggatgatatttattacattctaaatgtatcgcgtggaaacggtataaatccaactccatctatctagtttattttgtgagagccgtttacccaactcaacttccactanaggtggatc

SEQ ID NO: 83572 - DNA, 2919 bp, Oryza sativa
aattggcaatcctcaaggaaacaattttgtaactaatccaacgcaaccgaactacggcatgtgtgctaccatatgccaattccgaatcttatgccaatcaatatcaagcaataacaatgagctcaaccaagtgatgtctaagcaaagcgccatgaaatggggaatgggggtgacggacagtaagtaaaccaaccagttcccacggggccgccgcatggtgaaagccggagtagacgaggaaggccgcgtagccgaggaggaacccggcgaagacgcgctgcacaacacaacacaaagggaacaacaggccatggccgggtccgggcgtgagcagggaggaccaccaaaccgaatcgaatcgacgaaacaaaaccctaagccgaacgagatcggggatcggcagtgggcgcgcaccctccaccggcggctctgctgcgcctgcttctgctccagcgaccggaccatctcctcctggtctgcgcgcagtccacgaacgggggtgatgacaacgagagagggttggggaaggagaacggcgcgcgcgtgagatggtgcacaccttggatgtccatcgggatgaggtcgtcgccgtcttccgcgccgtcgccgccgccgccgccgcggcgcttccaccacctcctcgtcgccgccgtcgtcgtcgtcgtcatccgctccgatcctgggttggaggtccgaggtttctgatttggaatgtgatttttgtgaagttggcgtttccttctcttggaagagatattgtccggtcgacaattcaggtcgactttggctcaaacgaattcatatcaattttagaggattttaattctatagaaatttttctaatataattttttaaatcctataaaatttctatggaatacctcttatcgtgcaagttttaggggaaatttaacatcaggtaaaattcatggaaagaatcaagtgatttttttatctctcatcaaattcctttgtttttcctatggtaattctctgttttacacatgtatttctatctgaatccgtttttcacttgtattcctatctgatcctaccctttttttatttctttgatttttttattcctgtgattcaaaatagccctcaatatacacaccgtggcaaacagtaatggtctattctcctttttttcccctcttttaataattgattaatggaaaatagctgcttctaatgcatgttttgttgtgttcacaatatagaccaccaagacagtttgtcatgcacatattttatttttttcccagtgtactactaatgcactccatcaatagaaaaatagagttttatttttatttttccgattacacggaacaagcacacgcacacatatcacatacccacgagtatccttgatcccaaatcctattaaaaacacatctgcatgtgtataatattgtccctaatatttatgagcactctgatttaaccagaatcctactggaagcccacctacgtaatattcatgggccctccttgatctcacaaataagagtatgttcggataatccccttcacaaggtgtaaaattatttccaattcaatcccctccaattcctcgctctttggattatccagacaagacaagcctttaagggggcagaaattgagatatgcaaacgcatagacaacccaacataccgccgtaactttccattaatattgagtttgtttcagctcactgctctcaacaaaaaactcatccgctgccttactgcccaatcaggcacatataaaggcaaaattggaaaaagaattgcctcactgtaatgtcgattaatacacatgccctttttcccattcggtgatgtttgcttcaagaattaacgctcaagaggggttgaaagggcaagactttcgaaatacttcatggcgcatccccttcgtgtatctctccctcttcaaatagatcatcataagcaacaagaacacgaatcctgtctgctaatggtttgcgttcagctttgttattatcaggtacatgtggtgacttctccgcgtcaattaaccgctcaggatcatccgatacttccttttcaccatgtggttcaatatcctcgtcaattagcgcacttccctgtgagcttgcatcttcatttctgcttgtttgcggcctgccttgtttgtacctgaattgcttctgaaaggagaaagcaggtaaatcaattaattagtaattaaacagtggtagtggtacaaagacgtaaacttgtgatgaattattaacagctcataatacaaaaaataccatcaataacaatttacgtaaaggaggtttagaaatgactcatgatcaacatagttggcttggataatataagtttgatggttatatttattttacgtaaaggatagtaatgaaagcactaaaagcatccaaatggaaggaatgttaagaaaaacaagcatgttcatgacagtgtcatacctcaagctcccttcccttcgccataatttccttatatgcctttggctcccgtgacttcaagatgttccacaggattccaccaccggtgcggaagcgacttccatcagcaacaatctggcctccacacttctggatggcctcaacctggaacccaatggctttaataataatagataacaacttcagaaaagtaaaactaagaatattacatactattcaccacaactgtgatttaacatcacctacaccaatttatccataactcgaatgatttttgggcaatctagacatttcatgtttttcttacatacaatctgaattatataacatatacataactatgaacagaaacttaactgcaactggatttgccaccaatcaagtacgcagattgcaaatattattcagactcttctgagaaacgccaaacttctcaagtacacttaacaaactaatccatgtaactgcaa

SEQ ID NO: 83573 - DNA, 515 bp, Oryza sativa
tgatatgaatatttcccaaagtctaaagttgtaaaaccacctaaggttacctaattaaagcgaagcatctacctaaaatttatactagggataccatgagtaaagtgtccactagttgaggttttgcttgtctagggtgaacaaggtaatagtaataacaataacaataataatatggtcataacaaaggtaaataggcatggctaagtaaaacagtgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaa

SEQ ID NO: 83574 - DNA, 3841 bp, Oryza sativa
tggtatggtggtgacctttggtcccagcggtctgaccactgaggtcaagtcggttgagatgcaccacgaggctctccaggaggctcttcctggtgacaacgttgggttcaacgtgaagaacgttgccgtgaaggatctgaagcgtgggtacgtggcctctaactccaaggatgaccctgccaaggaggctgccagcttcacctcccaggtgatcatcatgaaccaccctgggcagatcggcaatggctacgccccagtgctggactgccacacctcacacattgccgtcaagtttgctgagctggtgaccaagatcgacagacgatccggcaaggagctggagaaggagcccaagttcctcaagaacggtgatgctggtatggttaagatgattcccaccaagcccatggttgtggagaccttctctgagtaccctcctcttggtcgttttgccgtgcgtgacatgaggcaaacggtggctgttggcgtcatcaagaacgtggagaagaaggacccaaccggtgccaaggtgaccaaggctgccgccaagaagaaatgagcatcgttgaagtggtggttatgctggctgcatttgagatatcttagcgttcgttaagttttgcccacggccatggcactcgttgcatggaccgttaatatctgctcgcaatgtgcactatgttagtcgtttaaaactcgtttatttctattcggttaaaaacttggatgctctgagtcttattgttgcccttcggttgttgtggaatgcgagtacttacagtgctaaatcctttgctctttattttcgattgtgctatttggtgaaaactgaaagctcttttgcttggtgaaatctgaaaactcttggtacttttgaaatctttaacttggtatttcaattgtagagattgaaaactgatacctaatgctacccaacggtgtttaattgaagctctttttgttccaaattttgtgctgattggaacattatttaggcatatgactggatttcgcttaaatatgaactgactgttagtagtctttatcagatacatcgagtacactcgtgtcggatagcagctatgtaaactgtaccatcgttgctctaataacttttcaatgaaaaaaaatcaagctctaataacttttagtcccccatgataatgttttggggccgtggcaatacaacacttgggtgatttaggctgtatgctatatgaacagttgacaaaaggctaacttgcttaaaatctatacgtatggacgcttgcgccggagttgatggtcactctatgatcctgtacatgtgtgcgatctcaaagcagttcgccaattccatcctacggatgcggcgatatgcaaactggaccaaatttgatgcggtctgcgagcaaatttaattcagcctggagttcagatcttcccgttgtttttccgtactctgaaatgatccatgtagttgtagaagtaaagaattgctgacaacaaaaatcgagctcagggccatcaatccccctacatgataccatcaacaaagacaatattaaagctcataattttaagataatggtgggatgcaaacaaaccatacggatactgaaatggtggagatgcatacaatagcggtatattgtacctgatagagatggtgtcatggcgaaatcaaattgaggcagcaacaccccggcggcaatagggatagctactatgttatatgcgacagcccaggctaaattttggtgaactttggccatagttgctttcgaaagtgataaagcatccattacctaagccgtagggtggttcttgtttattagcacgaatgccacttgaactatgcagttacaatatcatagagaacagaatcctacctgagaaagtctgtttcctaatagaacaactgaagccgcgtcagaggcagcactctcttttgagtttgttcgcatagctactcccacatcagcagctgctaaagatggtgcatcatttattccatccccaacctatgcaacagcaaattccactaagacaataatacagagtagtttcatccaatctaaaactttgagttagtcaaactttaatttttgtttactatgctcaacatttaaacactctccgaaagtcaggacgcggaataattttagtgcaggcaatttcagtatgccatagactagcaacaactgtacgtgctgtcaataatagataaaagcacatcacagagcattaccattgcaacccgacgtccctctccttgcaatgcagttataatgcctgccttttcatgtggagttaaggatgactttatgttttcacttctgatccctacagttctcccaatgctttcaactgcttctttcctgtctcctgatagtagaaatgtcaagatttcttcctgctggagcctgttaattaatcagaaagggaaaatacagtatttaaattatacagacaacataattagtaatagatgaacatttgcataaaaataggaaaaaaaaaacatttgcaatatgcgagattttaggatgcaacatctttttttttgtggatatcactcaaaagggttgcatgtcatatagagagtagatgcagcattcatagcaaatgtccaaaagtataagagaaaactatgaattctgaatatgtcccgttaggaagatatgtttgactgaattatgataaagcaggagacactcgataaatatacagacagatggtatctgcagtaaatacctgtccacggttgctttggcatcatcacgcagaacatctgatacagcgatagcacctattattccttctccctcacggccaacataagcaattgattttgagtgattagatgatgcctcactggaagacacaaactctagatgatttccgagatctgtcagttcagttgacgatgccttggtctcaaatcgattgtggacccagtccaaagtgcctactgcaaccaagcacccatctacttctgccaaacagccaaaaccaggctctgtaagttgaccacttgtggctgggatatctagtttgagaagttcggcctcctccattatagcatttgcgataggatgcaatgctgttttctccactgcagcggcgagacgaagaatctccgcctcctcatatgctaaagaagctatagaagtaactactggtcttccctttgttagcgtccctgtctaagaatcacaatacaaataccaactgtaacacaatacttaattttgaggagactagtttagcatgaaaaattaaatgatgtatgtagtgtgtaccttatcaagtacaatggcatctattccagctaaacgctccaaaacatcaccccctctaataagtagtccccgtttagcacctagtttaagataaaaggtagttccatgagggttagcagctcataaaaagcaaagatcagagaaggatcgcaacaaagtagcacagtcaatatgctgaattgactttagtaatgcaagggcctctttatcgtatttatgatgtatgagcatctccgaccccattgtatcagccaaatatcaggaacaaacgaacccaaacattatgacatagaaagttacccagtgaagttcctatcaaaatagctgtaggggtagctaatccgagtgcacaaggacaggaaacaacctgcagggtgaacattatgagatcagcccaaaaatcataaatgcaggcatatgcaaatagtgcccttcatagcccacaacttttcaaccaccaccgtccatcgaacaggtatcgtattgagaattcaagatgtttggcatgtacatcaatcatgtaggatttcaatgatgattagttagtttgtgcactg

SEQ ID NO: 83575 - DNA, 1220 bp, Oryza sativa
ccccccatgacagtaagaagcaaatgcaattctctcagcaagagataatcataagagaagccaaaactcatgtatcttagcaagcctagccctcttaaaactccagttttttatagccctcttacaatttttaaaacaagggatagacgttttctcgcacaaaatgcaagtatcagtctgaatctattttatatcaactaaattaaaacagaaaactgcagtagtagggggcataattgagttaacgtcagtaggaagtctctttctcgcacaaaaaaattcacattaactatcatagatacaattgtggcacaagtcgatttgggtttactgctcccgacgattgtggacaagccaaagttaaaagagctcataagcatcaacccaaactaaaccctaggttagcagaaaaacgagggtttatacctgttaatgtcggcgatcttgggcggcccgtcgggcttccccttgttcttcgtcctcgcggatttcttcctcttcttcttcttcttgttcttgttcttccccgcctgccccacgccgccatcgccttctcctcctcctcctcctcctccggtggcggcggcagtgggggcggtgatggctacaggatcctcctgcgcctgcgcctcctatacggcgtcgtccgcgtccgccatctcgacgtcatcgccgtcgtagtctagggcttcctcgtcgagcaccgcgtccaggacgctgtcccctccctccatgccggcgcgggatcctccaccaccaccaccaccacgatggggcgccccgctagggcacgaggtgacccacacacgctctcggtgaccgtctcctcccgtcctctcctcgccgccgggcgtagggcgaacaacgatggcgatgaaggagagcgcagcggaagcggcggcgatggatggaggggggaggaggcgcagcgcagagtatggaggctttgctccacctttggttaggccttgtgggcctgctactgggctgctcgaccctgatatggactatggagcaggataccgacttcaagatttaagctggttccaactccctactcttgttttccacacacacgcttttcaaactaacggtgcgttttttataaaaagtttttatacgaaagttgctttaaaaaatcatattatctatttttgaaaaaaattaacaaatacttaattaatcacgtgctaatggaccgcttcgtttttcatgcgcgg

SEQ ID NO: 83576 - DNA, 1893 bp, Oryza sativa
cttcgacaccattctccttctggaagttctccaaaatacagcaaagggtcctctcagtggcagtcaatgttgagttcaacatatgaacgaattgcttggattgctcatcattctgcaatttgaacatcaaatcagtggcaataacagatgacttttaagataatttgatctaccagcatccaagtgaaaagatacctttttctggccataacctataccaagtctccttgcttgaaaatctgtgcaatttgagcaggacactaattccctataggtttttgatgcagggaaccatgcttctaaatcatacttcttagctgcagcatcattaagagcaccagacacaatggagacaagttggtacggtaggccaatctgtataatagacaatgaagaaatgattagacatcaaaagacagttccgcatgtaacaaggtgcttaagatgtgtgaagcttccgatgtctacctccttgtagaaatcttctgaattttttatcatttcttcatgcatctcccaggattcattgtcatttggacttgtaacacagaattgctcaatcttttcgaattggtggactctgaagataccagccgtgtcccttccatgtgaaccagcttctttccggaagcaggtggaatatccagcatatctaaattggcaaaactatcatcaaactgctagcgcacatcaaccaaaccaaactacctaaatttagacattacccacctaattggcattcagcaggataaattcgatcacctagatgatacgcacacagcggttgctcggatgtagcgatgagatacttttcctctccatcgcctgttagctgtcaaatgcaactatttgttatgaacttgttacattaaagaaaaaaaactgacctcataccactgaaattacacttgatcagactgaatgtatcatttccggactgcttaactataattactgcaaattcgtgaacatagaacagcaaaagaatatataaaacataatttaattcatgaaaacattagaaaccacaaccacgattctcaataccaatgatgtataaaaccagagtttcatttgacttgccttgtaaagctcttcgtcaaattgggccaactgggcacattttcccatggtttcctttctcatgaaaaaaggagtttgcattggcttgaagcctcgctttctcagaaaagcgagtccaaaatttatcaatgccaagttcagtaggacaccttcatcctttaaatagtaaccccttccacctgctacatcagcacctgcaaaaattggataggcagtaagtaacctataaatttgagagaccaggaaaaaatggcaacagtgggattctgtgaatagatcaaagatcatttttaattttaatcaaagagtgagcaattatccatatttctaaatgttggtattctactattctcccatccttggagaggtatatacctccctattgttctagtgacaaaaaaaaataaattgattaaactgattagaagataaattcatgattggtaatgacaaagcatttctgattcttgggaagagtacatagaggtatatataccacatattgttaattactccctccatcccagtttagagggcacatattacttttttgttaacatcccaaaacacaggacatgctggggctttcagccaaaagtgcccggctaatttgcatgcatgcatgcgagcgaggaggtattggtcgaattagttgcgtgtgcaatctgaccccggttaaattgacctattggtttcatgcatgaggaaaggaagtgcttgaactatctacatttaataggggtagatcaggaagaaaataaactgcatgcaagcttcttggtcttagcaaaatactaggctgcaggaatt

SEQ ID NO: 83577 - DNA, 3234 bp, Oryza sativa
atcacttggaccttatggaatgctttgtttattgggaaattggcttcacaccgctccttctattcaaaatccccaaaatggttttagtctgggctcggggtgcatggtttttgatggtagcacctcggccatataaggaccggtcttcgggcctctgttgcaaagcactaccgtacttccacatgtctagtgggtaaggattagtttgtggctcagtctagttataaacaaaagtacacggatggagatggaagaagtcgggggtcgatggacatctccagggcaaatgaaggctacacgagctgtggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtttacaaaatagctttgagcaaccaatgtctttaaatgctgtttactgcaaccctaaccctttatagtataaatcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagtgcctgtggtcgtcgccctagtcttccgctgtttctcgttggtctctgtgtgtgctgggccttcgctgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacaagttggtatcagagcccccttgaccctaggacgagccgtagatcccaagccttagcagtattttcgaaataaaaatcctctgttatttgtgaaaaccctctagtctttctctgtcttgctgcttcatttatcgccaaaatctgattttttttaaaaatgttgcttttctttttggttttgtttggagatggccggcagcgtcacccgtcgtggtttggacatgactggtttcgtcttggagctgcggggcatgtgcgttgtcctggggtatccacatggagtggactaccagggcaggcccgttccggagcaggaaggtgacgatgcagagccccacgctgcttgggaggccactgcagtgatcctcgctggctctcccgagcggacttcgctggcagtcaccgcgggtggagattctttccccgccgcttgcaaaagcgccgctctcctcgccatcggcactcttcaccagcgctacccggacgagttgcagcactcgccctaccgctaccaccctcgtcgcggaggagcccgcgactacgccaccttccgggatgctagctcggaggatgacgctaccatcatgcacctggcgcgcatggtggaggcgtacgacgcggctcgtatcgacttccatcagatggtgcgtcgtggcatggtggagaacaacatgaagatcctggagctgcgtcaggagaacttgcagctcaagaaggacctcgacgcgatggaggcgcagctgcaccagctcaagatcgcccagggagaggacagccgtcccaagcatcgccgcgtctgccgcagccagaagatcaccgcccgcaagagcacctccaggcccgagcttgttcgtcagtccctggcgtggacttgcttcgtcgagacccctcgtgccgagcctgcgcccgtggttccccaggagggggaagcctccggcgttggtagctcggagggtgcgctgttgctcaccttccgccctggcccgtcgcagcggtagacgagcagttagtaggcttgcgcgtgtgtttttcctcgtttgcctttttgagttgtgtggggcatggttacacaggtgtgtggtgtaactatgtcggagcctgtctttatttgtttgcctaagcaacttgaactctaatgaaccaatttaatagcagtgataaatttaagaataatagtagtcgcgggtggttagttttaatcgtcagctctctttctctgcttgctggttctgtgtggggttttcagatggtgacgaccaggagaaatgttaacaccggtgaaggcaaccaacccgagggcagcaaccccaacccccaaggcaatccacctccaccaccaccaccagacaccaacgccattctcacccagatcctcgcccaacaagccaacatgatgaatactttcctccaccacctccaaaacccgccacaacagaatgctccaccaccaccaccccaacactctaaactcgccgagttcctccgcatccgcccacctaccttctctagctccaacaaccccgtggatgcgttggattggttgcatgccgtggggaaaaagctggacactgtgcagtgcagtgatgaagaaaaagtcatcttcgccgctcaccagctgcaggggcccgcatctctatggtgggaccacttccaggctacgcagccagaggggcaaccgattacttgggctcgcttcaccgccgctttccggagaacccatgtgcccgctggagtcggggctcttaagaaaagggaattccgggagttgaagcaaggcaaccgctccgtgatggagtatttgcacgagttcaacaatctggcccgttatgccccggaggatgtgcgggaagatgaggagaagcaagagaagttcttggcagggaatgggacccctttggaaggccccttgggggtccccctttggggggggttttccgtctagtctctgagactatccggatttccaacgtctggtggacaagagcatccgcttggaagccaagcacaa

SEQ ID NO: 83578 - DNA, 1523 bp, Oryza sativa
tccccatgtccgtacaattaaattgttagcctacaaagaaagaatcaatctctatatctagatatataatttcagaggaattcagggcatctgtttcgaatttctacaattggacatagaaaaaccacaatcgatgaacctagcatatctcaatcaacgcaatgttgttcgtgttactaagccatactaaaatggaatagcaaaaactttttaatccacacaactatagggtttgcgctgaacagctgttctactgtctctgcattataaacaagtgccgggaaacctgcaaatctaacaaacttaacagaccaaaaactgtgctaatgatcaatagtcacgaaatctaagcattccacttttcaacacacctcgtcatcgctgacagggacggattcatgcacaatgtttccaatcgtcacgagcttggcatcgagcgtgcccttggcctcctgcacctccgtctccttggcagccaacctcttcttaatctcttccgtgctctgaatcagagccgacgcgtcctcctttttctgcacagcggcatgctcaccgtctcacacgcaaataaaaaaaaaccgcaatgtggccacgaaaatggatcggatcgagaagaacgtacagccttgagcttgccgatttccttgctggttttgttgagctcctgcggattttgtcgagctcgaattgccctgcggcgaacaagcataactagtggtcagggaagggacggcggattcgcaaggggttcgatcccgcccgggtgagtgagaagccccctctctcttactctggcgccactggtcgtcgagggcgatgacctcgtcgacgagctcgacggaggcggagcggttgctctgcgacctgcggatcagctccgggtcgccgcccttctccgtgcggaagaggttgatgtcgagcatcttcgaaggcgtgcggcggcggcggcggcggcgagcagagagggaagggtagacgaggagggttttgcagcttgtgcggctttctagggctgcacacggttttgacttttacgaggcggaggcgctcggagacggcggcgcgaggcgatggcgacggcgcgagggggaggaggcgggagagggatagggagcggcgcggggctagggtttgggtggggattttctttttctttttttaataccggctagaggaaaatgaagaaaaataattccacgtccattcatagggtatgtttacttcacactaaaattagtttggttgaaattaaaacgatgtgacggaaaagttagaagtttatgtgtagaaaaattttaatgtgatagaaaagcggaagtttgaagaaaaaatttggaactaaacttggccatagaatactactcccttcgcactttttcttcaaactttcaacttttccatcatatcaaaactttcctacacacataaacttcaacttttttcttcaaactttcaattttagtcaaactttcaattttggcgtgaaactaaacacaccctaaatacctatgatttggcctcaa

SEQ ID NO: 83579 - DNA, 672 bp, Oryza sativa
ctctataaagtcccacccaattctcgattcccaatccagcgcagcacaaagccctcctccttccaccgcagctgcgctacctacctccaagagggctggtccgctggtcgtggagaaggaagagagatcttccaggctgatccctcctattggtacggaagccctaaactcatcggagctttgccgcggccgcgagcgatcaaatcgaaatctttctttctttgttctttgatgctccaacctagtgtcggatttgattttgactgttgcaatggcagctttctccttcccgagcccgcttgaggatccccgccggagtagggattagggaggggagaacaggaggcggcgattcaccatgaaggcgctcattcttgttggaggcttcggcactcgccttcggcctttgacgctcagtttcccaaagcctcttgttgatttcgcgaacaagcccatgattctgcatcaggtaataagtggtttcgctagtactctgatggagtaataagagtacttatttgcagtgccaatggatgaattgggcacaagttaattatagtacagtattctttaccaacagtccaacaatggcactggcctctccatgaaaggagggagagggtgctaaactggtcagagaacattaatactatttgatttgtttattactcc

SEQ ID NO: 83580 - DNA, 1253 bp, Oryza sativa
  unsure (1)..(1253): unsure at all n locations
cgcgtgnaatgataactcattgtacanccaattcgtttggagctctcctgatcctagcttatcgantccttacccaatggctttgggcaactaagtggcttttaaatgctgtttactgtaaaacttaatccctatattattattcgcttgtacctcccttgcattaattatgcatccccggtgtggcttgctgagtactgtggttgtactcattcttgctcaatctttccccccttcagtaagagaagctttggagaagatgtcttaggtggagtcctggcttataccccagttgagcgcctgtgaagatggagccgtaggccgctagtccgctgctgtttatttttgcttgtcaggcctgaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaattgtatgccaaacttagcaagtgtgagttatggttgtccgaagtcaaattcttagggcacgtgatatctgctaaaggagttgctgtggaccccgaaacagtgaccgccgtcactgaatggaagcaacccaagacagtcactcaaattcgcagtttcttaggtttggcaggatactaccggaggttcatcgagaacttctccaaagtcgctcgacccatgacacagttgttgaagaaagaagagaaatttgtgtggagcccgcaatgcgagaaggcgtttcaaactctcaaagaaaagctggtttcctcgccagtgttaatcttgccgaatactcgcaaggatttcatggtgtattgtgacgcttcgcgccaaggattggggtgcgtgctcatgcaggatggtcatgtggtggcctatgcctcacgccagctacggcctcatgaaggcaactaccccacccatgatttggagttagctgcggtggttcatgctctaaaaatctggcggcactatctcattgggaatcgctgtgaaatatatactgatcataagagtttgaaatacatcttcactcagttggacctgaatcttcggcagaggagatggttagaactcatcaaggattatgatgtgggaattcactatcatcctggtaaggccaacgtggtcgccgacgctctaagtcgaaaaagccattgcaacactcttaacatccgtggcattccacccgaacttaaccaacagatg

SEQ ID NO: 83581 - DNA, 958 bp, Oryza sativa
tgtgcataggatatgttgccatctccgtaacccttatctatagtgtactctagtcttttttttttacctcaccccttaatctccataaaaaaacacccgacattgctatatttcgagacgtttttatacctcaccccttaatctctgaagtagctatattttgagacggatagagtagttggcaattattttttaatttgagagtttatatgcccaaatgtatgttagaagtgcttaggtatgtttggataaaatatatttttgaaatttcataacaactttggatggagataaactttacataaaaggttgtacggctcgatgagagctacaactacaaaggttgatgccattttcatctgaaatcacttattagaatgtcaagttctcaaactattaactattgagagtctagtatagtatgccagcaagaagtgtcttacacagtgagacgataaggatattacatatggagagagggtatactggatttgaatcccatgcaccatgcgtatttcacaagattgcgtattcacctaaacgactacgaattcaatcttgcaagcaccaatttctccgtgtttactctttctttacctcgtgaaaacaggcaatcacacgccctgcttctgtctacagcatggttacccaggtagtcaggttacgacggtagacactcgcatttcgttaccgccttgcaaagtgaattcacgttcaaactgaacaaaattagcaagtatcacattaccattgaactgaacgcaatatggacatgaagtacagacagttaagactacggtaaaattgcacaagccatcaacttttgacgatgtagtcagtatcgacaggtacacgagttctgcactcagaagtcaagctactactggtctccaagagctggattgttttattagtagagctgaaggtcatcacagctgatagcagggctgcaggaatt

SEQ ID NO: 83582 - DNA, 1121 bp, Oryza sativa
cctctcatcgcgctatctctctctctcggtaaacccctggcctcggttagtatctgaagtggatttctcgcttggtctactggcggggttcgctcgatactcctcctcgagttagggtttggcgaatacgaccaaccccgcggatcgcggttggatggcgactagagcggccgcgctgctctgagaatgcaatgtacctttcaagggttcggtattttagttccttgcttgataattgctactactgcgacaatctcgcggttcgtttgcgaagaaatataaagagggtgccttgctgtggctgtgcacttctctctccttctttgttttcacccgaaagttgtgattttggtgtggggttttgatgtagagaaattgatgagtaccacgggtattgccagccaaatattaattgcggaatgtggggaatggggaaagggtgttgccttcgacgtggattcgcctgctgcgacacataagcatgcatatattcgtagagtggagcggaattctgctagcattctgtagttacccagttacgttaactactgtagtgctaatgttagagttaaatgatttatatgatgaagtgatgaagtatacttttggcctgccgacttcgtctggggtttaatttacacaaaacttcaataccttgtaaactacacacccaaatatcatgcatgcaaatcacatcctaggggtggtattgcgggtgttttggttgatgtggcatgcaggtgaacgtgggggcatgatgatttagggaaagaaaattatgtgggcctttttctctttcctagatggggtgtggtatgggtgggagtactgccatgtgttaaagaaattgatgatgtggtagccacatgacccaatggccaacacctctagtaacctctttgggtgtattctgcgctggaaactggtggagggatgaaaatatattaaattgcagggtgtacattaaactagagcaaagttaagaaacaattgtagggtgtacgtaggtcgttgcactgttggtttggacttatggagcaaatattttacaatttacattagaaaaccaggacaaccattattcttgtaactgtaatgggtttgaatgcggttatatctgg

SEQ ID NO: 83583 - DNA, 1211 bp, Oryza sativa
  unsure (1)..(1211): unsure at all n locations
actacatgcccgctatatgtgcatgcagtagcctatcttcctactcactagcattctcccccttcagatggccccccttttttttttttttttacctaaaagcggttttttttataaaataggcttgacatgagttttcttctaaattatttatattcaatttacaatccgattatatcttgaatttattgttattaaatatgtaaaaaaagatatcacataattatattcttatgaaagatatataaacttatgttttaaccatgaaaattcatgttcatacgcgatactgaaatgtttcaacatatgtttcacataatctttcagtatttcaatcactattttttttaatgtttcacctgtggacaacttaaacatttcaccccccccccaaatttttttatggaaattaggtgcctggtatcaatttcatgttggtacttcctcccgttccgtaatccttgatgttttggataagattgagatcaacaattaaaactttaactatcaatactcccttcatttcacaatgtaagtcattctaacattttccacattcatattgatgttaatgaatctagacatatatatctatctagattcattaacattcatatacatcaatatgaatgtgagaaatactagaataacttacattgtaaaacggaggaagtaacttttaaaatatctagtttgaagaaactacaacattatgcatagattaattttgaaacatgcattaataaatttaaataatataataaaaatatagttaaaaatatgttctcgagaccgtattattgtccaacacgtcaagaaatataatagaactgaggggagaatttagtcagatggtttatttatacgaaattatcattaaaaatgcttcctatcggtctgctgataaagccaacagattgtgcctccatcttgcgcttgcactctctgcatccggcgcacctccactggtggagaaaccatctttcgtcggtcggccgatttccacaatagtcccggatgcaataaaaaccggggctaaagatgatctttagtcccggttcaaaagggtaacgggcatatttgatctttagtcccggtttgaagtaaccaaccgggactaaagatcatctttagtnnnnnnnnnnnnnnnnnnnnnnnnnnnnnnnnnnnnnnnnnnnnnnnnnnnnnnnnngcattgcattcaagcgcgc

SEQ ID NO: 83584 - DNA, 2316 bp, Oryza sativa
caccgcgacggcggcgaggtgcgcgaagaggagcagcgccgcgagcgggggcaggacgaggcggaggcgagcgcgcgccgccatggcttcgcggcgagtcgcggcgcggcgctgttccgtgcggaggaagagaggagaattggttcgttcgcttcgctcggggggtttactgggaatttgggaaatttggttcgttcgccttctctccaacgtctcctttttattgctgccgttccggcgccggaggccctgggggtggtgggccccgccagctgtaaatgattgtttttgttagtgaaataaaatataagagattttcgctctattttttttcacgggaaatgtattttttttgtccctggaaaattgcaccttaatagttatttttcgcagtaagtaatgacttttcgaatttagttatcgatcaattatattataatttgtgaaggtgcttttgtggagcatacctttggtgcaacaacacacaagttgggcaaaggccaaggcatgtcaagtaagcagtgtatatgcatattattggtacatacaatcattttttttttcatagtggtattggaacttttaggttttataaaagagagttgagtctccaacttcatggtatgcttctattttgatgtaatatttatgcatggtgaaaccaagttattgtaattttaatagtacagtcgattgccagctgtattttttgtcgatgttatcttaaagatgtttgtacagccaactcatacaacaaattaactctaccacccttttcaatgtatttattgagagatttggctatttatacattgatcgctcctttcttcgcctcatcttacatttacagttgttctctacgctggcacacaacggtacgcactttagcatttctcaccaccagcatatgcctcgacactatctccatgatgtaactggcgcttagcctcaacgctacattgcgattgtcaccaataaggtcgatgagacaataccctcgtatagtggggcaacaccgagctcatagtcacgccatagccatagacatatatagcaacatgcatgtatcacgcgccttgctacattcacgtgggccctataaccgtggagagatagtttctaccgcttcacttaccttgtagcgcatgtataatccactatcttagctgccatctcacacacactctctctcatactatacaaataactcatcaacgaaccaatgcgaatatatatattatcatcgataaaaaaccgcttattgtttttattgtacatgctctcctaaccacatcaagtaggtaagcaaggagcttagccatatacacgcttccttcccacctcgatctcacccaactctaaacccttggtaattacaaatgatgatgatgtacgtactctttctaacagcagtcagcagcacacctatactactacagtgctacctacttttaaggggttgtatatatattatagcaaagatgcaaaaatatcttagccggtaaacaaaaaggccattgcatccaatttcatattttggaaaccgctctctctctctctactccaaggaatttttctgttgcaacggaagaggtaggaagggatggccctggactagatgagctgtaccgtggccaccctgattgcctgccctccaactaataatccgtttggtccgtcctagatttcttgtccctaagccagcttccctttgtccctaattaatctgcgtgcgtcctcccctctctctctctctctggtccagtgctagtactgtgctagccgatgtagggtttaggtgggccccacgggtcagtgagtagagggacaaccaacggcgacgacgattctgagatttcgccctctcgctgaccactgcgggcccacgcgcagccgtacgtacagccagctggctgattgccagccgccagctttataccttggccgttcgtttgttcgcggtcggatgggaagaagaatatctgacgtccgtccatttagccagctcagcgcgaacaaaatttttttctaaaattttgtttatgggctaagaaagacagatacaaatttagaattttttttgaaagactgatagaactagttttattttaaagaacacttacattacgactcctttaagcagagttaagaaaatatagaaatagaaaaatatagtaatatgatacgaatgcaagtgtaaaacaggaaataaaaactactaactccatcccaacatataacatattttgggtagatgtgacacattctattacaatgtccagattcattatagactccctgttcagattcattttg

SEQ ID NO: 83585 - DNA, 7636 bp, Oryza sativa
  unsure (1)..(7636): unsure at all n locations
cgcgtccattagaacgcctgcttacgnnnnnnnnnnnnnnnnnnnnnnnnnnnnnnnnntcccatatgtccaccaagtatgttcctctgttgatcaaagatgtgaaccccagtgtttcctggattaacccccctattaaatccagtgtgcaaagttgagtcaattccctgacttccacagaaattcgagggtgccccaacagttggcctgccctgcataccaccaaattggggtatagagaaattctgttgtggcccaaaatgtgtccccaaaccttgagagccaaatggtggtactgttggttgtggacgcggcaggtcaaaaaactgattgctgttggtcattcccgggccagtccccactccctggctcaccattcccattggattaccagatatagcttcaattgcaaatcttacctcagaagatgtggtattcatcgccgctgtagaacttggaccagcagcatcagcagtagtagcaggagcagatttccccttcgctgtggctgccgctgcgttagctccagcttccccttgctcttccaccgatttctgtttgcatagctccaacagcaaccctttaatctccttaacctcccccttgagtgcctttagctcagccacatcctttttcatcgctgccatatcagtcctgaattcgttcatctcctccatatcaaccatagactcgctggatcgggtcttcgttaccatccccctcctacaggatcggcttggaacttgttcctcccctctggatcccgaacaggagaatctttctaccgccgcctgttctgagtaacgagctccgtagatttcacagggccacaccacacaggatggaaccccaaccctcgctcaatcactcagcaacaactccgttgcccccaggatgatcttgccccaactcaggaattttacggtggatctcgccgccgccttccaccaaccctcgccggacaaaatcagagccaagaatcgacactgctctgatacctttgtcagatcccgtgattagaaatggaactcgcctctcgatctcaccgatgatagctctcgatttagtggccgccgcaagacttctagggttctaactctaactaagtctaagacaagtaataatatggttctcgatatcttcctctctccattccaccgattaataaaggtttacatgagtttcgatgacagcttgcattacagcggaaaaacagagtaaaattcagagaaaacgacaatgatgacgtctacagtggtcccatgggaaacttggacggtgggatttgccttcataacgcttcaagtgtctcctgggccgtccaatcttcatcagatcagtccttccagtaacactaaacgaaatttactgaataaaagtttagttaacttctgcatccttcagaatctccatttctcctgtccaattcctgacatgcactgcactgctgcctggaagctgatccacatccaccggtggttgtcgtgcaggcaagctgttcgacggaatgcatctttgcttgtcggaacaaggatccccgcggacccagtcgccggcggcggtggatcccagcttggacagatccggtgtgttgcttaagtcctatgtgttattgcatacgttcttggttgtgggtgatgtttgctatggagcgtgacacacccggccggtggctcgtgcaggtgtggtgctcggcggaatgcccaagaagatgtcaaggttggagttggacgcgggggtgtcgctgtgggcaggccttcaaccggacatactgggaatcgtgctccacttccttccatgccttgccgaccgtgcgagggtgcggtcagtatgccgtcactgacgagccagcgcgaacggccacgtcctgccaccgccgctgcccctgctggtgcttcctggtttcaagttctcgagcctatcagacaagggggatttcatgcctgtgcggtgcgtgccggtgcctaaggaggttgcagctgatgatctccgatgtgtgggttcttttcatggatggcttgtaggtgtgactcctaacaaggatcgcagcgacgagtacaacagagatgccgatggtgactgcttcctggtgaatgttttctctcgcaaggtcattcgcctaccgcagctgtgccatatgcgttacaattttcctgcttactccagtaagaccctccgcatcgtcaatggttctggtgaggtccattttggtgtcaatgatatatacacaatgtcactatgtaatgtggcactatctgcttcacctgagtcatccaagtacattgtggctgcttcctcagaccacaagggtgcaccagtaccagctctctggcagcctgggatgatttcatggcaggtttgctctggagttgaaattgatggcccaagagatctctccttctaccaggggaagctttatatgctcatgaggcacaggacacgcctattcacttgtgaacttgaggaggatgatcgtgggttcatggtctctcgtattgagctctctctcactgagctgcctcgcaatcatccctaccaggaaggtggtgcaataagttgcaatatggttgtgtggcgtggagagctattattaatcatcagacactacaatggcgattaccgtaagagacaacttcataaagttgaagtgtttgcactggatgttgacacaaacccttatggactaactgagattcacagcttgaatggtgactgtatctttgttggcttaggtggctgcaagtcctttcctgctggtctacatcatggagttgaaggtgaccatatctactttgtccctgatgattggaggccttatgatacatttgtgtatagcatgagagatggtaagatgaggtcctttgccgtcaaactattagcttccgaatttgatgtggaccagttgagtcgtgatttcccggtgtggttacttcctaccgaatgatgctgcgcagcaaagctgatctagctgggagggtggtcaagagcttacctttcattagactccttggtcgagactataatgtgtattatctgctatgttcatgttgcaactctcagattatcttttgtatttcctgttgaactggcaaccatgatttggtgctctctttcggagtctttcttgtttctgtttttctgggacagtggtactgttgttgtctgactgaggacatataaagtatggctgcattattctgctgttgtttgtggcatgtcgtttcttcaagtccgatctttgatggtgttttgagaaaaatatgtcatggttttgcgatatggatcagaagttagtatattattgctactatgtatctgaaggctttgatgttgcagttgttgctggatcatctgtagagattttatttcttaaggcgaaaagtttgattcatatactcaccagatattccatcttgttctttctactcaaggtccatgaagtttgtcatggggttgctggaacgcacaaacgggctccctgtctcttttattccattttctggttatttttcctatctattttgactatgaaactcgagacaaaatttagctgtgaaaatttatattttctcataaggcattagaatttggacaataatttgttcatgttctcatataaaacttttcacccaactttcaaaaccagataaataactcagcatttgcattatattgacctgcatgctgtcactaaatccttaacatgaacacccttgggttggggcagatggagaatctcgcatgaatggaaatgacaacactagttcttacgtgctgcatgcccactctgttcatatattggtgctccacatatgtgctagaatgttcacaacacttttttctctctctcatatctcaccaagaactttgatatatcaaaaggtctatcaattaatcatgtgaaatagtttcggactagtgaacatagttaagcggccggatggtgcgaattaagtcatgcctctttctactttttcaaaattacctactatccaggatgagtcccatgattttgttactacgaatgcgtctagagagcatataatttcaggtgttgatggaggagtttgtttcttcagataaaattacaagctttcagaatcaaaggttcaactgatcaattactcaattcctcaaagcaaagactcccagtccctcaatgcactacaagaccttatatatatggatggaatcatcaataaataacaaccctactgctaccgttttcctcggtcttttgaatttcttttggctcatcggaatttttttagtacagaagctcctcgatggggcagcttaaccgttcaagcatatcatatataaaatccatgtatagtacatccataaaaaaatattagtgcttacacattgcacagccagctcgatgctgaaaagatataaccatttaaaataactaggtgaaacctcgtgccttgcagcgggtgtttggtatgataataaaaattagaaataatgtgtaagataactagacaatagaaacttgcataagctgatttttttttttaggaaaccgacggcaggagctctgccggaatttgatttgagaaaagaaaatccgtgcaatacagaccagagcgagcaaaataaaaatacagatcaaggtggcttaaaagccgagctacgaaggtctatttcctgcttgacaaagtaagctacgtccctctctgatctaacagaactattgaaaattctattattcctttccaaccaaatattccaccatgttgtgaggagatctcctcttgttttcagcttttgctcatttgaaccttgacgatcgatttcagtccaccagttggatgttccacctgtggattgagcatttcctcctgccaagtttagccatgagcaaacaaggttccatacttgcctgacgaatggacattcactgaacaagtgatttgtgtcctcaaaagcacatgtgcagaggcaacatatccaattgcatggccaatgtctcatgagaaggttttgcgcagtgagagttttctgatgaagaacaagccatccaaaaaagagtgatgctccggtgcaatatacttgaagtattatactccgagtagaattaatctggaccgtttattttaaagggtaggtaagtaatcttctaatatcctttaggggtaattttggtagggggtgttttgttcggtgcgcatcttcggttcgcatcggttcacatcgtaggtgtggactccgtcgcgctattccttccccggcgtcaccgccttgcccgcatccgtccgtatcgctcgccgtcgccgccttgtccgccttctcagtcgccgtccctctcctccgcccgcgtcgccttatccgccccctccgtcgcagtccgcctcccccgcccttccccgcctcaccgttgtctccagtccctccggcgccgtccgtcggcccggccatcttcccctcccccttcggttcgcatctggtcggaggcaggcaccggcaggcggcagcgcgccccgcggctattcctcctggcaggcggcgtcgcggctggtggcgcggtgcgtcgcgtctgttcgacgcaggcggcggcgtggcttgcggcgctggtagtggctgggtgcggcgaaatcatcaggtaggtagtggcaatcttgtttttcagttcaatagcagttgaacttgccgaaatgggactaatgtgttacctgaattgctgaatctaaatctgaaaattttcttctggattttaaaagctattgtttttgtaaataccagtccataaaattagttgtttcccatcgatgttttcatatcacatcactggtagaagtagaaaacagcacattcccttcggtaatttggttatacacattgatatttgattcgtttctgtcagtttgatgcttcagtggtgatgttaacatgtcctacagagtagcaagtgcaaaatgcatcttgagtgaaaaacatatctgccaatgttgaatcattaggattcaataaagatgacctgattcttgtgaacgatgtggcttgtgcaaaattatttatctgataaacgaactatagaatacggtggagatttactcagtttgtcaacgactgttatgtgtgttagttcttaactgtaccgcattggctcgccctctgtgtgtgtgtgtgtgttttacaagttattactgttgtgcatgactaggaaatttagctgttaaaagaaccacactttagtttttttcttggtcatcattagcttttcctgtctcaggttgagaagtggaatgaacagagggagagtgggacatttgcaggaccactctaaatctcctgtttgagagtcttctcagatcagtccgctgccctcgtcggtgtcactgctatcatctggttggagtgggactcattcgggcgacgctccggtgcaatatacttgaagtattctacttcgagtagaattaatctgaaccctttattttaaagggcaggtaagtaatcttctaatatcctttaggggtaattttggtatgggatgttttattctgttcgcattggttcgcatcttcggttcgcatcgcaggtgtggataccgtcccccaattcctcccccaacctcgccgccttgcccgcctccgtcgccgtccgtatcgcattggttcgcatcttcggttcgcatcgcaggtgtggataccgtcccccaagtatgaacgatgaaactgaagaacaatagttttttgaaagaaatatgaacaatattaaattgattttgctgtgcatgtatggcttgctgccctagcgaactgaccattgatatttagatatgatttagcatgacatcttctggtaggataagacaaatgcgatatattttgacaaaaatagacaggggctgcattaacattggacttggcttattttgctagtttgtcagctaacttgattatgtccataggaatccacatgacctgcaaaagagattcaggaattgtggcaacgatctgactacaaataggtcttaataagctgcaatgacctggctccgtttcggatcttccttttttaagggtttcgacaatggtagaattatcagagaggagcatgtaaccgaagtcattgtgaaatacacaaatgcatatattctccagtggtgctgaaaaaagaaacagagttctgaaactactggatgatgtgcaacacaaaatttgactgtacagctgaaatgaaaaaagaaaaattatctctgaacaaccattttcagaaaatgtattttagtataacaatttatcgtacatacaaaatttgcagccattgtgggggaactgtagtaattgctcaatagtttagagtggcaatgtatttatgcagttgatggttgttctttttttatatatacttataaggtataaaggacgtaagcttatatttgggtgcttgatctgtttgtttttttttgtacttttccgtaggtgaggtctgacataatgccttcgagctatgtgagcctagaggttcaggaagagtataaaatgatgggccctgtggttttttnnnnnnnnnnnnnnnnnnnnnnnnnnnnnnnnnnnnnnnnnnnnnnnnnnnnnnnnaaaaggggtgtnatcaaagcaagggggnngtacaatgaggggttatcaaaatngcatcggcc

SEQ ID NO: 83586 - DNA, 4246 bp, Oryza sativa
tttgttgtcattttaatatattttaataataaattgagaatatatatatatatatatatatatatatatatatatatatatatatatatatatattattgtatgcgagaaaatataatgatactaatcacgtaatctgcgagagccaccatgctagtttcttatacgttaggagggaggggtaccaagaaaactctaaacccgtgctcacctctctcatcaattctcttcattggtagcgcctcatgctaagcttaattttgataattatgttaattaaaaaaataaatttcgggtagcgtgtcacgcatagccagtcatcagtgtgcaacgcacctagtagtaagttctggactgtggggggtgtagatggaacgaccgattgattggctgactagctaagctagctgtccctgtgagtcatcatctgttacaactgattaattttgttactacgtgtacgtatgcaaccgcataatacaaatatattactactagtaggtcgtagaaactagccacgaaatacacacctgcaagctccgcaccaaacgtacgtatacctacctagctactttgccaatgttataacagctagccgtggcggacttgcacctattcttaatttatttttgtactaaagcagatgtatttaatcaacctgtaatagtagtacgttggaggaaagatgcaaacaacatactcttttcattttaaaatataaatatcgacatcgtcctgtcatttccgccggcgccggagctatttctcccgtcgccgatgttgtccaatcttcgccagcccgcgcactacagcgggtgagtatccaagcaccatatacccacatatgcatgcacgggtttgcactaaaacgggctagagttcgccatgcactagcatgccaaagctcaccgccgacactgatttcggttatcactgtacacgagaccaccaccattagcttcgcaatcctccactctacaaatcctctttggccgcacctcacgaaacccccactctacaaatcctcttttggccgcacctcacgaaaccccgttcaccgctggcgccgatgacaagcttgccgaccaccacttcctctgctccttctcacgccgagtcattgccatgtaggtctaagggcattcctgacatttcacatgatttctctctcctcttcaatcggaaattatttagtcagcacggtgtccactggcaaaataccatgattatgaagtgtccccccaaaaaaaagttagtattttgcgttgtcttagggttaaaaccatataatttcagcgtcctgtagcaaaatttgtcttctagtagtagagtcaaagttttcatctagggtccgtttatcatagatttcacaattcttagtttagatggttaatttgtcgatgatagccgtgttatagttttcacttttttctttaaaaaaagattaaccattttattgtaaatgttattgtaaaggctggcaaaataccacgattatagattgttttctcccaaaagttagtttttgcgttatcttagagctaaaaccacataattttagtgtcatgtagtaaaatttgccttatagtacaatcaaagttttcaactgggtatgtttatcatagatttcacaattcttagactgcatggtttggcaatgatagacgtgttatagttttcacttttttctttaaaaaagataaatcattttattgtaaatgttattgtaaagactggcaaaatacaacgattatgaagtgttttctctaaaaagttactttttatgttgtcttaaggctaaaaccacataatttcagtgttctgtagcaaaatttgtcttatagtagattcaaagttttcatttagggtccgtttatcatagatttcacaatttttagtatgtatggtttgtcaatgatagccatgttatagttttcacttttttcttaaaaaagattaactattttattgtaaagtttttaggtctgatcttacatatgaattagattatctctattcttctctcgaaatttcacaaactggaactggaagtacatccaagataatggcctcagtgatagtttcctgttcatcatggccatccactcaagtatagggatgaaaccggagcggatagtttccgtccgctccggataaaaacgaatacggatacctctcggatcggataattctcggatagttcggatacggatacgaatacggatattttctctcggatacgaatacgaatatggtatcagggtttccgtcggatacggataataattcggatatccggtgaacagtgctattcggatatccgcagaagccacaagacataccccatttctttataactctatgaccttcaatatacctttttagattttaatagtagttcatctcttaacactagtccacattattaatattatttaaaattttaaaaatatttataaattatactatattttatataaaatgatctaattatatatgttgatatttgtttctattagaagttgaattggttttcgtgttccgagaaaaatttgtttccgtattcgtgtccgatcatattcgattcttattcgtattcgagatagtccgtatttgtttccgtattcgagccatccgtattcgtttccgtatccggcaaaaaatatgaaaacgaatatggtatgagcattatccgtccgtatccgctccgttttcatccctactcaagtacccttgtaaaacagagagggcaaatcagaaatcctccattcctccccactcccactccccaccatgacatgtgggccagggtagctggcaggtaggtcccatctatccgtggagagagtcctcagtgcgctcggctgggctgaaatttctaccaagtcctcttcgcgcaatgaatgaatgaacgaaggaattaagggtgaatctttgagattactcctccccttttggatggggatcgaattagataggagaatctcaactctcgcagctctcacaaacgtcacccgcgacatcactccccgaaaccaacccatcctttttggcgacggcgactcgcatgggggttccttgcacccgtacgtgcaaccatcgcgtggatcacttggttttgcttggccggcacgaccgtattaatcacgttcctagcctcactaggaacttgggaaagtaggatcgagtaccaagttctgtgtgcagtgtctggatcaactatcaacgttttgaaaagctggcgtattaattcatacgtatcccatgatgcacacctgttaccagtcggggacgcacagatatatataatgaaacttgggctaaaaaatgttattgctgtgaaaagttaacagttaaatttaaagtagctagagtaaactacatggctagtccttaaatttgtcacgagatattttagtacttgaactatttaatccatggtttacaaatttaacaatgtgaggtacaaagtgcaattgatagagccaaagcgttggcatggccatccaccctggcagaaccttttcatttagcccattcactatataaaatcgatcatttagttgtataggccacatcagtgtcacacaaccatggtgcgccaccgataaggcactggatctcccaccagacaatctttgttatagttcaaatttaacttgaggttgtctataccttaaaacttggaggatcatagggatgaagagaccggtcgacacgttgacgccataggtaagaggggtcgagacaacttaaagcagtggtgtagccagctaggtgataccgtggtctatggaccacctaaaaatttgaaattatagtatatatgttagttaatataataaaaattgtatagtggaccaccctttaaattgacatattacatatagatgaaccacctttactttaaatcttagctacgctactgtcttaaaagaccggtcgtatatttactccttaaaatattctcatatagtcattttattttgataatgaacgttttttttaactccggttcggctcatgcatatgctatagagttggtttgcgcttgaaataatcataactgttaagcaagagaaacctagaggatgtacgtattagtaataagatgtttttgttagatggatctccctccccttgagcccaacggctcaagggggccttgacccgcgccctgatcgggggcgcccagcccaatggctggtgggcccccgtcacactgtgccatataaagaggggtggag

SEQ ID NO: 83587 - DNA, 144309 bp, Oryza sativa
  unsure (1)..(144309): unsure at all n locations
gaatctttgatatgcaaggccaagataaacaccttagctaattaagtaaactcgaggtgaaatgaaactgttaggcaaataatcaaaagcccaggagcaactttctgagggcgttcgtgctttttgtaacattttctatcttccaaaatttaacgagaaagttactgagtaaagtatgtggttgctttgaaatcatggagctgacgtaatgttgttgcttcgttgttttgtggaatgcaagttgccatgttctgtgctggtggctgtgaattgtgacacatgaaccatgctttattcatgctcataagtcatcactattacttgtatgccatttactatgtattttcactgatgtatgttgtaatatacatgtatgcaacagtttattggaaaaaacagcggcaggcaaacgttgagataagttcaaacatcttaaaatgggtatgcatctgatgacagtaaatttctatatttataagtaaattaattaggtcataattgcatccttacaaatcttcatatatacgaagggctacagaaccatattggaccaaattgtgtagaataccttgctattaacagataaattaattactgtaatactaacttataggagccccagcagactcaccagtttaggcttgttaagtggggcaaagtgtcacgaactcagatttgagtcggaacgaactttctcctgtgactcgaattggaagggaaaggaagctggcttgaggaagaagaagaacagagacacgagaaagcagaggagcaggagggagattagaattgagtttgaggtttcagtttgaatacaatatttcatatctcgctctctcgcacctgccgactatatagcaatgcgccatctagtctctctcactgacagtggcccagcctttcgctactgggtccactcactcgacgggaagcgtgtgttgggccgcttcatcctttggatcgatcttgctgctgggccgctgttgccgtctcaggttgaacgccttgctcagatgccgccgtgacatcccctcctccttgagtggcaacttgtccccaagttgttgtagttggaaagcgacgacgtagctcctgctcattctcccaggtgacggcggcaggttcaccgccagaccacttgatcaacacttgttccaccatcttggatcctttgtgaacaaatcgacgatccaggacttgaagtggtaccggagacgcctctgttgtcggacgaagaacaggaagcctgggagacgctgtttcacttggtgccaaagcttgcttcaattgggatacgtgcaccactagatgaataaggctggaggagggtaacaccaagcgataggccacttcccccactcgctccaaaacctgaaagggaccataaaaacggaaagagagtttgcgatttactcgactgttgtacgaagggctgcagcttcatatacacccaatctcccacagcaaaaactcgttcagaacgacgattatcagcctgaaatttcatccgagtctgtgcacgcagaagatgctcccaaatcagagtttgcattttctctcgctcatgaagcaatcagcaagctcagtagactgacaagctgtagtagctgtcaacccaaaataccgaggtttgtggccatagagaacctcaaaaggagttgatcccaaagcggaatgaaaggatgtattgtaccagtattctgctaaggcgagccatttactccaatgagatggacaagcgtgcacaaaacaacgaagaaaagtttccaagcactggttcacatgttcagtttgcccgtcagttggcggataataagaggaactcatccttaattgagttaccgtggagcgaagtcgaggccaagcaaacaattgtttaactctgtgataagtaacatgaatgcctgaatgcccacccactgcagtagtatgaaggtttgctaaaattttctgttgcacagctgtattggtaccaatccatatacgatccttgaaatataacacaccatttctcagagaaaaattgggtacagcactagcactgatgcataaggtctgaaccttgctacacgcgtcaggatcaagtgagtaaccagacaccacttcctgaatccaatcaggcacagcaacagacaaggcagacaattccaaagtggcagaagaagggtacctggacagagcatctgctgcaccattatcagtgcccttcttataaatgattttgtaccgcaatcccagtaatttagtgagagccttgtgttgccagggagtggtcagacgctgatcatctaggaaagagagactgcgatggtccgttcgaatgaaaaattcagcgtgttggagataagggcgccaatgttcaacagccagcataatggccaagctcttcttttcataagttgacaagccctgatggcgaggtccaagagccttactgagaaacgcgattggatgctgatgttgcataagaacagcaccaatgcctttatcggaagcatccgtctcgacaataaatggttcagaaaaatttggcatggccaagacaggagcagtaatcaaggcttgttttaatgcttgaaaggctgcctccgtttcagatgtccaaatgtacaactgaccctttcgcagcagattagtaagtggtttacttaagatgccatagtgacaaacaaatttgcgataatacccagttaaccccaaaaagctacgcaattctttgactgaaccaggcaccggccaattctggaccactcgaatcttgtcgtcatccgtcgacacaccattaggagtgatgatatgccccagataggaaagacgttgttgagcaaaagaacacttactctgtttcaccttgagctgatgcttgaccagaatttggaacagttgtcgcaggtggttcacatgatcttccaaagttgcactgtaaatgaggatgtcatcgacaaataccagcacacatctgcgaagtaaaggagataagatgctgttcattccaccctgaaaggtggcaggtgcactggtcaagccgaatggtatcacacgaaactcataatggccactatgtgttttaaaggcagttttatgctcatctgacatcttcatacgaatttgatgatagcctgccctaagatcgagtttggtgaaccactgtgccctcgacaactcatccaacagctcatctataattggcagtgggtacttattcttcacagtgatagcatttagatggcggtagtccacacaaaaccgccatgtcccatcttttttcttaaccaatagcacaggagaagaaaatgggctggaactaggttgaattatacccttgtccaacatttccctaacttgctgttcaatctcgtctttttgagccggtgtataccgataggggcgcacattgacaggcactgcaccagggataagagggattgtatgatcaaaagattgagttggaggtaaacccattggttcatcaaagacagaagcaaattcttgaagaacatgttgaatcttgacaggaatttgttctgaagattctttgtcatccaaagaacatagctgaacaaaatgagcaactgctctcctgtcatcgaactctttcagttgttgagtggatatcatttggcactgttgcaattctggcacaattccttgaagagtgacagattttccctgccaacagataaccaaggacttttgtacccaatctactgacattggactgcactgcattaaccaatccattccaagaattgcatcataattggttaaggccagaatcttaaaggtggtgtagaatacatgcccttgagtcgtccaaacacaatcaggtaactcagctgtacaagacaaaacagctccattggccatctttacctgtgttgtagcaagaactaactgtacccctgacaactgatctgccaccttggaactgagaaaactagttgtgctgcctgaatccaccagtattagtacctccttaccctagatataacccgaaatcctcattgaacccacatgttctgccccttgtattgcctgaactgatacaaccattaccacttgttcttcagacgtaatcaattcagccgattcagaaaaggaactctctccaattgcatctaaaacagagaataattcctgaactgcgtatagctggacaagagtttgcgcatctatgagtcggagaccacttttcagcacaaatgtaacataacccctgagctcgcctttgcgcctttagagcaaccatcttgttagaacccccaactggccgaccaccatcaattccctttttgtcatcgacctttccaactgcagatagaactcctttgcctggtggtagaggaagtggcaaagccccttttaatactgaattagagcgaatgtgcattcctcctttagagtccttcacaccagactccggtggagcttccagcacttcctcctgcaaagacacaatagccagagcagactccaaatcgtggagacgttgtaacaatactgcatttctaatctctcgacgcaatccttcagtaaagcgatgcactagatactttttgctaatgacaggatcataggacaacaattggttcatcaactcatcaaatttctcatagtattcccaaactgttctcgactgtctaattgtatccatttgcctaatcaacacatcatgctgatccctatcaaacttagtggaaactgctatgcaaaaatcatcccaaacaggaaaccgcacatgagccctagacgaacgtaaccaggatgctgctcttccatagaaatagatggtggctacacgaacccacaaccctggataagtattgttcacatcaaaatagtgctcgcatctcatcctccaatcctgagggtccgtaccatcgaattttgggaaatctagtttaggaactctatgattatactgtctaccgccttgttcaaaaccaaactccccaacctctgaatcagatttgaaattctccaacgaatgcaaaggaactgaaggagattcaaacgtacccttgtccggagttgggatcagagtggttaccactccagatgccctcctccggaaattctgttgagcgccgtggccatgggcccaattgcttccgccttccgccgcgacttgatgtgaagaggtcgtcggcgtaggcagcaacagcgccttcctttcctcgtccgtcgacggaacccgaggggaaagcgtcgtcggtgaagcttgcttcggtttgccgaggagatccagctgttgacgaagtttgccaacctcgtcgtgcaaatcctgaatcgccgattccacttgaggccgccatcctccgactcctgcatccagcttcgccacggttgctgcgtctccgcttgcttgtcgttcaacgacttcagcgaatcctggatgtcgccgagaattttgccgaagtcgaggttctgcttctccatggcctcaacctgcgattgcaaatgggacgtgtaccttggcttctccaggatcgatgctctgataccaaatgtcacgaactcagatttgagtcacaacgaactttctcctgtgactcgaattggaagggaaaagaagctggcttgaggaagaagaagaacagagacacgagaagcagaggagcaggagggagattggaattgagtttgaggtttcagtttgaatacaatatttcatatcccgctctctcgcacctgccaactatatagcaatgctccatctagtctctctcactgacagtggcccagcctttcgctactgggtccactcactcaacgggaagcgtgtgttgggccgcttcatccttttggttcgatcttgctgctgggccgctgttgccgtctcaggttgaatgccttgctcagatgccgccgtgacacaaaggaaacatggaaaaacaaagctatcatcttgcaacactgcaacttgaaaatagctaggaaaaggaatagcagatacaactcacccagtatcagattgcagcaacactgcaacagaaaactgcataaggttcaccaggccaaatctgcaacagaaatttgctcggctcattaatcctattaaaaaaagcatacaaaagccctagaaatggagaatcttatgtgcaacatatcatatacgatgaacttaggcataggctgttgcagatatacaaactccatgataacaagcataaacaatattttgaaccaaatcaaccagtgactgatcgactgctatacattaacaacgacttttgtttaagttgcatgaacgatatgttgaggtgatgtgaggtcattgatcgatctcgcagttgtgcatcgtgaaccaaaggtactatctccatgtttatgactagtacatctgtacgcgcagagtaattgcaatacaatccatcatccatggcatggttgcatgaattttaaagagtcatacaaaccctatatagaggcagattgaatgccctaaaatgtcacagtttatcagctcatctcatcccgggtagcaaattcagaagtcctcaccacctattcatatgcaaaattgatggcagacagtgaaaattcatacccggcgctgcaagcatgaactctacatgcatgatgcagcaagagagcgaaatcccagaaaaaaaaaacgcaccagagagcaatacaacgcatgcagtcagcagtctcgtctacacaattcaaaatccggccctgtttattttgtactactaccgatcgggcacggatcagcacaaatcgtagcgattccacgcccaaattggaggtccaaaccctaacacccagagatttaggaaattgccccccaaattcaaaacaaagtctctatgtataatcccaagctgcaaccatcaaaccatgaacaaacccaaaatgtacctaagcgatcaggccaaccaggccaggggccagtgcctctccgatccgcgcgtcgtcaggtacagccggagcccggaggacatcacgccgcggcggcgccttctccctcgcgagataattttttttttaagacttttgtctcgggaagaaacttctagaggtttctagaagatactggagttggagaggtggggggcgatctggctgttgaggaaggcaggaaagccatctgtttttttttttcctttcacttccttcctgggctttatttacaactatcggcttcgtgaggcccaagggggaagaagaagctttcaaatatgggccggaatctggcaaggccctggcccaacaaagagagcagagtccaatacagaaccagccgattcgcctcctcctgcacaagctgaagctgcaacgcaaccgccgcctccgccgctggcgcgctggtcggcggcgatggcgggcggcgctggggggccggaggatcttgggaagccggagctctctcccctgaggctgtagcccgttgctgtagccgcggtagtgctgtagtggggaattggagggggggcaaaagggagatcgtgctgggatgggggcgagcctgcacgcgtcgtgcttctcgcggcgcaggagcccgaagacgagggcgaggtcgtcggagagtgcgaggctgccatggccggcgtccttgcgaggttaagcgcctgcccctctaggcctctaacttcgcatcctctttcttcctccctatgttgcagaatcctcttacgaaaatgttggtgggtgttccaggaaatatcaacaggaacattctttgcagatggagatggaattggtaaaaccttctttactattcagaatgttttcctgttagcactggcttgagcattcttacatatctatgttctgttctgttacatcttatataggtgaagtttgatagtttgacactttattcgttgccattttgatcatttgtattgtagtgtacatgcaggtgataattggggatgcatttttatgtcggaatggaagaattgagtagttgtttgcaaccttcagtacaatctactggtgagtagtttgtcttgtttgagtctgacagtccgtacgagactatgtcaagatcaataaaagcatgcaatctattcatatgcataattagctagatgactttgtacctttgcaggtaatttgtttcattacagatgatgcagttttgggactgatgatgaatgataagttagctagctagcaaacattagaagctaattttaaagttgctgaacttccgtagtaactaaactctgaaatacactatctaaagtatgtgacactgcctgataaaatgttaaggaagtgtaagcatttcttgatacaaatgctctctcttatttgctgatgatctaatctaatatttattttgctccatataattcatgctcatgttagtgaaggtataaattgcgagcactttcaccattaggcattaagtgctttagcctgtgttgctttacttttcctgtgaatattatccacacctgattatttaaatcataccctttttgataagcatggatgtagtctataaattctataagataaagcttaagttcagttttgttctgatagtacagattagataaagatggcatcgattcttatctctgtctatcgttttttctttcctgtctagtatccatcttcaatgtcttttagcaaggaggaacgaagaaaagaaacatattgtatattttaccttttatttttgcttatcttggttctaccatcaatgcttgcactattttgtctttaccaatggaaaagcgaagcactgcacatgtgtaagttaaaggaactcttttggcttacttctgcaatttcttaagtcttaacatgatataatggcttgatattgttgagttgccagttttgtaatagtagtttgagtcatatataagtatgcattcatttttggaaaaaaaaatatggaaagatgagagggtgagaagtgagataggacgtgggatttctcttttgatgaagaatctagcaaagtgaagctgacaagcatagcacagatcaacggtgcttttcctctttgctttgacaaataccaaataaggctaacaccgatggtagcttcaaaacaagaagatcatgtaaattcatccttgttatcaacaaattgcatgcattatcactgagaaaatatctgatgctgtctgccgaattgccaatattgtcaatttggggaattaccctataatacataaaagactttgatatgtaatacttgctgctgatgctaaggttctgagttgaaaactgcaacaagcaaataaaatacattttacttccattttttttctgcatgggttactttgtctcattttgctgtgtggatactaaagtatatctcttgcttgtaacttaagattggttatatagactaggactccaaagcataaagtgatgagttaagataacattaataagagagcttggtacagtcatatcacgtacacatagatgtccacagctgcatcactgaggaagtgttagtgcaatggttagaccaagaagtgcttgaggcaaaatgtgcaaacaattttgtgtatatcaggaatcgagtattcccaacctttggcacatacatgctcttgatattttacatgaaactcatatgatagcttcttttttacagaagaataagttgaaactaaaaaaaaccttccagtgattaccttcatggtgtatacaagctattgcctgaaaattttggttgatcctaactctcttcaatgtttttttctcttttggggcactatctcatctaaaatccctgcgattcaagtacctctctcaggcattcgatccttcgccatttgcgtgctcatctaactatatacagacacaaactcacagccctttagtccactggtggtatatgtatttgacaccaaaatgttgttagttctcattatcgaccaaatttaggaaatgtgatttttatcatttatatttaatcatctcaaggggtactttgaatgactacttaagtaatttttttgttattacacattgatgagacatcaaactatgctgacttggataccagagtggcagttggactgctataggcaaattgaaattagcatgcagctctggggaggaaacatcactcacggtttatgtaatgccttaagatcacacattgacttatttttgtgccagaattgaatatgaaatgcagctgtcttggacacctgagtgggctttgaggttgtatatgtcaatactgcatgaaagaaacatgcagatttgtggacaaaggagcactcatggtttttataatgcttcaagataacaagtttaacttatttcgtgttagaattgcttttttttgtcggctaaataggtgctttaccagtaggattggtgttgatggcccaagcagctctaaggcgacaagtcagcccccaattcgctagctagctggttctggcgcacacaaagtggaggggatcaaaacaggcaatagccaataaataatttgtttgtgagtgctctaagaatatgtagctgctccatttgctttgtgtttaagcttaaatgattcatctttcagtacttggtgcagtctccttgttcctacagttatatagttgaacttcaagttgcagaatctacataatttatatcaagtttgcaattgattccctttggatctgttaattttaatgatgaaatttgatgataaatccagtaaatttaaattgacaaacttatctgggattttttttctgcatttaggggtactgtttccataaattaacaagaaagggcaccaacgttattttgttttttcgccgggaaggccgaaggaggccatccgagtatattaaaaaggaataaagttacaagaaaaaactcgacagaggctgtcgaggtcggaggtgcatcgaaatgcacaaccaaagccacatgctaatcacacaagcacaacccactgagagaaaaacctagcaccgagacgacccccgctatgcgtggccgatcgccgccgggccaacgacaacaccacaaagacgggactctaaaagtgatgcccctaaggaggtcacgacatcaaggatgccgccatcgcccatctaaggagatgtggttttcacctagagaaaactcgccaagggagaaaggtatccttgccagcgccctcaagggggttacgacgcccaaaagcgtagccgctgccagcccgatgaatcatcaggcgaggctttcacccggaaacccttcaaccttgcttgaggttcgtcgcccatcaactcaggaaccacctcacaagcagatcagcacgaggcctccaccacactgcgccggcgcccctccacctgccgaccaccacacttgctgcatagagctgccgccaccctaggaactggcccagacttcctccgtcctgccacccgtcgacctccttgccagctttagccgaaggataacccggaattggacggcgtcgtgtcggcggtctgagctcccctcgctaaccggctgccgcctcaatccaacatagaaactccccacagagaaggggaggagctccaggaagggcgagggtgcaggctggcagcgaggaagacgacccactgccgccagctcccttagcactgccatcactcccttcactccctgcctcagggcctacgagccgccatgcccaccccaacgccaccaccgctgcaccagaaggccagaccgccgccgtccgaccgcccatgctgcgccgcgccgaccacgggccacgatctggccgcgccctccgggaggaccgccgccgccgccgccatccatccgcccaggccgccgcccggatgcagttggccccgccctccatgagggctgtcgccgctgcgccaatccccggccgccgccccgtgctggaccacggtgtcccacggccacccgcgccgagccgcgacacgcgcgccgcctctgagccccggccgtcacgccggggataggtgtaacaccctgaaaattcgacgacaaaaatctaaactctaaaaatgcggattttcaaaaactttttaaataaattgcatcatgccgattttattcgattattttattggagtttgggttcggagtttataaatcgcgaataatggataattggttaggaataaaccctaaaaagtaaatggacaaagtaagtaattaaagtgcaacttaaaataagatttggtgaggatagaaatgagtaaaatattattacgaccatatttatatccatcaaatttaaaagcaatggaatgagaattaactctaattaagttcaagtaaattacaataataatatataaaacatggaataaattaatctagaatgaatccatggattggaatggcacaaatattgagtatacttcatttatgcaaaatttgggaattaaagaatcaaatttaaataataaatgggccaaaatcgggttaattagaaaacggcactgttcattgcacctaaagtgttcgacgaggtcccctagccctagcccctcctttgccgcgttgccctcgcgccccgcgcgccgcacgccgctccacctcccctctgccgacgccgtcgccatcaccgcgcctggccgcccctaaccccgcgccgccgtcgccgtcgtttccgtcgcgtcgccgcgccgccgtccatcgccttgcgccgcgcaccgccgctaccgccgtgccgttgcgcgtcgctcgccgccatcccgtcgcgccgtcccatcgcgccgcgcgccgtcacgtcgccactgccgagccgtcgccgtcgtcgcctcgcgccccgtgccgcgccgctcccccgagccccgtgccgccgctactaccgcgccgcgccgcccgttccatcgtcgcgcgccgtcgccgttcggccgtcgcgtcgccgctgccgcgccatcgccatcgcacgtcgcatcacctgccgcgccgcgcccccgagccccgtgccgccgctgctgccgcgccgctgccgctcctcgcgccccgcgccctgccgcgccgcgtcgtcgtcacatcgccgcgtcgagccccgcgccgcgccaccccgacgacgccatgaggccgccgcccctctcccctcttccccattatctctctcccccctcccttatataagcccccctactcccactcttccccttcatcctcacctcctctcctgtacccacgccaccacgccgccgcgccgtcgcatagagccgccgcgccgccgccacgaagccgccgcgccgcgctgcaccttgcgccgacgtcaccaccgtcgccgtcgccgccgtcgccgccaccgccgtcggtaagccgctgcctccaccacttgctcggccgccgtcgccgccccgggtagcagagagccgagagagagagagagagagagagggagaaaccgagggagagaaagaagaaggaaggatgagagaaaccgggagggagagggagaaggaaaaagaaaagaaaagggagagagagaaggaaaaagaaaagaaaagagagagagagaaagaaaagaaaaagaaaaagaaaggaaggaaaaagaaaaagaagggaagaaaaagaaaagggaaatagataggaaattagagggagattagggaagtttagaaaatttaaaataattagcatttagttatagactagttatagacgtagaattgcgaaatttaatataaattatggattattcttggtaatttctacaagaaatcaattcgcggtagtagtttaaatgtaattaagaactaaacgattagatgaattcttatagactattatagattattttgggtaatctctataagtaattgatttacggtagaaattcggatttaatcactaggaattttagacgtatattatatttagtcgtttagtcctagactaaaatttaattgtataatattataagataattttaggattccgtccgatatttagcttgcgatagaaatttccaacctattatatggatataatgctcgggtagattaaattaaaaacttatgataacaaaatatttatacccgcaaaatagtttaggatataaaaatcgaaattgggtttgccctagttcgcgaatagtaaagttaatataaaagaatcgacttaagcgttcgacttccatttggatttatttggatttttatttgaattctaaccgaattcaaatcaattttcacacgtaactatagagcccgagggagttgcggatccaagtgaaggccaagacccgcaagactttgagcaaggcaagtcatcactatttctttaacatgttgatcccaattgtaaaattgttttgtttacaaataaaattgcatgcaatgatgaacatcctacttgtgattatgccatgccttgattattgtttgccccttattccttcgtaaccatgtttacgtatgagtccctagtcaattatgacaattgcttagaaatgctattctagaatcatgcatactcatatttatcaaatgatgcttgggcaattacttttgggaaggtaattgagatgcggcatgtggagacatgagcgccacattgccatgatgttgatgacatgatttgtgaaaggagaaataaaattaaacaattgttttcgactggggtggacgaaggatttgggtggtatctgggaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacagccgttgaggtagggccgagaggcgtgccctacatcggtgtcgccattggtaggactgccatgagtgtgtgtgagagagaacttaacttgaaccataatttaatatgtgtgagacttctcttttccgggagcgccagaactcctcacactgctagaaacatggacacctagagtgcatgaggatttaagttcatggagcggatactgccaatgcgaggttatcgaaaagctttgccgtgacgcgtctcatgtgttgggacgaggctcatgtgttgagcagtcgcggagtgcgggtaaagtgtacatccactgcagtgtgagtaaaccaaatctattcgaatagccgtgctcgcggttattgagcaccgggacatgtattacacttggctagactctaaattctttaacttgtgtgggatgggatattgcatgatgatttttatgctgatggagccacttcctgagaggcgggaatatggacgtcctcagaaaaccataacgactcaatggcgggaagctatccttgggatcacaatggatggtggacagaaccatcattatttaatatgaacactggtattaaaacttgatcagtctatgctaggtcttaggcttgtgaaaagaattacaaaacttgctttgcgcaaaagaaccatagccatcctttgaattcctctgtcatgtgcatcattgctgtggtggcttgctgagtacggttggtactcacccttgcaaatataatcagaagcgggagatgaagcttcggaggatccctatgcctactactaggagggagatgaagacgatggcgctcagtaggtcttagttacggtcgttgcctgtggcaatggcgtgccactgccttaactccactgccttacctacttctgtttttggaatgtattccggaccgctcggtccgatgatttaagactgtgcctgcgggcttatgatgtaataattcgtactagactctcgtgtatgtgcacttgatatttcagctatgagttcgtgtgtaccagactacttgatccagggaaatggtactgtttacacgattgattcctgttataaaaacgggggtccacaatagggcggccagatccggccaccgccggatccgcccgccgtccgccaggccgcgccgcgccgccaccccgcgctggcccgcgacgccccgcggccgaccgcgcgctgccggcgagccctggccgtcgcgcctcccgatccggacgtggggcggccaaatccggccaaagaagtgccagatccgccgccaccccaagctgccccgccgtcgtcgcctctggtcgtggtggtagacgtcgtcagcccaactccgtcctcctcgcaccaaggaaagggttgctgcagtggaaggcctcgccgccgccttcccggctcgccgttgacgagctccggcggcggcgaggtgaagggagaggaggggggtggcggcgcgggcggctagggtttcgccccccgagccgcccgcgcgagagcgacgcgggggagagaggaagagctcatctgtttccaacgttattttgttgctgggctggccaaagattaggccgactaaatttctttaagattaagagtttgtacaactgtacaagtgttaaatatttcgacaagaagctgttgaaattgaatggagtttgccgagaggcaccctcccaaaagcaaaagagattacacctctgttgttataacgttatgcatgaaggtattcctgtttctcctttgcatatatagttaactagtttattcacttcctttcttcaaagtagacaagattgtactaagaaggagcaaggggagtcacatagtttctcctttgtgcctttgtctatattttgtgtgttacatggaattgtgtttgactaggtccagctaagtcacgcaccaactattaaaggtcaaatttgtaggtccttgccagaatgtttacagtcgtccatgatgacctttgagctgtcttatttctgaaacacacaaatccatgttccagcttaatctctattcttgcgtatgttctttatagtattattaggcagacaatagatggtgctgcttgtggccccccgatccccagaaaacccactgagatgcagcccacttgccacaagcaaagaagcttccaattgtgcaccttctggcctttgccaaaagcatttgtctcaactggttgtcaggaccaatgggatagcccgtcgtactaaaccaaataaataaatgaaaccatattatttgttgtgtcgaagagtctataaatacttcatcacaaaccagcttatggttctatcttaggaagaacagggcagacccacgcaactaggtgagcccaagatcttcagttgcaggattccgaagaaggcttttgtccatacaccaagggtagagatgtactcaagaaggatactgctgcacaccccattctctgggcaaccctctggccctagtcagccggtgtctggagccaccatcgttgaaggtggttctcccgggagcaactttgatgcaaacatcgtcatgatcctagctgttcttctctgtgcactgatctgtgcgcttgggctcaactcaattgtccggtgcgcgctaaggtgttcaagccggatggtggtggatcctgagccgagtcgggtcacgcggctggctcagagcgggctgaggaggaaggccctccgatccatgcctatccttctctactcaactgggttgaagctcaatactgtgagtcctatgtgtgcaatctgcctctccgactttgaggacggggagcatgtcagggtcctcccaaagtgcaaccatgggttccatgtcagatgcattgaccggtggctcttggcgcggtcgacgtgcccaacatgccggcagtccctgtttggggcaccacagaaggcctctggctgctccgagtccgagggaagccaggccgagccagcgccagctcgccctgtgctggcgccacttagacctgaaggtttggttactccatatgatttttagagccttccattgcttctagttgttgcatcaagcataagggagtgtggtgaaatagaactaggttgtgaacgtgtgatttttaggtgttactgccaaactggcttgtactgctgtacattgtgtggtagatctgtagtaaaaaaaaattgctgtacagattgatttggaattctattagtgtgttaatacctgatgttgctcgagaatgaggcgtggatagaaaaaaaaaggtgctattggcttctgtgaatcacattttctatgccattttgtagggaagaaataggagtgaagatttcagatctaatcatatggcagtgctgcaccaacaatcaaccattatgttggttggaaatcaagcattagttgctaaggttcaagtcagtgggacaagcatattctcctgcaattatcgagagatcagggctttgttatctgaatgcattgtggtcatctatgtcccagaattgacaggtgggtccacggccgactatgccctgtgcactttggctattttgtgctgtctgctccaaaagcttgaaaggtaagtggccaatccacacacaatcttttctgcagcttcctggaaagctaatgcctttaaagaatctgctagcttagcaactgtgtggttcatatgaatttgaaagaaaaataacaaggagatcacttaactgtgcacactgaaaacgaaaactgcttggatgcccactgaatgggaagataaactctttttctgaacttgcagtggttatgagaatgttgtagcagtgttacatatagcttgataacagtttcactatacacaagggcccactcagaatatatgttatgtgataatgttgtcgcaatgttacatactccttccgtcttataatataagagattttgaaaggatatgacacattctactactacgaatctgaacaggatatgtcatatccttccaaaatcccttatattatgggatggagagagtactaatttggtaacagtttcactatacttaagggcccactagaagatatgctatgatgagaatgttgtagcagtgagtagaatttgataatagttattttatttgttctaaggccccaccaagaagatacgttacgagtatttgaaaaggatgttagcactgctgttgccccttacaagaaaggagggccaatggttgatagagttcatctgaatgccttttttttttggaacgatatcatccgaatccgattgcttttaagaacagtttgtagcgtatgaagtctgaactactcatgttgaagctggcaatgatattgtctgccaattttgcgaacactaataatcaaaatcttcttcagccttgtatttgacatagacatgtttttcttttggatatatcaaaacgaaggaaaatactgttatcaactattcaaagaaaattacgagtcctttgtgtactttggggaaggaaagaaaatagaggtctacgaaacaactattttcttctatattttctatataccaatttccacgcaatggattcttccttcaataaagaagttatgaaagcgacattttttttctgcaatgaaattaagaataatcttataatagtcagtatgaattacaattcaatgcgtctgacctttgacattttagatctcaaatcaaccaccatcaaatataaaaaagttatgaaaatgacatatttcctacagtgaaattaagttgagatgccactagtgataagaggtgtgtggtttcaactctgaagtcatgtgttcaatccctaagttttttttcttaaaaattgtttgaagggacatctctcccttcaaatctagtttttttaacagtgaaattaagaagtcttacaatattcagcatgaatcacaatcttaaatgcttctgatcttcgacatttagatctcaaatcaaccaccatttctcgggcggagctagagtgagatggagggggtgccacttgtttaatttactctgttttatatcaagtttaagctaatgcgggtgtctaatttatagtgaaaatatgccagatatagctatattttttttgaccgggttccttggcaccctccttaatactctagctccacccctgatttctcccactataacaagatatcatatttcttcgagaggcgttgcctatcattaacccaaaatggagccgcaaaggggatgataagcctagtccacaagtggcaagttaaagggaatatggccattggggggggggggggggggcatatcatgtactagtaaagctatatgatctccatctatctggttgatatgactgcagcatcatcttgcaacctcaaatgctctctcagtggggagggttcatttcagcccctgattcctttgaaagcccctcggactgattgaccaagcataaggtgaaaacacagcagggggggatcatccaatgagcggctgcgtgactcttgttcgttcgggtgggtgtagttggagtatgatacggcagccgcgacggaggccaaaccttagcggaaaagcatgatgagcacgccggtcacctctcaattatcatcgctgatcacctcttataagatcctttccggagctttgacgcctgatgtccgttgctccacgccttgacatggttcaccacagcttttgaacaatgtgaataattcctgtgtctcataaagagtgcacttttcagtttttatacgacgtttgactcttcatcttatttattttttattactatttttattgttattagatgataaaacatgaaaaatactttatacgctactttttttcttaatttttttttcataaatttttcaaataagatggacggtcaaacgttggaaataaaaacccaaaaatgcgttcttgcagatggactgatgtgcgtgatcttgcagatgaagctacaagggcagtagagtgtacatggtttgtaccacacttaggccctgtttagttcgcaggacgaaaagttttggcgtgtcacatcggatatacggacacatatttgaagtattaaacatagactaataacaaaacaaattacagattccgtctgtaaactgcgagacgaatttattaagcctaattaatccgttattagcaaatgttactgtagcaccacattgtcaaatcatgaagcaattaggcttaaaagattcgtctcgcaattttacacgtaatctacgtgattagttttttttttctatatttaatactccatgcatgtgttcaaacattcgatgtgacagtgtgaaaagtttttgcgtgggacctaaacagagccttaggttgtgttagtttgtgttggttgggaacatatccctccgccacggaaaatgaaatagctcattagcgcatgactaattaactattaactaaaactaacttgaatggattaacatgatttttaaagcaacctatatattttttttaaacacacaccgtttaacagtttgaaaagcgtacacagcctttatgtatggaatgaaacccatctgtgcatcttttcctattattccgttgcaaccgatataattgtataaagttatagaatatgcgttaaatatacaacatgaaaaaaaattgcacaatctcttatgcggaactatggccacgttgattatggattttagaatttcgtttgcacacttcccaagttcttaaacaatatatttcatgcaaaagaacattctacataaattttttttggagtgcttttcaacaataacgtttcaatatttctttcgtttataccattaaatagcaatacaaaaattaaattatccatcaacttacaactatctcaaaccgggcatatgaaccctatgactaatgtgatttggtcccaaagtttgccctcctagtcgtttggtggcttcaattgaattgacatgtaaccttatcctatcaaaacttacggatttgaccctaccaacaatcttacaggcatcttcatcgtttgttcttcagcttatcaactccgactaaaaactattctaagttgatattgttgtttttcttcgtagcttattttccagcgttgccatttaagtattaaaaaccatatacaaaaatctttatgcacagattaatcttaaatggtttataagaattacagcttatcatcagttgcaaaccggtggtactgcttgagaaaaccaaagtctcttaatcctgtgcagaatgagtgtgtccacaagcaatgtggcccaccaggccgctgttaggccagaatgggcctacgcctgggccgcatcttcaatcgggctaaaaaaaagtcatcatctccgctcccacccaagatcctctgacgtctgggtccaccgatcctcccccatcccgtcccagccaatagcgtcgcgcccttccccccacccgcggatcgcggccatcgttagactcatcccagccgtccacctaatccgacgctccaaaccccaccccccaaaaatcccaaaatttttcgcgatcccgcgccttccgccaactacaaatacccccgcgcccccaacccgaaatccccacgcctcaattcaaaaaatccattcgaatttcgcagcaaagagatcgagagagagatccatcaatccatcatccatggcgcgcacgaagcagacggcgaggaagtcgaccggcgggaaggcgcctcggaagcagctggcgacgaaggcggcgcggaagtcggcgccggcgaccggcggcgtgaagaagccgcaccgcttccggccgggcacggtggcactccgggagatccgcaagtaccagaagagcacggagctgctgatccggaagctcccgttccagcggctggtgcgggagatcgcgcaggacttcaagacggacctccggttccagtcgtccgccgtcgccgcgctgcaggaggccgccgaggcctacctcgtcggcctcttcgaggacaccaacctctgcgccatccacgccaagcgcgtcaccatcatgcccaaggacatccagctcgcccgccgcatcaggggcgagagggcttgatgccgttattgttcgagttcatggcttgttagatctagaagtgttaattaacccatggatctgtgttatcctgtaatcactcgcttgaattgggttcgcattgatggaatacaatctgttcttggcaaactgtgggatttgtttgtctgtttcgtgggttgtttgatgctagtatctgaagatggtagctaggcaatacgtttctgtcagtctgcatgtcgatgggtatgcggatgatttgggaatcaaccaccctatatttcattttatttgtaggcttgcagtggagccatgaaatttcatgtgtttggtaatttttctctttgattgtcagatattgcaattttttttttcagattttccttttgaagtaaaacactatacgaaagaatcctacagtgtcatattaataaatatataatatttacaaagtacaatttacaccaaaggtgattacaagttctctagccattgtttaacttttgggaaataagattgtttcgccctttggataaccacggcaaattcttgtcttaaagagaaactgatctgaagaagagaatttatgtttctgaagattctattgttcctccagatccagatactccatgccattgttatgactatctccatatactcaattttttcagattgaatgcagaaaaaggaaaatgctttatactaccagtgtgttttgggtcaattcgatcgacacattcactgttaccaaatctgatactaactgataagcactgaggactgatatgttatgggcttttggatcaattcttgggcttgttcttccgcgaagggccaactggccatgtctgaactcacaatccaaaaggaagacaattattaggagtatcaattatcataaccatccaaaaaaagatcatacgagggaagacttgcagaaggtttcagagcaatgatcactgtccgtcaccaactacccttcatcaaattgtttcataaaaacaaagactagcagtggactggtaccaggttacagctttgggattgtcggcaaagccagttcatacttcgccatgcggctccgaccatgtactgcaatcacacaaacagcgagaaaaaagaatatgagcattaaacaaaggctaatgcaggtgtgagcctgcgccccacaattgctttcatctgcacgactgactttaatttccctccagtaatcaaatcagtgggaatatttacaaccagtactccatatctatctatacacgtacagtagttgatgaactaagatgaccatatataggttcagtcctagttcatgctcacactctctgctctgttgagttacccaatttgaatagagtaaacttatctctacagtaaaggattcagatatctcaaactgtagatgtaaaaacaaaatgatttgaagaactaagaatgaagaaacttttaagaggcacaggggtatggcctcctgaggctctaaaaggttcaggcaaggaccatgtgaagttacaaccgatgccacattttctagtaggcagtcaggatccctggaccagcattccattcattgcactcatgaccaatcggcaatcgccatgcgagtccggggtaaatgattgatcaatattccagcacaagaataatatttgtcggattctcgatcacctttgctctagacaacaacttcatccctttcccaatgaaaaaaaaagaagaagatcactgtacactagacaacaaaaatatgtcatgccttttccaataaaaaaagaacccatgccatcctgctcaattccctgataacatttgctacccctttttctcatgtgctcctcaccatttcctaacacctatttaagtgccccaagtggcaagaaacttaagtatccattccaacattgtggcagctccctctgaaatcccctcttccaatcatatccaccagctcacagtttgtgatccactatgactatcctccttgtcattcttgggcttcatctctgcagcctacacctccctgcaatctctgctgcagcagacacgctctctcccggccaatcgatcgccggcgacgacaggctcgtctccagcaacggcaagttcgcgctcggcttcttcaacaccggcagtaagtcctctggaaatgacactctcagctactggtacctaggcatatggttcaacaaagtcccaaacaaaacccatgtttggatagcaaacaggggtagcccggtcacagatgcaacctcatcacatctcacaatctcccccgatggcaacctcgccatcgtaagccgagccgatagctccatcgtttggtctagccaagccaacatcacaagcaacaacaccgttgccgtgctcttggacaccggaaaccttgtactacaaagctcctcaaactcatcacacattttgtgggagagtttcgaccatccgaccgatgttttcctccccagtgcgaagattggtctcaacaagatcaccggcctaaaccgccgtatcttttcgagaagggatctagtagaccaatccccaagtgtgtactctatggagtttggacccaagggtggttaccagttggtatggaactcatcggtagaatactggtctagcggcgaatggaacggccggtacttcagcaggataccggagatggtagtcaagtcaccccattataccccattcattttccaaatcgaatatgtgaacaatgatcaagaggtgtacttcacataccgcatacacgatgaaaccataccactgtacaccgtgctagaagtaactgggcaaagaaaggccttggcctggttaaatgacacacagggttggcaagcagtcttcacccatccaaatgatcagtgtgaagttgctgctacctgtgggcctttcacaatctgcaatgacaacacatttccatcttgtagctgcatggaaggcttctccatagaatcacctgacagctgggaactaggagacagaacaggtgggtgcaggaggaacattccattagattgtgttagcagcagaagtgacatcttcaacgctgtaccggccactagattgccctacaatgcccatgccgtagaatccgtcacgactgcgggcgaatgcgagagtatttgccttggcaagtgctcttgcacggcatattcatttggtaattacaatggttgctccatatggcatggtaaattggttaatgtgaaacaacaaactgatgacagcacctctgctaatggagaaacacttcacattcgccttgctgctagagagcttcaagctagaaaaagcaataaagggttagttgtaggggttgttgtatctgcaagcctctctgctttgggtatcttaacacttgtcttgctactgatcatgatcaggaggcacagaaagaagttgcactgtcaagcattgaacagcatttatgctggtactggagttataccattcagatatagtgatttgcaacgtgcaactaaaaatttttcggagcaaattggggcaggtggttttggttctgtgttcaaggggttgttaaacgggtcaaccgctatagcagtgaaaaggcttgtctcctattgtcaagtggagaagcaattcagggctgaggtgagttccattggagtcattcatcacaccaatttggtcaaactgattggtttctcttgcaagggtgatgagaggttgcttgtttacgaatacatgtcgaatggctcccttgatactcatttattcagaagcaataacagtgtaaccctgaattggagtactagatatcagatagctcttggagttgctcgaggactggcttacttgcacgagagttgtcgagattgcatcatacattgcgatatcaagccacaaaacatacttctcgatgatttgttcgttccaaaaattgctgactttggaatggcaaagcttctaggaagggattttagtcgggttatgactacagcaagaggaactattggatatctagcacctgaatggtttagcggagtggctgtcacgccaaaagttgatgtgtatgcttatggaatggtactcttggaaattatatctggaaagatgaactcgcatagagagtctaatagttatgctgatcacatcgtttgtttccctcttgaagttgcacataagcttcttgagggggatgttctaagcttggttgatggcaaattaaatggcgatgtcaatgtcgaggaggctgaaagagcttgcaagcttgcatgttggtgcattcaagagaatgaacttgaccggccgacaatgggtaaggtggtccaaattcttgaaggtctactcgaacttgatttgcccccgatgccaaggctacttcagtctatagtacagagctcatggaaaacagagacccaacactgatttgtaatgccaaaagaagtgctaggataaaataatgtctttccatggcttttttgtggcatatgttggtatgaagagagttttagcttgtaatgccttgtgtgctatgttgatgattttggacatgttgtgccataagatgttatatgctccgtttataaacacgcagttacaagtgtacacaatttgctttatttgttttgctatatataatgatgcgcatgaatgatgtgaaatatttttcggtcgacccggcaaataaatgatgtgaaatacatatttactctaggcctctagcttaataaaaaatattccgcagcaaacacagagccataagccttatcagccttgcatggagacaatgctagtttcagggacctttcagaattctggtattgtactaggaaatattactctcttgagtcataaatatactctgtttgtactaggaaactttcagagcatgtcatttgattttttttagcttttctcaagaaagaatgttgtaggttttaaaaatactactttgaccacaattttatactccctccgacccaaaataagtgcagttttacactattcatgaccaatatttgaccgttcgtcttatttgaaaattttaaatgagtattattttttttattattagatgataaaacatgaatagtactttatgtgtgactaattttttttattttttttcataattttcaaataagacggacagtgatcaaacgtttggacacagatattcacggctgtacttatttgggacggatgtagtaccatattacaaaagtttgtaattaaaatattgcaagtttatagtataatcttctaaggtaaatctacctataacattttttatgtttttaaactaagcactttttaaaaataaaagtttgcaatgttgatctaatcaatgataggcgatgtacccgtcgacaacaacaaggtgcccgtgatgacttcgtcaatctcagatatgctggcttagtttttcggagatacacatagagatagagtgtgcatgtatacgtttataggaggtgagtgtgtgtatgttgcgagcgtctgacgtttgtattgtgtttctcagaaaaaaaaaatatgccagctaaccaaaacactctaccgcgtaaaaattagagtgcatgtggctgccgttctccccggtcttgtagcgttcatgtgttccatgctttccatgatcgatacatcgattcaaactaagctagttagagatggtacggtttttgtcacgccctgaagttcccctcccttgctctaaattcataaaataaatcgtccgaagaaattgtttaatttaacctagagagaaaccctaaagtaataaatgcaaataataatcggaatcggcatgtggaatttttcttgggttctacatgtcaaaatacgctaacaggatttttagtggaattttcagagccttggaaataattttaaccaattaaaataagcaaagtgcaatattaaatccctgggaaaatccttttttcctttttatctttcctttttccccctctttttcctcctttgggccgccggcccatctctcccgccccctcccgaagtccaggtcgcctccccctcactccctcgggcgctgacaggtggggcccacctgtcagccctttccctaacctccggcagccgccaccatccgccgccgaaaccgccgcccacgccgccgcttcctccgccttccgcgtcccgggccacgtcgcccactttccccgcgcgccccgccctccccgcgcccacgccccactcccgctcaccccccgcgcccgcgagatggccgggattcaaatttgaatcccgcctctctctctctcctcctccacctcctccactactccggcgaaattgcgccgttcccggccacgactcgccgccccctctccccttatttaagcatcgccggcaccccctctctctttttccccatttcgccgacccctcccgtgctccccatcgtccccgcgccgtgcaaccacccaccgccgcttcttcccgctactccggccgccgctagccgtcgctaggctcgccgccgtcttgcgccgtcgccgccgttcgattcgcgtggccgagatccaccccgtccacccctcctccgtcgaagttcgtcgccggagccctcatcccctcgcgcacgggtgagcaccacctccaccgccgccgtcggccatggtttccgatcgccgtggtccatctccctctctctaacccctcccaaccttttctctaggtcctcccggagcccgtcgccgtcgtcctcccgtctctcatcgttgctgttcgccgtcgctcctccctcgcgccggccgagcccctcggtgaggatcggtctccctctcttcctctctctccctttgccgcgccgcccgccgcgtagcgtcgccgctagggtcgctcgcgccgccgcttcggccgccgccgccgtctttgcgccgtctgccgccgcctcccgtcgccggttgccgtcgctggcaaccgtgcgcgcgcgccgccgccctcgccataaccggccggccggcttgaagccgagccgagccaggccgccttcctcctttccccgtgaaccgccgcccggtgggccccgcttgccagccgcgcccctcccgccttgtgccactgcccggtgggtcccgcctgccagccgcccctctccctctcttagtgtcactgacccgtgggtcccgcatgtcggcgccgccccaccccttggatgacgtcagccctggggcaatattgcgcaataaattgattaagggtttttctttattagtaaaaacacagataatcttctaaaaatcataactaattcatccgagctccgattaagtccattcaagtctcagtaaattcataaaaatgtgtagaatccattaaaaatggctttgttatctgtttcagtagtcttatagcatgttttgcttgtgtgctttgtttgtcgcgtagatttcggccgtttcgtcgatccgtggtttctcgaagacgttgctgtggttccatcagtgcgagagcaaggcaagtcatacattgcaattgatcatattgtacctaatttacaaatgtcccgcatttctattaaatattgcattgttttaccatatcatgtgggatgggtcctattactcagctatatgttgtttcccttatgccattgataacttgggtattaaaatgactagatgttggtttaggagatgcttagccatgcttagttcaactagtgcataaaaggggacaacattaaagcatagacttgattattggcaatagctttggattagtgccaccgcaatggtgttggctaattaaaatacattacctggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactggttagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtatgacttgctgagtacagtgggtagtactcagtcttgctctcttttcccccacatcagagttgaagtccttctcagttgaagatgtctcgaagaggttggtttcgtcgctgccgtcaaggatgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacagttttccaattgactggctctcaatcatttgcagctttggagtctttgcccactgtaattgtgcacaaaatacaggttagacccatgccgaccagaagtcatccagctgtgcactgatcgagcaaaccaaagaccaaagaaacaggggtagtctaacgcgcaaacgcgtgaattcacacgcttcaattctagtaatagttaaaaaaaagttatgtttagcaactttcattagatatgattaaaaaagaccgtcatgattcaagaaactttccacagaagatttgaaaataatttacaggaaagactaaagaatactcggaaaacaacttccaactattccatgttgagaaaaagaatctctctacttgccactaacgactgacttgtccttttacaatccagttgcaatcatgtacaagttgcagtatcactgccttttctcctgtgatggctgatggaactgtcgcgtttaatataatccagttgcagtatcaagtaggagtacaagttgcagtacattaaatgtacaagattcatactatgaacatcaatttggatgtcataaagaacttaaggactagctatttacaaacaataacgtcaagttggatcttggatgttataaaagactcagttaccatggctactccctatgtccctcccattctttagccaacgctcgatgccatctcaccgggacaagagctcgccgccggcgacaagctcgtgtccagcaatggcaggttcgccctcggcttcttccaaaccgacagtaacaagtcctcctccaatagcactccgaacatttacctaggcatctggttcaacaccgtccccaaattcacccctgtatgggttgccaacggcgaaaaccctgtcgcggatctcgcgtcgtgcaagctcctagtttccagcgatggcaacctcgccatcgttgcaacgacccatgccaagaactcctccatggtctggtccagcaaagccaacatcccaaccaacaccacccatgctgttctcctggacgatggaaaccttgtcctgcgtagcactagcacaaccaatgcatcatccaccattctctggcaaagctttgatcacccgacagacactgttctgcagggtggaaagatcggctggaacaacgccaccggtgtgaaccgccgtcttgtctccaggaagaacaccgttgatcaagctcctggcatgtattccttcgagttgctcggacacaacggccctacctccatggtctccacgttcaactcctcgaatccgtattggtccagcggagactggaacggccggtacttcagcaacataccggagacggtaggacagacatggctatcactgaattttacaagcaatgagcaagagaagtatatcgagtatgcaattgcagatcccacggtgctatcacgtaccatactggatgtctccggccagctgaaggcgcttgtgtggttcgaggggtcgcgggattggcaaaccatcttcacggcacccaaatcgcagtgcgatgtctacgctttctgtggacctttcacggtctgcaacgacatcacattcccctcctgcacctgcatgaagggcttctcagtacaatcacctgaagattgggagctagatgaccgaacaggtggatgtgtgagaaatactccgctgctctgcaacagcaataaaactgcagcaggcacggcagataagttctatcctatgacttctgttcagcttcctgataaagcccagagcataggagcagctactagtgcagatgaatgtgcagctgcctgcctcagtagctgctcatgtactgcgtattcctacggtgaaggtggctgctctgtttggcatgacaagctgctcaatgtacgacaacaaggtaatggtgttctctaccttcgcctttctgcaaaagaagtactggaaagtaggagaaacaatagatggggggtgatccttggtgcttcaattggtgccagcactgctgctttgggtttgatctttctgctgatgatttggatcagaaaagggaagagatataacctcacaatggataatgttcagggaggcatgggaatcattgcatttagatacgttgatctccagcatgcaactaaaaatttttcggagaagttgggggccggcagttttggttctgtatttaaggggtcgctaagtgactcgactatcatagcagtgaaaaggcttgatggtgctcgccaaggagagaagcaattcagagctgaagtgagttccatagggataatccagcatgtaaacttggttaaactgattgggttttgctgcgaaggtgacaggaggttacttgtttatgaacacatgccaaagagttctcttgatgcccatctcttcccaagcagtggtgcagttttgagttggactattaggtaccaaatagccctcggagttgcaagaggactagcttatttgcattctagttgccgagactgcattatacactgtgatatcaaaccagagaacatacttcttgattcatctttcactcctaaagttgcagactttggaatggcaaagtttctcggaagggatttcagtcatgtcgtaactacaatgagaggaaccataggatatcttgctcctgagtggataagcggaacagctatcacatcaaaagtggacgtttacagctatggaatggttttgttagaaatcatttcaggaagcaggaactccagtaaacaatcttcgcgtgatggcgtgcatgaagcttgtttccccgtgcaagttgcacgcaatcttctgaacagagacattgacagtctggtggatgcaaacttgcatggtgaagtgaaactggagcaggttgaaagagtttgcaaagtcgcatgttggtgtattcaagacaatgagtttgatcgacccacaatgagtgaggtactacagtttctcgagggtctatctgaagttgagacacctccaatgccaagattgcttcatactcttgcaggaggtttagattcgaaaataatgtaatcactagttttgatcgttgttcgttcacctaggtagttctacacgtcacatttctcatctgccgtttatatcgtaagcttccttgccgcttcattatgccacccttgtaatgattgtaaccattattcccactcccagcagattgttaaacttacgtgttacatcctaataaatcagggggaaacttgacctttggtctgaagttcaaatacttgacccgaaatttcagatcaggaatgctagacatcatatgacagattttaggggagaaatcacgtgaatttccgaccttctctacctacgattcatgctccaagatcttctccagctccggcaactctagcaagctcgtgagtagtttgctttcggggttggtgtcaagtggtggcaaaggtggacggaggggtttcgtagcttagaggaacgaccgggacagtggcagcacgatggtgggccattggccgtgggggtgacaagtgagatggctatggcgccaccttggccacgggagaggaggtgacgggctggtgttggtggcgggggaagcttgtcattggagtggttaggaggtagtgggaggtggtgattgatctggtagtaggagctgccgaagacggaggaggatggtggcaccgaagctagggagtgtaaataagaaatgagatgaaatggggctgagaggagggggcttcgtggtctggcaagcctcaatggcgttggaggtgatgcccacgagggagagggtggtggggtgggtaggcgacatcggtatgggaggcatcgagatgcacgtgttgcacctggacgtcgacaccaacacggttggccgcgcccttggccgtcaatgccgacgcggatggcaacgcgtggccactatcgccgccgcccgttccttggccgtcgacgctaacgtggatggtggcacatggccgccgccatccgcgcctagccactgctggaggaagacggctcggccgccggtggagagtgatggctgggtgggtgaggaaatgaggatagggtagagggtggggaaattaaggtttggctttgtatatgataggctagatcggctttttgggcttgcaatattagtattaatagtctaatatacaccctcggggctctgcgggtcatccgcgggtggctgccatcccccgcccccgcccatggccggggcaccgacccggactctccacaggtcaaaatcagcacccgtccccgaccccgtaggggcggccccacgggggaaattgccacccctatggatggttatattttgatccaacagttaaaatttcataatatggaacccctagaacattctagtttatatatagacaatgtcattttagatattcatgagaacgtaaatgtcatctggaaatcctggagccaggatggagtcaggatggagtcaagatgtagaacttatgttaaattgataaaattggtgtttataacatttttatatctgtatgtagtatttaatctatgacatgtcagtttgaaattgaattaactatggtaaaagaatcttacaaaatgttgtactccctctaagctgataatattagtcgctttgaacaagggtaaagtcaaactttaaaatctttgactataaataatttctaaaatatttatcttaaaaatatgaaaaccatatgtgtagattagtattaaaaagtacttcaataaaatcatactccctccttcccaaattgattatcatataatggaatccaaaattttctcaaattgatcatcatataactgtatggacacggatttaatcggaatacaattaatacatcatgggagaatgtgtgcatggtagggtgtaattggcatggtgttttaatcgatgcatgcattgtgggagaatgtgtgcataatgtcttgattgatacgatttaaattatccttggtcttggtgcataaacacatatgatgatcattttgggatggagggagtatatttgttgatatttctatatatatactttttggagactgtgtccttgtccaaaacgacaagtattatcaaccccaagggagtattccaaatgagacctagatgataatagttagtgcacgtgcaaggcacatcgacatataaagaattgagtaaatattcttatattcttattttttttatacaataatggtgagaaacactggttgatggaaaatattttgaatcccaacgtttgcaaaaatgagaaccgttgcaaatactatcaattgagtccataggtaacaagaagaaaatttaaagttctacaacctaaactaatattttattacaatgaaattataaatgcaaaacttgtaaacaatttctagttccaacattagtccatgttagttgccagatcagttcccctcaggagattaggtattgtattacaatccagttttgaccattctaatcctaaggtaaccttgaagaaatcgtgaattttgttttggtaggttttctcgaacatatggatacatataggttatatgatgcattcaatacactactaatttatttatttcaaacataacaaatgaaatgtgtgcacgtgcattcaagaggagcatacatcccactgtttgttcacaacggaacactagtgcctgtatcgactatactgaccatacttatctaaaaattaggtatagatggttttaaagcatttagtagataacatatatataattcagatgagtctatagatatggatatactcgtcaaatggtcaaccttcaaaaacgttgcaacaaaaaaggatgtttctatttcaccttagcattttccgctagtgatctatttggtctccaagcattagaaaaaaattgatactatgtctacaaagtgcaatgagattgttggttaaaatagagattattaaaatggctaaagtatgtagttttgaagcatcattggtaccagatatccatcaatcttttatctatcactctcattggtcaagcaagactgaagtcacgaagccctacataagcataattctctttgttcctatgcgctagaaaagaatcaattggtacgttctatatcaggggttactgaacaaaatataacccctaatataaatgtaacccttgacaagaagaattatgcatatgtagggcctaaggacttcggtttggcttggccaatgagagtgagagatatagtgttgatgaatatctggtaccattgatgtttaaacactactcataatttggcaattttaataatttctatttaaaccaaccatgtcattacactttgcagccataatatcgatttttcttctaatgcttggggactaaagagatcactaccgagaaatgttaatgcaagctgaaatagaaaggtccattattgttgcaaggtttttggaagttgaccatgtgacgagtacgtacatgtctataggcgcatagatatgtaaattatatgttatctaataaatgctttaaaaccatcttattcctgatttttagaaagtttgtactccttacaatcattagtgtactgttgtggccaaatagtggaaactatgcttatcatgaaggtatgtgcagccatttcatttcttttatttgaaataaataagttaatgtgtatccagatgttcaagacaacctactaaacaccattgctattcatgatttcttcaaaattggtctcaggattaggatggtcaaaacatgactattttacgaagattgatggaataaaatgtttacaagttctccatttagttacattataataaaatactccctccaattttttttttaacattggttagatcaacatacattagcaaacatgggtagtaataatttaggtcgtggaaccttaatttttgttgttacctttgaactcaactgatatatttgtaacagttctcatttttgcacaaatcgagactcaaaatatctgttgtgaattgatgtttctcaccattgttagtgtaaagaataacaatttaagagtatttactccattctacaaataacaatttaagagtatttactccattctacatatgttgacgtgccttgcacattcacgttaattactccctccgggtaatcatatattcgtatatgacatttacaaaacttgagaacaaaaatagtttgattgctttgtccgaagcgccatgtacttatgactaaagggagtagtttcaatatatagtacggttaactcttattcggtttaatttctacgccaactttaatcataattttttattagaatataacacactaatatctaagaaaaaaacattctgtaaaggtacttataaagaaatatctatctatatgatttttatgttttcaaacttaaagaggtattatattgacggtcaaggttcaaaaagattgatagaataaaattaatcaacaatatcatagatgtgaatacggaggggagtaggagtaccttctttttccttccccctgcgatgggagattggatctttgctccagaatccaaatcctccacgacagtggtgctggtgcgtgagagattgggtcgtgcgtcttaccaggcgcccaacgacgagagctacggccgcgccgccgcgcgacaagcataccacaccgacgaggtccccccctccgccgcgaacgccgatctcagcacgccgccatcgacgaggtcacgctccaggtctagggctccgcatcggcttaccagtttgccgtcgcctgcaacacggctgacggcgctacgaggacgaggcaatgggggaacacgggcggcggaaccgagagatggagcttgggcctcatgttgcctgttgggccttgggttcagggccgctcggcccaaaatctccgggagatcagcgaggggccgtgcaggcctccaccagctcggagtatcgtatcgtgtaggaataagtctatttaccatctctcatcttcgtgtcgagtttaattgacatcccaaaaccaccagatatcttcaccaatcaccactcatcttgacaaaacaattcaaatcagagtgatttcgttgacgtgaaattctagtcagaaaaaaaaaataaaaagcatgtgaggcccatatgtaagtggaatacatattcgaaaatttcctatcggatccctccgatatgatattatttcagccgaaatttttaaaggagtaaaggaagaagatgtatgccatttacaagagtctcacatgttttttattttttttctgactaggatgccacatcaacaaaaccatcatccatattactatggaacttgatttggatagtttcgttaaggtgggggtggagtttttgttactgtggtttaaggatgtcaattaaactcgatataaagatgatactagaaggtaagtggacttattcctatcgtgtccgagcccacgtaaagtggaagcccgctcctgggaggccctgaagcgcagctgcttatctgcatctaggcgtctcatctagtggtcacctgagtagcaagttcgtgctccctccgtccataacgaaaaaaaaaactcaaatactagagaagaatctaatattaaataattagaaggggtgaggtttcgaatccagatcatctagcccaccaccttgtggagctaaccggaaaacccctaggtgtttctccctccgtccataacgcacattggactagtgatatctaatctaattttagtttgtcatattttataacggaggagtactctatttcgtcgtacatatctaaagttttggaaaagatttggttcaatatttaaaattttgacagttaattgtgtattataatatgtttataaaatacataagtttatagtattatggaagtatttctaaagaaaatttatgcatatcattttttttcttattttaaactaagcattgatttggtcaaatatttaaaacttagcaatcaaatatgatcaaaaacttatttggaacatcaaaaaatatttatgatcagagtactcaaagctaaacctttagggtgttctacgtccgtaatagtatctatgctacttaaaatatcagtagttatggtgtccattctgccacattggccctttacttttgagtatcacaatctatattattataagaccctccagcgaattatcttccgtatcttccgttttactgctggttctccctaaatttcaaagccacctacttgtctaataaagaaaatcatacgagtactacttagactaaatatatgcttaattgacttaataagttagaaactcaatttgttttatgttgaaatgcacgggctcttggctagttaggatagaaggcatcatttgcctctgggatatttcagggtggcgtcgtacaattggtaagagtgtgaagatcttgcatcacggttgaatatatttttcaccaagttaattcggcggatgcgcttgcctaaacaccatgcactagaaaaaccatttgtgtagccagtccgtaacacatttatacatgcgtttagccaaccactgcagcttaaggcctataggaatcaatgatttatataagcggattccacagctgcatgtaaaaatagtttttcacatgtggtttatgaccctaagacaaaaaaagaaacgcgaatattagagaaggaagcacactaccttgtgaaactagccgaaaaatccatgggcgtttctcttatgaccctaagacggctttaaccatcttcataatggtttttctttttgaccgcttgagataaataaagccaagaacatgcaaaaataattttagtagcgatgtttttctcacttttattaagtttattcgtaaaccttatggtaaaaaatatttaatttattcttacaatcaagtaaatagttcacagcaataatatgatgaataatggcaatatgagattgacacctccccgctatgaattattcatgcggggggctaggaatcatactgacgaaacgtgctcaactcccagagcacaaaatccagtgaataacagaaggtcaagcacttcaagtactgctaaactttttcttcaaacttttaacttttccatcacatcaaaactttcctacacacataaactttcaacttttccatcacatcgttccaatttcaacttccaatttcagcgtgaacttaaacacagcctaaagtgctatatatggatgatgtacagaagttgtgcacatatcttatattgcttggcaagatttgctccggtctaacaaaaagtatttcgaggtaccgatatctcaagataccgaatcgttttcaatcgttggagttaaaaacaattttaaagagtgaggtaccgatatcgtaagatatttttttttctcaccagagcaaatctcattgctcggcatacttgctgccactggcttctgcctttgccacaaaggcactgcttcgcaataatggcaaagataggaaaagctatatggtgaattggtgattggtgagtggtgactcgtgcattaatatggaggtaatacgcatctgtggcatatatgtctcgcatttgtggcatatatgcctcatatgttgtgttccctgatagttcacatggagcacagagctatagtctagtgccttttagcccacatatataatgtttacatgatcactaaaataaaacgacaagatacttgttagtaaaagttaaacaagttggaagctgactagtctgacaggtgtgcaccagggatttcaattttgatttaattcctgttgcaacgcatgggtattctactagtagtataaaatttgaatcctataaatttttatgtcttggaacaaagatagtactagattatcatgaacacgtgttttaaactgcttagatgatgtcatttttttaaaaaaaactttctaaagtttttttaaatcaaataagtctattttttaagttggtaacagtaacatatattactaatcaaggactaattagtaagcttgtcagacacacagctatttggctgatcagccatctcaaaagcggccttaaaagaaaacattaggttggagcccactcgctagctagtaaatacatatactccgttttataatgtaattaaggtgttttaattttgttctaaactaaattcctctaacttgggactaaatttatataagaatagttaaaacaaagatcactagtatggccatctctagcattgcaacaccatcaagacctagggtgagaagtataatatatgtacgactgtcatttgtcacacatagtagacatgccgtggatgtttggcaattcatagcaaaagatcttacatcaccgtcgaaacattatgtaattaattgggttaattggatcatgctattataaatttgtgtattaaaaatgacattacaattcatctgttcatagccatgccaggctacaaacagatgaattgtaacaatatttttctgaaaaggcaaatttgcaatgacatgaatccaattaatcttaattaattactatttccttttggctactataaatgaaagaagaactgaatagtgatcgcccacagttgctcaccatggctcttctcatttttgtagtactactattcgccttaagcatcccagcaagttctgccacgatcgacaccatctcaattggcacggcgttggccaaaaacgataagcttgtctcagaaaatcgcaggtacgcacttggcttctttgagacacaaagaaaagcatctcagaaaactagcaagtggtacttaggaatttggttcaaccaggttcccaagctaaatcctgcatgggttgcaaatagggataagccaattgatgatcccacatcagtggaactaacaatcttccatgatggaaatcttgccatcttaaaccagtcaacaaagtccatcgtttggtctacacaagctaatatcactgccaacaacaccgttgctacgctattgaatagtggaaatctcatcctaacaaacttgtcaaactcattagaagttttctggcagagctttgactaccccacagatacattttttcctggggcaaagcttggatgggacaaggtcacaggccttaaccgtcagattatttcttggaaaaactcaattgacccagctaccggttcctattgcaaagagttagacccttctggtgttgatcagtacttgcttttgccattgaattcctccacaccgtattggtctaccggtgcatggaacggcgattacttctcctcaatcctggagatgaaaagccatactatttttaattcatcatttgttgataatgatcaagagaagtactttagatatgatttgctagatgaaaggactgttagtcgtcagatattagacatcggaggtcaggaaaagatgttcctttggcttcaggactcaaaagattggacactgatctatgcccaacctaaagctccgtgtgatgtctatgcaatttgtgggcctttcacagtctgcatcgataatgagcttccacattgcaactgtataaagggcttcaccgtaacatcactcgaggattgggaactggaagatcgaacagatggatgctcaagaaatactccaatagactgcattaacaacaaaaccacaacacattcaactgatatgttctattctatgccatgcgttagattgcccccaaatgcccataatgtggaaagtgtaaaaagttcaagtgagtgcatgcaagtttgcttaactaattgctcttgcactgcttattcattcatcaatggtggatgctctatttggcacaatgaattgcttaacataagaaaagatcaatgtagtgaaaatagcaatacggatggagaagctctttacctacggctagctacaaaagaattttatagtgcaggcgttgatagtagaggaatggttattggacttgctatttttgcaagttttgctttattatgtttgctaccactaatcctactactggtgagacggagtaaaactaagttctcaggtgacagattgaaagattcccagttttgcaatggaattatttcatttgaatacattgatttgcaacgtgcaactacaaatttcatggagagacttggaggaggtagctttggttctgtatttagggggtctctaagtgattccacaacaatagcagtgaaaaggcttgaccatgcatgccaaattccacaaggagataagcagtttagggctgaagtgagctcaattggaaccattcaacacatcaatttagttaaattgatcggcttctgttgtgagggtggcagaagattgcttgtttatgagcacatgtcaaatcgttctctcgatctccaattatttcagagcaatactacaatatcctggaatactaggtatcaaatagccattggaattgctagaggattgtcttacttacacgaaagctgtcaagattgtatcatacattgtgatattaaaccagaaaacatccttctagatgatttattcattccaaaaattgctgattttggtatggcaaagcttttgggaagggattttagccgagttttgacaacggtgagaggaactgcaggttaccttgcacctgaatggattagtggtgttcctataacaccaaaagtcgatgtttatagctatgggatggtcttgctagaaataatatcaggaagaaggaactcatatacctcatctccttgtgttggtgaccatgatgattattttccagtgcttgtggtccgtaagcttcttgatggagatatatgtggtttggttgattatagattacatggtgacatcaacataaaagaggccgaaacagcttgcaaggttgcgtgttggtgcattcaggataatgagtttaatcgaccaacaatggatgaagtggttcatattctcgagggtctagttgaaattgacatacccccgatgccgaggctacttgaagcaattgtagctggaagctcaaatccaacatgtacctcatctagttttttcggatcaattcgagaatccttgtaaatatttatagttccttttttcctacaaatatacatacacgtatatatattaggaaatggcatgaacccaacctctacatccaaccatatgtacccagccaaactacaaatatatatgtatgcatgagtgacggactgatgctatgtgcagctattattgttgacatttctgctacgactcatgctatgtgcaactattattattgacttttctgctaggactagggatttgtaacctgtcatcattcttcttttccaatgaagttttttaccacctattgttgatgtaatctacaattttgttgtccataattcaatagaaatttaggtggatagatctaacaaatctatgatcttaggatatgctatgtgattcatgcgacaagatcaatggaaaggtcgttgtcttgcgtcctcgtggccagcgtttgaactctggtctcaatgctggacctcactgttctgctaatgattaaatgctagtcattactctctgcgtctcaaaataaatgaatctatgataatatgtgacatcatcatcatcatcatcatcatcatcatcatcatcatcatcatcaatgaagaatgtttatttgtttcctgattgagccacgtatactgtaaaatatgagccattggatctggaaagaacgacttaaaagtatggagggaaaaagaagagtcaggacacttccattagaaggatctatagaaggcatgtggcatgcaagagtaaaaaagacccaacttgtataaatttgacaaaaaaatattattgaaaatcgagagttaaagctagaaaaataagagtttgcaaaaaaaatatgtcaccacattttttatttaattgccatcacttttctctatatgattggtttcttctatatgtaagtatgcttttatctctcccgtctcattttccaagtagataataaattacttttaattctaattcttttatgcattgtgtattagaaaaaaaatacaatgtaagcatcaaaatttacaatgtaattacagtttaagttttaaaatttacaatgtgagcgcatgtaatttacagtgtaaaaacgatttgactaatgttgtgaaaacatagtgccgtaaatatagctactccaagaaaaaaattaggaagaagataaaaatagtggaaaagagaggaaaacccacatgtgtcccgtttccttgtcaccactcaccacatgtccgcctgtcacaccatcattgctagggaggaggagatggtggcacaagtcgagttgggatgaagtgcgggcgtagatggagaaataaaaaatgagcaaacaagagaaaagaactgaggagaagccattgcacgccaactttgaaatatttaactatttgccacttgtataaggattcgtcactgaaccatatgtcataaacacatgaggacccacatattatagactgtgagtgtcaaatccttaattgccatatcttaaaagtgaaaaaaagttaaatgccccagtaacgtctggtggtgccgcctcttctcgttcgcgttgccacgttccatgctctctttcaagaatgtctaaaacaacaagttcctcaaaagtttgttagaagttattatattttaaatatttgcctaaaggattttttaaataaaaaaggtcatttgggcagatatttaaaatataatacatgctactaatatacataatttagaaccttccagtattatatttatagtaaatattacacattaggcatgttaattatttataatcacgaaaatattgtttgttacagataaaaaattgactacacttcctaccaaatcaatattcttcgagaacctatttacattatacaaccatatagcatttaatagacaggggctagagccgcgcgaacgcgcggctctactggctagttacatagtataactaatccggacaagtccatgtctagattggttgtactgtgtaatacattgatggagaagtgctttttattcccggttcataacccccaaccgggactatgaatccggaactaaatagatattttttcttttgtttttctctttttcattgtttttagcattgaatattgatttcacaccatcccctaatcatgccaagaaatcctaaatccaaatcatcacatatcacagaacatctccaaatcctcaaatagatcatctccaaatacatcacaaactcttaaaacaattacatcacaagttctaaaaaatacatcacagattcacatcacacacaaatcaaatacatcagaggataaatcataaattgtgaaaaaaaaagaaaagccggccggccactgctgcctcccctcctcccctcctcccctccgcgccggccggccgccgccgccgccaccgccaccgcgccgctgcgccggccgctggccggcccaccctcttcttcgctgtgtggaaggaaaaaaggaaagagaaggctaggagttagagataaggaaagagataagaagttagagaggaaaaaagagatagagggaggagtttgttgtgtggacgggaaaagaggatcggtactaggattatatagtgtgttttgatttttattcctggttagtaacatcaatcggaactaaaaataggtttttagtcccgaatggtgttaataaccgggactaatgatcctagggccctgacacggcctgacatggaatcaaaagatgaattttagtcccggttggagttaccaaccgggacaaaagatgatttttagtcccggttggtccaacaaccgggactaaagatcttcctcttataaacctggactattgtggatttgggtcgaccgaccaaagatagtttctctaccaatgataatatatcgatcctatgttgatttattttgggatgaagagagtacgtagtaataatatgttatttctcctttaatattttttatgctaaatttctccattgtgtcccaagaatgactgaatgggcagtggtcaagtggaggacagacgtttttatgctgaatcttgccgattacttttatccatcctctttctcaatttcatcatggtgatcgcctttcaaacaaacaaaggaagaccaactcaggatagggcctatttagatcccaccccaaaattttacactctatcacattgaacgtttgaacacctgcataaagtattaaatataggctaaaaaagtaactaattgcacagaatacaattactttgcgagacgaatcttttaagcctaattgctctatgatttgacaatgtggtgctacagtaaacatgtgataatgatggattaattaggcttaataaattcgtctcgcggtttactaacggatactataattatttttctattagtggccgaacacacatgcgataccctacataatacccgatgttacgcgtcagaactatacacccctatacacccctgatctaaacacccccataatcatgtatgacagttacaaaacctgagaacaaaaatagtttgattgctttgtatgaagctcgatgtacttatgagtagattagtagtttcagtatggggcagatcgtttgtgctggtttgcagccggctatatatggttgcgattgtgctgtatgtacagtgcaagcagtaaaacttatattgagcttagtcctgttgctgctgctgcacaactctcttctgatcagcccctatattaccggtaatgtacctggacactgtaagttttggtcccgtttgcttcttaaaatgggacatcttctttttaatataaaacgtcggcaacagcctgaccgttcgaaaaaaaaaatatattaccggtaatgttaactcttaattattcaattttttgcgcacgactttaaccataattttctattagaaatagcaataatacctaacaaaaacttactttacgtaaaagtacttgttatattgatttttatgtttttcaaacttaaaaatattatatatattgaagttcaaaatggattgatagaaaattaatcaacaataccatagatgtaaatactgagggagttggctgcgatgggagattggatcgtacgtgctccagaatcctccaggacaatggtgcgtgcgagattggatcgtgcgcggcctagcttaagagcaagcttaataagtttaatactccaatcaaataacaaatttatacaatagttgcttactatactattaatacatatggtcccacctgacatacacacaccgtgtcttggagtccgcgctgcagctggctacagatctatagcccgcttctcttctctcttatcttttatctcattaaattatatttatagctggctaatagtatactattgtagccgctctaacaggctaacggacgagcgctacggccgcgccgccgcgcgacaagccggccaccacacccgcgacgaggttccccctccgcctccgcgcgccgatttccagcacgccgccatcgacgatgtggccgccgggtgcgtcgatcggctggtcgaagtacaccgaagcaatggggaagttccggggccacgaggccttacggcgcgcgtgcacacgagtggatcaaatggcccgctcaaccgccgtcacaacaaaacagggggcaaaaaaaaaaaaaaaaacctccatcctcatcgtcaaattttagcatctgcattacatcgcaaggatcacaagctgactgggcgaggtggcccatggatgaacaaatgaataacagaaacatgtccttttgcagacaaaaaaggaactagttggggccaaaacaagatgtaataagggagaatcatcagtcatgtagtggtaaaattcaaaccctgatacgtacgaatattacgcatatgtaggtgggtttttatcataattttagtgagatcatggatgtgtctcgctggtttagcatgtgttatggggcgtattcgtgtgtgcgtatgactctcccgtgtaatctcaaaacaagaaaagaaaaacaagaggcacaacacgttttgatggcacagatgaatatagggtagtgttacaatatatacttcttttaaagagtatagtattggtagcggtgaccggtgagtaataaatcttccaccacctcacaccaccaacatttttttttaaaaaaaagagagaaaagaatgatgtgggcctagattgtcaactactctcactattttttttcgataattacacggtacaacgcagacattcacaacgcacgcgcactcaccccgatgagcatcttcgaagactgggccggcaaatcttttgagattgacgaagtcaccacatgcgcctcgctgtcgacgggtacgtcgcctaccactgaaagcacaaagccgttaaatcctgcaaaattcgctcccatgtggagtcgaacccaggacctcaggtgctactgaggcacttgtaaccaccatgctttatttaagagtaaagtgtacggacggtccttaaacttgtagggatgtgtcatctttgtccctaaactctcaaaatgcacatccaagtctcagaacttgtcatactgtgtcatctaggtctcaaatcaccaaaaccccttaggatcctacgtggcgttgatgtggcataccacacagacatgacatggcattattttggactgacaaatatgacccatttaaaatttttcctttttctttttttcttctctttttttccctttcttctcctttctctgtgacctgagcagaagaaaggaaaaaaagaagaatgagaagaaaacgaaaaagaaaaaaaaagaaaagaagaaaaaaaagaaaaggacatgtcacgcccatgtggcatgccacatcagcgccacatagatcatagaggggatgtgtcgatttgggacttagatgatacactttgacaagttctggcaccttgatatacattttgagagtttatggacctatatgatacaacactacaagtttaaggaccgcaaatgcactttactctttatttaactccatactttttataggaagataaaaagactacatgttaaccctaatgttaacattcatatgcaaaattcatatgaagtgcttcatgtaaattggcacttttgagttaaccctttgagcaaattaattggcatcctcccatccttggagaggtcatcatacgctgatacgcatcagtggcatactgatactggcatgtctcacagatcgtgctccttgctagtcgacatgctcagaactagtctactgcattttggccactcaatattgttacacatcactaaaaactaccgagtcacctgttaacaactactaacaagttggaagcttcaaaactgactagtcgaatgggtactttactttacacgacttaccagaggcagagattcaaacaataggtacgtgtttgctgaatatttacttaagatcggtgtcaaatagccatcacttttggatttgtacatccataagggatgtagagaccggattgatatatattatctttatactacctccatattttaatgtatgacaccgttgattttttgtccaacgtttaaccattcgtcttattcaaaaaatttatgcaattatcatttattttattatgacttgattcatcatcaaatatcctttaagcatgacataaatatctttatattttcacaaaaattttgaataaaacgaatggtcaaacattggtaagaagtcaataacgtcatacattaaaatacgtagggagtataagaaaaagccatcactttcttgtataaagactttggctcaataatcaccgctgcagcccgccatggtttaaggtcattgtccatcaattttagaaattcatgcatgtaaaatttcagtgggtatgagtacatgtgcccgtacaaaatgagtacatttcccgtaatacgggaggtctctactttctcagataatttattggcgttcgtataggtgtgcactcatgggtgtgtgtgtgaatggtctgactgtggtgtatcttccattataggccgtgtttagtttcaaagtttttcttcaaacttctaacttttctatcacatcgaaactttcttacacacataaacttataacttttccatcacatcgttccaattttaaccaaacttttaattttgacgtgaactaaacacagccataatatctttttagaggaaaactgacaggctcatgtaaggtatggttgtcatctattaattcatccattcagccatttagaagaaaagaacaggcggtgcctctctgatgtggccgtctctagatggttgtttgcattgctgcgccatcgaaatctagctgaaaaaagtattgtaggtacgattgtcattcgtcacacatggttgccatgccgtggatgtttcgcaattcataacaaaagatcttgcatcaccaacgagacatgtatcaactgtgccatttttccctccaatattacataagcattccctccgtttcaggttataagacgttttaactttggtcaaaatcaaacaactctaaatttgactaactttgtagacaaaatagtaatattttacaacaccagcaaagtttcattaaatctataattgaacaaattttcataatatattgtcttaggttaaaaatattactattttttctacaaaattagtcaaacttagagtagtttgactttgaccaaagtcaaaatgtcttataacctgaaacggagggattactatatatgtttctacttctctatatatgcctcagttccctactataaatgaaatcagaactgaccagtgatcacatatactacagttggccctcatcatggctctcctcatttatgtagtgctcctgttctccctatgcatctcagcaaatgctgccatgacggacaccatctcaatgggcaacgcattgggtagaaaggacaagctcgtctcgaaaaatggcaggtatgcacttggcttctttgagacagaaagagtagaagtatcccagaaaagtagcaagtggtacttaggaatttggttcaatcaggttccgaagataactcctgcttgggttgcaaatagggataatccaatcaatgatcccacctcattagagctaacaatcttccatgatggaaatcttgtcatcttaaatcggtcagccaagaccatcatttggtctagccaagctaatatcactaacaataacaccagtgctatgctcttgagtagtggaaatctcatcctaacaaacccctcaaactcttcagaagttttatggcagagctttgactaccccactgatacactttttcccagggccaagcttggatgggacaaggttaccggcctaaaccgtcgtattatctcatggaagaactcaaaggacctagctgctggtgtatattgtaaagagttagaccctagtggtgttgatcagtccttgcttacaccattgaattccttcacaccgtattggtctagtggcccatggaatggggattactttgctgcggtcccagagatggcaagccatactgtttttaattcaacatttgttcacaatgaccaagagaggtactttacatatactttggtagatgaaaggactgttagtcgtcatatagtggacgttggaggtcaagccaagacgttcctttggtatgaggatttgcaagattgggtaatgaactatgcccaacctaaatctcaatgtgatgtctatgcagtttgtgggccttacacaatttgcatcgacaacgagcttccaaattgcaattgtataaagggcttcacaataacatcacatgaggattgggaactagaagatcgaacgggtggatgctcaagaaatactccgatagactgcactaacaataaaaacacaactcattcttcagataagttctattctatgacatgcgttaaactgccccaaaacgaacagaacatagaaaatgttaaaagttcaagtgagtgtgaccaggtttgcttgaataattgctcttgcactgcttattccttcagcaatggtggatgctctatttggcacaacgaattacttaacataagaaaaagtcaatgtagtgacagtagcaatacagatggagaagcccttcacatacgtcttgccgcagaagaattgtatagtaaaaaagccaataaaagagtaatggttattggagtggttatttctgcaagttttgctttattaggtttgctaccactgatcctgttattgctgagacggaggagtaaaacaaagttctttggtgacactttgaaagattctcagttttgcaatgggattattgcatttggatacattaatttgcaacgcgcaactaaaaatttctcagagaagctcgggggaggtaactttggttttgtattcaaggggtctctaagtgattccacaactatagcagtgaaaaggcttgaccatgcatgccaaggagagaagcaatttaggtccgaagtgagctcaattggaatcatccaacacatcaatctagttaaactaatcggtttctgttgtgaggctggcacgaggttgcttgtttatgagcacatgccaaatcgttctcttgatctccaattatttcagagcaaaactacaataacttggaacattaggtaccaaatagccattggaattgctagaggactagcctatttacatgaaaactgccaagattgtatcatacattgtgatattaaactagaaaacatccttctcgatgcttcattcattccaaaaattgcagattttgggatggcaaagcttttgggaagggattttagccgagttttgactatggtgagaggcaccgcaggttaccttgcacctaaatggattagtggtgttcctattacactaaaagttgatgtttacagctatgggatggtcttgctagaaataatatcaggaaggaggaactcacgtacctcatgttcttgtggcggtgatcatgatgtttattttccggtgcttgtagcccgtaagcttcttgatggagatatgggtggtttggttgattatagattagatggtgagatcgacataaaggaggctgaaatagcttgcaaggtagcgtgttggtgcattcaagacaatgagtttaatcgaccaacaatgggaggtgtggttcagattctcgagggtctagttgaaatcaacatgcccccaatgccaaggctccttgaagcaattgctgctggaagctcaaatctgacatgttccttagcttcttttgtatgaaatatttcagctcaagaatccctttaaatacgtatagttccttttgatacaaatatatgtattgagtgacagacatattgtttgcaactattatattgttctaggactacaaggggatttggaattcctaccatcttccttgtctctctctctctctctcaattgagttgtttatcacctacttttgatatattctaccattttgctatccattatttagtagaaatttgggtgggcagatctaacaaacatctgatcaggatctgctccatgattcatgcaatagtgagatcaatggcaaggtcattacgttgcgcccttgtggccacgtttgaaccctagtcttaattctaaatctcatcgttttgcggttttgctaatgatgctaggaagtaataatatattccttctccttgcacctttttatattaaatttctccatagtgtcgtaagaataagggaagcaccattggcgtagtgatatagtcatggatgcatgacttcggaccccattaggattcaaatcctagtgcccacaaatatagttgtgtgcatcattaattggtgcagaggctgaaagttatactttatttttctaaagaaattccaagaatgagtgacaatatcattcgaaaagagttgcatttgttttctctacaattgggggatggtacaataccagatatcataggcacaaatgaacaatttatgatgactccaagatactctttttaaaagaggtcatgaacaatatccactaacagcaagaagtgtgggatgagaggttaagaatgtctgatgaggatatagttggattttaactataactttttgtatggaagagcttttaaggagcccagttggctttcctataggtttttataggaagatgtgggcacacataaaggaggtagtgaaggagatgctagatgagctttatgaaggagagctagaggtgaaaagacttaactatggaattataggaattatatctttaatctgcatgataaaatatgtgtgattgaacaatacggaccatttgtttgctagatattgtccttaagatatgatgaaagaaaagtgtataaatggaacactgtagatttctgacagatgtatgggctgataaaatatccccaagagtaaatagtccgaacttatatagaatccagcttggacacaatgtaaggagctttttaatgatggcgattggtgagtggaagttagagtttaggaggaacccaagtgaggctgacaaaaatgatttgatagagttgctagatgtaaggcatgatggggagagtgtaaggtgatatggacaactctggggaataaaaaagatctatacaattaacaatgatccctgcacaggcagattaccttaggaggtgtaattggctctgaaatgaatctgatttggttgagtagaattcccatgaagattaaacaattctttgtacctaacaataatgggcagaatcccttgtgcggctcaactggttaaaaataaactgaaagggagggacataattaagcttctaaactttatcataaacctgaaactgttaatcatatcatcttttaatatcgtttagctgttttttttccttattagagatttttttgttcgaattgcgtgttttgtaaaatgcagaaattttagagtttggtgtaattaaaattttgaaggctttgcttggtttgaaggggattgagggggaattcttaagaagaagaagaagagggaggaggaggagttagaggatgcaatgtaagttttataccctgcaaataatttaaaatcaaactcaattgcatttgcagatttaaaacatatatactttatgtacaaagttataatgagttttgtctctctgtatatttcagagaccgttgagtttaattttcagttcagtaatagcatgacaccccctgttacataatgcttttagagtttgtgtcgaatatatctaagtagtcgattataaattaggacttggatttgtaataggtgttaataaaatagtaaggctataaaaacaaaattttgagttcgacttgtcctaggctcaatttaagcttgattcgagctctagactagccgagcttgggctcctgtcaagcctaataatatataatttttattatttactttatatactaatagatcaaatatgctgccatttatatgtatccacacgataaaatagtttatattaatatcatatatttatctttattctttttcttctattcacaaatataactaaatagaaattaattacttttatttagagattatattcttaaaatatatgttaactaagcttgatggtcgagctcgaaccgagttcgtctggaagcttaaaggttacacaggcttagctcgagcctaggtaggtgagctcgctcgagctcgtctcgttaacatctctagataatagtaaagtcagactattatcttaggttatgttaaattataatcgcgtactttatcatagatgatggatgtctgaccagtggcctaacggtcgatggttgtgcccaaaattcgcatcaaaagcttggatgctaagtattcactacttactggactcaagttacatgtgatcgatcgttccaaacagaaaggaaatggtttccaacgctgcattgcacctgaggaccaaacaaagtcagggttttgttcgatcggattccctccattcaaatcacttccaaattccgttaccctttgcatttccactctccaaccaaaacgcctccaatagtcatctgtccatcagtgtcactgatcaggcagccaatccacacgatgcaccaccaattaatacgccagccctgcaccattttatgaccaggaattaatgggacctggaaactggaagcaacatgagactgactgttttaagttctaaggccctgaatggatcattcagtccctagactaaaattagtctctagactaaaaactttagtcccctactgtttagatacaggaactaaagacatgtggaccgagacagagaagagagaggctatcactttagttcttataagtacctccaagagaaactaatgaattatagtcccaatatacacttttagtcttttttttttgtcacatctgtttaaattcttagggactaaaagggactaatgaattagtcccatgaaccaaacagagcatgacacaccaggttctcgttcgtgccgttgccgctacagcactgctagctcgcaataacgctgaagttcagttcaagattctgtggtaacttaaacttgttgattttttttctttttgtctggaccatcaggatctttgcatcactatacccagggtcattttcccagtcaaagccactgtaattccacacaaagtctccatgccgtggatattttgcaaagcataacaaaagatcttattacatcactgtccagatatgttatcactgttaccattttgccctccaacattatgcaagcgtatcctttgttaacttattatcccctatgggcctcattaacctactataaaatgcaagaagaagtgaagagcagtgatcacctatcctacagtttcactatgtctctcctcattttcatagtactattgttctccctatgcatcccagcaagttctgccacgacggacaccatctcagctggccaaacgttggccaaagatgacaagctcgtctcgaaaaatggcaggtatgcatttggcttcttcaagacagatacaaaagcgtctggaaaaactaacaagtggtacttaggaatatggttcaatcaggttcccacgctaactcctgcatgggttgcaaatagggataagccaattgatgatcccacattattggagctaacgatctttcgtgatggaaatctcgccatcttaaaccgctcaactaatgccatcctttggtctacccgagctaacatcacaacaaataacaccatcgttattctcttgagtagtggaaatctcatcctaacaaacccctcaaactcttcagaagttttctaggagagctttgactaccccacagatacatttttccccggggcaaagcttggatggaacaagatcactggcctaaaccgtcgtattatttctaagaaaaacttagtagacccagctactggtatgtattgcgaagagttagaccctactggtgttaatcaggtctttcttgcactagtgaattcctccacgccatattggtctagtggagcatggaatggcgagtacttatcctcaatcccaaagatggcaagccataattttttcattccatcatttgtgaacaatgaccaagagaagtactttacatataatttggcaaatgaaaatattgttagccgtcaaatattggatgtcggaggtcaatcaaagacgtttctttggcttgagggatcaaaagattgggtaatggtcaatgcccaacctaaagctcaatgtgatgtctattcaatttgtgggcctttcacagtttgcaccgataacgagcttccaaattgcaattgtataaagggcttcaccataacatcgctcgaggattgggtactggaagatcgaacaggtggatgctcaagaaatactccaatagactgcatcagcaacaaaaccataacccgctcatcagataagttctattctatgccttgtgttagattgcccccaaacgcccagaatgtaggaagtgttgacagttcaagtgagtgtgcacaagtttgcttgaataattgctcctgcactgcttactccttcagcaatggtggatgctctgtttggcacaatgaattgcttaacataagaaaaaatcaatgtactggcagtagcaatacagatggagaaacctttcacattcgtcttgctgcacaagaattgtatagtcaagaggtaaataaaagaggaatggttattggtgttctttctgcatgttttgctttatttggtttgctgctagttatcctactactcgtgaaatggaggaataaaacaaagctatcaggtggcacaaggaaggattatcagttctgcaatgggatcattccatttggatacattgatttgcaacgtgcaactaacaatttcacagagaagcttgggggaggtagctttggttccgtattcaaagggtttctaagtgattacacaattgtagcagtgaaaaggcttgaccatgcatgccaaggagagaagcaatttagggccgaagtgagctcaattggaatcatccaacacatcaatttagttaaactaattggtttctgttgtgagggtggcaggaggttgcttgtttatgaacacatgccaaatcgttctcttgatcaccaactatttcagactaatactacacttacctggaatattaggtatgaaatagccatcggaattgctagaggattggcctacttacatgaaaattgtcaagactgtatcatacactgtgatattaaaccagagaacatccttctcgatcattcattcagtccaaaaattgcagattttgggatggcaaagcttttgggaagggattttagccgagttttaactacaacgagaggaactgcgggttaccttgcacctgaatggattagtggtgttcctattacaacaaaagtcgatgtttacagctatgggatggtgttgctagaaataatatcaggaaagaggaactcatatgcctcatgtccttgtggtggtgaccatgacgtttatttcccggtgcttgtggcgtgtaagcttcttgacggagatatgggtggtttggttgattacaaattacatggtggcatcgacaagaaggaagttgaaaaggctttcaaggttgcatgttggtgcattcaagacgatgagtttagtcgaccaacaatgggaggagtggttcaaattctcgagggcctagttgaagtcgacatgcctccaatgccaaggcgacttcaagcaatagctggaagctcaaattcaacatgctccctgtattctcttccagcaaatatttaagttcgagaatccttgtaaattaaaaggaactttgtaattcctgacatctttcttctttttaagttgtcttgttaacatagtaatttttttacagtcttgctatctgtcgttcaggattcagcaaagtacaaaactagcacaatgttcacctgaaaattaaggaataattaactatttgccactcttacgagtggttctaaaagatttaccactggacccacatgtcatagacacatgaaggcccacatgtcatagacacatgaaggcccacatgtcatagataacgagtggcaaattcttaattgacacatcttaaaagtggcaaataattaaatgtcccaaaaattaactccatgtgcaatttctgatctcttcagtcttcagaataacagtcacacatgaatggctttattcgtgagtttactgatcgctggtcgacggcgtctgagataaagcttgtgttggcccggatggtcgattcatcacttttactctgaacaagtttgaaagccagatcgactgttagttcatcattttgttctttctctctctctctcttttttaacaaaccggcacgagacgatgcccgtttcaattaatatagaaggaagaaaggtttgcatcccctaggggctgaaaaaaaaaggtaactatagctatacaaatgccgattgtagctcaagcaaacgctttgcccctgctgaaagcccatgtttaatgtttttgccacttccttgattttattgaccagacgatgtactggggactccttggagcaggtacaatagcaggctataagccggctataaccatatatcgagaagaaaaaagaagagagagaagaaatcaggctacagatttgtagccggctgcaacacggactctaagatattatgtgtgtatgagaggtgggaccaggtattaatggtgtaatatatttttatagttaactattgtatgaatgaactattagattgattatagatgtttgggagacagtagtggctatactattgaccttgctcttatgcatcctcattcattcagctcttaaagtggctgaaatctgtatcgccagtcaacaagtgatatggtgtagcaattctgaatttgccaacgactttgtgcgcttagcaggctgttacaacttacagctagtagcaaccaccatttcaggctttcagctggctttgccacgcctctcgctatccatttgttcagaagtcataaacctgtatatcaaagagcctgtccaagatcgtcgagatcggtcagacagcaacgctgtcgcgtttggttctggccttccggtgaatgatcgaattattatgtgccaatttcacaaggaacatttgtttaatggccatgctaatcatgattatattttaaaggttaaacagacgacgatttctctccggatatcactgccacagtgccactggacgccaactttgtctccagctatttgaccaggttatctctgagctccacagtccaaaacatcggaaatgataagatattaataaacatctcaaatgatatagaagtccaggaagacatgattaattttagtttccaaagttgaaaacaaacagatgttgagcacagacttggatcattcgccactacggtacaatttgcgagctttcagatgtcatttgtgccacagtcaaattactaccatttaccaacaacttgatccaaattcaacccgatcgatcattgacagaaatcacccataccttgagattctttaattcgccggccgatacagatgctaaacataaatttggatcattcatcactagcgctacaaatttctggttttcagaaagtcatttatgccactattgaagtactccctccgtttcatttatgaatgaatctatacacatacatatatatctagattcattaacatctatatgaatgtggacaatgctagaaagtcttataatatgaaacggaggaagtatcatttaccaacaactgagtccaaattacaacccggtcgattgaccatttgacagaaatcagccgtactttcggattctttaattcgccagccgactaattggtcacaaagccctaagagtcggttatatgtctgtatcatgatgtaatttttttactgccatatatgctaggtcaggccaatgactccatccttctttctgccttcaaatatgttaccatctgccaagtcccaacgaccatgcaagcttactcactttccctcttgcagtgtgttctctcgtatccacacgcgcaagccgcagttggcatcctctgtcatcctttttttttagataaaattgattaaacccggcctctacatccaaactggatgtacacagccaaggcatcctctgtcatctacctcacccaagtacctttgcagctgtgctagctagttcttgatttgttcaccatggctcttcccatcactgtcctgttcctcctcttcacactgcacattcctgcatcctgcaaggtgacagacaccatctcagctggggagacactcgccggcaatgacatacttgtctccagcaacggcaagtttgcgcttggcttcttcccaaccagcagtaagtcctcccacaatgcttcaaactggtacctggggatatggttcaaccaggtgccaaagctcactccagcatgggttgccaatggagatgagcctgtcactggccccacttcgccggaggccacaatctccggtgacggaaaccttgtcatcttagatcaggccacaaagtccatcttctggtcaacccaagctgacatcacagcaaacacaacaatggtcaagctattggataatggcaaccttgtcctgcagaacacctcaaattcttcggttgtcttgtggcaaagctttgactacccaacaaatacccatctcgccggtgcgaagctaggccggaacaaggtcactggcttaaaccgccgtcttgtttccaggaaaaactctgtagacccagcttctggcatgtacagttacgagttaactgacaacaatggttctaccaggttcatccttgcagctctcaactcctctataccatattggtctagtggagaatggaacggacattactttggttccataccagagatgacaggtcaacgcttaattgattttacttttgtcaacaatgatgaagaagtgtacttcacatataccttactagataacgcaacgatcatgcgttttatgctggacatctctggtcagaccaagatatttttgtgggtggagcatgtgcaagattgggtaccaacctacaccaacccaaagcagtgtgatgtgtatggcatttgtggagctttcacagtctgcgaagagagcaagcttcctatctgcaagtgtatgaagggcttctctgtacgatcacccaatgactgggagctagatgatcgaacaggcggctgtgtgagaaatactccattagactgtggtataaacagaaacaccagtatgcaagacaggttccaccctatgccgtgtgttggattacccagtaatggccaaatcatagaagatgttacaagtgcaggtggatgtgcacaaatttgcctgagcaactgcacttgcacagcatattactatggtaatactggatgctctgtttggaatgatgaattgattaatgtgaaacagctacaatgtggtgatattgctaatactgatggagcaattctttaccttcgccttgctgccaaagaggtgcaaagtataaaaagcagtggacgatcaatattcattggcgttgccatcactgcaagtgttgcttcctttgctttggcactcttcttgatagcgaagatcccaaggaacaagagttggctgcttggtcacagaagaaagaattttcatagtggtagtggagttattgcatttagatatgctgatctgcaacatgcaacaaaaaacttttcagataagctaggggcaggtggttttggctcagtattcaaagggcttcttaatgagtctactgtcatagcagtaaaaaggcttgatggtgctcgtcaaggagagaagcaattcagagctgaagtaggatcaattggaatcatccaacacatcaatttagttaaactaattggtttctgttgtgagggtgatagaagattgcttgtctatgaacacatgccaaacctctctcttgatacccatttatttcacaatgacgctacagtcttgaaatggagcataaggtatcaaattgctcttggagttgctagaggactagcttaccttcatgatagttgccaggattgcattatacactgtgacattaaaccagagaacatacttcttgatgcatcatttgttccaaaaatcgcagattttgggatggcaaagtttctgggaagggagtttactcaagttctcactacaatgcgaggaactatagggtatcttgcacctgagtggattagtggtacagttattacatcaaaggttgatgtctacagctatggaatggttttgctggaaatcatctcaggaacgaggaactcaagcaaagaatttgcaactcgtgatgactatgaatatttccctctgttagtggcacataagctgctggatggtaatgctgggagtttggtggaccaaaatttacatggcgatgttgatttggagcaggtagaaagagctttcagggttgcatgctggtgtattcaagataatgagcttgatcgacctacaatgagtgaagttgttcaatatctcgaaggtcttcttgaagttggcatacccccagtgccacgactacttcaagctattgcaggcaacccatattcaaagtgagcactaagcagaatttttcttatacaaacatcttaaattgagaacttatcataatcccagaaatatatgtgcggctgagaggcatgataagagcatgatatttttccatgacatcattttgtataatatcataaaagaatatgacacatcaacattccatgccagcactcctaactgcatcttttttttttgttatatgtgcaggtagttgatgggtacctgaaccaagcttcagaagaggcaggccaactgtaagatacaatagagcaccgtgcacctcattcttgacacgaaagtagctctgatgtaatcctggggcttcccttcagtagttgcctggagtctaatctgtcaaaataaaagcagtgatgatttgataatccaagtctcctgcagaaaccaaagtcctctgctaatctgtggcacagctttgagcacctgataagtaaatttctcgccggtacaaagattatttagaacaagcttgccggtataaactgctgtctaattgtgttgttcccagtaagaatttgtcaaccttgtacctggaatatatcatgagtaaggtcatcctcaaacaactgaaatctccccagccacacttggttttttactgaaccaagacacactgcttgaacaagaagggatcgatcaatagctcaatttgatgttagccatgttatgtcaatagcaccaaactgtacatttagcaacaatggaagaggatagcactttaaatataccttatgagacgagataacagctgtgcatcatttacaggattcttcttgtgaaatggagattaagacctcacgagactgcataataatgtattatatgccaaccccaaaaatatttgtgagatgtcttctggtcctccaacaaacagcagcggcaatcagaatcagtcttcggtatttggaacatatcaccccccaaaataatctaatttcgtcgtaactctgatcagccaaaaaatacttgcatcaacgttatgtaactgtagacttgaaaattgaaatgtacaaactgctaagtgagagatgaactctaaatccccattaacctttgtctcctcaagcgcgcgccaatttctaccggaaccctagtccattccaagcgaaacgaggatcaaacaattcgtctcgctttggcgacgctcgcgggggcacctgcgaaaggatccccaaatcgtagaggaacagataccagtgtatgtaggggcgacgaagaaaacccataccttgccacggagaggctccgtcccatttctcggcgtctccgccggcggcgccggtggcggcgaccggcgaggtcggcggcggcggctggccgccgacaaggaggcgaagagagagaggagagtcagagagattctaggccaccagcacaggccggcccatcacccccatgcgagcgagcttttctgcgcgaattcgcccacaaaaaaagtccacattacgtcccttagctatgggtccgagtttcatccgcgtccctcaaccgcgaaaccgggatacacattgtcccccaagctataaaaaccagtgtaaatcaacacgagcccctcaatgatttgggtgtcgattccatcttagggcacccacaatggttatctataagctctctacaagagatccatgtcagcatattttcctacttggaagagattaaatgaagagagagagcaaagctatctactaacatgaagatagtctatagagaaaaacgaggcaatggattagagagctatagatacccatgtagacataccattgaagtggtttactattaatctagtctattgttgaggtgtacatattttatagatagcaccttaccattgcgggtgctcttatgtgatacattgacatagttttcatccgatgtggcgtgtacttataatcttcatcctatccctatcagttcatccataacctctaaatgaattaactttaatcctcttgttttttcgcctagtccccctctctctcagctcaaataatcacatgacgagaggacgacgagaagaagaaacagagaagaatgccttttttttccttactagcaaaagtgcccgtgcgttgcaacgggtgaaaaaattctaatgataatatacgtttttcatgaataatcatgtcaatgacaatgtttgtattttaatgagcggcttgtttttttataaatggtgttttttttcttgcgcgattttctcaaaccattcagaaatggcacatttctttctaaaagtttttttatcatttttcttttgcttttttacttacaatgaaaaccatatttttctctcttttgtgccttttttttctagtgtgttcttttgtctttttttacaattattttctcacgcattttttttcttgttttttcttcaaatgttctttttttgcttttttccaatacaggacttacgggaaatagaacttttgttgttgttgtttttctttttatgcacctttctgcttttgttctctctctttttattatttttaccaaaaacgaccacaagtatcttgttgtaagattatagggactcaaatgtaaatataaaaattacagggactcaaatacaaaagtacaaacccaaaaaataaaataatataaaaatggaatgctctcgacatgtaggtttcgtttttgtaaacagatcttcaatccggcacattattttatttcaccaagatttgagagataacacggtacagattgaaactgagaggaggggtggcgggtatctcggactcaaaaggactggcgccttttatttttcgggggaatcggatctatagtcggatttttttcgtttttgagagagaaccggataggagtcggacttttttattattattttttcgctatttttttcaagatttttttcgtccttttttttggcacgtacggaatcggattattttttcgctttttttttatcggacggttacggtttttttatcgctcgtctagttttttcgccggtttcttttcgcccttttttgcagggaatcggaatttttttgccctttttttatcggacaattacggttttttcgcctggtttttttctcgctcgcccttttttttttgccggttttttgacggacgatggaagcatctcttattttttaagtagtagagataaatccaatacaaataattatgaaaaattctaaaaaaaacaatgtagggtatattgacatgtattgttctgccagaaatcgaattcaattttgacctacacattaaggaactaaaataagaaaaattcaaatgtgaacaacgcgttactattctatgctgaatttatcttttatatcctacctccatcccaaaataagtgcagccatgaatatccgtgccgaacgtttgaccgtccgtcttatttgaaaaatttgaaaatatttagtcacacataaagtactattcatgttttatcatctaatagaaataaaaatactaatcataaaaaatttttaaataagacgaacggtcaaacgttgaacgtaaatagtgtaaaactgcacttattttgggacggagggagtatatcttacgtgtgagttgagtttgtacccaagattttatatagtggtgtgtgtacaaatcttctgaatcaagtaccgactgtttgttctgaatcatttttggatgagtctgtttgttccttactcctgaaaagttaggattaaattttagattaaagtggcatgcttttcaaactactaaacggtgcattttatgcgaaaactttctatatgaaagttgttctaaaatatcagattaatccattttcaagtttgtaataattaaaactcaattaatcacacgttattaccacctcgtgttacgtgaaacacttcatcttcatcttcatcttcagtagattcaaacaccaccatcactctatgcttatatagtgtccttctgaactattcttctctttaccttagaaatataaataaggtagattagttgtatgaattgatcaataaatttgagctaatttattcgtaatcccccttttcaattcggttttcgtgtggggcaagttttgacaagcttttctctaacttcattcttcttctagaatttgatctaaccgttagattttagggtgtgtttacttcacaccaaaattggaagtttaattgaaattggaatgatgcgacggaaaagttgaaagtttgtgtgtgtaggaaagttttgatgtgatgaaaaagttgaaaatttgaagaaaaagttaggagctaaaccagaccttagtgtggaatttttgttagctctatagtgaagtctggtttctacaagcaaagtttgtcatagttctatcggttactttcaattaatctaggtttcagtaaacatatgttttcgttcagattaaagtttgttagatcccctcaattttatccattgcttttatgtctcttgacaaaaaaaaaataaaccaggcttattcttcaagatttctattatatggatttgaattgccgacgttcagtccgaggaagctttgctgtttttctccgttggcttcccacgtactgtagctgcgctactgtagtactgttttgaggctttttgcatattagggtgactaatttagtgttttagtgatattagaataactttattactacctccgtccaaaataagtgcagtcatgagaatccgtgtccacgtttgaccgttcgtcttatttgaaaattttataaaaaaaatttttaaaaaagaaatagtcgcacataaagtgctattcaagttttatgatctaataacaacaaaaatactaatcataaaaaaatttcaaataagacgaacatttaaacgctagatatgaacggatagagtattattttcactgcggttttgcattttttctaagaaaagaaacaggtgatcattcacttcttgtcatcgacaccaccccgatataaaatctaatgcctagaaaaaagtattacgaattgcttctttcttaaaatcgaatttaaaattaagtttcaaaatttaaattcacggataaaccaactagcaaactactccctttattctaaaataagtcaacctcgtaataggatataacacaattcatatcctaacacaagattgatttattttgttacgaagagagcatgaagcgataccgagagaaggtgaccgagcacaatctctagaaaaggcaccggaaaagttgagaagtggactggataatcattttagcattgaacattgtttttagttgcagcacgcgtagccgtacagacgaccagaagcaacgcaacaaacagagtcaatgataagcgtcatcacctgtttgctggggttgggatcacctgcataatggcagccatccgtttttttttaatgaacggatcagatcgttagctacaatatcgatgtatttagtactcatcgattctttccgtagtgatctacagtaaccagatgcatccttcaactccaactctaactccactcctcctggagctggagctcagccaaacagtttcagctccaccaaaactgggagtggagttggatggagctctctcacaaaatgtactagagttgtggagctggatttaggcagctccacaacgccactcaagactcaactcctgaagttatatttaagaattggagctgtaccaaacagatccttaacactcaatttcagatttaacagctagaagtggactatacaagttgtagtcatattattaactgcactggatccaaatcctgcctgcggaagtgctgtactgctgtccattttcactctatttaatctactaccaattagaacatttgtgcaaggaactggtgaagatggaaatactctaggcatggctgatacattaaattttcatatttcaaatcaaaatgatttaaaatcaacgtacatgtggaaggaaagaaaaataacttgtgacatgttcgaaagagctagctgctgcaacattgctgctacgcttacatcaactagccagcagcaactacagcagcctaagagcacctccaacagtctctccaaatgtctatttggctaactctccatctaatttagcaagtcaaactcgttgtttactccaacagcctccccattcaccctctctattctaagtctattacagtgggacccacgcgtcagtctctcaacatttccttcttttcatctttctccccctttccccaagcctcctctgctggtctgcccccatccgctgccgccatctaccgccgccgccgccacctaccgccgccgccgccgccaccatctaccgccaccgccgccgccgctactcgggctccatccccatccactgccgcggtgccgccatccgccgccgccgctcgggttttgctcccatccgtcgctgacatccgccgccgggcgctcgggctccgccccctccatcgccgccgccgccgccatccaccgccgccgctcgggctccgctcccatccgtcgccaccatcgggctccgtcttcatccaccgccgccgccgctcgggttccgtccccatccgccgccaccgctcgggctccgctcccatccgtcgccgccatccgtcgccgggagctcaggctccgtccccatccatcgccgccatccgcggccgctgctcgggctctgtgcccatccgtcgccgctcgacggcgagggacgacgaagactacggcgatgacgacggcgagaggggagaagccagcaccatgaagccgtcgccggcggtagctagctgcgccgattgcaagtagtaggaggtgagagagaagcatcttcaacgtggggcccacaaatagcaaggcaatttgggctggccaaatttggccattgagaggaggagtttggccagttatttggcttagccattctagtagagaggctgttggagtagaatttttttgctaaaatagctaaattttaacttggagagactattggagagtttgttggagatgctgtaacagagtaacagttgggatgcagtacagacctgcagcccaacaaactgtagaacagaccaccgaagaacagtgaacagaccaccaaacgttccactgatttcaagtaaaaaaaaggtactttatcctttcaaattactagttttatcttaaattaaaatatttatacatttttttattaatttttagaaatttgtataattcaataacatgtgaataattactagaaagcatttctcatgataaatccaaaaacataaatcttataataaatctcataatgttaaaatatatgaacgtctagaaattggtgataaaaatacaaatgtttgactaaagagaaagctagggtggcaagtaattttaaacggagggggtaaagtttaaatgtagttgcataaatgtcacaccctgaagtttccccccttttcttgctttaaaaattggttaaataaattgcccgaagaaattatcttaattaacctagagctaaatccctagttaataaattcaattaataatcggaaatagcgtggtggaatttttcttgagttccccatgctccaatgcattaacaagatttttagtggaattttcagagccttggaaataattttaaccaattaaaaatcaccaaagtgcaattttaaatcccaggaaaaatcctttcttcttttctttttcttttccttctttttctctattgggccgtcggcccactccctcccgcgctcggcctccttcctttgggctggcccgttcccctttcccctctctccgggacgctgacaggtggggcccacctgtcaggtcgtccccttcctccaaccgcccgccccacgacggcaaccgccgccaaaaccgtgcgcgtcgccgccggttgccatggccggccggccggttttgaagccgagccgagccgtgcctagccgccgccatgccgtccgatcggcctcctggccaatccggaccggcggtggaccacccgcgtggtcccggtccacggtagaccggccaccttgagccactgcccgtggggcccacatgccggcgcccccttcctctcccctttgagccgctgacccgtgggccccgcctgtcggcgccgccccccctggatgacgtcagccctgggtattattgcgcaataattaattaaggactttttctttattagtaaaaacacagtttatcttctaaaattcataagtaattcatccgagctccatttaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgtttcgtcaatccgcggtttctcgaagacgttgctgaggtctcatcagttcgagagcaaggcaagtcatgcaatacgtttgatcatattgtacccaatttaccaatatcccgcatttctattaaatgttgcattcttttacaatgtaatgtgggatgggtcctattcctcagccacatattggttaccttatgccattgataacttgggtatgaaaatgactagatgttggcttaggaaatgcttagccatgcttagttcaactaggacacaaatggggatcacattattacatagactctcactattggcatagctttagattggtgccaccgcaagggtgtcagttaattaaaatattctgaatggcgggctgtgagtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccgagatgttcggttgtccagctgccggattcaccgtggcgcaagaggggaccgcccactgccttttgagggggtaggggtgaaaccttagcgtgatgtggatggttaggggagggttatgtggagggtcttgtcacgatttccccctttgcagtatcatggtgatacttcggggcatggcgacatgtgtggaatcatgtcttgtgggtacagttgtacacctctggccagagtaaaactattcgaatagtcgtgcccgcggttatgggcgatcaaccagattcaccgtgattagtctcacccctagtttagcttaataaactggtgtagttcaggtggttggttgggcctgttgcaacgtggtgtagcgttagacagtgattggttaatattgattaattactacagctgttttactgctttcaattactgttttgaaatgcctgctttatgcaaaagaacccctagcttcctttggttatatcctacatcatacctcctcttccgatatgacttgctgagtacagtgggtagtactcagtcttgctctcttttcccccacaccagagttgaagttcttctcagttggagccgtctcagagaggttggtttcgtcgctgtcgtcaaggtttgcctgtggagtggagtcgcccgctgctgaagtcaagcttcccggtttagctcgcttttatctttcccgctgcatttgtaatcttttatatttttgtaagacgtgggtctgtatgtcaataattgtcgtttgtgtaccctggctggtcctggacagggatttaatgcacattcagcttagaaattctggttcgagaatttctgggtgtgacaagttggtatcagagccgaccttgaccgtaggacaagccaactggaaacctaagagccctctgaaccctttttttttcatatgcatatgcccttttgcacttggattttgtttcgggaaaattttggggtttgttcttttgatttgtgggaaaaatcttggtcgcttatttaattggatttctcgactagggacagtctagggatttagtaaaagtttattcggaatttattcggtagtcggtcgggaattgtcgggtgatatgcattaggtcgtgtctatgttcggtggggtaagtttatgcgtatcagtatgactatgcatctatttcatgcattaagttattgtttagtcagttgcattagtgtcttttgtctcggttcgtgaaaaatgttgttctatgcgtaaaaatcatcatgctcggttatttatttgagtcttcttttgctttgtttaatttggatttgagcattaattagttcctatcccttgtctactttagatgtcagtcctatccctcgtttgcgagcgccgccccgagcttcagagtcgccgcccttagctttatcgccttcttagtctgtttgcttgctagttttcgtgtttaggtttgttgcttgtgggttagtcggcggtcattatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacctattcccttcagatggagacaaggaatggttcacgcgactccaacaacgccagtggcagcgaagagccgatcaatggagcacgtgccaacagtgcatctgacaacagtccgtccccaccgcccgagaacccaacaattgctcaggtgttggacaatcagactcagatgatgacaatgatgatgcaacagatgcagcaacagtaccatcaagtgttgcagcaggtgcagcagcaagcacagcagcagcagcagaacctgcagtttggtcctccacctcctcagtccaaactgttagaatttcttcgtgtcaagccgcccactttctcaagcaccaccaacccaatcgaggcccacgactggcttcatgccattgagaagaagctgaatcttttgcaatgcaacgagcaagagaaggttgcttttgctacacaccagttgcaaggtcccgcttctgtttggtgggacaactacatggtgactcgtccagctggggcagaggttacttggatagagttttgtcatagtttcaataaagcacaggttcccgagggaattgtggcacaaaagaagagagagttccgttccctgcaacaaggaactagaacagttatagagtatttgcatgagttcaaccgcctcgcgcgctacgcccctgaggacgtgcgtaccgatgacgggaggcaggagaagtttctgtctggtcttgatgatgaattgactaaccagttgatctctaaagattatgaggactttgagaagctggtggataaggctatccgtcaggaggagcactgtaacaaaataaaccgtaagaggaaggcagctcagttcaggactccccaggggaagagtcagaagcctcgtttcacgatgggacgtcacggtggaccttccaccatgattatccggcagcaccgtccctaccacccgggtagcttcaacgagaaccaccatagtggcagtcacaacaacagtgagcagcatagcctcaaccctactccgagttcactaaagattccagctcaatcagttcagctagctctgccagaacagcccaagaggttgggagaaaaacccgaactctgcttcaattgtaacaaacccggacacacggttggaaagtgcccaaagccaagatgtgctggacccaagttcgttcaggcctgtgtcaatcatgcatctgcagaggaggcgcagtcagcaccagaggttatattgggcacattccccgtcaactcgacaccggcagtaatattgtttgattctggtgcaacccattccttcatttccaagcgttttgctggtgcacatgggttatctttagtgaagcttaagataccaatgcgagttcatactcctggaggtggcatgaccacaactcactactgcccatctgtgacagttgaaattcaagggttgatttttccaaccaacctcattcttctcgaatccaaggacctggatgtcatacttggaatggattggttgacaaggcacagaggagtgattgattgcgccagccgcaccatcaagttaaccaatgcaaaaggagaggtggtaaccttccagtctccagtgccgcagaagccagggatcagtttaaaccaggctgctggtgaagaacaagaggtagcagtggagaaaaccactaagaagctggaggatattcccatagtcagagagtatccagaggtttttccggacgatctgacaacaatgccaccaaaaagggataccgagttccggattgacttggtacctggaactgcaccgatccacaagaggccttacagaatgggagccaacgagttggcggaagtcaagaagcaagtcgatgaacagttacagaagggatacattcgcccgagcacgtcgccttggggtgctccggttatctttgtggagaagaaagacaaaaccaagaggatgtgcgttgactaccgcgcactcaatgaggtcaccatcaagaacaagtatcctttgccaaggattgatgatctgtttgatcagttgaaaggagctactgtgttctctaagatagacctgcgatcaggctatcaccagttgaggatccgcgaagaggatattccaaagacaacattcatcactcggtacgggttgttcgaatgcacagttatgtctttcggactcactaatgcacctgtcttcttcatgaatttgatgaacaaggtgtttatggaatttctagacaagtttgtcgtggtttttatcgatgacatacttatctactccaagtccgaggaagaacatgagcagcatctctggctggtacttgaaaagttaaaagagcaccagctatatgccaagttcagcaagtgcgacttctggcttaaggaagttcagtttctcggtcacatcgtgaatgctcaaggagtagctgtggatccagcaaatatggagtcagttaccaaatggaccccaccaaggacagtcactcaggttcggagtttcttaggacttgcgggctattaccgccggttcattgagaacttctctaaaattgctaagccaatgacagctattgaagaaggaagaaaagtttatctggtctgctgaatgcaataggagttttgaagaactcaaacgacggttggtgtctgcaccagtcttaattctgcctgatcagacgaaagatttccaggtctattgtgatgcatctcgccaggggctaggatgtgtgttgatgcaggatggcaaagtggtctcttatgcttcacggcagttgcgtcctcatgaaggcaactacccgacgcatgatctggaattggccgcagttgttcatgctttaaagatttggcggcactatctcatcggtaaccgttgtgaggtatatacatatcacaaaagtctaaagtacatcttcactcaacctgatttgaatctcagacagcgaagatggttggagctgatcaaggattatgatatgagaatacattatcatcccggcaaggctaacgtggttgcagatgccttgagcaggaagagctactgcaatgttgcatgggtagagcaactatgttgtgaggttcaacgcgatttggaacatctgaaccttggtatagttgagcacggattcgtggttgccctagaggcacagcccacactggtggagcaggttcgcatagctcaagcaagtaatcctgaaatagcagagctcaaaaagaacatgagagttggaaaagcccgaggttttgttgaggatgaacaaggaacaatctggatgggagaaagattgtgtgtacccgaaaacaaggaattaaaagacctgatactaaccgaggctcatcaaactcagtattccattcatcccggtagtactaagatgtaccaagacctcaaagagaagttctggtgggtcagcatgagaagggaaatagctgaattcgtagcactctgtgacgtctgtcaacgagtaaaggcagaacaccaaaggccagcaggtttgctacagccacttcagattctagaatggaagtgggaagaaatcggaatggatttcatcaccggtttgcccaggacgtcatcggggcatgattctatttgggtagtcgttgaccgactcaccaaagtggctcacttcattccggtgcacactacctactcagggaagaaattagtagaactctatctggcaagaattatgtgtttacatggtgtacctaagaagatcgtgtctgatcgaggaagccaattcacttcaaagttctggtagaaattacaagaagaattgggaacccggttgaatttcagcactgcttaccatccacaaacagatggccagaccgagcgagttaatcaaatactagaggatatgttgagagcctgtgcgcttgactttggtggagcatgggacaaaagcttgccgtatgctgagttctcttacaacaacagttaccaagctagtctgcagatggcaccgtttgaagcactgtatggacgaaggtgtcgtactccgctcttctgggatcagacaggggaacgccagttgtttggtacagaagttttaaatgaggcagaagagaaagtcagagctatcagggaaagattgagaatcgcgcaatctcggcagaaaagctatgcagacaaccgccgaagggagctcgctttcgaaacaggggattatgtgtatctccgtgtcactccgctcaggagagtacatcgcttccaaaccaaaggaaagttggcaccacgctttgtgggaccatacaggatcttggaacgtagaggtgaagttgcttaccagcttgagcttccctccaacatgcttggcatccacaacgtgttccatgtctctcagttaaagaaatgtttgagagttcctgaggaacaggcaagtccggatcacatcgaaattcaggaagatctgacgtatgtagagaagccgactcgtatcctcgaaaccagcgagagaaagaccagaaacaaagtaatcagattctgcaaggttcagtggagtcatcactcagaagaagaggccacttgggaaagagaagatgagttaaaggccacccacccgcacctcttcgccagctcttccgaatctcgaggtcgagattccgtttaaggggggtaggtttgtcacaccctgaagtttccccccttttcttgctttaaaaattggttaaataaattgcccaaagaaattatcttaattaacctagagctaaatccctagttaataaatgcaattaataatcggaaatagcgtggtggaatttttcttgagttccccatgctccaatgcattaacaagattttaagtggaattttcagaccttggaaataattttaaccaattaaaaatcaccaaagtgcaattttaaatcccaggaaaaatcctttcttatttttctttttcttttccttctttttctctattgggccgtcggcccactccctcccgcgctcggcctccttcctttgggccagcccattcccctttcccctctctccgggacgcacctgttaggtcgtccccttcctccagccgcccgccccacgacggcaaccgccgccgaaaccgtgcgcgtcgccgccggttgccatggccggccggccggttttgaagccgagccgagccgtgcctagccgccgccgtgccgtccgatcggcctcccggccgatccggaccggcggtggaccacccgcgtggtcccggtccacggtagaccggccacctttagccactgcccgtggggcccacatgccggcgcccccttcctctcccctttgagccgctgacacgtgggccccgcctgtcggcgccgccccccccccttggatgatgtcagccctgggtattattgcgcaataattaattaaggactttttctttattagtaaaaacacagtttatcttctaaaattcataagtaattcatccgagctccatttaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgtttcgtcaatccgcggtttctcgaagacgttgctgaggtctcatcagttcgagagcaaggcaagtcatgcaatacgtttgatcatattgtacccaatttaccaatatcccgcatttctattaaatgttgtattcttttacaatttaatgtgggatgggtcctattcctcagccacatattggttaccttatgcaattgataacttgggtatgaaaatgactagatgttggcttaggaaatgcttagccatgcttagttcaactaggacacaaatggggatcacattattacatagactctcactattggcatagctttagattggtgccaccgcaagggtgtcagttaattaaaatattctgaatggcgggctgtgagtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccgagatgttcggttgtccagctgccggattcaccgtggcgcaagaggggaccgcccactgccttttgagggggtaggggtgaaaccttagcgtgatgtggatggttaggggagggttatgtggagggtcttgtcacgattttcccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcactcctagtttagcttaatgaactggtgtagttcaggtggttggttgggcctgttgcaacgtggtgtagcgttggacagtgattggttaatattgattaattactacagctgttttactgctttcaactactgttttgaaatgtctgctttatgcaaaagaacccctagcttcctttggttatatcctacatcatacctcctcttccggtatgacttgctgagtacagtgggtagtactcagtcttgctctcttttcccccacaccagagttgaagttcttctcagttggagccgtctcagagaggttggtttcgtcgctgccgtcaaggtttgcctgtggagtggagtcgcccgctgctgaagtcaagcttcccggtttaactcacttttatctttcccgttgcatttgtaatcttttatatttttgtaagacgtgggtctgtatgtcaacaattgtcgtttgtgtaccctggctggtcctggacagggatttaatgcacattcagcttagaaattctggttcgagaatttctgggtgtgacaataaatctcgcgattctgctactactaaaactacatattttgatattcgagcattaaggaaaacaaattttagtggagagcagatgcaaacaggctcctgtacagccccgccctagttaattgccccatgtacaaccacgggatcggacgtctttatcgtcacaattctaggcacatcacaaataggacggagccgagtcactcatcggctcccaagctcagatcaagtcggcatctctacttcgcagccgctgtcaacactctcttgccgtcgcacggacagcggatgaaagaggcggcagaggcagcggctgcagagtagagatgccgatgcaatctgatcacaatgcaatctgagctcatgtgatgagaggcttcaaagccgatgagcgacttggctcctccatttaatctatttccgttgcatgcgccgggctgcatgcgagctagtttgcattcaatatccaccatttttttttcctaaatcctatgcttgttgaaatcccacctatacttgcattcattttcgttgatggatatttgtctcctaaagggatgtcctcttctcttttacatggcattgcatgtcattaaaaaattataaaaatatttgacagtgtagatcaatacatgatatcttactccaaaacctatgcaagtataaaagaaaataacaaaataaactctaactagtacatgtactactgacaattatacacagtttgtataagtcgaacttaaacttgcatgtttgtgaacttatatatcacacattgatctatgttatcatttttttcatattttttcacaattatttgaatagcatgcaagccatgagggtacatcccttgaaggataaaaagtctttcccttttttgttgaatcttgtgctaactccctcacttcttgcctctcctccaatcctccacacattcttcttgacttcttttttgatggtcatggcccatgcactactgcattattgtgcaacttgtgtgaaacggttccctgatgtcggccaatatgtcatttgaagaacttgattgatcaggctcctggtatatactccttggagttaggactcaatggggatggtcatttgctatggaactcaaccgtggcgtattggtccagcggagactggaaaggccattattttggccaattgccggagatgacaggctctttcatgccaaatttcacatttttccacaatgaccaagaggcttacttcatatacaccttgtctgatgagacgacgatgatgcacgctggaatagatgtatatggaagaggtttggtgggcatatggttggaggaattgcaggactggtttatctattacaggcagcctgtagtgaattgtgatgtgtatgcaatttgtggacctttcacaatctgcaatgacaataaggatccgttctgcgactgtatgaaaggctactccataagatcaccgaaggactgggagcttgatgatcgaacaggagggtgcatgaggaatactcctttaagttgtggtgctggtaaggacaggacaggtctcacagataagttctaccctgtgcaaagcattaggttgcctcacaatgcagaaaatttgcaggctcctaccagtcgagaagaatgctcacaggtttgtttgagcaactgctcttgcactgcatattcctatgggaatggtggctgctccatttggcatgatgagttgtacaatgtaaagcaattatctgatgcttctccaaatggggatgagggggttctttacattcgacttgctgcaaaagagttgcaaaattcacaaaggaagatgagtggaaaaataattggtgttgccattggtgcgagcattggcgttttgtttttgatgatccttctactgatagtttggaagagtaaagggaaatggtttgcttgcacacaggaaaagcctgaggatggtattgggatcactgcatttcgatatactgatctgcaacgcgcaactaaaaacttttcaaataagttggggggaggcagttttggttctgtgttcatggggtacctaaacgactctaccatcgcagagaaaatgcttgatggagcccgtcaaggagagaagcaattcagggctgaagtaaattcaattggaatcattcaacatattaacttagttaaactgattgggttttgttgtgaaggtgataataggttacttgtgtatgaatacatgccaaactgctcccttgatgtgtgtttattcgaggctaatgatatagttttggattggactactaggtaccaaattgccattggagttgccagaggccttgcctatttgcatgatagttgtcgggattgcatcatacattgtgatatcaagccagagaatatacttcttgatgtgtcttacatgcctaaaattgcagattttggaatggcgaagatgttggggagagaatttagtcgtgctatgactacaatgagaggaacaattggatacatagctcctgaatggattagtggaacagttgttacatccaaagtagatgtttatagctacgggatggttttgtttgaaatcatatcaggaaggaggaaccgaagtcatgaacatttcatggatggtgattattccttctactttcccatgcaagttgcacgcaagcttctcaaaggagagattggatgtcttgtggatgccaatttggaaggtgatgttaacctcatggaggttgaaagagcttgcaaaattgcatgttggtgcattcaagatcacgaatttgatcggccaacaatggccgaggtggtacagtcccttgaaggtctacttgagctcaacatgcctccactgccaagactactaaggcagcgttcgtttggacgacattgagggagaaagcacctcgttttccgcacgcacgctttacaaactattaaacggtgtgtttttttaaaaattttctataggaaagttgctttaaaaaatcatattaatccatttttgaaatttaaaatagttaatactcaattaatcatgagctaatggctcacctcgttttgcgtatcttcccaatctcctcaatccccttctcctcaaacacaccctaaatgctatcacaggaggatcacactcgatgacaacacaatattttgattcactataaatctgtatactgattcccaatttcaagttatgtatcagaacattatatatcatcttgccctttaagaaaagtaggcataagatgtaagatctctaagagatcatgtcttgtatttgaatgaactaagtgtcgtaacatgtaattaagatctctatacccgagaaggaaccagccttactaacaaaatatacttggtttctgttgtctctgtgatatgtaagatctgtaggtatcagtgtgcccccatacaattgtcatatgatgtttttgaaaaacacaggcgcgactgaattgtcagttcagagtggattgttgagcctaacattggcgaatgtgtgacatcctgacagttatgttcaaattatgcacacatcggctatatatcacctatatatacgaggcataattgttcactcaaacaaaagggagaagcctggctgctagcctgaaacttgttttttcaagggtaggcacattaatttggcaactacaacccaagaacctttttgttgagaatatgcaaaagatgtgcacatcattgtattaagatacaagagtttcattacaaaccttgctagatagtggtatagatatgtgtgtgtacatggtatttagctgatatttatgtaaattcgtggaaattggaagccataagaaataagactgttttcacacccagccaatacagtacttgtagcttgcaatagtgccaaagatttgttcaagattctttcagatcagtactaacaatatatgatagcttgtgcaagttgaatcttttgtcttggccaataggacctttgcaccactatccccacggcaggatattttttccattttctagtcaagtcaagccactgtcattcgtcacctaaaatttctatacacgccgtggatgtttcaaaaagatcttacatcaccgtacagaccctttcgactatataccattttgctctccatcattatatacaagttgctagtttttcttttgtcctcatttccctactataaatgaaagcagaactgagaaatgatcaccaatcctacagtttgtaactatagctctcctcatttttatattactattattcttcctacgtatacgcatcacagaaagttctaccatgacagacaccatctcagttgggaaagcatttgacgaaaccgacaagctcgtctcaaaaattggcaggtgtgcacttggcttctaagagactggtagaaaagcatctaaaaaaatagcaagtggtacttaggaatatggttcaatcaggttcccaagctaagtcctgcataggttgcagacagggataagccaattgatgatcccacagcagtggagctaacaatctccaggatggtaatcttgctgtcttaaaccagtcagcaaagaccatcatttggtctacccaagctaaaatcactaccaataacaccattgctacgcacttgagtagtggaaataaatctcatcctaacaaacccttcaaactctttagaagtttctcggtggagctttgactatcccacagatacatatttccctagggcaaagtttggatggaacaaggtcaccggcctaaaccatcatattatttcttggaaaaactcaagagacccagctatcggtgtgtattgcaatgagttagaccctactggtgttgatcagactagcctttcgccattgaaactccgattcctctgttcttcagtttcgtcaggttactgtagcaatctgaaattctcgcttcagaaatcagaacgtgcgagtgatacacagagctgagtggggaggattgagagataggttagctaatcacaacacggggcacggtataaacttcggccaacgacaaccgcggttaatgccgtccgaagtggaaccataatcctgatctcgtgatctctactctctagagcgctaattaatttctaccggaagttgaaccctagccatcccaaacatgctatatccgtctctcgattcgctcgatcggcgacagcgacactcgcaggggcactgagaagaggggtgacgagacccataccttagccgcggagaggctccgctcccgttactctccatctccgtcgggggccgccggtgccggcgagggtcgcggcggcgagacggcgacggctggccgccacacaacccaaggagacgacgaagataatgcgagagagatatggaccttccgtcccgtggtgccgcgtggtgaggcccaagagcggggaccaatcggaaacccagccacggcccgtttcgatgagcggtgcagcccaataaaaaggaagaagttcacttgacatcctttatctaagcgagtcgagtttcaatcgtatcggtcaaccgcaaaaccggttataatgcatatctcatcttctaaagccagcacgaatataatccaaagacagtattaaggttgtgttcggcatatgatgattgatgaagatttctctcgttcgccgcgtgtacgcttccgaactaccaaaaaatttgctttaaaaatcatattaatctatttttaaatttaatatagttctcgatcttctcttttcctctcttatcaacacagcctaagttgttttagatgacaagatactgacatggcactgaaagataaaggaccagaagtgaacttattcccaataaaaatacacgtaaagaaggcccatcaaccacgctcaacgcccattcagtgcgccgatttgtgctcagctcaacgacaaaatgctctctctcactaaacatggagatctcaaggagatttggaggccagtgccaaacttattgggtacccatgattacgcgacgacgtgacatgataatgtattaatgttgttaaggcaatagttaatttgctaatcattgtttgccaccatagtttttttttttttgatctcctgccaccatagttttggtggttgactgtggccgtttttttaacacgcttctgtgtgctgcagtgcaagcccagccacagctttctgctccctttcacacccttcttttatttatttttttagacttaccctttttttattttgagcggcaaatctatcgcctattgatatactctccgtccctaaatatctgacgtcattgacttttttaaacatgtttgaccgttcatcttattcaaaaaaaattaagtaattattaattcttttgatatcatttgattcattattaaatatacatatagttttacatatttcacaaaagcttttaaataagatgaacggtcaaatatgttttaaaaagtcaacggcgtcaaatatttaggtacggatgaagtatgatttgctaatatacgtagattcacgtatactactagttcatagttcacacaatcactcgcccaatcggcaatgcaagaattcttgagaaggcgacatcactgttgaagtagagtactccctccatgaaaaaaacaagagacaaacttaaacatgaatgtgacattataatgaatctagataggtttattgtaccagaaaatattatatccgtgtctaggtttgtttttttacgaagtagataatcactttagcactgttgaacaatatttttacttgcagcatgcgtagccgtacagacgaccagcaaaaactcaattaccagagtcaatgataagcgacaccacgttgcagtgctgtccattttcacactgttccagagcatatgtaaaacgttctagcattggcatcacgccacacaaatctgccaattataacacttgcgtaaggaacttgatgaggctggaaatacttaaggcatggctaaacactctaaacacattgtcatgtgcactcatatttcaaatcagatgtttcaaagaaaatcaacatacatgtggaaggaaagaaaaaacaacttgatctcaagtaaaagaaaaaaatagtttataccaggtagttgcacaaactacagatttcggtgttccagcattagcacagttgcaacctcacactgagcgtcattcagtcaattcctacgcttgtctcgtttcaaaaaattctgacgcctatacttgcatttttgactgtttgcgttgactccctcacttcttcttgcctcctctccaaatcctccgcatccttcttggacttctgttttgttgttggccatggcccatgctctgcactgtgcaactccgtgtgtgaaagggttttctgatgtcggcgaagatgctaattgaagttgatattttacatcccttggtcatgaactcatgatcgagtggtccaaatttgtgatcaaaatcagacaaatttgcttttggataagaatataataattgatctcatcagtgcccactacaaagtctagcctaaattttctgtctcctagcttttccatttggacctgaaaccattaaaaacaaaattggagcaagtagagtacactgcattggtgttgggaaaatgggaaggaacttgcagtgtttcgcaagggtttgaaaaaagagttcacataaagaatacacctactcacctgcgtatggctggcagaggaataaacaaccaattttgatctcgaatagttgggcacagatcatttctgagtccaaacgctccagcgttgaggtttgaccaagatgacaaagattactattatactgatgataaccaatcatacttctcgaggtttgtttcaggttaaacacaatatcgttagtggttacgactgattgagatgtgtgctcagacagtcacaacaccacgttgacctgcgattctgcgagctgaactaaatccatggtctgaattcttaacagcaactcaacctgcttgcagcatcgtgctgtgtataagctagcttcaaaccattcctccttcagttttccttctccaccactcttcccccgtgttcatcttctgcttccccatgcttctcccttgtcatgtccttcttggcctcctgctcctctccctgcacactccggcgagctccgccgccgccacggataccgtgtcacccggccattcacttgccggcagtgacaggcttgtctccaataacagtaagttcgccctcggcttcttcaagccaggtaatgagtcctcctacaccaaccacaactcctaccttggcatatggttcaacaaggtctccaagctaaccccgttgtggaccgccaatggcgagaatccagtggtggaccccacttcaccggagctcgcaatctccggtgatggaaacctggccatcctggatcatgccaccaaatccatcatatggtctacccgtgccaacatcacaaccaatgacaccattgccgtgcttctgaacaatggcaaccttgtcctacgaagctcctcaaactcatccaacattttctggcagagcttcgactacccaacagatacacttttcgctggtgcaaagattggctgggacaaggtcaccggcatgaaccgccgtcttgtttccaggaaaagttcggttgatcaggctcctggtatattttccttggagttagggctcaatggggagggtcatctgctatggaactcaactgtggcgtattggtccagtggggactggaacggtcgatacttcggcctagcgccagagatgataggcgatgtcatgccaaatttcacatttgtccacaatgacaaagaggcctacttcacatacaccttgtatgatgacacggctatcgtgcacgctggactagatgtctttgggataggttttgtgggtatgtggttggaaggaaaccaagaatggttcaagaattacaggcagcctgtagttcactgtgatgtgtatgcagtttgtggacctttcacaatctgtgacgacaataaggatctgttctgtgactgtatgaagggcttctccgtaagatcaccgaaggattgggagcttgacgatcaaacaggaggttgcatcaggaatactccattaagttgtggaagtagcaaggacaggacaagcctcacagataagttctaccctatgcaaagtattaggttaccccacaatgcagaaaatgtgcaggctgcaaccagtggagatgaatgctcacaggtttgcttgagcaactgctcctgtactgcatattcctatgggaaagatggctgctccatttggcatgatgagttgtataacgtgaagcaactatctgatgcttcttcagacagaaatgggggagttctttacattcgccttgctgcaaaagagttgccaggttcagaaaagaagaagaatagaaatataagtggttttgccattggtgcaagcactgccactttgtttttgatgatccttctactgatactttggaggagaaaagggaaatggtttactcgcacattgcaaaagcctgagggtggcattggggtcgttgcatttcgatatattaatttgcaacgggcaactaaagccttttcagagaagttggggggaggaagttttggttctgtatttaaggggtacctaggcaactctaccatagccgtgaaaaggctcgatggagcctatcaaggagagaagcaattcagggctgaagtgaattcaattggaatcatccagcatattaacttagttaaactgattgggttttgttgtgaaggtgataacaggttacttgtgtatgaatacatgccaaaccgctcccttgatgtgtgcttgttcgaggctaatgatatagttttggattggactactaggtaccaagtagctactggagttgcaagaggtcttgcttacttgcataatagttgtcgggattgcatcatacattgtgatatcaagccagagaatatacttctcgatgcatcttatgtgcctaaaattgcagattttggaatggcaaagattttggggagggaatttagccgtgcaatgacaacaatgagaggaactattggatatatggctcctgaatggattagtggaacagttgttacatcaaaagtagatgtttacagctatggaatggttttgtttgagatcatatcaggaaggaggaactcaagtcatgaatgtttcagggatggtgattattcattcttttttcccatgcaagttgcacgcaaacttctcaatggagacatcggaagtcttgtggatgccagtttgaaaggtgacatgaacctagtggaggttgaaagagcttgcaaaattgcatgttggtgcattcaagacaacgaatttgatcgaccaacaatggctgaggtggtacaggcccttgagggtctacttgaactcgacatgcctccattgccaagactactaagtgctatcacaggagactcacattcagtgacaccacaatattttgattcagtgtaaatctatatgctgattcacaattaaaagtagtctaccaggacattataattcatcttgcctttttagaaaattagggataacatctaaggtctttaagagatcatgttaaataaactcgtagttattaagatctctgtgcccaagcaggagatcgtgccagccttccagacaaaatatattttgtgtctatgtaagatctgtaggtattagtgtaccgtatacatttttcatgttgccaattgagatgtttccggacacgcaggcgcaattgccttgtcagttgagagagtatattgttgagcctaacattggcaaatgtgtgacaacctgacaactatgctgctcatattatgcaaagttgcaaacatggcctatatatggcctataaatacaaggctaaattgttcactggcaaacaaaaaggagaagcctggctgctaagctgcaacttgtattttcaaggatagccacattctacaactataacacaagaactttgtaagccagaattacgcgcaaatcctaacactaactaccttaactgcaaggaatttaaaagttggggtgtgtgttaccaatcactgaaggaagataacggatgagcatgtttgattgtctctctttcttcatctacagttgttgctgctgctgcagttagttgcgatttataggccattccatctgccaaaggcaaactgtatactgcatcagtttccatcaaaactattgatctgagaaagataagtgccaagatgagtaaataacagaacataatagaagaatagaactgccgctgctaaaccaaaagttacctttggtgaacaggtcaaggcaagtcgatggtaataaccagctaagtagagttggattagcttcacaagtagttgttgtgtgcatgtgccaagcctcacaagtcgtcacaagaagcaaggtaactgcaagaagcttcaaaagaagttgacacatcaacattcctagctggatttttttttcatatgtagagctagttgatgggtacctggacagaataagctttacaacaagcagtgcaccagccaattaactcttgacatgaagataggtttgatgtaaacctgagaggttcccttcagtagttgtctgaagtctgaaccctgaatatattttagtatatgtattgttataattaaattttctcttagtacataaactggatagagaaggctgcatctctcatcatgcttacttcaattctgttcatcgtgaaatggcatccaatccaatgacacactgcatgggatatatgaaaaaaaacaatacacaacaagaagccttccattgcgactgtagaaatcaaatagcacaaatgccttccattcactgtagaaatcaaaaccatctgtagcgctgctttgagcacctgacaagtaactttctccctggtacaaagatagatcagagcaagctcaatggtatgaactggtgtcttgtttgtttccagtaagactatagtattactgtactatgagttaggcccaaatgcccaacgaagttaacactgccaatcttacgattcgcttgttcagtgaacgatgaaccataaatacagcattctttccctcgaacaaagtactgacaaaaatagtaggaaaagaaaaacctaatatgttcaaatctatttttccttttaacgaacaacaaaatggcgacggtttccaatcgaataatctaccggagagcacgacgcatcccacaaatctcacgcttgcgagcatccgggctagcccccaaggatccctcagtatctcgagcgattcgcatcgtcctcagcggcgcatctgctaacattttgtggaataacaaaatatgctttcccccaaatcgaagaaacaactggtacaaaggagacgtagcggcggcgagaccgtaccgcggagggagatgctccgtcgcacatctgccccatctccgtcggcggcgacggcggtcggcggactggcgctgctcgccgctcgccgctcgccccgcgcgcagaggaggaggatttcacgactcgtccgaggctgcaggcccatcgtcttcatcaccgtggccgaagaagcccaccacagcccacctaacttacggacaacgggacaatgccgcgacaggtccagcgatacataatgcccgaatgcccgataaaacacatgctgcgcttggagagttggagaggtaaaattaatacgtaactctagaattgactcgtgggttacctattaatttgatttatactttctccgttctaaaatataagagcaagtataatagtaggctataagtcggctaaatgctgagttggaggaaagaagagaggagagagaggagaagcgggctataaacttacagccggcttggacacaagaaccaaaaactctgtgagagagacaagtgggtcctgtattaattgtgacaagctaactattatataggtaggctgagagaaggctacaaatgtccttatagctagcaggtcggttgtattattagccttgctctaaggcacaactactttttaaagttgtttcataatataaggcgtgcatgcatgcatgtaattaattagcacattctctcccataaattattattattttaaatcctacactcacaagattttaattctattggttgcatgtattgtactagttggggtgatttatgacaatgatgtgatattaattatttcttggacttcgggttaaggttggttgtgccttatattttggaattgagggtgtaaataattttatggatcgacccacttgcatctctacgtggtaagtcggaccataataggcccacgggttgacatataagttcgcaggtcagtcctcttttcatccctagctgcgctccatgttattagttagtttgtgctttaaatcgtcaatagtagttgtgtatatgatgtaaatttataatgcaaacttgatagaaacttccttgttattgtgatacggtgtttccgatgccctattctaatacttccccatcctagtttgatcattagttttctcaaaatgatcatcatctaataaaatctctttatttatttgtgaaaaaagtaaatgtgcatcgcgtaatgccctgcatgcatgtatgcttgaatgataattaatttataaatgatgaatgttttgatattcttggtctaggtgtccttttgtttagtggatgatcatattgggacaaagggagtagcttcgttcatgatattttccgatattacggtagaatcggtatcattttcgtttctggctctaccgtttggtttgtattgttcaagaaaatagtaaccctttcctgatattttcatccttactctaaagtcttaattgggtgtggcctacgctagaatgtgactcttcaattatattgcttaggccaggtacaatgatctttataagtaaactctctctctattatcatgtaagtaaaatttgattacatggaagaaaaagaggggatgaaaataaaaatatggttgctatctaagccctcttagcaattagtaaaaaaaaaagaattgttgcatggatacgagagaaaggaaagaaatattattttggtacattaatgtttagacaccatgcttacagagataacatttaatgataaaacaagtcacaataaaataaataataattacataatttttttaataagatgaatggtcaaacgtatataaaaagtcaatgacattatacattaaaatacggtaaaatacggactgagaatctgtttagacttttgaaaagtcctacaattccgcgagctaaaaaaactgtgatgcggtgtctgcacccgcgttgcacccgcgttgtttgacctcactaagagcaagtttaatagtatagccaaccgctggctttaaattatctatagtcaacttaatagttaatttatacaatatatatacagtctgcatcaatctcttcaaaagtactacttaataaagagggttgtaaacgaaatcgttagagttgcagcatatttcaacatgacagaattttgcaggatgcgaagaagtaaaactcaaactctcggctgataaaggtcgagctgcataccaaactctcagcagcaacgagctcaataaaactactgaagtagcctggcaaaggctcggtttaaaacagattgttgagtagatggttgccccgcattattacttgattatagtgatagattaaatattttaataaataaacttaaaaaatacagtggaataaagttcttttttttgaaaaaaaagtatttttaaattgtgtagcaaatatcccttttcaacaatctagcactaatttaaacgaactaagcctaaaagatggagttgcctatcgtgagcaggtcaattcaatcagatggtcagtaccagctttgagtactcgtgattaagcactaaacggcatgaccaagtcaaggcatttttcattatttgtctccattatttccaaggccgatcaagcattcttttttttttctttttcaacacacctgtgccaccccagttacgattccattctctttcacatttgagggagctacttcatggctcacacggctgacagggcaagaaaacgatctctgaaaaaaaaaataaagtgcagtggttagttataaattgatcactacgattgtatgaaaatgatgtttttctatctgtcctgcagcatgcattcacagttacgtagtcatacaggtgacaaacgaacagattcattgaccaaacttacccatttgtagcaggtaatggagtctaaaattggcatcccaagcaaactgagcacaaacaaaatataaaggggaggagctgtggctctgcagttctcattcctaaccaacactctgcatccatccatcccaatttctcgttcagaatgcctctcgccctcacccttcttggattattactcttgtcactacacatctctgcatcttgtgctgccatggacaccatgacacctgcgcaagcgctctttggaaacggcaagctcatatccagcaacggcaagttcgcgctcggcttcttccagactggcagtaagtcctctcataacaccctaaattggtacctaggcatatggtacaacaaaatccccaagctaactccagtatgggtggcaaacggtgataacccagtcacagaccccaacaattcagagctcacgatctctggcgatggcgggctcgtcatcttagatcgatccaacagatccatcgtttggtctacccgaataaatatcacaactaacgacacagttgccatgctattgaacagcggaaacctcgtcctacagaatttcttgaattcatccgatgcgctgtggcaaagctttgactacccaacacatactttcctccctggtgcaaaacttggttggagcaagatcagtggtctcaatagccgtctggtttctaggaagaattcaattgacctagctcctggcaaatacagtgttgagttagatccaagtggtgcgaatcaatacatctttacactgttgaactcatccacaccatatttgactagcggggtatggaatggccaatactttccctcaattccagagatggcaggaccctttatagtaaattttacatttgtcgacaatgatcaagagaagtacttcacatatagcttactagatgagacagtggttttccatcatttcttggatgtctcaggtcgaacaaagacatttgtttggcttgagggctcacaagattgggtaatgacctatgcacaacccaaagttcaatgtgatgtatttgctgtttgtggacctttcacaatctgtaacgataatgaacttgggttctgcaagtgcatgaaaggtttctccataaaatcaccaaaggattgggaattagatgatcggacagatgggtgcatgagaaatactccattagactgtgctagcaacaaaaccgcatcaagtttgactgacaagttccattctatgccatgtgttagattgcctcaaaatggctacagcattgaagctgctacaaatgcagataaatgcgccctagtttgcctaagtaattgctcttgcactgcatattcttatggcaatggtggctgcttggtctggcatgctgagttgttcgatgtaaaacagcagcagtgtgatggcataactgatactaatggagggaccctttacattcgccttgcttcaagagaggagcaaagccagaaaaagaacagaagaggattgatcattgcaattgcccttggtctaagcttcgctgctctgtttatgctggcaatcgcactagtgatttggtggaacaaaagtaagaggtataattgcacatcaaacaatgttgaaggtgagagtggaattgttgcgtttagatatattgatctgcagcatgcgactaaaaacttctcagaaaagctgggggaaggtgggtttggttctgtattcaagggatttctccatgactcaagaactatagcagtgaaaaagcttgctggtgcacatcaaggagaaaaacaattcagagcagaagtgagctcgattggactaatccaacatataaatttaataaaactaattggcttctgttgtgacaatgatagtaaactgcttgtttatgaacacatgccaaatcgttcccttgatgttcatctattcccaactgatattaaaattttgaattgggatactaggcatcaaatagctattggagttgctagaggactatcttatttgcatgacagctgccgcgactgcattatacactgtgatgttaaacctcaaaacatacttctcagtgaatcattcactcccaaaattgcagactttggaatggcaaagtttctaggaagagattttagtcgagttttgactacaatgagaggaactataggatatcttgcacctgaatggattagtggagtgcctatcacaccaaaagttgatgtttatagctatgggatggttttgttggaaattgtttcaggaaggaggaattcaaatggaggatgtatcactggtggtgacaaagatgtttatttcccagtgaaagtcgcgcataagcttctggagggagatgtagaaagcttgatagatcccaacttacatggcgacgccaacttaacagaggttgagagagtttgcaaggttgcttgttggtgtattcaagataatgagttcgaccgacctactatgggtgaagtggttcaaattctcgagggaatatttgaacttgacacacctccaatgccaagactactgcaagctattgccggaagctcttgttctattgcagaataatattttcacaatcaaatgattctatttaatcgatagggttatttttacctttcttgtgcataagattgtcagacgtaaatgtaagctacattgtggatctatattgaaatgttaattagtgaaatcaacacagcaggtaccattgcttagcctatagcaatgtttaaacctacgacttccctttcccatattcttttgaagctcatccccctaggcttttcaaccaagcggtctaattactactttcgatttttcaacaattatattcgcatcatttactagatagccataatccctatgatattttttttgtcccacagttctgcatcatctactggatgcatcttgtcaaataaaaactactaaccacccatctggctggagatatcactggattggttgtaactaacaaatgttttctcctctttaaatcttaatgagattggtcggacaacctttggctgacccggcaaaaaaaaatgtcactggattggataatgtcctgtactaaccataaagattggaaagatgtagcaaaaatacatgatattagtagttttttcagtcttacgcaccaggaaattgatcgatcttctctagttgcaaacgaacagtatagaccaatctgtctgttgaatgtaagtttcaaaatattcacaaaagtcttggcaaataggattgcgttggtagcccaaaaaatcataaagccttctcagacagcttttttaaagggtaggaacattatggaaggagctataattttacatgagaccttacatgagatgcataaaagaaagaaggatggtgttattcttaagcttgattttgagaaagcctatgataaggttgattggaagtttctacaacaaactttaagaatgaagggctttgagcctaggtggtgtaagtggattgatcaagtggtaagaggtggcagtgtagcggtgaaagttaatgatgagataggaaacttctttcaaacaaaaaagggactgaggcagggggatcccctctcccctttacttttcaacttggtggcagacatgctggcagtgttaattcagagaacaagcgagcatggtaagattcatggagtgattccacatttagtagacgatggtctttccattcttcaatacgcagatgacacgatactttttatggagcatgacctagaggatgctaaaaatcttaaacttgtactaagtgctttcgaaaggttatctggcttgaagattaattttcataagagtgaattgttgtgttttggcaaagctatagaggttgaaagagagtatgctctcctctttgggtgcaaaactggttcatatacactaaagtacttgggcctcccgatgcattacagaaagttgtctaataaagattggaaggaagtagaagaaagatttcagaaaagattaggtagttggaaaggcaagctactttcggttggaggtcgtctcgtgctcatcaactcagtgttgagcagccttgcaatgtatatgttatnnnnnnnnnnnnnnnnnnnnnnnataatcaaaaagctggactattatagatccagatttttttggcaaagtgatgaacacaagaagaagtacagattggctagatggagtgttctatgtaaacccaaggaatgtgggggcttagggattcagaatcttgaggttcaaaataagtgcttgttgagtaagtggttatttaagttgattaatgaagagggggtctggcaaaacttgtctggcaaaacttattgaggaaaaaatatcttgccaagaagactataatgcaggtccaaaagcaaaggggggactcccacttttggacaggtctaatgggagtgaaggatacctttagctcttttggctcgtttaaacttcaggatggtttacaaatcagattttgggaagactgttggcttggaaaccaatctttagagaaaatatacccatcgttgtacaatcttgtaagaaataagaatgtggtggtggctaaggtgttggagagggttcctttgaacgtctcctttaggagagccataataggagataatttgaaagcatggcatgagattgtagctaacgtggttgatataaaccttagagggcaaaaggataggtttacttgggatgctagtaaaaatggaactttcacagtcaactcgatgtataaaaaactcatgtttggaaatgtgataccaaggcaatcttttatttggaagctaagacttccgttgaaaataaagatcttcttgtggtatttaaaagagggggtcattttaaccaaggataatttagctaagaggaggtggaaaggtagccttagatgttgcttttgtaggtctcatgagacaatacaatacctcttctttgattgccccatggtaagatatgtgtggagcgcagtacatttcacttttggcatctgcccaccgcacaatatgtctcatttacttggtagttggctaagtggtgttaacattaggctaaaaaatcaagtttttgtgggcatagcggcgttgtgctgggcggtgtggttaaataggaatgatgtggtttttaatggaccatgtacttactcttttatgcaggtaattttcagagggacacactgggcaagactttggtctttgttgcttaaggaagaggatggcaacatgttgaaaaattattgcaaggtgttagagatgagggtcttagaattcttctctaattatggctggaatttcagagggagaattgaagcttacactgttgtttaagcttgtttgttgagtttgcttggttgtcttgttagctggcatattagttgaacttggtacttcttatgttacttttaagtatgttttgtaacccatgtaatgggaggagccttagtgctcttgtatggacttgattggcagtgtacattcttcgggatgtagaagccggggtttatataaatcctttatctaaaaaaaagttgcaaacgaacaatatggtggccgacctcgtgcgcccctaatcccaggtaagctactaccagctcttgccaggtgacaaacgccggccaaggtgaacgatggtggaggacgagcaatcaaatgcagggcaggttgcatccccccaaatatttgcgctgatttctaccggaatcttcagttttttgcaggcacacacggagatatatatatattcttcgacgagatgttgatccccaaaacgtacaagaacagagagaccaaaaagcgtaagacgacgagaccttaccactgggagagagagagagagagagagagagagagatcccccgccgccgccgtgagtctggtcatctccggcggcggctcgccgccccgaggttacatcgcccacgacgccgacgagcggtgcagcccaaatgaaagccacgtcatcagcagcaccgggccggcccatctccccttcccaagcaaatttctgcgctcgcggcccaacgcttcgtggctcttcctgctgtggagaatctggagatcacgtggattttttttaatatatttattttaaaaagatttacaaaaataaactaccatttcaaagttttttttaaaaaaagagtaaattacacccacagtacgataacttagtagatgcgtgcgatttagtgcaagaacttgaaaaataagtagagtagtacataaactgacaatcacgtgcattttagtaaaaacattgatacgtaccttttgattaatcctggtattataagcttaactgctagatcattagctcatggattcaattttgtgttttgccatgttcatagcccaagataatgaatatgttgattaatcgaatcgctcggaaattatgcttatttgcatgcacttacttttgataatcatatatctttcggtttcaaatcgatagaattattttattattattataactaacaaattaaaagcaatacataatacatgtagatccttgtcgagatggaataagtggctgcttttttatatggcataaaaagtatggtgtggaatactgatcttttaaccaaaatgcacgcactagccaagttgttgcacatatatgcttattttttaagtttttcactagatcgcacccacataccaagttaatgtactatagacgcaatttactctaaaaaaaataaactccacgcggcgctctatgatagggtaatctatgtgacgtggcaccggccgcaccccgcgggagggggctacctacagaattaccacggtgcaaagtttagtgatgcatggggtgcaccaaggcaaattatatttatatttctatagaacttcaaaatgagaatttatttttgtaaatctttaaaactaataaaaacaaaaaaatcgatcacgagtaacctttcaatctgccaaagcccaaaggccatcgtattcgtgaggatcaggactgccaaagccctaaaccaatcaccagtggaacgaatggtaaggagtaattggtaggggtgaaaacggtacagaaacggatggaaaccatccttatcgttttcgttttcatattttttttcggaatcggaaacctcggatacgaaaacggaatcgaatattatagaaaccgaaaacggagcgaaaatgaaccggcgcgaatacggtaacgaaaatttatcggaataaaaaccccctcaaactgataaatccaattgaataaattatctatgtttaaaagagtaatgttgttgataaattctaatgtagtacaaaatattcttatataattttagatttgcataacaaacattttttaaaataataacagacaaacaccatggtattcactatttagtgcttaaaaaaagaatccagggtatttcgatcacaaaatttctagtaattccaagaaaatttccggaaagtttccgaccgattccgagttccgacggaaactacccttatcatttccgattccatttccgagaaaatatttccaaattcgtttccgtttctgaaaaattccgaccgacagattccgttttcaaaaataggtctggaattcggaaagtttccgtaccgttttcacccctagtaattggtaagtattatttcttttcttttcaacgtgagtgtatacaagtatagattagtcaggattaaagattcctacttactccgtttaactatgtaagacttctatataaatgtgggtgatggtagaaagtcttacattatgaaacggggggagtaatagttacgctttaaatacaattttcaatctgccaaagtccatgtattcgtgcgtgctttccattggttcagccgatgattgcgcggagaaaaggtcaaactgggtgaaatatacttaatcacactattatgataagctgtgctcattggcaagcactcatgggccctgtttggaagattagcccagggctaattttgagagctaatgtttagtcatgaattggtaggctaaacattagcctaacatgatatgtttggatccataggctaattcaagactaaaaggtggagagagagtagaaagagatgagagagaaggagagagagagagctgcttttttatggtccccacacaaaattagccctattagcactctttggaggggctaatgttttgaggggggctaattcacattagctcaaaattagtccacctgtttggatccttgagggctaatttgagactaaaagatgagagctgaacattagcctatggaaccaaacagggcctggtagcctggtacacatggcgatcgaggaaatttggtggttagtgccacgccttcgagtacccatagtcccgtatcatgatgtacgcaccgatttggcatgataatatagttaatgtgttcagcatttttgcctcctttaattccgccgtccaagtccataagaatggtttgcaacacgctttggtatgaccaagaagagatgtacactattccagcattaactcatactccttacgtactagtaaaggaagtcgtttaggacagcggcatggtctccaaaacacaactttgacttcttgtttctataaaaatatttattgaaaagtgatatatgtatacttttatgaaagtatttttcaagacaaatctatacatataatttttacatttttaaactcaacaacttgagagttatttatgatttatattcccaaggtttgacttaaacattgtcctaaataactttctttatgagtacggagggagtattccattatttctataaaaaaaacttctagccgcatcataactagaaattggatttttataggatggagggagtagtcacgtacttatatacagccgcacctgagcgttgacatcctgcatcctgtgctcaacatgaaactgatttgattttggagaaggaatgtcagatttgatctcgtgtgccacactggaaactggacaaaattttgtctactagctgaagttttcatttggacccgaaacatttttttgctcaggaaaggaaaatggaacaaagtagagtccacagtgtccactgcattggtatgtgggatgaacttgctgtgctttgcaaggtttagaagaatatataaacctactcacctgcgtacgtgttgatggcagaggcataaaacaaccatttctgtctggaatagttggcaaggatcattcctgagtccaaacgctccagcgttgaggtctgaccaagataagaagattatttattattcagataacctatcatatttctcgaggcttgtttcaggctaaacacaacgtcgtcagttgacaaggtctgatttctaaacagcaactgaagctgcttgcaggaccatcatctgcttcaatcccactcttccctcagtcctccaccacgccttccccttgttcatcatctgcttcctcatgcctctccttcatcatgtcctccttggcttcctcctcatcctcctctacctacggactccgacgagctctaccgccacggacaccgtgtctcccggccacgcactcgtcggcagcgacaggcttgtctccaacaacgggaagttcgcgctcggcttcttcaagccaggcaatgagtcctacaccaaccacaattcctaccttggcatatggttcaacaaggtccccaagctaaccccactgtggactgccaacggtaataacccggtggtggaccccacttcaccggagctcgcaatatccggtgatggaaacttggccatcttggatcatgccaccaagtcgatcatatggtccacccatgccaacatcactgccaaggacaccattgccatactgttgaacaacgggaatcttgtcctacgaagctcctcaaattcatccataatcttctggcagagcttcgactacccaacagatacacttttccccagtgcgaagattggctgggacaaggtcaccggcctgaaccgtcgtcttgtttctaggaagaactcgattgatcaagctcctggtatatactccttggagttagggcccaatggggatggtcatctgctatggaactcaaccatagcgtattggtccagcggacagtggaacggccgatattttggcctaacaccggagatgacaggcgctctcatgccgaatttcacatttttccacaatgaccaagaggcttacttcatatacacctgggataatgagacggcgatcatgcacgccggaatagatgtcttcggcagaggtttggtggccacatggttggaggaatcgcaggactggttgatctattacaggcagcctgaagttcattgtgatgtgtatgcaatctgtggaccattcacaatctgcgacgacaataaggatccgttctgcgactgtatgaagggcttctctgtaagatcaccaaaggactgggagcttgacaatcgaacaggagggtgcatcaggaatactccgttaagttgtggcagtagaacggacagaacaggcctcacagataaattctaccctgtgcaaagtattaggttgcctcacagtgccgaaaatgtgaaggttgctaccagtgcagatgaatgctcacaggcatgcttgagcaactgctcctgtactgcttattcctatgggaaaagtggctgctctgtttggcatgatgagttgtacaatgtaaagcaactatctgattcttcttctgatggaaacggggaagttcttacattcgccttgctgcgaaagagttgcaaagtttagaaaggaagaagagtggaaaaataactggcgttaccattggtgcaagcaccggtggcgctttgcttttgattatccttctattgatagtttggagaaggaaagggaaatggtttactctcacactggaaaagcctgaggttggcgttgggatcattgcatttagatatattgatttgcaacgggcaactaaaaacttttctaagaagttggggggaggcagttttggttctgtatttagagcaatgctccggtgctttctaccggtagtatatactaccagtagaactaatctgaaccgtttatttttaagggtagattagtaaagtactgaggtagatttgggataaatttggcacttaatttatttttgtcgtggatcgctcggatgtttctggaaaagcagtgctgccaccgcttcctcatccatcgcaatcgagcggaggtggagagagcgactccttccgccgccggcgcttgtgcatcacgttcccttccgccggtggcaatactctccggcgccccctcttgttcagttccccttctctgccggcgtctacccgcttccccgccgcaggagcttctggtgccaccctgaagacttccggcgtgcgcacaggggcagcggtgcagaggagccccgcgtggttccacctcctctcgcacgacaccgccggcggtggtggcagccgcgacgacggctacaggcgtgcgtggagccggctgttgaggaggctggtgcaggagagcatgagcttctgtagcctcagcatcagcaggcacggtaatgttaattttcgtggatgacttcaccagaatcaagaatctgattctgaatctgaatcaagaatttaatttggagatggacagtatgctctattgctataccagaatcaagaatctgaatttgctatgaaaagaagtagctcaacttctgtgagcctgatccattaaatttgtgctttgcttcctctttacccaagctaatgtaatgtgaataggcccatcttgttggaattctgcgtgaaacccattccagcaatccagtccacgaaggcttccccttgcgagtcgtcacggcggcgagcgggtggcggtggcgccatggatggccagcaggaggagcagcacgcagggcggcggcagctgaagcccgggaaagacaaaagtatccctccgcaaatatttttttttggacaaaaatatccctccacaattctactaccattaagtgtgatggtagtagaaatagatctgaaccctatgatcaaatgagatcaacggttcagattattttctactacaattagagggcaccggagtgggtatcctgtatttaagggctacctaagcaactctaccatagcagtgaaaaggcttgatggtgcccgtcaaggagagaagcagttcagggctgaagtgaattcaattggaatcatccaacgtattaacttagttaaattggtcgggttttgttgcgaaggtgataataggttacttgtgtatgaatacatgccaaacagctcccttgatgtgtgtttattcaaggctaatgatatagttttggattggactactagatatcaaatagctattggagttgccagaggccttgcctacttgcatactagttgtcgggattgcatcatacattgtgacatcaagccagagaatatacttctggatgcatcttatgtgcctaaaattgcagattttggaatggcaaagattttggggagagaatttagccgtgctatgactacaatgagaggaacttttggatatctggctcctgaatggattagtggaacagttgttacatctaaagtagatgtttacagctacgggatggtcttttttgagatcatatcgggaagaaggaactcaagtcatgaaaatttcagggatggtgattattcattcttttttcccatgcaagctgcacgcaagcttctcaatggagacgttggaagtcttgtggatgctagtttggaaggcggtgtgaacctcgttgaggttgaaagagcttgcaaaattgcatgctggtgtattcaagataacgaatttgatcgaccaacaatgggcgaggtggtacagtctcttgagggtctacttgaactcgacatgcctccattgccaagactactaaatgctatcacaggaggctcacatccagtgacaccacaatatttttattcactataaatctgtatgttgatttgcaatttccagttgtctatcagaacattataattcatcttgccttttaagaaaactaggcataacatgtaagatctctaggagatcatgtcttatattaaatataaactcagtattgtaacatgtaattaagatctatgtacccaagaaggatattatgctagccttacaatatggattatctcttaaaagatacttggtgtctgtgatatgtaagatctggtatcagtgtaccacatacacttgtaaatattaccaattaagatgtttttgagacacgggcaattcagatgagagtggatagttgagcctaacggtggaaatgtgtggcatcctgatagttatactcatattatgcacacatggcctaaatatacaaggcaaaattgttcactggcaaacaaaagggagaagcctggctgctagcctgcaacctgtttttaaggtaggcacattttacaactacaacataagaactttgtaagctggagtaactcataagtcataacactaactacctggattgcaaggaatttaagttatggcatgttgttcagtgggtaccgaatcactgaaggttgatgattgacgagcacgttctgtctctttcttcatatacagttgctgctgctgctgctactgctgccacagataatgtgattcataggctgttccatctgccagaggcaacctgtatcatgcatcagtttccatcaaaactgaactggttattgatctgagaaacataagtgccaagatgagtaaacaacagaacataatagaagaatagaactgtctctgctaaacaaaaggttaccttggtgaacaggtaaggcaagttgatagtaagaaccagttgagttggattagctccatgcttgatatggcattctgacttggaccattcaggacaatgtcatgtattattcagttaaacccttctctgactgtgtactgcccagccacagttccgtcttttcaccttcttattttacatgacaaggtgagacttgagagatacaccataatttatggatccaatagtcagtacaacagggggaaaggtaggagaacacaattaaggaataacaatcaaattgttaggcatgtttacagttagcaatggtttttcatcaactctgccaagtgcagcagcatattcatacaggccagtgaaaatcggaattattgctacaatctttttactttcaattagtaatgaaagatggaattgatatgacaccatttgtttactagtaagttaggaatgcgcctgttattagagggtattttgatcacatttgtccaaaacatgaaaaccttggtatgcataattttgtgagtacactggtgaaatgttacatcctaagctatcagaataccagcctctaggtgaactgctagatattgccagacctctagacctcattgtaggttatactgaacactgacctacctttggatatttagcaatagagacaattgcgcttttgaccctgttttaaaacctaactatcaatttgaccctacttttttagggtttgatagataaacactaggtagtttatatgcaacgtcgactataatcaatgaaataactaaatattcatcctttcctcttgtccaaagtgattctacagataaccagacagccccagtagtcatgtacataagtcgacctccctagggtaatgaaaaacagaaagactagggggaatgacataagttaagttgtggttacatcttgaagcatttcctgcgcacaaaaggcagacgccatcttatggcctacaagttgtacatctgagaatatatatatacattcatacaggctaaggtaaagaggtaatccagctcttagtaccaacctgccaactacaataagaaataatcaactcaagttgcaagaaagaaagagtagctagtaactacagctacttgtactaattgaactgctacataccaatgatgtatatgcccatttctagctggtccatgccatctatagtcgatggatgacatctaatcatctcgagcctccaatctacaagacgccaagatggagcttacatgttccgtgctgtgctcaaaagagagaagcacagcaccttgcaatgaggcattcatatctacaaggcctacagagaagaatggagattgttcaactcagatgtttttgtgcagaaattctcatcaggttgctgaagaaaacaacaaaaacaaattttcaataatttcccaagctttacatgtgaagtgatagaagggcacccacacatatcctatgatcatttacctggttgtgtgggctgctacttgacacctgagaagtgtgataggttgcaaaacctagatgctgaaaaagtgtcaatcacgttagtactatttccaatactcaaaggctagaatgggttcaatcaaaagttcttaataccgtcgtgaaagtcggatctaagccagagggcatttcatcatagctaattgggcccatcggacttgaaagatcaatcccctagattaaaaaggaaataaacaactatctcaatcccctggattaataggaaataaacaacttccaatacaacaccactaaaagaacatcatatgtagggaagcaatttgtatgtaacttcataccctgtaggttttataggtcggagtttgggtacccagtggggacatgttaggaggaccctcgaaagcctgcatgttgaaaaatgccatgactatttgttgcactaagtaaaaaaatgcagcacagcataatgcaaaattgttagtaagttagattatcgacaccaatgcatggaacattgcagcttaacatgaagtgatgaagacaacaactttatatcagataaaatagtacctcagcacaactgtacaacaagcgaacttaaaaaatgcaaaacataaacttttcccaacaaagttctctgccaaaaaatgtgggatatgggtagaatcccagacaacagacgaatccatagtttgaaatgaaaaacatattcagacttacaatttgactaaacaaaaaattggcgaaaaatacctgaaacatgtttccagattgagaaccacctaacaaagcatactctgaaggttgttctgagtgaaccttctgcttctttcgtaaacctttttcaatgcaatttcttgattggatcttatttttctgccccttcttctttgactcttttgctgttgtgccacttgatttgtccatgatattttctgcttgagtgccgtttgtaatagaaggtaaggaaaccttaaggttctgaacatcagtctgggtcagagttgcatcgacacaagtttgtttctgtaggatttcttcaactttgttgctaagatctacccaacattggtccagtactctgtaggattcctcacattctgatgctcgagcaacaagcctaacatactttgggcacatgtattgatagcgactggaggattctgataatttatctgcttgaattgcttgaccttgaacatctccagacatcaaagtcctagcatattttgtccagcgcttcataatatatctgtctggtagatattttatatccattgcatctaaaattttcagcgcgtggctacacaagaaaccatttctttcaaacttcttacatgagcatgaaacagtctgctcagtagggtttccataaactgtatatcgcttctctttctcaacaactgaaacgacatactcacgacaagggccactttcatcacggtttacaatgtaagctgactggaattcttcgtattcttcttgaaaaagcggaaagatcgtattggtataagcctcaaaagcttgtgtcaggataggagctttaattttaaagtacagcaactttagccttgaactatactcaacctccaattctttccgccgcctatcattaataactgtctcaagatgcctcaacaataaaagaatatttacctcaggtctcaaatgatcccgcacatcagactggaagcggtcgttcaatcgtgtgcctttcattccagctgaaaagacccctctcatataaggtctagcccatttttctttttcttcaaatacctttttcaaccatacattatcatgaaggttatgcttattgatcatagcatcccaagaagtgagaaattccgtctcctcttcatacaaattgatgcatgccttgaactccttcatgaaatcactgtcacttttaagctgatttatgttcctcgttgcagcatgctttaggtgccatgcacatataacatgggttgtgtctggcatcactatagagacagcctttgctacaaccgcatcttgatgtgaaaagaaagttttgggtgctcgtccagacattgcatgcaagaaagtctcaaacagccactggaaagactctgcagtctcgtcatacatgagcgctaacccaaaaacaataggctcaccaaaattgttacaaccgacaaaagaggcaaaatgacggaggcttatactgttcctagacaccacatcaaatgcaataacatcaccgaactgactgtagtcagtaatcatccttggatcggcccagaaaacatttgccaccttatcctcgacatccaactgcacggaatggtagaacgaggggttagccagagactggtcttgaaaataatttaacaaagcaccagcttctccatacttcatctcccattgcctcctggttcgcagcggctgccggcgcccttcccctgcactcgcggtactattctcttcggtagaattctgccctcccacctcacccccgtccatcagaagatcaggcggcgtaacggcatcgggcaatgtcgtccagtgcacgacattgggctgcagaggattgggcatgcaggatgtagcgaagagcgggtggttgtgccgcggctggaaggcgtaaacctccagcttggcgccgggcttcttgcggcggatgacgaggtgcgcgttgcagccggtcctcgagtccggcatcggcaccatgtggttgccccgcttgacgttggccctgtagccctcgcgggagcaggcgaacttccgggaggtgatctcgccggtcttcttgctcttgttggcgtactccttccggacgttgaaccctactttccagccgtagtagcggtagaactcgtacgcctcgtgctcgctctcgaactccatccccatccgcggcgtgtactcctccgggcgtgtaggagcggcccggaatccgcccctccccaccgcggcaacggtggcggtggcggcggcggctcccgtcaagggatttcgggatgccgcgtgggtcgtcgtggcatcagttgccctcaagggaattcgggaggccactgcggcggcggcggcggcgggccttcgggacaccgaggtggcggtagtggtggtggtggccctcgtggcggtccgggacgccgcggtggtcgccgggatgttccgggcggcgacgggggcagtggtcccggggggcttccgaggtagcacaccggtggtggcggcggctacccccgaggccttccgggtcgccgccgcgggggcggcggcggatgtagacccggattcctttcgggatggcacgggggctgcggcggcggcggtagccggcgatccggatggcggcgcggcggaggcattccgggcaggcgcgggtgtgattggggggttaggttttggtggggcggcggcctcattgcctgaggcggcggggtgtggaggcggggaagcgggcgctggcgctggagctggagtaggggggtgctccggtggagggggctctgccggcgagctcatcgccggcgggcgcggcgacgggggaggggttggagccggtgctcgccgccgtagctctgtaacgctttcgtgcaaacaagacagctttcgggagaggaggggaagtgcactgccaaccaggagatgacgctttcgaagaaagaaggcgctaaaatcatctgctgtttccacgagaaaaaaaatcgtctaaaaaaatgcaccaaggaaagctgatagcctgatactgcctcgaatcaaattcattgacctgaaatattttttactggagggagtactggatgggtcgaattaatttatgaacccagttttgttttctcactgattaaactcattttctgtaattccatatttttcaggttagtttatacattaaaaaaacggcatattagttgttattccactactgctcaaaaataaaatgcaagttcccaaactacataggaagtacatgaatactcacaaactacagaggaagcatatgaatgcagagtactccttccgttttgaaatgtttgacgaacaaactaaacatcataagaaaaacaaactaaaacaacatcataaaaaagaacaaagggagtagtagtatttttccagctgagagaataaaaaaaggaacgaaacaacgagaagaaattaccgtaataacatgacggtgatgtttccctcaaaaactggcatttgattatagttaattcacttgattcacatgacttcgggtttcaacccaaaagaggaaattaaaaaaaaaaaaactacagcgaacttcagtcaccaactctctatcagatttaaaatagaaccacaaggtgtgtgtgtacaaaaaagaatgtatcttgaactgaaaacatattcataaaatggagtatacagctaatgtcattataggaaaaagaatgttcgggtccctgataaaattacatcaaaggatcattcacgcaaccaagaaaaatcatatattcatcagctggaacagtgataacaccaggagtccaggagcagctgtcactttcgcggcttccttccctcatggccttgaagctcaagcagcctgctctgcaatagccactttaaaatcagactagcacgcggcatggcatcagacaatactaggcatatctccaacccagctacaaactgcccgtggccatcgggttctaatgcagtccaccaacggtgcatgctgagaagtttgaacaggtggagcaagtgaaagaacactgtcatccttgctcccgctggtggacgcgcttacaacatcagctagatactcatcttgagtccaccttggcgggacactgacatttaacttgcacagtctgggtctctgtattgttgaacctccaatgttagcattcccattaagcacggacttcgcgattccattgaaatggtagatagtgaattgcttcttgcccataaggcctgtaggatccttcatgcctccagcccttttatccaattgtagcagcgcctgccagaattcactccatactataatgccagcattacagaggtcctcaagcttatcagaaggaaaatttatgtcagtgtccctcagaacttgttggaacccctcaacgctaataaagcctccacctccactttgatcttgtgcatcaaatgccctccttattttagattcccgctcttccagctcattctcttcttgaacattgggatttagggcaaaaaggacggagtagtgactttcacttcctaccacccatattggccatttcgggcactttaagtattgaccaaccttgcagaagtttagtgattccagaagggtaaggaaaccaacttcaacatcatttggtatcccattcaggaacatgccaccaccaaagtccaccttgccatcaaatacatttgacacagcctctccacatagcaataaattcacaacttcctgcaaaaatcacactagtcacatttgggtcgaaaacgttggctcaatataactgttaccaaagtgacttcactacattgcaagagtatgtggcagtgtgaactgacacggtattatctactctgctaaataaatatctgcatgtcaatgccatctatacctgtgaagcatgcccaaatggggcagtgaccaatggtaggcttggatcatccctatccgcttgaatacgttcctgtgtacaaagacgtataaattgcaagaaaatgaagataatatcgagatgctttgagatgaccatcaatgagtggaagaagtgacgattaataaaacaaatggaagaaacaaattgatggcaatcatagaaaaaaaatactgttttcttatgagaagtaggaagcataactaaattaccttcatagataacaaggcagaactaaactagccgtccataagatcctaactgaattaacccaaaagctaacctatgtaacactcattatcattaccacattctagaccaatcaactaatctatatttccctgtcattatattactatgttgataattttaactgtagtatgattttgtaatatcaaagcatgcaaaagtcattggtggttatgccagggcatgtacatgaaatttctgacagatttaaatagtgttgtgttcacttattgaacatggattaacagaatgcataaaaagttgagaactaaaggataaacaaaggcataccaatcctcgagagagaagagcagatataaggaatagcatggctcctaatcgactttcaaacaaagaaatgtttgctataagactgttgaatgcatccttccttgaggtaaatgtacttattctaagaactttctgcagatccatagctgagtcaacagaaaggccttccaagactgcagcagttttctgcaataagtttcataagagtatcactggcatgtcgaagatgaaggtataaaaaactcgagtcacctgatcttcaacacgtccacttaccgcttcattgacacttccaatggttgctacaactgctctgttccccgttccgcataaaaatagaatttccagcatggcatgaaccagtgctctaacaaatgacaggaatttgatagcagtcattttaatgtaaagaatattaaggaagcactactctgtatatattctgcaccatgaatatatttcgtgacacatttagaatatcgattgtacattataaatgaaatagtatataacaaaaggaaaagaggaaaatgatagttctaaaagcattttacgattccaataataatatataaaacactgatgttgttccaataaatatttaaatattcatttgtaaaagagttctgttggtaaaacaagggcctatgttttcttggctaaaatttaaattgtcaatccctaatatgaacttgagtggacaaataatcaaaagataatgctgacaccagtattatctaaaaggagcaaaagaaaccacctcatctttctgtcatcagtcagagaagaaaaatcatccctcgcagcaaaagagctctgataaaagcgcctttgtcccagggcataaaacggatcactaacctccggattacccaattcatcagagaaaaacaaaagatatttaagaacataggcctgcattaagaaacacaccatcagaaatgttgagctttcagaaaacagaaataaataatgaagaaatagtttgatcttgtgtctgtctatcagatagcgatacactagtgtcacaaatcaggaaaaaagaattaaaatcaggtcaaggtgaccacacaaaataaacatctaaaaaagctacttacctttaaatagcatttttctattaaatctaatgaaacagcagagaagtccagcctatctcctactaacatatatctgtttgtacattgaatcatcaaagatactttgaatttctttcattggtatctagtgttctagacaggttgcttaggtccagtttgagttgtgaggatcatgtacaggcagtccaaccaaaaaggtccactaaacgtagcttgtgttgacagaacaggtgtattaaaatttagttgcagcaattagaagggtttctcaaatgcatttagtagcttatgtgctacaaataaactgataaaacatgtcacagcatgagaaagaagtaacaataaatatgaagtcagtatggaaatctgagttcagaagaagactggaactaaagattaacatttctgtccaaaagggacaattaattaatcacattatttaggtaaagcaagggagcggtacctgtactgtagctaggacaccacaagggccaccttcatgctgtaccagtcccatggttgtttcaggatcagagctaaatctgttcatttaacaataattaaacaaaagcagattaattgcatagcattgaattgtgcaacaaaaggcatgatatgattaacactgtaccatatccaagcaactgtttgcatctaaattaaaatgtgctgtagtagttctcatctaacgtgcaaagtcaattgctgtacagctctaaccagtcagggactagaatgacagattaaattaactaagagctgcttctcgtgttccttatgtggattatgtagggctgaaaatatcacacttcatcccatcagtagttagcaccattctaaacaggtggacacagacagcattctaccaaaggcacagggattcgttgtgtaattgtgctacaaaaaaaacttctacacataaaaaaaatgcatacagatatgttcaataccacaacagtcctactttcagatgcctcaaatcaacccattaacaacgcatatatggatgatagtaaaatttgtaacacctatcagctcttgttttcacaaatactacggaacaagagctatcctttaaagcctgaacttagtattacatgtacattgtccgtaactgcaaagaaaacacatggtctcatttaacatccaattctgatattggtatgaaccagatcaacaacttcaaatcatcagctgaaagcacaaacaaaaacaccaacagcctatgtatggcagcaatagttgactacaaagaaaaaataagaatgaattttcagcctttacagtttacaaacattgagaaccccgcaaaaggaaaaaagtttacaccagctactatgaccattcttcaaacccgatttatggtgtgttttaaccattcatatcaattaagcaggtgagaaaacgacacaagaaaacagctgtattaccctttataactgcctcggaaaagcaaggaggggtcaacttgtgtagtttagtaataaatattatggagaaagaataataggggtaatgatgcatcgtaagggtagacatccatcagagggaggctggatggagacaacttgacgtgaactgcagtaggtgaaggaggaatagatctagaatatgtcataggagagaccacgtcggaagtataggggttgggatttgtctatagatttttggttgctacgtagaaatacaatccccatccttatatacatgggataacttgaccttcaagaagctgatctggtctaatctctaacaataaaggaaataaataactcgatctaatctcatcagtaaaatgctgctactgccacgcatggtcagtattcatgaataataatttcggccagtgaaaaaagaactcattaagcttttaccaagccatctattttgtgaccaaaatagaaaaattgagtgcttttatatttcccgcgcatggaatatttattaactgcccgccatagacgatactcttgagtgaagctaagcctagttgccaatctgacaaaccacaagcaccacaaatagctcttatttcctaccctacaatctcagtctgaacctctaacataaatataaccttgaatcaacagcgtctaacacacacataaacaactgttcatgcaaactaaaacctagagttgcaccagatcctgaaggattcagggtaacatcctaatggtcatttccagacgtccatccttatactcatcatcagaaatagaaagcatccaagtaatatacactcctgtggtcgattgacaacaccactgaaacagaaatatgttgatatgtatacaatcttacgaccagataacaaaatgctaagcatctcgcaggctgatagtcgtttcagctggccgcagctgcagctgcagctatagtaaccagcagtagagctgtgctgtgactgtgcaaccgcaacctcggatcagctgctcactataaaagccacatcttgcatacatctacacgcatattagtacagagtatccccaacaccccttcttcaaataatgaaggaagaggtactcttggaccctgagaactgcaagcttagtagaccttattcgggttttttttttccttacgttcctaaagcactaggatttgatcattttgttacatctctcaactttgaatttctataaccggaccctttcttcccctaatatatcgaaaagataacagatctcctgtaatagccgttcaaacaaaatgaaagaaagagacagtagagaacgcaaggaagaagagctcacctgatgccctgattgctccactgcgccaacacctccttctcaagcttgttgccgaacaccattagccacagcttctcggccacgtccgtaggcaaccgctcccctttctcctcctccacctcctccgccttcgcctcctccatagatacccccgatggccccgggtccgccttcacctccacctccacctccctggcgaccacctccggggccggcggccgcggagccgccgcggcgggggagggggcgaccgcgcggagccgcttctcggcggcggccgccctgagctcgcgctgcttgcggcgcgcctccgcctccgcgtccgccgccgccaccccctcctcggcgggcggcgggggcggcttgctccgcttcggctcgggctgctgcgccggcggcgagccctggaggctcatgcggagcgccatctgcagctcctcctcctcctcctccccccgatcccccatccaggatcgatccggggggggctcctcccaaaccctagcacgcgcgcggggggtttggcttggcgctctctctgtcagaggcgaagaagattaccgcagccgacgcgaggtggagaaggtctcgggattcgggcctgtcgcatcgggatccgggaggtggcggcgtatttgtaggggcggcgtcgcggcggcgcggggtctctggggtgtcagagatgcgttcggctgcggcgcggctgctgctgcagtgctgctgcctgctggtgatgggggggattgatctgccgcgcgtggacgccggcggtaggatgccgtcatagtagtcgatgacttgtggggacgggtttgagtctggcccacttgtcattgactgggggtggtaggccgtggggtggccggttggacgttccggacgttttcttttcttgctttggggggttttggacaatctggatccgtcttcaggtctgatttgcgcacgatgccgttggatgcgaatacgatgttcgtgttgcgacaggtcgcattctgattcggtttaggactgctccttcagtcgaggaagactgaagatcaacttttaagttttaactatattaatctaaacatagtctagtccagattcttttgaagagaggatagattttaagaacaacacacaccaacattaaaactaatttggaacaaagaaatttataggattttgtaagtgcagttctattcaggaggtgtttggaaactagggactaaactttagtccctctcacaaaaacattgtcccataatacgaggcgtgtcttcatatagtgattacgtgattattcacttcatcggcattcatacacgtgcgccctaacatttcgtatgtgcgtgtgacacttcattaaccccttccatacacatgtatgcaagcccctaacgtgggtgcatggaattatttagaacgacgtaccgtctccatgcataatacgcgcatcaatcaccgcaattaatcttatgcatgcatcgtgcatttatttacgggaatatcatccagaaacttccttccatatcatctccctaataaattttttacatgcctataaattaggacgggtaatattattttcctacttaatgacgttaaattctaagtaagtgagtgatattaaaggataccatagatgaatcaaaagacaagatggatgagtgatccccgagcgtgaggagcactatcgaacaagaatgtgagaacatacacctattatgaatctagttaatctctttagttgatatgtaggttttttacgataaaagtgtgtcttacaacgatcttaatggtatcctcatgttttggcaaacaaaagtaaacaggaaatcaagaccaaagtgaatgttttggaaataatgaagatccaactatgcaaggttaggtcaagatccaatagtgtttgattgtaccattgaatttaaggaagtccaaactgtgtcctatctgcacaaggcattatgttatattgattcataatcgtcatagtttttttttctatgttagaaatcgtcgcctattaaagtatatcgcaataacttagtagagacataagagatctaacaaccattctctctcatttattgtgtactgcaccattttgcaagaaccatctcttcaaagcagcaagataatttatattgtcaactaagacggaattgaattaagcaatacaagtaaccaatcaggtctaaagtaaatactccatccattccaatataagtgcattatagtacaagatgtaacatatcatagtattacgaatctagatagacgacgtcctagtacaaatgtattctagtccaggatgtgacatatcctagtattatgaatctggatatataggcatagatccatagtactaggatatgtcacacattgtaccagaatgcactcatattgggacatagagagtaaaactcacttgtctctatgataattgataagccattactcaagacatataaagctatcacctttgcacattgtactactgcataatagctacattcatgttcaatatacaaaacaatacaaaggctatatattactaccccatcccatttaagtgcagctaaacatacaaaacaacacaaatgctatatattactacccccattccatttaagtgcagctgtggatttctgtgtccaacgtttgaccgtgcatcttatttgaaaaatttatgaaaaaaaattaaaaatgctagtcacacataaaatactattcatgttttatcatctaataacaacaaaaataataatcataaaactttttcaaataagacagacggttatacactggacacaaacagtgtgaaactgcagtctttctgggatagaggtagtagtagctaatgttgagctttgttaacctagatgggaagactatcttgcgcaaggcgccaaacaaaagctctaattattttggatacacccgcatttcagatcgtagaccaacaaatgctttaccaatttaatcatacgatgtttatcctaattttaatttttctcagagcaacacacatcatttttttctatccaatattaatgatcaaaattagcaaaagtggataccaattttatcagataaggttatccaccatcttcattgaatactccttatctggccactccattcacccttatccatcaatcaaacatacttaaaatttgaaaacccttcttcaatggctaagggatatccctctaaatcacacacatgaatccccatcatttggcttatccattttattttgtaaacaaaaataatttatgaataaaacttttatatacgtgttcttaacgatataaaagtaaaggttgaaaaataaacttcggtgaaaaaaccccctaaaatcaactactccctccgtcccaaaatataaatatttttagcatagtgtcaaagtcaaatattagtaaccttgactattaatagtaaaaatataaaaaagattaatcatgtaaaattgatgttactagatttatcattaaggcaatgtttggctaataggatagagaaataattttccacccaccaaaagacatatttaaatcctaaccatccattccccctctcccatttaatcctaacccttcattcatttcccaatcccgattccactcctcattttccattatccaaacacaccctaaacaaactatcagaatatgcaactctttttatttaaaacatcttacttttataaacatcgttggtcaaagtagcatatctaccgtgcccacctgagctcgcttcgccgccattggcagcctcccgagctcgctcctcctccgcctccaccgctggccactcgagctcgctttgccgccgccacccacccctgctaggtccgcctccgccgccggccaccgctaggtccgcctccgccgccggccacctgagcgagagatacttccgcctccggtcacctgagcgcgcgcgcgagagagagagagagagcgcgaagggggacttggagggatttggttgaggaatatgtatgacatgtggtcccagggaattttttttattttctttgctgactagattgccatgttggcaccatatgtataagctcaagtctaaactgctaagaacagtgtttagggaggttatttgtccggtataaatacttgagggtataaaatatttggttttatgatttagggggataattcgatcggcggccgtgatagttgagaagtaaatcatacttttttttttctttctgaacgaaaagacgagtctggtaagcaaaccaccagccacacgcggaccggtacgcaaaggtctccgatgctcggtcagcaaaactgctgatccgtaaaatcaccaatgttcacatgcgcgttttcgcccgttgcccctgccgaaccgaactcgcgctagagtacgccacggctgccggtaaaacaggccaagaaacgaaacgaaatctaaacaggccagacaaccacgcagccgcacacgagagaccgagagacagagagcgcgagcacggaatgctccgcagatccaaccgccgttcggtcccccgttccgtgcagctgcacctgcatatagaaaagtagaaaacccaaaactccgtagcgaaatctctcctcctccacctcctcgcctctctctccctctctctcccctctcatcactctctccccacccccctcgtcgcctcgtcccagatccggacatggcgagcgacagcgacgtcgacgaggacgagctcctccagatggcgctgcaggagcaggcggcgcgtgacctcagccaccagcgccccgcgggggccgggaagcccgtcgtcaacctcgtccgcccccctgccaactcctcccgcggcggcggcggaggaggacgcggcggagggggccccgccaaggcgaggcagcccagccgcggaggcggcgacgacgacgacgacgactccgaggtcgagatgctgtccatttcctccggggatgaggatggcgccccctcctcccgtgaccgtggccccccgcccccccgcggcggcggccgcgccggggcacggcgggccgcgtcgagggatgatggggatttcgacgacgacgagcccaggagctggaagcgcgtcgacgaggccgaggtatgtggggggagatcggcgagatctcgatctcggccgctcgtcttccgtgctagttttttgggggtcgcgtgctttgatgatccgaaaattttggttggtctcgcgggtttgttaaggcagcgagccgagtagcttgttatgaacatgtcagaatcgtggttgagtgcatttagctagtagtgtaggttatgaaatttatgctggtttgatcagtttgtttctgttccttctggggatcgcacaaattagctgtggtgctgcagagtggagctgcttgttgggtcgcctggggggggggggatttgggttaattcctaagacttgcctattggtgtgaactctgggtactggtgtgtttcaatcattcatgttgtgtagtactatgatatatggaggtataagggattaattaatggacttatagacaacatttttacaagtttgctggtctgacacacaatgcttggtcatcacatcaattgcatttgtgcagcgtgcattactgttggcacactctttcggtatagttcattttgatttccttctagctgcacattcatgttattcaaacctcctctctcagcttgtttgaaattgaatgccatgcttttcattttctctgttgttgcatttgttcatgtatcatttcatatctgcattctccatattagatgttaaatgcaccaaatacaaacatctgttttaacatgttatcttgtactgaatatgcctaatgtcagtctgcctttgctccacccagcttgctcgcagggttcgggaaatgcgtgaagggggggcagctcctacagttgatcagaaagcagctgctgcagcaactcggaaggcacttaccaatgtacagactttacctagaggagtagaagttctggaccctttgggccttgggtaactatctggatcacaaaactcatggtcaatacatgacacgcatcatcttcttttatatattttttccacattaatgtaccacttgaccacttgataaacattttataaaatgcaatcacctcatacattgatagtatgttagatagcaaacacattcactggttctaaaatttttgaaagtgagctgtacgtaaccttactgaaacatcaaactttgtattatcaatatattttggcagcaacaagtattaacctcatatatattaataatgtcctgctctgcattacctagtacatgtgtggtatgctctttatcatggagaattaaaattaccaatccaatgtcctctctatattcgtgttttaatagcatttattttcttaccagagtcattgataataagtctctgcgattaattactgatgcttcagtaagttctcctgtttcaagggagaaggctcagggtttagaccccagtatgcgaggtatgccttttggtcatacatattatttcattctgttatctgttcttccataacaagggtatgtttttatttgcagagaaagttatatattcttctccgaattttgaccccaaggtttttctttcgtgggttcacaaagatacaagtgctgctgacttagagtctggtgcgcttaccttgaaaactgatctcaaagggagaacacagcagaaaaaacaattagtcaaggagaactttgattgttttgtttcgtgcaaaaccacgatagatggtatctgttccttttttttcttcttctgctctgttgtagataattctcatgatcttaatttttgcacctgtttttaataccgcgagtttttctgcagatattgagtcaaagctgagacagatagaggaagatcccgaaggtgcaggaactgctcacttgtactcagtcacccagaaaattagtggtgtagcaaaccgtgcatttgagcctctatttgagaggcaggtataccaactaagttttctctagaacttcatttcactaatcatggtcattattactgcaattcttgagtgcggtaacgtaaaccgttgtgcaggcccaagctgagaagatcagatctgttcaaggaatgcttcagagattccggacattatttaacctgccaagtgcaattcgtgggaacattagaaaaggagaatatgacctagctgtcagggagtaccagaaagctaaatctattgttcttccttctcatgtacgtcaacttgatttattttatctgcgtctgttatttgaagatattagaagtggtgggaatgatggggatgggtgccaactgatcatagcgcactatctggggtaccgacacccgtaaagtgaaaaacaatgtgatttagtgggaaccacaatacccatcaggattcttacattatcaccgtcttacactacttctagtttagtaacacaagagaaacatgtacccgttctttttatttgatggctttgacctttcacggtccaagatgtaactttgaccattagctatatattgatatagtattatgagagtacctctcgggtacatacctagtgttacagtttcgtatagccaatctcgagttctcatgtattgatgttcaaagtaacatgggttctaggatgtcaaataagaaagaaagggtattgtctgacctacaggtagcatgggtttatcaaagttttaatgcggttgcattaacatttctgttgcccctgtttttctttttggctattttgtgggacatcccttaaccatttggagatcatgagaaaagcatgaaatagttttatgttggattaaaaatgcgatgaaatagatttgtggattatattctctttcttcctttcatgatggctcatatgcctgatacatgctatatgattttctttgttttccaagatcaattatcgtatgcttctttgttctttccttgcacaaaaattttgcatattgtttcctgttcatgccaatttcttgcacatgtatttggtaattaatataacatcataataactaataacattacatgattgattcacacaaagatctaagaaatccatagtttagatggctcatgcatgtccattacttgattttattatctctctattgtatgacttacaaaatcttgagtattttgatgctggagtaatagggactaaaaatttaactattgtcttgtgacatcccttctattttaggcacaatacgccacaacaaattgttgcttaagcacatccagtatttttactatattctttttatgatgaataactgacacaggtggggatactaaaacgtgtacttgaggaagtggaaaaggtaatgcaggaattcagaggcatgctttacaagtcaatggaggatcctcatcttgacctcgctgaggttagttgactttccaatattcaatgtagaatacttgaagttccttactagtgttgatagtcaaatactcaaatatcactcaactcgctaattttgattatagaaattttggtagttacatgaggaagttacttgatacctacacgtaggatgctgctggctgtaaactgaactactgatcgctagttgtttatatttatgctatttagatacaatatgattcagttctatctgcctcctgattttcttgccaactgccagcttgagaacattgttcggctactgttggagttggaacctgagaccgatccagtgtggcattatcttaacattcaggttaacgctcttgaccaaaattatctgtgctttatgtcatggccatacttgcttgtaccactacttatatgttctatcttcatatcttctcagaatagcaggatccatggattgtttgaaaaatgcaccttagatcatgaagcacgaatggaggttctacagaataaaattcgtgagaaaatactatctgatgcaaaatggaggcaattgcaacaagattcaaataaatcagtgagtagtttgggttcagcatagcactcatttgatcatctactatgatgctacaaatttacatggtatttgcaccttgtcttagttaacatggcacatgttccttatgtttgcatagttggaagttgattctgctaccggtgactcttttcaagatgatcaactgtcaacaaatattatggctgatgaagctgatagcttaagggcagcctacattcgtaggttaactgctgtacttatccagcatgttcctgcattctggagattagctttatctgtcttcagtggaaaatttgcaaaggtatgaatgggtttagctttaacatttgtcagatatagttaagatcttgctccaaaacatatgaatacatatgaaccttttcatcccacctcttctcatagattgcaatgcgtatgaaataagcgccttttatatatttttttttcatatagtgtattctgaaatactgtgcctgcttcatgtcacctcatgaaaaatgagaaccaccatctttttatgatttatgagaaagacttacatgaatttgttacccgtatctattgtttacaggcagctgcggggaatgtactttctgattctgatatgaatacaaaacagagtgtaaataagactgatgataaaggtggagaagcaaagtacacaaaccatactcttgatgaagttgctagtatggttcgtgctactgtatctgcttttgacaccaaggtagagttactgcatgttttgcaattctaacatttaatcagaacccttagtggtttgattgtatttgttacaattaagcatgtttttatatcaacaggttcagaatactttccgtgattttgaggaatgtaacattcttcgtccgttcatgggtgatactataaaagaaatagctaaggcttgccttactcttgaagggaaggattcatctccaactgctggtatattttattgcccttttttagaactgtagatacacttaacttcttttgtatactgaatgtggttaacaataattccagtgaaaatgttgcgggcccttcattatgaaataacgaagctttacattctacgactttgttcatggatgcgggcaacaactaaggagatatcgaaatatgagacctggtttactttaaccacccttgagaggaacaaatctctatatgcaatttcaagcatgcccttggagttccgtgatatcatagtttcggcaatggaccgcattgatttgtaagcatattttttgttcaatattgcactttctctgatgatatcttatgcatgctgtaggtataattgtttgtgctattaatgggtagtttatgatttcaatactgtctgtggaatctaataatggggaattggggatatttagtacagtaatattttgccattgtgttagtcgaaaatagattagatacatgcttttgaaaagccatggcaatgacaaacagacctaagcataagatttgtcctaaagtaattgttaggtgtgcttcacataatgaatacttctagtttgttagttcatatcatatcatggctatgaaatcagttcttcgttgtgatttataatggtttgcttacaatcctattcactgtaagagaactgaatgttgttttcaacttgttaataaaagaatgataataaatatcaaattgtatattgaaataactgcatttgaagtgtgcatttttacattcaagatcaatctaagtcttgagnnnnnnnnnnnnnnnnnnnnnnnnnnnnatcgtgccttcattttttatggtttcgaactgcctcctgatctatgcttttctattgcagtatggttcttaatctgaggagtgagactgccaagtccacgatatttctcaacacctccatgaaattcatgaatctgtcagacttgcatttctaaattcttttctggattttgctggtatggattttctttgtaacgtaactactgaaggtcttacaaattttgtatctaattgttgcatcatccattattgacaagctgtgttagtgcatcaggttatctggagaggtttggaggggaactagctcagaacagatcaaataaagaaaacaaccatacccaaaatggatatgtaaatggtactaacagtgaaacatctgctggcatggatggggacttgtacaagaagctgttggttgttctgagtaacattggatattgtaaagctgaactttcagatgaactgtataccaaatacaggcacatttggtccccagtcaggtacccgatcatcttagcttatgttccactaacattgtcttactgtcctttataatttttggtgcgagtcgttatccctgaatagattgattgaaagcttgttatttcatctaaaagcaatgctttgatacatttgcttcactcagttagtgttcctctctcagggataatgatgagcgtagtgctgacatgcgagatctgatgacttctttctcagcacttgaggagaaagtcctggaacagtatacatttgcaaaggtatggtagaaaatccagaattgttgattaatcattattggccaaaagatttagttataaccatgttagctttaatcctttcgtgtcttggtgtgcaaagttacaagtttgaaacacctgatttagcccactatttgttcttcagtagtggtatgcccaaaaaggccttaatggaagtaatgatcacttctttttctgaagttgttctatgggaatatctgcgtagacatgcacatgcctctatgcgtctactggttgatctgatgtgaatcaaatgaagcatttaacttattgcatgtttattcaagatccgttgcaatatgtagtcctaaataactaatagctagatcaaaatgtgcatagttctattttctgtgactgaagcattttattattgataccctagttaatgtgctagttttggatttattactacctccatattttaatgtatgacggcgttgactttttgaccaacgtttgaccattcatcttattcaaaaaatttatgtaattatcatttattttattatgacttcattcgtcatcaaatgttctttaagcatgacataaatattttcatatttgcacaaaatttttgaataaaacgaatggtcaaacggtggttgaaaagtcaacggcatcatacattaaaatacggagggagtactagttattactctggaatatgtcagatgtttgtccacttcatagattattatattgtttgatgactaggataactttaattcaaaattgtttggaatgcctacagtggaagttcatatatcatgcttgatagtagcatgatttttggggctataaattcggagtctatgcacattttgctatcttcctttgctttgccctaatttttgttttgtagtcgaacttgatcagaaatgctgcacgaaactatctgttggattatgggattcactggggagcagcaccagcagtaaaggtatgtagcataattaagataatcgtactgatgttaacgcttccaaatgtgtaccactaaaaaaaaactggaaacaaccaatagtatactactgatggatagtctgtaactttgtatatgcagttcagttgcatgtactatattatttgctgcaagaaaattatcataatattttgtgcctgcattgctatgtgctggccatggctagtagttgtgtgcgcatattaatggtagcctcatataacagttgtacgactgcctttgttatcttacatgaaattaacatcttgataatgctcttgtggcatttacattctattacaaattattcttctcgcagggcattcgagatgcagctcttgatttactgcacatccttgtagctgtacacgcagaggtttccatttctacatttcccctgattattaaaattgtgcatctctccttcgcactggatgtacatcaattactgataaatcataaatttacttcaattgctctttacatactttcttctttgatggaatactgtatctgtggtttcaggtctactccggtgctaggcctctgctggaaaaggcgatgacaattttggtagagggtttgattgatatcttcctcagtattttccatgagaataagaccaaagaactcagaatgttggacgcaaatggtttttgtcagctcatgcttgaggtactaattttgtttcttttagcttcaactgcattagcctcttcagagtcttaagttgtgtaaacgattcaattatgaacttaaagaactgttctgtttgttttacgggtgcagcttgagtattttgagactatattacggacatacttatcaactgaggcagagcaggctttgagatccttacaagagaatttattggagaaggcctgcgaaagtgtgactgaagccttggagaatcctggacaccaccgtcgaccaactcgtggcagtgaggatgctgcatcagatgatagacaatcagtatcacctgatgatctgcttgtaagttctaaaagatgtagaacatatggattaattcttgcatcagtgacaactgaataacacttccagtaggttctgttgcattaaatctgccaaatatacatcccgtttgcgttaggcatctatattctcattgccctggattttgaattttggaaaacactaagtcaggacttctggtgctttcatcatctaattatgggaagctctctttagtgaaagtttcatcctgttctgattttgcaagggagcatggctaaccaggaactatttattttttatttttcccaggcacttgctcagcaatgcagtagcgatttgcttcaaggggagctggagaaaacccggttaaatattgcgtgctttatggagtcaactcttcaatcaacgcctgcaccggctggatcaaaacctgctgcttatcagtcatacaaggcacctgcgacacaccaaccagttcaagtgtcctccccaagttttagaaggcagcagacaagtacaaattcacctgcagcctcgaggcggcgtcgatgaagaaaatgcatcatgttgagagaaccattccttcatctacgtgcctcttccctaaattctcctctttctttgttcatctttcccatgctttcgtttgttacctgtaattagtatcatgttgtcatgtattatgaattttgacccattcttttggtgttgtaagataaaaggggtgtacaggggttgctgtacggggctatctacttgtataatttccatgagcctggaattattgtcgccattttttctaaagacaccatctcaacttaactttctggaactgagtgtcagatttgtcggtggctgacgaactcattagtcattaccaccattggacctcactcttccgattttctatgcggacttaaatgtgtcttgtaccaggctgaaacgatagttggagcacgcgatcgatcttatttgattcgtggatctgaatacctttctttagtctaatgtaacatgtttttttcttccttctcgatcgatcattttgctgtttatacgactaaacgtggaagccccccatccccctttgttttgttgattagttctttttgtttgaatcaaattattacattcttgatcgataatgatctcttcctcttatcctgctgtcaaaattcctgaactcctgcacgcaccacgcactacacgattacattatccacaaaaccaccttgcattacacccccagttgttatatgtacccaaagattcggccattgcatccatgttctccatgcatggctgcacctgaacttgtcctgcactcctgctgctccaccatcgctcgcacgtgccccaggatcaatgagcctctcgtggccctttttcttttcttttttaaaattcccctcctccagctgtgtccggtggtgtctcatctctcatgtgccggttgatagatactcgggctttgtttagttctcaaaatttgttttccaaaaacattacatcaaaatctttggacacatgcatagcattaaatataataaaataaaaaattagttgcacagtttctatgaaaatcgcgagacgaatcttctgagcctaattagtccatgattaggcataagtgctacagtaacccacatgtgctaataacggattaattagacttaataaattcgtctcgcagtttccaggaaagtcatgaaattagttttttcattcatgtccgaaaactcctttcgacatctggtcaaacatccgatgtgacatctaaaattttttttcgtgaactaaacaaggccaacaaggcatcagactataaataggtgataccctgtgcttgtactactgtctactgctccctccctccatcccttgctcgctcgcgccacaacgttatcctctcctcgtagatgtggccacagtttttgcagccggaacgagctgtccaggctactactcctactagccatctcccacccacttatcacgaggctaacccgcatgggcgcgcgccaaggaggcgggaggagtagcacaccgccaccatcaccagcagcagcatggtgcagctgagccgccgccggcaccgcgagcacgctccatagccctctgccatggcggcagcttccgtcctcctcctcctcccttcccccttcctccgtccgtcgtccccggcgcaccgcgcgcgctgcggcattgccaccacgacgacgacgagcacgagcgggaggagggggctcttcctcttcgcctcgcgctgccgccccggcccacggcgacgcgcggcgtcggcggcggtgcctcccgagcacggcttgtcccagccccagccacaggcgcgggcggtgggctcgtacgaggccgccctcggcgacgccaaggacgcgctctacgccgctctggaaggttccatctctctctctctctctctcgcgcgcgcctgttgctgctgcctgctgctgattgtcaactgtagcagcgtcgctgttcgatcgattcgctggcagcctattgattaattttatttttttgcctgtttgatgctttggaggaaaggcatgaacagagggatattcgggatgacctccgagaaaaggtcggagattcacgcactggtggagctcctcgagtccaagaacccaacgccggagccaaccgacaagctgcaggacaaggtattactacatacatgccactttccaccaatgcgcttatgctactactaatcaattcgagcgttaatttggaagtctgatcacctgatattgatcaggattttctttaccttttgagtttatgatgagcagggattgttgttagaatctaggtggaaataggtgtgtactagtttaagataaacaaatgtagtatgaaattgcctctttggtaatgttactgatagtttggtgttgagacgatggaaggtggatggatgctggaggctcgtctatagcacgatttcgatactggggaagaagaggacaaagttgggactgagagatttcatcagcttaggagatttcttccagatgattgatgtcaaagaggttagtgaaatttaccgagaaatgttgtcaagccaaattggtaacgttggtgctgtgcttgtttgctgtatggcttgttctatgtttatgcctgaatttacaagtttttcatcggtgtatttctcctatgttgtatagagtttgattgagtagaatttgacttcagtactcttcaattcttggacaataccaaaatgatcaaaacttatgttggctaatggctaccgcaacggaagtacatgacaaatgctctgtttcctaaaaagacaaagtacatgcttttgtgctataagcctattaactatgaagtaaatgttattgaaaaagaacagtgaatattgttacatgatttttatactggcaaaccaagtcagttttgatttttgatatatcttgaaataaatggagatttagcatcaccttctctacacccaaaggaaaaggcggtaaatgtgataaaattcagtgcaagggcgttgaagatattatctggccaacttactattgaagcttcgtacaagataactactaaaacagtaaggattctatctgcttctcatcattggttacgtcgtcctagaaatttttggaacctgaccacttaaattctgaagcacattattcttttatccaatttttgttttcagaaggttgatatcacgcttgatagttcgaccatcactcctgatcaggtataattcatgatattttcacttagaaactagcttcatatacataagcagtacttcaatactattggaagggtagagttatgagtcaaaacttttgtaacaaatctttttacaaataaccttgagcagaggcacattgttttccttcacaggatgcatgtgcaactgtgtgtgatgtctattttcttctatggacataagtaaccattttaattacaccatgtaaagcaactgtaattttctctgatgttcactttgactgtcatgtgcagctgatgaatattttccagaagaactatgatatgctccttgctatattcaacccagaaggctggctagagataacgtatccttttcggcttatgtgaaactgttttgttcttcgctgtttttctaattttacaatctctgctacaaatcactagtttccctacgctacattttttctttccagaagtggtgtggatgcttttaacaccaataatttcgggtagcacatgtatagcagcagagtaacccaatttgcatccagattccagagttctcctcaacattttggtcagatacgttgatgaatctctacggataggaagagatgacaaggcaaacatctttgtgctggagagggcagacccctcagaagtttgacaagatttatctgaagcaaaatgcctgcatatacatggacattccggcaaagatgcctttgcacatacccgtcctgtaacacggtggtttttaacagccagtgcagatcgtgtgctcaactttccatttgcgttagattatactactgctatttttttttctttctggagcaaaaggcatttccctttgcgacaaaatcatgcaagctgggaaagctcatgcaagttcagttacactacatagagaattggtacattaagaactggtgtacttttgaattttgaaatacaccattttcaattattcatccttgtaagacataatctaatgagtgtacagcttggcaaatggcaataccctttagacaaagttgttgttgttgtttttttttttaaatgatcgctgggtgatcccttatatcagctctttgttcctgccacgccatgcgtcatgtaataataactgggcggaaagaaattcttgcgttatgtcattttggtggagctttgcacctttcaacaaggacatctctcttcgagtctttgcctcgggtagagactggaaatgccggaaaatattttaagcccttgatgttgcatattctcattttttatacagtcacgtggagcattcaaagtcaaactgaacatcacatggagaaaaagcaacatatcaaactacacaaagtgatataacactgaatttgttatttttgtttttccatgtttgtgaagggatatgtagcacaactcgtttatgtttgtccatttttttttataaaaagtttcataactatttgtactatgtgcaacaaacattttaaaataaggtatgcgataaatatacttccgtaagaaagcatctttatctacagtctaaaggtgcattaatattcgatggtcgaaagaagctagcatcaagattctctctacctattatctaaagatgcatcatttatatttgacggctaaaagaaattatcatcaagattatctctatctattgtctaaagacgcatcatcatctgtgatcatcaaaagaagccatcatcaagattcctgaaaaggcctatataaaaatcccaagagaagccaagagaagtgaggatccacttttggaaatgctagactttgtttgcattatatatagagtgactctaatccatagaggaacgtggagagctccttggaggggtgcaccttcttgcgcgtcgagccaccatcgtccttgttggctcccgctcatcatcatccaaatctagagtcggcctcaaaggcaccgtgcaatagtggcatggcatcataaccatcgggaagaggtggcgagacgaggtggcaattcgttgggcgcaagaccgatgacctccctcaactgccaccaagcgaaacaacaggtcgtgggagccctgggcggtagaagcagtaacaggttgtgcgggtggagaccggttgaggccacatctatcttgcctccactgagtgcggtaagcttcacaacattccctattcaccgcttccgtgggcacttctcgagccgccgccgtcgttgccattcatccatgctaccaagcttcgaggatgttgcctccataattggatccatggtgccgagcttcaggctattgccaccaccgaggattcacgccaagctccttggccgccatcaccacaagccgggtcgcgctgtccgctcctcctccaccaccgttgacaaccacaacaccatcctctccggccacccacctctaccgccgcattcactggatttttcacattttgatccttttgaaaaacttatttcgcaaatagacctctgaaaaaacttatcccagaaatggtcctttttggggcgccagagtggctggcgccgtcatccaacgggac

SEQ ID NO: 83588 - DNA, 4223 bp, Oryza sativa
tgtaaatagaaccacccgactagatctaaacctaggtgatccaatagacaaccctatcaatggtatcagagccatcctagcgtttagtttggttcggggatagacatccacagagaagaaagaaatccaaagagaaaagcaaacgatccaacggatcaaaaagatcgaaaccctaaccctaatcttacctcgtcgccggccgtcgatgacgccggccacggaggggggaggggcaaagaggcaccgccgaggagccactcgacggccgcgcgcgcacccgcgggtgcacgcgcgcgccggtgagggggcccgcggcggcgccgccatctccgtttttcggccgccgctctctctcacacggtgggggctagagacggtggagggagcggagaagagaaaaggaagagggcgcaagggccgctggcggcggcgacgccgctccgctcggccactccgcccggcggcgcgctagagaaaaagtgggcgcgcggcagcgcgaggtcgccggccatggcgcggcggcgcaagggtcgccggcgtagatgacgccactcggcgcggccgcacccgcccgcaagagagaagaggctagggtttcggccggccggcggctggggtcgggttttttttttgtccctccgatctcagcgcccggccgtccgatcgaaaccctagcgatcggacggccgacggcggccgggccgaaagcggcccaagtggggagcgcgcggcggcggctttcccggcccaggcccaggttgcggcctgggggaggggagggggcgctcgcccgcgcgcaaggtggccatggaccgaccggcaaaggccggaaaagttcaatttaggtccctcggggccgaaagaaaaagaaaagaagagtttaataataggtcctctcagaagctttttcaattatgtataattattgtgattatttctaagcaatttgaaccaacgtgaaaattgtttagagaatagataaatgtgagaaatgcttctgaacatgtattttgtatattttcatgcaaattacaatagaattttgaattgtttttgcatgttttagctctgtttaaatttgaaccaacgggagaattttacagagagtaaataacagagtttttgttattgtttatacgaattgtacatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgtcatgtctattttctgcccaacggtgatgtagacttaatacataataattttaatgttaattttgttctcacaatacatgattatctcaggtggctactccttgatgggttacattaaagatattccgaccctgaaaggagataactacgaagaatggaaaagagaactcgaccttgcctttatcttgggagaggtggactgggtgttgactaccccatgtcctatagaacctgctgaaattttcagaggtgaaaaagagtcagatgctaaatggcaaaagagagagagggacaatgcttgcctcatcatgtcgtatgacatagagcatgcgaaatggtcttcagccaacaagaattgtttggctgcggtaaagaacacgattgagccaaccatattgggctcaatcccagagtatgacactgtctctaaatacctcgaaagtataaagagccagtttactggttcttcaaagttttatgcgacacagctgataaagcagcttgttacagagaggtaccatggaggtggtgtaaaagaccacattcttaggatgagcaacatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaaacaacagtttacagttgagacaagatcagtgtctacactgtaagaagacaagacattccaagaaagatcatcctgacttcctgacagtgatcatggcaaagaaaggtgagaacattattacatttgtaaagaatctcattatgattggttattctagatccacatggtggatttattctggagcaactattcatgtgtgtaattgtttaaagggattccattcaatgaggactacgcaaagaagtgaaagatctattagagttgccaatggagttgaagcaaaagttgaagctgttggagattttcgcctagaactcgcgaatggcttcacacttttacttccagatgtttttatgtccattctttgcaaagaaacttgataataagtgtatccaaattggattctgatagatatgaaatggcaaatgtgaactatggtataataatgaatgtattggtcttgtgttgcaagatcagctttatttgttatctctttctgagaatgtgaatgttgtgtcctcgttgacaaaagaaaagaaaagcgaacttctgatgtctcatcgaaattatggcactgttgtttatgccatatttcgagggggagaattgagagactggttaagaatgtagttcttcctccattggagttctcagttttagaacgatgcatacaatgtatagaatgcatcggtgcccaaaacaccgtatgagctatggatcctccgtgtgtggggaagtcctgcaaaggataaagtatttaacccaaaacagtaggctgccattttattggctattctgaaagatcaaagggtcatcgtttctactgtccaaacagttatacaaagtttgtagaaacgagacacgccgtcttcttggaagacgaaatgattagggggagctcggtaattcgagaaattgatcttgaggagaggcgggtgtctgtacccgctccgtcgactcaggaacctttcttctctctacctgctaatgttgtgccagcaatgcatgccgttgcggtaccaacacctgttgttatctctcctgtggcaacaatgaatgaaagtgaggaacctgttctacaggattcaacagaaattattgccacatcagaggaggagctgcaacagcctcaaacagataatgtgccagaataggaggcccctagaaggcctgaaagagtcgcatatggaggatgatcccatctcatatgaagaggccatgagaagccatgaaagatgaaatgaaatcaatgaaattaaatgatgtctgggatttagaagaaattcctaaaggagccaaaacagtaggctgtaaatgggtctacaaaaccaaatatgactccagagggaatatagaaaagtttaaagtgtgacttgtggcaagagttttcacgcaaagagaaggcattgattacaatgagacttttctccagtctcttgtaaagattcctttatgattataatggcactagtggcacattatgatttggaattacatcagatggatgtaaaaacggaatttctaaatggtgatttgaagaaaaaaagtatacatggcacaaccgaaaggtttcgtcatgaaatgaaacgaaaatatgggatgccgtataaagagatccatttatgggttaaagcaaagcttcgagacaatgctacttaaagtttgatggaacaataaagaaatttgggttttcaagagaatgtagaggacaactgtattgattcaaagttaagaatgggagactcattttcctaattctgtatgtagatgacgttctactggctagtagtgatgtcaatctactgcaggaaataaagaaattcttgtcctcaaactttgacatgaaagacctcggtgaggcttcatatgttttgggcgtagagattcaccgaaatagaacaaagtatgcattgggattttctcaaaaggcattgtcggtgatatgggaccgggagtatcatgaccagaggcttgaggcagacacaatcgcccacgtggcctggcaccttcggggacgtcgggcccgagggtgaggtgtccgccctcctcctgatttcccccgaggg

SEQ ID NO: 83589 - DNA, 710 bp, Oryza sativa
aattcctgcagcccacgggagataaattacgggaattcatacttctttaaggtatcttaacagaaaaacaccaataagttccattgcggtcttcatattactgcctagaagtttactagagttccttttgcagccaattagaataagtgacttgaagaaggtggatccaataagagcgtgtgaatatttcaacaattgcttcaaggatccatcagcttttactgttgtaatagttggaaacatagacccatctatctcagttccactgattctgcagtacttggtatgttctgtgccttctattattgttcagaggtgacgaataacagttgtaatgctggttgagtctactttgtagggtggaatacctaacgtagggaatgcagttctgccacttactcgtgatgatctaaaaggattgccattcaagtttccggagactattattaggtttgctactgccccttttgcactagtttgcctgcattcgttttatgtccttcatgtgtatgcaggactaagaaaccatacagttttcttttttagatataaagttgggtgtgtgccgtatgggttttacccttctttaatgcaatgatacgcagctctcccgcatgttcgataaaaaaagttgccttatgatctattatagtcttactataaagtgtgtcatttttccagagaagttgttcgcagccctatggttgaag

SEQ ID NO: 83590 - DNA, 1609 bp, Oryza sativa
tggtggatttagcagagacgcaaaggttagacattcatttatcatgccatttgcttcaatttagtctttacccatggctcttcctcacctcaccattttgagatccgtctttcctgcagattttggctggcatggctggcgcaatagtgttagcggtcagtttgtggagatactcacgtagcacattgagatcatagcacgtctatcacgctctcgactgttttagtaagatccaaaaatggatctgtcaagacaatcatctgcttgactccaggtacatgagctgacgacaagattttggtttcctcctgggatgctgcttcctatctgagagtggatgtggtgattgtccgtcacagaagaaagtatacagaaattggtagctaacagattcattgccgcatgcgtgcgctaagcctgtaacacaacaccatacgattcttttgtcgcagcatacgtgccccgtaacagccactgatgtatattgacacctcccatttcatttgatcctctagactgcaagtaggaaacggcaggttgcatgctattagctgaagtagtagcggttttgtttcttggtgagctttggatgtgtgtttgtgggaaaacccagaatgataaaagaatataggagtaaggatgcagacatttgtatgcactgtatttgttaccttcacccctattctttccgtgttctgttccatgtgctctttgagtccaaagttagatttctgctttattttttttctttctgttgttgatacgatggatgataatggacttatcctgatgaatagtactccatgatttggatcgaaaaggggagacgtggcgatcgaagcaggcgcagggcctttttaccccaccgtcccacgagcagcaccgaccaaacgtgtgatttggcacccttgcgagtttttttttctttttttttggatactcctagtatatatgggcgagagatttctcaagggaagaggagaagatgtgacgagacattgaagaatccctctagaacactcgtcacgatgccgaaaaaggcgttacacggatagactagaccaagagaaacaggagagagatgcgataaaaaccagaggcaaagcaaaggaaacaacaggccgctgctatatatccgcctcctgctaatccgcgactagggagtgaagagcgaatcaaacaccaccaccatcgccagcgtcattcagatttcagagggagggagggagggagagagaaaggaaggggaagtgggggagaaggaggggagaggatggcgtgcctgcacgaccacagctgcgaggatcacaactgcgccgccgactggtcgctcttcaaccacatcgacgtccccaaggtccctctctctctctgcccctcgctcgcctggttgatcagatggattggcccccgtatcactcacttcgtttgatgttcctctttgaaattgctgttgatgttgattccctattagttcatctatatatccgcgtttaatcgtgcggatgaaaaacaaaagacgaaatctagagatggcatgttagggcaatgggtttgattttttttgtgtgtttttttgatggtgtttgcccttatactgctgcatcat

SEQ ID NO: 83591 - DNA, 691 bp, Oryza sativa
agggagtagtatcttttttcatcactgatgcaggcattactgatttcgattaagaaatggaacatgacaacattatatgcagctaataaacaatcttcacgcatctgacggctgcacattgggggtgcaaactgataggcaataattcagcaggaatgcaagaatcgggtctatctatacatttgtttttttttttcgaggaaaacggggagctttattaattaaagattaggagggatacagtctttggctaagctctccttaacacactcaggcgcacagatacgccacaccgaagattgcttcaggcgcctagccaactggctaaggcaatgagcaacttcgttagctcccctattaatcctattaaacttaaaagcaggaagaagtggaagaatcgacttgatttcctggaagacctgccacaaaggcgatctgttcttagctcccgacgtaaggctagccaccacattcgcacaatctgattctaggatcaccggcatctgaatccagtctgctgctagccgtagcccatccctgcacgcttgagcttcagcttcctcaggcgactgacagcttcggatcccattccatgaagtcaggaggacatcacccacatgatcacggatgacaattccagtacctgcttctccgatttgctgcacgaaagctccatcaacattaattttag

SEQ ID NO: 83592 - DNA, 592 bp, Oryza sativa
taagtataatttctctataatttgacaatgtggtgctatagtaaacatttactaatgacggattaattaggtttaataaatttttttcgctttacttacggattctgtaattagtttttttattagtgctcaaacatcccatacgacatcttataaaatacctgatgtgacatgccaaaactttactcctctagatctaaactttacacgccagttgtacatgtgttgtataattgggttgtacacatagggatactctttgtcatatgcccatgcgtgatgagtgcgcgcgtagtgtgtggtgtacgcgtgcatctgcgcggattgcaccgatcgagttactattattgctcagcagcatatatatggcattgcgtgctgttgcgatctttagcatctcctggatacaggcaacagcgttaatgcgcgtgatacgatctctcacaaaattgaattattggcgatcacgttttaaaaactaccataaacagaaatatcataattcatgcataccaaaatacaaatcactgcccatatcgccctcaaatacaaaatacaaatggttaatcttatttcaaagtgtgttgtgaac

SEQ ID NO: 83593 - DNA, 677 bp, Oryza sativa
  unsure (1)..(677): unsure at all n locations
ggagtattttatacctcgagaggcacaagaactgcaagaagtaggaaagggtgcatagagcgaaaccggtcggaacgaagcaagaggccaccttgtaagttgaaacacatcacggggacgcttgaggcagagatggccaatgatcgcgatgtgaaagaagatgacgggggtgaactgaagccaggtggatgcgtagtcggggtcatctccggtctcccagcggtcgggaccgtggaagttggttggggtgccggcgacgtggtcaggccttggcctgatcagcgacatcttcgctgcacgcccgctgaggctgtaggcgatggcgacggagtagccgagggtggaagtgacgaaagtagatgcgaacacaaatttggtctgccaagaacaaaaaaacaacaagtagcttgaatcagaaaacgccgagactgcctggatgggttatagcagcaagaaagaagaataactcgccttggtcatgatgtgaccttccatggcgtgatcttgctctgcatgaagagaactctatagttgtgattggttgagaggagagtgtangtagagaaatagcttcattttaggataagttactgtgctagaaatagctacatttttggataggggtagtagctggtatatatgcatattttctgctttcatttgtttacagaacacct

SEQ ID NO: 83594 - DNA, 2812 bp, Oryza sativa
aactctatggtgtttccattctgaaacatgatcataataatcacctgtctctaggtcatgtgcattgtgaaatggaacacctggagtctgtatccgaatctgactgtgtgtgcttctgaattttcatcacagaggcttctggccaactgctgctgtttacctgcaaaagagccccaccttcggttggatattccaccaccctcttgtgacttcggtacggctataagtcaccaccggatgtgcttaaactccctgcttgtcgtcgtagattcatagtctctgttcttatggttgttcctgtttacaaatttgcagctgatcactaggttcaggggaagacgagtcccggtgtgatcgtcgctttgctgctggagctggatcactccaagggatgccgggtcacctccaaagaaacttgagcgatacatgcggttttttctggttagcttgtgattcgttggtgctgctggtatgtgaatcttgtgtctctgctaccagtaccctgcctcaaagacctcgttactacgctcgccagttgcccagttgttcgtagaaactagaaagactttcttgcttgttaatgggtagagagggtagtcatcgtacatatggctatgctcattgcacgattggttgattgctagtaattgatttgtaggtcatcctacgggaatattactgagtagcaaaagctttcagttccggtgctacgtatgacgttcatgtttttaccttatgacgttcatatttttactgttcatgtttttaccaaatgacttttagtagaatcatatttttaccatatgactttcagtagaatcaatctgacttaccgttcatttttttactgtatgacgttctagaatccttcgagtttctatttttctacgcaaataattcgatcttttctgcatgaatcttttgtcgcacagaacaactataatagtataattgagaaacaatagagtgaaatatcacaaaatgaacaaggtaaactaagaaatcaaaaatcaactaatccatcagcaccacaacgtatataggataataggatactgacatcagtggaaagcagaatgtatcagtttcagaaagacctgagttcctacgtgttcaggcttctgaatgctaaaccaatcttcctcgaccagttccttggccataccgtgctaaaaaatgattcccttggccataccaatttgctccttattacaccaatatcaactatagttggtaaagaagagtaaaatgccacaaaatgaacaaggtaaactacgaaaccaaagtcagctaaaccatcagcgtcgctggggaatttgaatgacgcatacagaattgaggaaaaaaaatattaaaatatacctttctcctatgattttataggaatatacttatttttgaaggtgattattttgcatcctaatagtaatatatagagaaaaacgtgcattgcacgtatatgtactagtatactcatgattttacagcctgacttgaaaaccgtgccatgaaccaaaaataactagcaaacaacagtgcaacacatgttgacacgagatagattatcactttcaaccacatatgactcgttcttccagcacacgtcgcgcctatggcttctcctgcaaacataaaaggaacatagacgagtaggaaataccaccactcctacaaacagacaaaaaaaaataatgtcatgaagtttggccacgcataaattagataacctttgtgtatttgtaatttgtaaattaaagattcggaaaatttattttatttattttgtaaaggatgtgcagtaatggcgtttattagctgtaaaggttcataaatttcatttatttatcgtatattttgtataacaagaccacaaatcgaagtgattaacttttccatattattagttagcagaagtgctaaacaaagattaattagtgattaatctttcattaattactatctcaacaacaatttaaaggacgtaccttgggcttataaaaggactttttaacgcaagcaatcctcgccaccttgaattgctgctcatcggcgaagtaggccgccgtgtcgacgttgaaccagaagttgtccactctaccctgtctagttatcatggacggtgatgatggcagctcagcgaggatatcggcgccgttgatgcagtgccccttgatgacgacgacgagaggacagggggctctgcacacgtgacagcgcctgtcctcgctgacgaagcggacctggacaatgcatctcgcgcaaacacagcggtggccgcatggcccgatcgccacccactctaatggctccacacacaccgcgcagcagttggtagtagtagcagcagtgccgccgcgggctacgtcttggagctcgatgtcgacgacgacatggcacactgccttggtgctcatagtattgggtggttgtttcacgtggtatatgttggatcgaacacaagtaaccaagtctatgagagagatgttgaatggtagattacatcagcggaagtcaaataattgaatcttaatagatcaaaacacaccccaaccttaaaaccaatggaacacacgtaatccagtctatctgtggagattatgggtaccccatacccacacggcatggttatccgactagttataggggataacttatatatatgaaatatgtaacagatcatgacttgggtattacgtttccttgtatattacggaacggcctaaagtcctggtttgataagattgtaaagtagagttaggaaaccgataccgtattggataaggtttctatcttgtaatcctgccccccattc

SEQ ID NO: 83595 - DNA, 2059 bp, Oryza sativa
gtgagtggaaagttcacgagaatggaagaagcacaagacacgggcgatgtatacaggttcgggccgctgagaagcgtaataccctactcctgtgttttggtggatctgtgtatgaagaagctacaaagagctggagagccagagagctcttactctagaaaccctcttctcccttttttcctctcctgggatctactctccagatccttttctctttcagtcctccccagagtcgtccccagagtcgtccccctttctaagtgggcaaggtcctccttttatatctcaaggggataccacatgcaccatctctctcttttgtgtggggacttatcctatcttttctccaacttgacttgccttctcttcataaatggacggagatttgtatggttaccgtccgaatgaccttctgatgggacggcccatacctacctccacttccgccggaagcaggtgcgacgtgggaacatggctgtctgctgacgacatgaccagcgtcagaccggtcacaaatcggtcattcttgtccaccacgtgtcagtttagcaatctgcatgttcgcccttcttcatacaatatcttgcttgtaatggttaggatgaagcctggcatatatctgaccgggtccaacgtgccacctccaggagctaacacgccggctccggctagggacgagtgcttggaggctctcatcctgacgggatggggcgaggcgtgcgtcagaccgccagtcgccacctaacccatgatctgatcggtctgtgactggtcacagaccggataaaagagcgcgctgcattgcgctgcatgcagcgtgacacgcttgaccagaccgcaataaatgcggttaggtgagccctaccgtgttcacccaacctatgtacatagtgcaaaccccacaaggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacaggcggatttggggggagaagcggtgccggtagggaggagaaggggcgcggggatggcgaggagaaacgacggatttattattattattattattattattattattttgggggggagcggcgcgggaatgaggagtgacgggttttttttttttttcatagaggataagcacgaaggggtaagtaaaaaaatttaactctaatttcgttcggctaggagttctggcttagtagagtactgtgggtcacgtgcactgtagggtgcgtagctttcgggccaatttcgtcgcataaatagaccataggcacgctatgcgtgtcttgcactgctcgtgccctaaggctcctgctttctgtttcacttcacttttcttggtttgctttcttcgtctttttcctaatctgtgggactccgtgaggagaaactcggcaggactgctttcaaggggaaaaaaaagcaacgatacaatccatcctattttttgaacctggtgaaacagtgagtgcaagcgtgtggcgcgacatcattttccattatactccctccgtccaaaaaaaaaaaaaacaaaccctgggtttccgtgtccaactttgactgtccgtcttatatgaaatttttttataattcgtatttttattgttgttagatgataaaacatgattaatactttgtgcgtgacttgtctttttaattttttttcataattttttcaaataagacggacggtcaaacgttgggcacggaaaccagggtttgtctttttttgacgaaggaagtactgtttagggctcctttaatttggaacaaaagattttgataatacaggaataaaaggaacataagattaaaatgttccgtagtactaaatcctgcatgaattgcaaacacctgaatttgataggcgatactatgtttgaatagctcacagaaaaataacacgcgaattcggaagaatcagggctgcaggaat

SEQ ID NO: 83596 - DNA, 7440 bp, Oryza sativa
atcgttagattcgtctcgcaaaatagcctagaggttatggaatgagttttgtcagtaatctacgtttaatactcctaaatagcaagatttcggagagatatttaatagcccgaaggatccaaacaaaccctataaatgatttgaaattaggagttagctattctattaaacttgctcttacagagcctgaatggagatgggaaagaaacggtcaaaccaagaaatcggtagacatttttctttttacaagacactttggtacaattacacatataaaaagagccactgcattaagccatgtcattgtcattttatcatccattggatttcattttaacgttttagcagtttatttcagaattcagattcagttacttatttacttcctatctacacgtacttagcacgtttgttgagaaataagcacaacatttagcgtgttctcatattccaacagaaatactattctatttgttatatttctgaaaaacaactttataacatgttttatgctaacaaacttaaccctgagaaaagcccgacagaaagttttactttagagtattacctagaaattccatagtaacgtacagaaaatcacctagtatatataaagtggagaaacaaaatcattttttaatcaaattcatgaccaatactatatctagttttttttagaggaagtactatcttgttaatatggctgcacgcattaaaaaaaaaactctaagacatactttgagatctttgccacggtggtttgcagtattaaaggaagcattggttgccgtctcggtagaaaagtggtacgtacgtacatgcagcaacatatcataggtgtttggtgatgctttgatggaaagcagtcaaagcacttagaggttgacgtcaccttctttttctacagagtttccaagccaaatatttttctaaaaaaatttattgcagcaaatataccgatgccattttcgtataatcaatctgctcgtttttctgtatgctattggatggatcatagcattccaatccaatgctaggatctaatccaaatggaggcatgaacagctatgctaatgagcagctaaattacaagataagcaacagggaatgttctaaaaaaaacagaaggaaaactgaatcggtggacacagaactggtccatggatgcaatgcaatagcagctaaaaaggagactttggatgctggcttggcttatctcctctctctctctctctctctattcccaccatgcctggaatggaaactgcgtcgtgtctgcgcttctgtttgggtggggccccactttccaacgctttgcttgctttccatagtgttaacattaactaggatcctgacacttgcatctttctccgagcttttgatgcccaatcttttttttttttgctgtcaacatgatcatctctttactgtgcaatttgatttcgcgaacagtttctgcgtgtgtgttgctgaacatgtggtacttgtcccagttaatcagtacggctcaacttgattttggtgtgactacaggattgttgattttggttaattactagtcgagatggtaaaaggatgcaggatctccgcccggccaacgcacatgcgtagttgcttgcacgaatcatttttgcgtcatattgaaaaggcaatgtcaaaaatggtcctgtctgttttttttttgagctactgaaaaacttccaaatttttagcattggttcttgattggtactagaagatatcatatgcatgcatgtgttcagtccaatgatgctaatagccgtgttcggaagaaattttttggcagcggcagcagcagtttaaaacggctataagctgcagtgattttcaaccgctgtagtcacagcggctgcaacaaaactggctgccgaccaaggccaatactcccaaaagtccaaaccaaagagtaccaagctagaaatcgacatctcattttgaattttagaaattttggttctaaggtcaattttaggggaggtttccttctactccatccgtccaaaaaaaaaaagacaaaccctggtttccgtgtccaatgtttgactatccgtcttatatgaatttttttataattagtattttcattattgttagatgataaaatatgattaatactttatgcgtgacttatctttttattttttttataattttttcaaataagacggatggtcaaacttcgacatggaaacccatgatttacttttttttttttggacggagggagtacaccgtttctattgcaatgttttcatcttcatgattgataccatgatgagtaaaaagaaatctatctaaaattgcatttaaatttatgttccaaaaaatttgggtctttttagactggtccatggaccccatacgggagtagagagggttacccattctccctcttttgggggcggaaaccgtgacgtgtctgtctcactgcacggtgggccccacctttcccctcctgggttcgcttgctgtagttaccatccatcctgacacgcaggcacagtagtacagtacagtaaaaaaaaatatggcaccacctttttacacccaccacctcccctctcaattcactcctcgtctcctcctcctcctccttcacatcgaagcatattctcgtgaagccctcgaggaggaacaagaacaaccaagaaacactcctccttctcctcctcatcctagttcagtgcagcgcgatcgtctcctcctcttcttcttcttctccatggaacagtagcggtggtggccgggtgggttttgtttttgtttttgttttgttttttggcagccgcgccgatcgaatcttcctcccaaggtacgtggccgtaccactgttcccaaaccgcattgttctttcatttctttctccccctctttcttttgtttctttgtgtgcgcgtgtgtatgtttgtttttttgaggcttgattatgtgctttaatctaagcaagaaaaggaactggatggtaatgagctagtgcttcttgtggattttgggtgaacgcgtatttgattggttcatccgttcatgtttgggtgaacgcgtatgtgtgtaagcagggcaacgattcgtgaacagattaggtttttttttcttttttgtgatttggtgatgttttttttttcctctcaagcaaactgtggtccgttcttgaatcgacttcaagttggtcccgtcgctgcttcattaatcttgcatgtgtagtggtctttgccctgtcactagattgatgtactttgtttgattccatcattgattttgccctgtagccccacaagaagtgtgggctttgtacggattccatttactgagacattgatcgaactggagttcatgttgatactccttttgagttcactaactcgtgattcatttcttgtttttttctttgttctgcatatgagtcgtcaaggaatagggctcagttgcttttgttctacattgcgcttcagtaatgtgatttgattgcgcgagttctgaaaaaatcatgatttattccattaacacccaaaagaactcatctcttgaaaataatgttggtgattcctaaagagttttacttcttgttgctttccgtaaaacaagaatcaacgatacagttcagtctatttatgtgtattttcttttggttctccatcttctagagtcaaaatgatggtgaagaaaaaaacctcttggagccagattgtgaaaaatggcaggccagcaaacacgtctgttaccacaagaaacctccgaccacaagatcttggggctgtgatatttggctgcacaaacaataccatcgcagagtgtcactcacggcaacttttcggtacgttcttgtctttcttaattcaaactctttgcataagatatctatttgcaaaacttagccatataaaattgacacattcatttcttcctgtgagtaagataaatatctccacctttcaaaggattgcaacttgctaggtaatccaccaacttagtagctatatttgtgccatgtttcaggcttgccaagaacacatctctcctatgtacaaaatatcaaggaaggcctacctctgttcctgttcaattacgatgaccgcaaactatatggtatttatgaagctgcgagcaatggcaagttctgtcctgaatcaaatgcatggttacaagatggcaagggaaagaccagctatcctgctcaggtacaatccctgatctttgtatctttggaagctgccttcttgctaaatctcaatgaaacgactccaacatgaatgtccttttttgccggtttaggttgccatgcggatcaaagtgtggtgtgttccactagcagaaagtcagtttagaggtgctattctagccaactactaccagaggatgcctggcgctcctggccagaagcttcattttttccagtttgaattggatcatgcacaaacacgtgctttgatggatatgtttaccccttcaccttctaccaacaatggctggtcgcctcctgttgcacaacctgctgatgagcatgtgagatcgtcatgggcaccagtgtatgcggggaataatggtctcaaatctgagaagattgtaaagtcatatgcggatgtggtaaacaataacaaatttgagcaagttagaacaggagatgtggtccatgtggatgcagagcatgctagctcaggtaatgaacatgtcaatggttttgatgatctggattgtggagacacaaccccagagagtgaggagtatgcactatcgggtaaggaggttgaagtgcaacaacaacagcagcagcagcaacaagaacagtctggtcagcaggataagcttagctttaaaggggtactagaaaagctcaagatgttgtctgtccagcagaggaagtctactttttatgccaatgctactgaaactgaaagtattgatgcgtatagctgtaaggatgtacaagatgatttgccagaaaacttagattctgaagtagatcagttctcctgggggcattctaagttgctgatgcactcattggactcagagtcctgtacagaagtcaaggttataactttgcacatagtggcatctctcattatcatccttgtttttttgtgtgtattcattcaatcttgttaacatgttcagcttttgcctatctattccaaatttctcacattagttttgtttgtgcagttggtagatatagtcaaagagttatatgagcggatagcgatcatggagaagaagcaggtctcttttgaaatgccattaacccatcatactaagattgcaatcttaaagttatgaattgtgtaccatatgcataaaataagtgagaagtctaaggaaattgtagagttgtgttaatataatatacctttagcacaaaaaagggaaaaaaaggtaggaatgaatagaataaaacatgaactgtcaagttgagtaaatcattgtatattactttacatatgctaaacttggttgcatgtgtttaagatttgctttcatcgacaatagctaatttttgcagcctagaatgactaaatttgttatgtgtactaaaagggaaaatctaaaatatgtttgcagtgctttttacctaccagcttgctagaaatcaaagtagtctatgattttgctattatgcttataaaatcggtctcacatctagttaatttatacctaataattatattttaaattaactttgctgtagtcagttgatgaatataatatattctcaactaaaacttggaagtcctagagaattaatcttccttggtggttgaatttatgttatgttaaaaatgcaggcttggtccaataaagaactcaaatacttacaaggtgtgaacgagaggttactaaaaagagttgtggagctcaagggcacggtgaagacattgaattcaaagatagatcctttaacccttgatgattcccttagccagtttgttgaacaatgtttgggttcagaagatgtcatttatctagttggtggttttgatggcttctcacatttgccatcactagactctttttccccttcattggacgtactaacacctctcaaatcaatggctgttggaaagtcatatgcctcaactgttgcattagatggcaagatatttgttcttggtggtggtgatggagtctgctggtttgatacaggttacttactgaattctttgttctgtttcctcacaagctctccgatttatgttctttcctaatcctgcatttgactttttcatgaagtcgactgttatgaccgaagacgtgatgattggaccacatgcccatcatttactcatgataaagggagccttgctgcagttagcttcaatggaaaaatctatgcatatggtggtggagatggaaatgagtgtttctctgacgttgaagtatttgatcctgcttatggaaagtggattaaaaatcagtctatgctggataaggtattagtcactctctactccactcattttgtttaaacctaaaagatttgtgctcatggagtagtgaagctcttaatagaattaatggaaatttatttaggaaacaaaaaattataggaaaaaatcaatcatttacttcaggaaaagtcatacttgtgtaatgagacaacaatttctccatgaaaattcgtacttctgtaatgaggcaacaagttattcatttttgtgtactaattaagaattgtacttcagttttctataatattgtcttcggaaaatatttgcttctgagccttaaatctccatactgtgtgatgaattcttttgtttgattgacatctcctgcttggtttatcagcgctttgctctagcaggcgtggaacttaacggtgcaatttatgcagttggaggcttcaacggtgttcaatatcttaggtgatgtccttttgtgcttgtacttagtacttgatttgttccgttttgaattggtgcagatacaataaacgaacgagtagtacttgttttctaaaagacacttacaaatgtcttagagctgatgcagtggcctatggcttagtgtaaaactgtaaatgtggactatcattagcctattcttatgcaagggaaattattgtttcattaaaatgagaagcatctcagaatttctttttatgctaacaaatgctgtgttaccagctctgctgagagacttgatcctcgggagcctagctggaaaagactcccaaagttgagtacaggaaaaggttgtcatacactggcagtgcttgatgacaagatgtaagtttttagttctttctttatacttcaaaataaccaactaaaggttgcagaatgttctcttaaaaaaggttgtcttttctttttaagataatggaaccatttataaaactcctgacctctacaacaaaagattgtagaatgtgtaccttgaagattgaatccctctggtgtatattaccttctgttcttttga

SEQ ID NO: 83597 - DNA, 3308 bp, Oryza sativa
ccgctgccgagctcgagctcgagctcgcgggcctcgcgccgccgccggcgagacgaaacccggccggggtgagtcgtcgtcggcgttgaggtagtgcgtgtagtttggatgaggaaacggaacggcgtggagcgaggctgcgaaaatggcggagttatcacttatcgctgggtgggcctggcggtgcgccattttctgatgcacgagcatgctgtaggatataggaaaaagtccaactgtcctccctcaacaatagcgtcaattataacctcttaaccgcaaaacgagcaaagaggtttcctcaaccaagatagtttttgacggtggttttgtcctctgtcatgcttactagcatcctaaacagaaaaagaaataaaagaagaaaatgggtctcccaaatcgtggcatttaactatttgccacttttaagatgtgatgatatccatcatcgtcttcttattctttctcctctcggttcggctggacgcaaccactacgatgattttgtgcttgggtcagagaagcatagaggagacaggccgcatgccctcctaccagcatagaggagacaggttgcatgccctcttactaaggccagcgccaaggaagaccgctagagccgagcatcaaaggcagtgtcaaggggaaggacagcgccggaggggatgaggaggatatcctgaagccatccccaactcacaaatcggcggttgcaatgctttcttcctatggatgagaagaggtcgaggtctaggttggagccaatggatgcagggttggtcgtgtctgggcgtggccgaggcggagctaggatctagaatcattgccacatcacccactattgttggtacacctgcaacgtcagtgtttaggggttccacatggtggcggtcatgggcggtgacagactgaccattgaccattcaccaccaccattgaagccttttaaaaggagtatagaagtatgtacatagttgtcttgtttctattatcaataaggtagttagtctagttgggtagtcggtctcatgcaagagtggattggttcatgggaggtttcatgtcgttgtgggtcagttttgtttgggactgttaacacatatgcatgtatgtttttgtgagttttcatttacaagtcttaaccctattgttggtaaagtaggaatgagggctcccactccattggctgctcggggcattgtggagcccaaaatagttaaagcaagagccaacgaagggatccaagcgatgcctcgagccaaagaaggtgacccgacatcaacgtcagctcggggctttagctagtgttagcttggagtcacaacgactactgcaattgggctaggaacccaaggtctaccttgggcactgatgcctccccgagtgaatctacttcattaagtagatttgaccagtccctgtgtgcagcattgccttatcattccgcatcaaatacgtgtgatatatttcatgtggatagatcatgagcgacgtggcagagcatgcctccctcgcttgcccacgtcgcctcaagggaaaagattggcgacatggcgtgtgttccgtagtccgtactcacctaacacaccccctatcagcatcggaggctgagaggtgggcccattgatagtcgggatgaagacttttgctaccctgctccacatgtcagccgataggtgaacccatcacatccacccattatttttggaaggacgatgacaggattgagcataccaacccttgtgagcggggtcctacacatgcacacttgcatgcacactgtggtaaccccttggcatatgaaaggaggaccaatgccactaagaaaagggttcggttcggttcaatttggttgggttcaactggatatgtttagcccaattagcccaagttagaccaacaatcacaaaggcaatgaacaagggttcatcctctcccacttagaacaatatccacccaacacatacattgtaagtttcatcatccatagcaagattacatgagtatggtattacacttccgacagcctgaacctatgtaaaccacctacctacatttctttcgtgcgatctaaacacgagctcggaacccgcaccttggccgaacactcaaaggagagtatgattctctctagaggaacatcccactccgacgcctaagcagtccatctttgggttcagattctaagaagttgcagttgtaaaatccagaaaatgaactaaaagctagaagctagaaaaccctacttttccatattctcggaaactaactaccaactactatatatatcagtttctcataattttaagctcccaaatagatcctacgtgtctcatatggggtagcctgcaatgctaatgccctaaggccctttatagtgcaacaccgtggatcagtgctatggggcgccacgtcggaatcaagcttgcgtggcgctaggttccgcgcccaagcaaggatgcttgcttccacggagagaagcacgattcctccttgccgcgggcccacgcgaggcgaggaaacgagcgctgtagagcgcgttgccccgtgcgccccgcccgttcgtgccctcgcgccgcccgtgtggaagggttttccccaaaatcacccaccaaaaaatcacggcaacaaatcaaggaacaacccaccaaaatcgcggcaacaaatcaaggaacacgcccaccaaaatcgcggcaacaaatcaaggaacacaaatcgcggcaacaaaatggccgctcgccgctcggccccgaggggatttggaaaaatcgccaacacaaatcgcggcaacacaaatcaaggtcgacgccaagctccgccgctcgtccccgaggccgccgccgcttgtccctgaggccgccgccgtcgccgccggtcggccccgaggccgcctccgccgccgccgccgccgccaccgccgccgccgccgccgctcggccccgaggctgccaccgccgctcgtccctgaggctgccgccagctccgccggtcggccccgaggccatcgcagacggagggccccgaggccgatcggtccctgaggccactcggcgccggcggagggaggaggggcgtcggcgccgagtggagttgggggaagtgagggcgtgattagtgatgtgaggaggggagggaggatgctgctatgatgacgaggggattggtaaagtagtatatgtgggtcccactatcgatgcttgcactgtggagaaaatgtctttgcagctcttcatcctacgtgttaccctgtggtacctcatagtggatgcttgcactgtgagaggcttaaaagcctccctgccggacct

SEQ ID NO: 83598 - DNA, 616 bp, Oryza sativa
atttttgtgttcattcaaaaaaaacctgaacattttgtacctttcaggagctagaggttgagtatcgagtgaggagagagagatacccaggccgagtttgcttgccagcggcgagctggtggtgcgcacctgcaagtgtggtgtccacaaggagttcagcttccaccattcccactgagattgacaaggtcattgctatctgaaatactcctgtactcgaagctctgagattgagaaggtcattgctgtctgaactacttctttagttgcctgctttgtttaacttggctacatagttgaggtacactgcaaataaaatgctttatatccaataatttgtaggataagaaacacattccagattcacataataataaggatatagaccctccatgcatttgttgattctttttaaacccaagaagtagcaagaagtgacctgatagggcagccgtacggcataaatatatagttctgtttgtggttttgaattatcaacatttataactgataattatcatgcaaactaaaaatttgagaaaaatatgcgcatgctgaatttcttaatgagatcacagtaatcttcctttgaaagaaaaaactattttgaaacatg

SEQ ID NO: 83599 - DNA, 2747 bp, Oryza sativa
attcctgcagccctcttatatatatttttctattgtattatttaaatgaggtctaattctaaaattagcctagataattttggaggctttgagggttctaaaatatcctagtgtggccctttttattacaatagcacattgaacgaacttatagcaatatattttacacggataggttgaatctatttattctataaatagtatattaagactcggtacaacattaatctaattttaaacactcacatattcttgtttatatataaggactaatttatttatatgaccattattttatatgagtgattttcatgtcatgagtaactcggcgacatgttgcaagtatcaatctatatattccggtgaattacttatttataaacatgatcactatagttgtgatcatcatttcatgtgttcttatatttcatgtgagattcgattcaaatgaattagatttaatcttactatttctttagctaattgtgacatcaagctatcaatcatggttcgaatatttaatacatgatttgtaatttgtaatagaaattaatatttgacttaactatcttgtgcataattatttgtaggattaacaatattatattctcgtaaatttatctattacttaaattttagatccttactttactttctttgtgatcacttacggtttggcaagcaatagcaatcataacaaccagcataatgcaaaagttttaaaaagttcaaaattttagtgatttttattgtcttgaattttcaggatgttacagggaggcgagaagcctttgggtggaagtggataaggatgaatgggtgtcagttcggctctgttcgattttgtacgggtacccattttttcaaaaccggcaactataatatatgtgtcgatttttttaataaccatcacctattgccaactataagtgtcgttttttaaatagtcccacattggttgtggaagggtaaaaaacctaatatataaatgggggagcccctcacctcattggctagcttttggggtgggaaagaccatttacgattctacaattggtatcagagcctaactagtttaacatctcttgcccaagggacagagaaattttaggagttgagggagctacttttgaagagaagtacctagaagacttcctaccccagagggtaaaatgaagagtgaacccttccaacctgtcaaggaaagatttgcaaaaaggctatgtgattatagatggccatttggcccgcccggcctaggcacggctcaagaagaatcgggccggcatggcatagtcgacactttgttttatcggccttttgcaggaggtgcgttttgctcatattggaagagggtgtaatcaggggcgaacgtaaaacaaaagtgacgatatgaatcagcagctgctgcagctagcgccaccgaacaggccctaaatatataccaaagggtaaaaaaaactcttatctgcacttgatcctaagctctatctaattaattaaggtatagcatgcagcctacaaccttatgcaaggtttaaaagaaaacgagtgtagcaagtagcagtatatttaaggagtgtttagatctatgggtataaagtagttttgacgtgtcacatcggaacacatttaaagtattaaacatagactaataacaaaacaaattacagatttcgcctgtaaattgcgagacgaaattatgaagtctaattaatccatcattagcaaatatttattgtagcaccacattgtcaaatcatgacacaaataggcttaaaatattcgtctcgcaatttacccgtaatctgtgtaattaattattttttttgtttatatttaatacttcatatatgtttccaaacattcgatgtgacgaggtgaaaaattttactaagagatctaaacacaccctaaattacatacggttccaagcaaggaaggaatttatgaaccgtggaatataattctactaaccatcattgagataaagaagcatctgtaatctttgagactatgaaaagcaaaaaagaaaaaaagaagaaaagaaaagagaaggaggcacacgggcacacggcacagcattccaggccactgtgccccactctactagttaggcactgctggtttgaagcttcgctaccgttgctgcctcagaaacttcagactttcagagcatcgccctttgtgggcttgtggcagcgccactagggattaaaatggcttagaaacaaacagaaactacctgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatcaatacatactcggcggattcaaatccccaaacaggagtagggtattacctctcattgagagggcctgaacctgtctaaatcatttgtctccgcatccatccacttttaggtctcgtgcgctacccccttttattattgccgaattcatgtttcgacactaccctaaccatattttttttcaaattagaatagtaaacgataatttcagataaaattaag

SEQ ID NO: 83600 - DNA, 1953 bp, Oryza sativa
attcctgcagcccgccttctataaccttctctccgccgccgccgacgaccagccaccgaatcgaagtgatggccgccgggggatgtaaggccctcgccatcctcgccgtcctggcggtcgccgccatctccgccgtctccgcggccgacgcgccggcgcccagccccacctccccgccggcgcggccgcgacgcccctcgccgcggcgctcgtcgcctccgccgccgccttcctcttcgccgccatccgccactgagccccgtcccgtctctccgtcgatgggagatccggctagtgccgccttcgcctagatctactatttttctatttatcaccattattattattgttattattactgccatcgctagctagcgaaatttgttggttattattattattattattattattattcgtgtctcattttgctccagatctgccgctactagtactagctagtgcttgatctgtgttcattttgtgtgggtgtgtgcttgtagatactctcatctgagtgttcttccgctactgattactagtagtatattattactgcttcaatttcattctcagttctatcttttctgcaattagtttttttcttcttttttttttcgttttattaagtactccgtacgaatctgtgttgcgatttccgaaatttactgatgcgctctgagtgagacgagatgctcatcgtcgagatgcagttggcgaagccgccatttgtgatgagcgaatcgtcagatctacgctgtttttttagcattgtgcttattttattttatcggcaagtgcattctggaagatagtgcgcgtcttcttttctgtggaatgttgtttggggggccaattctttatttgccactgcaaatctttcaggattattgttagatttggacagtgatacccctggaacatgcgtgttggcgtgggggattaggagattttagttaggttaatatataatttaacactagaactagtagtttatcgtttccatttctgcttgttcaaatagaacatctggtgtgatactgaccaatgaccagctatatatataatgccggcacatcgatttgatcagggatttgattagtgcaaaaattctgaaggcaaagtcgaaactccaattgatgatttagacattagaccttgtgctgcagaatgaatggaatccattaatgttttgggtagagaatttgctgacttctgttgcttcactacaagctctgcctttaaaatatgggctctgctttcacaatattggcgcatgatacgttcctaaatgtaagaggagtgatctcttatttttttttaatggagggagtaatataaaaaataaaaataaaatggagtggtaagagtaaacaagaaacaaaaactagcgagtaaacaaagaacaatgatactcaattgatatgattgttgctcatgaggtgccatggattttcttctcatttggaccgactgaccggtagtttggacggacttgttgagtttgactgggccggacctgccctgcatctgcatgccccattgccccgctgtctcctcttttcatctctcgcacagtaactatgtcgccttgcatcgttgaaaagaaaacaacgttgtccttgtgctccaaggagtgcattctatggatactgagatttggagtgtgtttgcaatcccatgttaccaacccctctccctcgttttccgcgcgcacgctttttaaactgctaaacagtactttttttgcaaaaaagtttctatacgaaagttgctttaaaaaatcaaattaatctatttttttaaaaaaatcagcaaatacttaattaatcacgcgctaatggaccactctgttttccgtgatcactgttcttccggatgggaaccgcttctaacgaacacagcatgaagtggaaacggacagagcaagaaaggagaggaagcaaacacact

SEQ ID NO: 83601 - DNA, 2705 bp, Oryza sativa
atctcaaggactaaactgggcccgaagtaaaaactctagggaccatattagctattcaccaaaaacaaaatcgaaactactttaatatgaaacgtataaaactgagtgagtaccagttacaaacaaatctgtgtttcccctttcgggttttatgattttatcaccgcggccacatgttgtggtctcgttcgtagtatatgccgattttggaggtggacacgcgagtcacccatgtcgaattgtcgatcggttgggcttccacgatgtggcggcttttatgcgtgtggcgcggtaccagacgcgcgtgcgcatatggcaacgcaaatattgctgttctttcgaggaataacaatatgcaagttgttgttctggtccatggattttcatcgtgctagctagttaatgcgtgcgatcgaattattgttatcgtctgaaaatgcgctccccaagatgaggcatggccatgagatctgccactattaaaacctcccaatattgatcagtagctccaagctagggccatgttgatcgagcagtaatgaaaacacattgatttgatagaaatgcatgctcacaacaatggattgaaaatagacaatattacaacatttatcatttaaatgctctggaaaattttcatgttaattggacaaataacaaacaaatctattcatctatctgtgtgagatcaaattgtaacaacttagattagaagaagaaattaacatcattactgtaggaaaagttctagttaataagaaaaatagtgattaaatctggtcatccatctaaaccgaattacagtaacaaataagattagaacaggactaatttctaattattaattttaattttcaaattcaataaatataagatgcaagatggagaatacaagatgatcgagtacagcatcatatttatcaattcttgatggatttattaatgaaggcaaaagaataaaataaaattgagactcatattgaatacaacttgtgttaacttcaaaattactttatcaagaaaataaattgaaacggaccatctacaacttaaaaaaagttcatgttggtcactacctactaataaatgctattttgaatttcaagaattatggaaataatataatacttcctccatctcagtttaatcatcacctaaacaaatagcgtagggaccaaggataacaaaatcttcattattctaaaattaattctcatcagttaaggtgctacgtcgtttcgtatcccgtggattacataaagttttaaatattatatgtagttgcactaacataaattaattttggttggttactctgtgcacaaataaatgaagatgtgcttgttagatgatgattattttagaaagaactctgaaaccttagatgacgatcaaactggcatagagtgaatatatactaaattggggcttcaaggcaagtacaactaagtgtttattaatttcgaaattttaaattagtaaaccataaaagcagaaagtaaaataaaataaagaatatagcccagatgcctgtttggaaatactattttaaaatttgaatgattaataaaatcatttttaaggtatagagcagtgtataatgcaaataatttgcacggacgcacctctgggtttcaacataggaggctgttgatttacgtttgactattcgtttattaaaaaattatacgatcaacatttattttgtagtaagtataatttatcattaaaggttttttaacaagatgtatatttttaagaaaattaaataaataaaatagtcagtaagggtggcatatattataagctagcttacaagctaaaaactctaaatctaaacaaacaggttgattcttcatttagttttcttaaagccaaaagccattttatactggtaagcccaggttggagaatttttttttatgtgaagcggggaatgacttcaccaattaaacctaatgctttaaacccataggcttataaaatttttaagcttaaaattagcaaagtataagctaataaacctaataataaaaggccctaagaaccagtggtagtatatttttagaaaagtccctttgggtctcaccgtgctggctgatgatgatcagaccgaagatgttcggtttcctaacaccatgcaggcatgcaccaaaagaaacggaaggaaatggtttaatatatcgttaggcagtgctagcttgactaaccattttccacacacataaaccaactgcagaaaaacagcagcaagtggggtcatcagtagtttctccatcctgctgtcgttgtcccaacgaggggctagctgcatcatccaaaaacgaaaaagaagaggataagaaaaccaagctgcattcgccaagaaggtaacagtgtaacactactaccctcaacgagcgttaatgtgattcgtttgagatgactcacttttaataggtaaaaaaaatatatcccatttaaaataccctagtgatatttaaaatattcttagtatggaataccgtttgtgatgtatgactatggttaatataccctagtgatattaaaaatacattttagtgtttttagtgtatttaaaattcaaaactcgtaaattctcatcggtgaaggttcttaattaattataaccagtcacgaataagtcatcggtgaatggtgttcacctgatatagataagatttttttcatcggtaaccactaat

SEQ ID NO: 83602 - DNA, 18908 bp, Oryza sativa
  unsure (1)..(18908): unsure at all n locations
aattcctgcagccccaaaatcgccctcccaccccaccaattcttgttcttgcctcccgcgtctatatttggtcattcttgcgttcgcatcctcgctcccatgttcgaatcgtcgctcctgtccagctccgtgtgtgaggcgcgctcccttattgatgcgccaacacggattgggggagaaccggcgcggtggatggacgagaagaagtggtgtggattggggaagaagcggtgcggcggctttagagggagaaacggcttggcggaggagaagcggttggggatggggaggagaagcggcggtgacggagctcgtggctcctcaccgggagaccgtgcaggcccccctttgccagttcggccgggggcttagggtgagatctcaagctctctctgtatgtggaaagatcgcgtgccaggaagaaacgcgagacacggacgatgtatacaggttcgggccgctgggaagcgtaataccctactcctgtgtttttggtggatctgtgtaagaacaagttacaaaatatcaaccagccctctcctctcccgggaaaatcccgttctctctctttgtgggcatggtcctccttttatatcttaaggggataccacatgtaccctttcctttccaaactggacttttcttctctttatgtaaatggacggagatttgcacggttgccctccgaacgtccttctgaagggacggcacatacctacctccacttctgccgggggcaggcgcgtcgtgggaacgtggctgtgcgctgacgacatgagcagtgtcagaccggtcacaaatcggtcattcttgtccaccgcgtgtcagcttagcaacgtgcatgtttgcccttcttcacacaacatcttgcctgtaatggttaggatgaagcctggcatatatcgatcggggctaacgtgccatctctgggatgtaacacgctagctccagctggggacgagtgcctagaggctctcgtcttgacgggacggggcgaggcgtgcgtcagaccgccagtcgccacctaaccgttgatctgaccggtctgtgactggtcacagaccggataaaagagcgcgctgcattgcgctgcatgcagcgtgacacgcttgaccagaccgcaataaatgcggttaggtgagccctaccgtgttcacccaacctatgtacatagtgcaaaccccacaaggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcgatcatccttctcaagggaagcggtcgggcatgacgccactcataaagcctggtgacaggtgggaccggtctccgtgattgggcagaaacccaacggtctcaaaccacgcatatcggtaacggtgtcttggccgtcagtcatgggcggtctcttcaagactgccacatcacttgagcagcgctcgaatctgggcgtgcagattcgtttcgtctggagatatggtaacgtcgcttcggtcggcgagcgtaattaacgcgcacacgatacgatctatctcgactgccacaaccgcatatccacctcatgcgccgcaagcgggcgaatggaattagtggaagcgtgggcgcgagaaacgagggagcgagatagcgagtaacgagggagcgagatagtgggcacgagaaacgaggagccgggctcagcgatgggaagggtataaagccatcgaggaaaggacttgctcccttcctttcgccactattcccctttccttcgccgtttgcgccctaaactctctctttgctgcgcctcaccttcgccacacacgctcgttctcaaccctctctttctccgacgacatggcacggggctccgctctgctcgacggtagcgtactaccgccttcccgcattgtgggcgagaggcaggctgggctgccgcgccgcttcatgccggaatccgccaccggccgggagatagtgatgctgggcgaggcgcgcccagcaccagattacccggggcggtccatcttcttcctccccctcgcaatggccgggttggttcctcctttttcttctttctttatggatgttctggagttctacgatctccagatggcgcacctcacccccaacgcagtgatgactttggccatcttcgcgcacctgtgcgagatgttcattggggtgcgcccatctcttcggctgttccggtggttcttcaccgtgcagtcggtgtcgccgccgtcggtggtcggtggttgctacttccagccgcgggggccggtgttgaaccgctacatcccctgcgccctccgcaagaagtgggacgattggaagagcgactggttctacaccccccttgccaacgaagcgcgcctccgactcccaagccagcccccggcgccggtctccagctggcgggcgccagtagatctgggggatgactatgacgccgtcctcgaccgcctggcgggcctgcgatctcaggggctcacaggggccatggtgtacggcgactacctccgtcgccggattgcgccgcttcagcggcgcgcccggagcgcatgggagtacaccgggtccgaggactacatgaggacccaccggggagtcagatgggattgggctcccgatgacttcaagatcgtggtccaaagggtgctgaatctcagctccgtggaggcgtctcttattcctcaaggactcctccccctctgctgcgatccagaccgcgcctccattctgaccatcatgatgggggtcggggcctcagaggaggtggctcctaagggccacgacggcgccggcgggagccgccaggaagaatcaaccccaggagggggccgtgcttctgggccccgcgacgggggctcggggagcaaccgccctgccgccgcccgggggaagaggaaacagggaggaacacctcccccatctcctccccgagggggcggggcggtgcgtgccagcagcaggcgcccggagggggccgcgccgacgtcacagcccgagacggagcgcaagaagaagcggctccgcaagacgggggagacggaaccatcccggggaaacctgatttcccctccaaggtggtcgttcaaccgaccccctcgcaggttcgtttcacgcctttcacaaccatcttccctttatcccaatcagcaagttttctcttatccatcttgtttgtcttccggttttttcttctgcttcagcgatgtcccgtcgcgttcctcccgccatcccaagtccggccaatccgaggccaaagatccggcggccgcagaggaacggaggcgagaatctgaccggcgagaggccgcagatcgccttcgggaagctgaagaggccgcccgggaggccgctcgggttcggcaggcggaggataccgctcgggaggaggccgcccgggctcgccaagccgaagaagctgctcgggaggaggccgcccgggctcgtcaggctgaagaagccactcgggaggaaaccgcccgggctcgccaggctgaggcgatggcgtcttccgaggcggttcacgacaagaccgccggcgcgtcgctcgggcccactccctcgggtgacgctcaggcgacaacctccggggcggctcgcgacaaggccgcgggcgcatcgcctgggcccgctccctcgggcgacgcccaggaccaaacgggtccgggggacatccccgagctcagtgcgtcttctggcgggccgagccgcgtcgcattttctccaaggcggctcttctcctcgtcttctgccgccccgctgagtgccgagccccttctgcaagccttggccgccgcaaacaccgcggtgctagatggattcagcgcccaggtggaggccttgcgagcggaacgagcggagctcgaggccgcatgggcgcgcgtcgaggaggggcggcgctcggtggacgccatgtggaggtggccgtaaggctcaccgccgccacatctcggagcttgaagcccgcaaggcggcgctggcggagatcgcccgagaggtggaggaggagcgagaggccgccctcatcgccaccaccgcgatgattgaggcgcaggactccctccgccttcaacacgggagctgggaggcggagctaaagaaaaagctcgacgccgcccagggggtccttgacgccgccgctgcccgagagcagcgagcaacggaggctgaagcggcatcccgacggcgggaagaggcccttgaagcccgtgccatggcgctggaagatcatgccggcgccgtggagatcagcttggcggaccgcgaggccgccgccgctatccgggaggcgacgctggcggcgcacgaggccgcctgcgccgaagaggagtccgcgctccggctccgcgaggacgcgcttgctgagcgggagcgagctcttgaggagtccgaggccgcgacacaacggctggcggacagcctgtccctccgcgaggcagcgcaggaggagcaggcgcgccgcaatctggaatgcatccgcgccgagagagccgcgctggagcagcgggctgctaacctcgaggcgcgagaaaaggagctggacgcgagggagcgcagcggcggggcggctacgggcaaaagcgacttagtcgcccgcctcgcagctgccgaacacaccgtcgcggacatgcagcgcgccctggactcatccaccggggaagcggaggccctccgcttgtcggtgagatagggcccggcatgctttgggatgcagtctcccggctggatcgcgccggtcgggaagcgggcttcttgaaaggccagacaatttcgcgctctaccaatctggaaggcctcgccccgcccttaggaggatggcctgggctgtccaacaactccccgaggagctcgagaagaccatcaagtcatcctcgagggacctcgcccaaggagcggtggaactcgtgttagcgagttaccaggccagggaccccggcttctccccatggatggcgctggaggagttccctcccgggaccgaggacgatgcgcgcgcgcgggtccgggatgccgccaaccacatcgtccaaagcttcgaggggtcggcccctcggctcgcgttcgcccccagctccgacgaggagggcgacgccagcggtgaggacgacggtggcgacgaggccggcgacccgggcgcattggaatgagcccccaggcccccgccaatctccaattttttctttttctttcttctttttgtatagatcaacttaatctgcaatcaaaaatgatgaaaaatttctatgttaactttattttgctatgcatatgagttgaggatgatttgtgccgtggtccttttgcattttagcttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattcttcagaaggaaaaacggcacagacacaacctttagaaaattgaaactgcttttattgaaatgctgaaataagaaaagtaaggctgtgcatgtgtggtagcccccggctaaccctgcacacccgaggggggtgcggggttagcccgagcccgaccccccccctcaggggtagaagcgacgaaggtgttcgatgttccacgggtttggcagctcagtgccgtcgcccgtggccagccgtacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctacgaagctgatcttgatcagcctcgcagtacatggtggcccgaggagacctcagggtgagctcggatgggagaactgcttctgcgccgtagacgaggaagaaaggcgtttccccggtcgctcggcttggtgtggttcggtttgcccagagcaccgctggtaactcctcgatccatgaatcgccgtgcttcttgagaatattgaaggtcttggttttaaggcctttgaggatttctgcattggcgcgctccacttggccattgcttttggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagagcctgggccggctgattgatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacgtagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcagctatcatgttatcccgtctgggcacatgccgaagctctatcccgtcaaaatggcgctccatacgccgcacttggcgtacataggcgtccatttgcgggtcagagcaccggtactccttacagacctggttaacgaccagctgggaatcgcctaacaccaggagacggcggatccccagtccggctgccaccctgagtccggcaaggagtccctcgtactctgccatattattggtcgctcgaaagtcgaggcggaccagatatctaaggacgtctccggtcggggaggtcaacgtgacccccgcaccggcaccctggagggacagagaaccatcgaactgcatcacccagtgggtggtgtgaggcagctgcgaggggttcgtgctggcctcggggattgagacggtctctggagccggggtccactctgccacaaaatcggcgagggcctggctcttgatagcgtggcgtggttcaaagtgcagatcgaactcagaaagctcgattgcccattttaccacccgtcctgtaccctctcgattatgcaagatttgaccgagggggtaagacgtaaccacagtgaccctatgtgcctgaaaataatggcgcagtttcctcgaggccatcagaatagcgtaaagcatcttctgggcctgagggtatcgggtcttagcgtcccggagggcctcactaacaaagtagacaggccgctgcacccttcggtggggccgatcctctctgctaggggccgtatccccggggcgttcttcgttcaagtggcctttcggggcgcacttgtcttctgtgccgatgacctcggggtcggaggatgaaaggggcggccttccctcggtggcctcggggccgtcctgggggtcgggggctcctggcatcgtcggacaagcgggcaaagggccaactccggtcgtcaggggcctctggcctccgttcggctcgggggcctcttctccctgctctttcccgggtcgagtcagcacagggttagcctcggggtcaaagggcgttaagtgcggccttcccgcagtggccttggggccctcctgagggtcgggggcacctagcaccgtctgacaagcgggcggagggccgactccggtcgtcgggggccttaggccaccgttcgactcgggggcctctcctccctgcctgctcccgggcctagtcggcacagagtgggggtgcgcagaatgaggattgtcctcatcgcgctccacaaccaacgctgcactaactacttggggggtcgccgctaagtaaagtagcaggggctcatttggctccggggcgactagaaccgggggagagctgagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacatacgcctcaacattacgtcctatttggctacccaaagaaattcgagtagtacgctgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgctccccgcagtggagtcgacgatctgatctatgcgaggcaaggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggccttccgccgcactttctgccggaccggccttgcgcccggccgcacggcgagacggtgctcaatcaccttcctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcgatgggggcggaggtgccaaggctctcgtcaccaccctcgggcttggtcgcagcagcgaggtggtccgcgcgctgctccatgcaagcgagcgtgactttaaggtcgccacggacagagatggggccaccggggcccggcatcttcatctggaggtaggcgtagtggaccgccgccatgaacttcaccaacgcgggtctccccaggaccgcgttgtagggcagactgaggtccgccacatcgaagttcacccgctccgtgcggaagttggctgatccaccaaaggtgaccggtaggtcgatgtgacctaatggccatgtgtgccccggcgtcacaccgataatcggttgggacggccggagcaccatccccggggccttgatagcatcaaaggccgcgggggaaagaatgttgagagccgctcctccatctatgaggacacgtcccaactcgacgttgcagatggtgggggaaaccaccatcgcaacctgccctccccgggcaatgcacggtgggtggtcggtctggtcgaaagtgagagcgacctccgaccaccgcgcccgacgcatcgcctcatgggtaggggccatggccagaagctctcgcttcatagccttgaagctccggcgagagacgtgagcacatgctcctccatcgacggtggcaatggtggccccaggttcttggaaacctaggtcatcatcaccatcatcaatgtcaacagcgggggccttctgcttagcctcacttcgccgtttgccggaaggaaccgccggggacttgccctcacggcgttcctgcctcctgtcctcctcccacttcctcgttcgctcagccaaatttttgactgcgcgacagtccacgagatcgtggagggaggtgttgtggacggagcaccacctgccggcggggcgctccttgctgggagtaccagcctctttctttttgtcgctcgcaggcctcccctttcgggtggcccgcggagcgccctcgacggcgaggacatgaccctcgtcgccggaacggtccgacctcttcttcctcctcctgtcacgccgccctgtctgagcggcggatccgggggcggccgaagctgccactccggaaccggaggagttccatgtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccagccggaggcacggagggctggtcctcacgtccatgtcgaggtgacactctggacgaggaggcaccctccgttgcacggggggtacgccggctactacgccggcgctcgatgttgaggcgggcatccggctccccatgctgatcctcccgagtcgaaggtgtcgacgagggagtagcaaccgaatgacgtgcagccgccgccgctcgccgcgccctccgccttgacgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgtagacgaggaggcgacgctccccatctcgccgttctcctgcatcacctgcgactggtgatgccacggatttgtcgaccctctcaagcgcctccccctgcttagggctttggcgcggaggaggtgggggagtacgagctcgacggcgtggattcggctccccgtcgtcgccgctcacacttggagagaggtcgtgcgcttttccttgctcggccattaggctgaacaagaaaaagttggcgcacacggaagagtctgagagctcagaaaacacacgctgagccccctacctggcgcgccagatgacggagctcgtggctcctcaccgggagaccgcgcaggcccccctttgccggttcggccgggggcttagggtgagatctcaagctctctctgtatgtggaaagattactcgccggcaagacacatgagacatggcgatgtatacaggttcgggccgctgcgaagcgtaataccctactcctgtgtttttgtggatttgtgtatgaatgagctacaaagtgtgagcccacttctcccccgctctaggctctaaatctggcaagaatcaaccaaccccttctttatgggcaaggtcctccttttatacttcaaggggataccacatgcccccttctctttctaaactggacttttcttctctttatggacggagattggtgtggttgctgtccgaatgacactccgatgggacagcccacacctacctccactcccggcggagacaggcgcaacgtgggatcgtggctgcccgttgctgacgtgatcagtgccagaccggtcattcttgtccaccacgtgtcagtttaacaacatgcatgtttgcccttctttgtgtaacaccttgcctgtaatggttaggatgaagcctggtatatatcgatcggggttaacgtgccatctctgggatgtaacacgctagctccagctggggacgagtgcttagaagctcacaccttgacgtgatggggcaaggcgtgcgtcagaccgcctgtcgccacctaacttgcgatttgaccggtctgtgactggtcacagaccggataatcgagtgcactgcactgcactccgtgcggcgtgacacgcttagccgatgcgcaataaatgcggttaggtgagcccggctgtgctcacccaacctacgtacatagtgcaaacccctcagggggtcggggcacctcggccctcggggtcggggcaagcgcaccccgaccccccctcgggggaaatcaggaggagggcggacacctcaccctcgggcccgacgtccccgaaggtgccaggccacgtgggcgattgtgtctgcctcaagcctctggtcatgatactcccggtcccatatcaccgacagtagcccccggcgttatgccagagcaatttcccttcccaaggggagcggtcaggtgtgacgccacccctaaagcctggtgacaggtgggaccggtctccatagttgggcaaaatacccaacggtctcaatccatgcatattggtattggtaactttggttgtccataatgggtggtctattcaagaccgccacatcacttgagcagcgcgcgaatctgggtgagcagatttgtctcgcttggagatacggtaacgccgcttcggttggcgagcgtaattaacgcgcgcacgatacaatccgtttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgaggaaaggatttgctcccttcctttcgccattgttcctcttgccttcgccgcctgagctctaactctttctctgctacgccctactttcgccacacgcgctcgttcccaatcatctcttcctccaccgccatggcacggggctctgctctgctcgacggcagtgtactgccgccttcccgcatcgtgaacgagaggcacgccggactgccgcgccgcttcatgccggagtccgccaccggtcgggagatagtgatgctgggcgaggggcgcccggcaccagactacccggggtggtccatcttcttcctccccttcgcaatggctgggctggtcccgccattttctcatttcttcatggatgtcctggagttctacgatctccagatggcgcacctcacccccaatgcggtgatgacattggccatcttcgcacacctgtgcgagatgttcattggggtgcgcccctctcttcagctgttccagtggttcttcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccctcgccgacgaagcgcgcctccgacttccaagccagcccccggcgcaggtctccagctggcgggcgccggtagatctgggggaggagtacgacgccgtcctcgaccgcctggcgggcctgcgatcccaagggctcaccggggccatggtgtacggcgattacctccgtcgccggattgcgccgctccaacggcgcgcccggagcgcctgggagtacactgggcctgaagactacatgcggacccaccagggagccagatgggattgggctcccgaggacttcaagatcgtagtccaaagggtgctgaatcttagctccgcggaggcgtctcgccttcctcaggagatcctccccctctgcagcgatcccgaccgcgtctccattctaaccattatgatgggggtcggggcctcagaggagagagcccctaagggccacgacggcgcgggcgagcgccgccgaggggaacaacctgccccaggagggggtcgtgcttctgggccccgcgtcgggggctcggggagcagccgccctgccgacgcccgggggaagaggaagctgggaggaacacctcccccatctcctccccgagggggcggggcggcgcgtgccagcagtcggcgcccggagggggccgcgccgacatcgcagcccgagggggtgcgcaagaagaagcggctccgcaagacgggggagacggaaccatgccggggaaacctgatttcccctccaaggtggtcattcaaccgaccccctcgcaggttcgtctcactctcattgcaaccatctttctccaaaaagaagttttttcttgctcactttgttcgtcttctggcttttccttctgcttcagcgatgtcccgtcgcattcctcccgccaccccaagtccggccagtccgaggccgaagatccagtggccgcagaggagcggaggcgagagtctgaccggcgtgaagccgcagcccgccttcgggaagctgaagaggccgcccgggaggccgcccgggttcgccaagcggaggaagctgctcgggaggaggccgcccgggctcgccaagccgaagaagctgcccgggaggaggccacccgggctcgccaggctgaggcgacagctgctgctggcgcgtcgcttgggcctactccctcgggcggccctcaggcgacatcctccgaggcggctcgcgacgaggccgcgggcgcatcgcctgggcctacctcaccgggcgacgcccaggatcaaacgggcccgggggacatccccgagcccagcgcatcctccggggggccaagccgcgttgccttttctccaaggcggctcttctcctcatcttctgtcgccccgctgagcgccgagccccttctgcaggccctggccgccgcaaacaccgcagtgctggatgggttcaacacccaagtggaggccctgcgtgcagaacgagcggagctcgaggccgcatgggcgcgtgttgaggaggggcggcgctcggtggacgccatggtggaggtgggccgtaaggctcaccgccgccacatctcggagcttgaagcccgcaaggcggcgctggcggagatcgcccgagaggtggaggaggagcgagaggccgcccttgtcgccaccaccgcgatgattgaggcgcaggactccctccgccttcaacacgggagctgggaggcggagctgaagaacaagctcgacgccgcccaaggggttcttgactccgccgctgcccgagcgcggcgggtaacagagactgaagcggcgtctcggcggcgcgaggaggcccttgagtcccgtgccatggcgctggaagaacacgccggcaccgtggagaggggcttgacggaccgcgaggccgccgctgctctccgggaggcgacgctggcggcgcacgaggccgcctgcgccgaggaggagtgcgcgctccgcctccgcgaggacgcactcgcggagcgggagcgagctctcgaggaggctgaggccacggccaaacggctggcggacagcctgtcccttcgcgaggcggcgcaggaggagcaggcgcgccgcaatcttgaatgcgtccgcgccgagagagccgcactggagcagcgggctgctgacctcgaggcgcgggaaaaggagctggacgcgagggcgcctatcggcggggcggctgcgggcgaaagcgacttagccgctcgcctcgcggtgccgaacacaccgtcgctgacatcagcgcgcgctgattcttccatcggggaggccgaggccctccgcttggcgggcgagatggggccaacagttnggatcggtctcccgcatggatcgcgccggtcggcaagcgggcctctggaaaggccagacgaggacgcgccctagcaacctggaaggcctcgctccgcacctcaacaggatggcctgggtcctcgaacgactccccgaggagctcgagaagaccatcaagtcatcctcgagggacctcgcccggggggcggtcgaactcgtgctagcgagttaccaggcccgggaccccgatttctctccctggatggcgctggaggagttccctcccgggaccgaggacgacgcgcgcgcgcgcgtccgggatgctgccgaccatatcgtcgacggcttcgaggggtcggcccctctgctcgcgttcgcccccagctccgacgaggagggcgacgccagcgatgaggatgacggcggcgacgaggccggcgacccgggcgcattggaatgagcccccaggcccccgccaatcttcttttctttttctttcttctaaggccttcatgcctcttttttgtataaattaacttaatctgcaatcagaaatgacgaaaaaaaaatttttgtgttagttttattttgctatacatacacgatgaggatgatctgtgccatggtcctttcgcgccttagcttgaaataagggctcgtgcccaagtcccggtcctcgaatggctcgggtcggggctagtgcctggggagatccgcatgtcgagactggccaggccgggaacgtggtgaccgaggggtatgggtgacccgattgtgggtttttgccggttcccccccggagttcaccacgccccggggcacggctcggttctgggccccgtttggcgattttagctgaccgaaccgagcccccgagggcaaggttgagcacgagtgaccttatttcaagttaagattcttcagaaggaaaaacggcacagacacaacctctaggaaattgaaacttcttttattgaaatgctgaaataagaaaagtaaagctgtgcatgtgtggtagcccccggccaaccctgcacacccgaggggggtgcggggttggcccgagccaaaacctgacacccgcccccccccttcaggggtagaagcgacgaaggtgttcgatgttccacgggttcggcagttcagtgccgtcgcccgtggccagccgtacggagcccggccgggggacgccgatcactcgatacggaccctcccacattggtgagagcttgcacagtccagcacgcgtttggacgcggcgtaggacgaggtcgtcgacgcagagtgatcgggcccggacgtggcgctgatggtagcgccgcaggctctgctggtagccgcagctcggagggccgcgcgccgccttcgttcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatcgcatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggtactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtgaaactgacacgctctgcatcgccggaccagatcgactgcgtcattgagagctgtcggccaataaaatccttgacgaaaggccttgccaaccagggtacgcgaggcggaatgggctccgcactcgccctcatggatatcagcaagaagctcaacgccttgttcctgaggaatgcacttcaggaggattccgttagccgcgcgccgatagagggtcccttctaccaacacgtagcgtttggaaatgcgttgtacgcgttcactcccttcgcggtcctcaggtagagtcttatctgtgaggtatgtttggatctcagagatccaaggggctgcaggaatt

SEQ ID NO: 83603 - DNA, 690 bp, Oryza sativa
atttttgtgaatatgaacatgtattatttcctaacatattcttcttggcactccaaaaaagatcaaaataaattgctggtgtttaatccggccaattgcatggagacattctgaagtaaaatcacatcgaaagactgaatttgcaaccaacaaaatggacagcagtggcgatgaacaaaacccaaacctaacccaaccatggccgatagtgcgttagacggctgggctcccgttcctcgcatgggccatataatgggctttcgtgatggatgatgggccaaacaagcctaaataggacaggcagcagcgtgcagcgagtagcgaagcagcgctagttttagtaccacctcgccaattcgagccgcagccaggcgggaggaacgctataaaatagggcgaggttgcaccattgtaacccatatctttctcagccttttggctatttggctattggctaagggtgtgattagttcgcgaaaagaaaatattaaacgtgggaactaaacaagattaactgttctcatcagtttaactaatatctgatgtgtgggccatatgctcacttcgatattaaatttattatttgtgggggagggcttcgatattaaatttattatttgtgggggagggctcatcacagtggcaagcccttgccactggggccctcgcgcgtcgctcaagcgttgcact

SEQ ID NO: 83604 - DNA, 4723 bp, Oryza sativa
aattcctgcagcccaaaaaaaaaaatcaaatgtcaaatcttgtacttagttgccagttcttttattttgaggcacaactgtattggcacctgtctctactgcatatatcatttgttaccatgccactcttgctattatctgctgcatttcagatgatcatcaatttttttacggtcattaagcaccagcttttcctgtacaactctcatgtattgtgactgataattaagccttggtgttggccgatttgtcaggtggaacgctacaaggaagggtgtggttgggtgactaccgagtcgaggtcaattggcaggaggtgctactgctcggccattgttctctgactctcaatatcgacgctgtgaatttagttagctttctgacaagggaacaacaaacagatagttaaagaacttagaaggctcttcttttggctgaatttagagctgtagacatacataagctcttaccctaatcttttgcatgaactagaaaaccgttcaatgttgagctattttgttgatactgcaaaaatctgatgcaaaaatcagtttggtactaaacaagatgagaattccatgaatgaatatttgatagaactgtgattattaactgacatcgttgagcttcagttcagttttttcctacctgtttgaggattttactgaagcagatgtgggtctggctgggttcaccattccagcaatcacaaaccacatttaagaacctagtttactctttgctgtttcttacagagacctcaaagttgtgatgacttttgggggtgttaggcctgtttgttattattcctatgttgatctcaaatgttttgattttgattttaatcaaatgataattgcaagtattcagaaatgcatttgaagcgatacagtcaatggaaaaaaaattctgtcttcagtaaaacacaagggatgggagacgtgcgttccttgttgctgctgctgattctcgaagtcaccggcgatggccgccggcgacgaagacgctgctccggcgctgtcacgctgtgagatggtcaccggcggcgactgcgacggcctctcttcggccgctccctccgaccacgacggcaattcctcccatcaatcgccgatcccccctccgccgccgccgttcccgcactcatcggtttctctttcacctcatgacaccgcccaccccgcgcgctgctcatcgaattgacgcggagatatggggccgaactgacccgaatttatgtgcatcctttacaggccgatgaacgcacacttttagcccaactgacgtgcatggttgggctgaaatgctatttgggacaaatttgttcacacgtttgggccctactcacagaaaatttgggcttacattactagcgcagtagcgctgctctggtgaatggagaaggtccacttgactcactcctataggtcggatctgattcatatttctcgaccgcaaaacaggtataatgatttcctcgaggctccaactgttaaaacaggtacaaaataactcctaaaacagcattaggttttcactaatgtggcacgttgagctagttcaacttgctgagtcaacatgggtccacgtattagtgtagtgaccgatgatagccagtggtggctcctttctctcccctctcttcctcctattgtcctatgggcatggtggctggtgagtggcggcttctcgctttgcattttctactgcaacgagcatgtccggtcctagaactctactaggccatcggcgaacttctcgctaatcctgcaacaccacactgaccccccctccttctgcctcaccatcacgccccgatcaaccaaatcttagtaagatttaatgattgcttccgtggtcctgccagtagccatctccttcttggctagctagtttcatggttgggaagatgcatgctgaggctgagcttgagctccatcgagggagcaagaaagaaaagatcaaagctttcatcgattagtggctggtgctactcctatgtcattgccctcctcgtcggcaccacccttctgatgctctcccactgccttatgcctcgatctggttagccaacgtctctactatctgttgccctgatctacagaaccgacgggatcaagaaaccaactgccctgatccgatctgccatgtgccgccgagatcgagatcattagtgattgagcttggttggaatgatggctaggttgaccgtacggtggttggtgaggatgccacgtcctattcacctctggtgcgggtatcaccagcgtgtcatcgcggtgtgggacagagcgcgaggggaaatgcaaaggaagaagaggagagtggcatggatggacggtgagctagagctcgacggggttcactcgccattgtcgcttccattgggagctcaagctcccttgccactactagagggggaagagcgaggagagggagatatgggggagagaggaaggagagagaagtgaggtagagtgagatgacatgtgggctccacaaaatatttctaatttaatgtgccatgtcggccagcaccacctctcaatattgtcttaggaattatttctctggttttaacaatttgagggatacagataagcgatatgaatatgatccgacctatattttgaaggagttagagtggacccttttgcctagtttattgacgtgcaaatttgggccaaatttatgatcacctttaggcttaacctacgcccactttttggatgaactcgtacccacgtttaggctgaattaacttaaaactagaaaatcagcgcgtctattggcgcgcttgctagttagcccataaatgtgtgtaaaaattgaacttcagtaaagtgtcaaaaatatatttttgtcgttgatttttgctgcatttgcaatagatatattatcattctaaaacttttttaacagagtagaaccgtatttatatgactcaataatacataataaaacagacattgatttttttttagtattgctatttttgtggctcttgattttatacataaattttatattaaaacagtttatgtattgcataatgcactctcagtaactacgaacttaatattacgtgaaaataatacaaatttaatgataccacatacgtaacactattttttataaaaaaaatattagtcagatttttaaatattgaagtttttaaaccgaatcctatattatctttttagtacccagggttaccacgctgtttgaaagtgattgttggccacattatcacccgatccaatctttcacattatccctatcatctagttttgtatgattattgtttttataatatagaaatatttttatccaaatattttacaaaaatatatgtatttttttctagtactatttatttcctcctatttctattttctacctgctcatgcatgagctgcaaagtagcccagggaggaggaggcgatgttcaacgtgcaaactctaattatcaggggaacacataattgggtcgatccagtgcatacgctcgtaatggctttgttagttttctaaaaaaaaagttaaataaatatatagcatccatctatttaatgggctctattggagaccatttggcccagcataaaatggcggacggacaccgttaagcgtatgtacgtgacaattctagaagagattagattggttgaggaacctgcgacttctccgttagctgtcggaatttatctgcaagatgaggaaggacacgtggtccaatcagctggctgggtctccagccagctttagaagtatctagaaatatagattatatatggaccgaattatgcttgattttgggctgaatacttgctcactgatgggtgatgggtcgaattaatgtgcagctatgggctgaatcctatcttactaagttatcccccactaacttcttaaacttaacatgcaaagatgccacatcatcatccactaacaagatgccacatcatcattcactaattaataatatgccatatcatcatccactaacaatcatcacatttaaacatcatgcaaacatgctatatttttatagtttttataatttaagagattttcaaatacaaacatgttaaattatcatccaacataattcacataatgtttcaatgtatatcctatataagtatatggttcatactcatttagttagtgcttaaacgattaatttatggtacaaattatttttctcccttttccctctaattaagtcatatcacatcaattgtttttaggccctctttgtttagacttataagccaaacttataagccgaaaagtccaagcctaaacaaataagcggcttttttgtttggcttttctgaagccataagacattctgacactattaagccaaaagctaggttagagaagcttttttggcttatatgaggtagatgcatgactccaccattaaatttaagacattaaatccatcggcttataaatcatataagccaataagctaacttaaaagtctaagccaataagtctaagcctaaacaaagagggccttagcctttagatgattaatctacggttcaaactattttcctacttttcttcttctataaagtcatactaccttactttttacgtttgaatcactattctacatactatttaaatttaaattatcacaaaccatattaatttacttaatctgatattatctagctatcttacacgttattatttttgttgt

SEQ ID NO: 83605 - DNA, 3674 bp, Oryza sativa
agaacatcttggcactacggtatcatattcctactcaaaatatcttcccatccggactcaaaagattttccacactacttctggatattcacactactaatcttttcaggcagtcttaatcacttgattcgtacccctcatgatgtggcacatagtcatcatcactttcatctggaacaaaatcatcatccgaagaatgagactcctcttcatctggaacatagtcatcatcttcggtagaccgatactcatcatcatcgacaaatccataaagggctggaagaaccacctcgtcccctacctccacagccacctcaagaacctcctcccctacctctacagcagcttcaccgtccaactgcccctcccctcctacagcagcttcaccatccaagtgcccctcccctccatctgctggctcaggcaagagaagagcagcccactgttcagggtctagatcatgtccttcaggaccggcaatggctgcaaagtgttgggcccgagcatctatggctagttcttcgagagcttcaccatgagcaaggcctgacagaatgctagccctaacggtggctctaacgtttggtaggaatttgtactgcaggaaatgatatattaccccatcttcttccataagcaccggcggcaagacgacacggcgtctgaatcgaatcccaccattgatctcgaaagtaggcaatgcaatgccattaggcaagacaagcgattgcacattgttctctggtgtcctggtcaaatcgtcatcagtatagaaacgccaaccagttgcatcagctccattgttgatcatcatcacatttagcacctaggaagataaaaaagcaaaatttaaaaggaatcctaggcatctgccatgtgatattttgataaaaaaaatcatccaacaggctgaaaaaaaataccgaacagacagcaaaaagaaattaaattcatcatgcacaacatcaaaaatcaggtcaagtatgattaccgcatcatcatgcacaacatcaaaaatcaggtcaagtatgattaccgcatcagagactacgatattttcaaactctttgtggtcctcggagtccaatgggggatcagcaactgcatatcttgctccgttcattagtttggcacatacttcagtagcaaaagagaacctagaacccgcatttgccatagaatattccaaagcgccagcagaatcaaagcaatgaaataatactccacgccactgcataaaaaatgaaaaaaggaaagatgagccggatacacgttatatcacccagatacaagcacaactaagtactattcacagattagctatcactatgatgacaaggaattcagacatcacaaaataactgtgaacaaaaagacattcaatctgtacctcatcattggcagcaccagccatcatgaagtcgcgtactggccttggaagtaaaaacctgttagcaaacaacatgtgcaattaaacccaagaataagtggagcaagaacaatctatgaactggatacgaaaccctagcagaacaaaaaagtatataggattttgtatttttgggatctacatagaaaaatatatcctaagctaccacagaagggagatacagataaaaataaagtggaaaacatgaaatcaacttcaagaagcagcatgaatcatagtggatcccgtgagctcaaggaacaaatacaaacgaatctagcggccataaagcgatcaaacaataggcatctggaattcaaataaatttctataaactcatgcattcgcattcgttgcaagcgaatgataactgatatcatacaaagcagatatacgacaggaatatgaacacgttgcatatgaataaatgaggagaggagatcaagggggatcatggcatactaacaaattgcatatcagaaaactaagaatagaagattaacaaattggagaccagaaaactaaaaaatagatagggaatcatgtctatgaacagatcacaattgcacataggaaaactaagaatagacagggaaccatggctatgaacggaacgcaattgtagatcacaaaacaagaatagatatgaacatgtcgcaattgcagatcacaaaacaagaatagagaatcatggctatgaacggatcgcggcacacatcgatgttagggaatcatggatatgaacagatcgcagcatcagaggagaaaacgaggatcacggcacacatcgatgctagggaatcatggatatgaacagatcgcagcatcagaaatcagaagagaaaacgagaagagaaggggagggatcgagatgcacttacagtacttgcggcggcgaagtcaggttgaaaaagtggagaagtgggtatttatatagaaagattgtgagctagggcatcgtgcttatccgtcggatcctcgacggacggacagatttctctcgtggagattatgggaagtgggccacggatccagcccactaggagctcgtcggccgtgtgtgtgggccgaacggttcagaaacagaaagttcagttgaggtccctcatcttgtcacccatagatttataaaatcatccttaaaccaaaatacgaaatcttataaaacgggattaaatttccttcggcagtatacatgcccggtttggctgacgtggatatttgacctgatccactcgtgctgattgggcacttgcatgataaaaataaaaagtaggtcccacgtgtcatacttagggcccctttgaatcacaggaatgaaaaaacgaaggaatattaaaacataggattctgatagaaatacgagtgtaaaacagaggattgtaaaacataggaaaaatataaaaatgaccgtttgattgagccgtaggaaaaatacaggaatttgaaaagagagataaaaactcaaaggattcttaccatgaggtagaacctcatgctaaatttcctccaaaacttgcatagaaagagacatttcataggaatttcatgggattacataggattcattcctctaattcaaaggccgatatagaaaaaatttctataggaatgaaatcctttaaaattcctatgaattttctttgaatcaaaaggaagccttactctattccattcctctcgctctcttccgtttctctttccatctctcgagcgagagacgggcgaccgcaaagggacaacaggcgcgggtggtctaggcgtttggcagcgagggccctcgtcggcgggcttggcggcgctgcgtcgtcgaggttgttgggacgtctccggagcccgaggtcggtgtagcatcgagggacggaggtcgccacgtttggtcggtccagcatattctttgcttgaagagaagaactgttaatgcaaattagatatcccaaaacaaacaaacccacaataaataagatacgtaataaaaaaaataccgattctatttagctctacaatacaaacactgaatgaatcaaaatgccagtgagcacatggacacgcacacgccaggcatcaatgaaaacagacatcacaggtttcatctcagttgagcgtaacatccatgaatgtctctctttttgtcttcgaagaaaaaagaaaaaataacaacagtaataaactctctttttaggcttcatagtttaactgcttttgctgaatgaatatagatttaattggcagaggctgcaggaat

SEQ ID NO: 83606 - DNA, 5413 bp, Oryza sativa
aaatatttcagggtgctttacaactgtcgcggccttcgatggatacgagtacatttgatcttttaacagtgactgccacggctcaaccaacaactaactgctgccgaatctaattcaagttggcccattagctgcttctgcggtggtgaggtcagctgctttagattgaactttgcgagcactgtgtacctctcgatcactccaaccatacatataatctgtccagaaatcaaacaagtccatcagaatctgaagtgaaaccaacttagcaaagcttcaaagcgtaaccagatgtgcaattcaaacaacgtaatgtactagagttcacacttcaaattttgaaaaggaaaaatgcaggaataaaaattagatgagataatcatatcgaatggagtagcaaactgaaaaggagatgcaactagaatgaaccaagagtatgctcttagattcactgagattgggagtcatttactttgcagctggtacatcaatcatgagccatggaatgggttggcaggcacgatatttatgacaaacaagtactacctccgtttcacaatgtaagtcattctagcatttctcacattcatattgatgttaatgaatctagacatatatatctatctagattcattcacatcaatatgaatgtgggaaatactagaatgacttacattgtgaaacgaagtagtcatgaacttgaatgggatggcaaatcatttagaagaacaatacaagaacatcagtttggatcatgacatgtacatgtgttttcactcacaatgtaccaatgtcatggacttggcagagttaaacaaaaggtggaaagcaaaagcatcataaacaacgtttttataagtccattttgtttatccaatgtcggtgccatcaggatgccaaaatggaatcaagccgaaaagatgatgggccctaaattatataatcatgtttataaccctaggtgatcatatctgtcttatctaatgctccattattagaataaatttgcaggtgtgcctggcttctagtacatagagagatcatggagcagtatatgttccttcactcctgaactatataatgccaactaatcattatggcataatttgcaggcatggctgctgcctagatagagatcatggagaagttacttctctcctgaacaataaaatgccaactaatcattatggcacatttcccagactagttaaaaactgctccagtaactgcatgatccttttcagccggtttcagtattggttaacttaaccacagagcagtacgcaaaagaacatgtcatcatattttattaaattgagcagtcaacaagaacttctgagttgcaaagtagagcgtcttcagcttgttcaaaaagtggttaggataacaataaagaaagaaaaaggacctcaatcaatgtaagatgcttcccctgtctattgggcattgaaaacactacaactacaagagtgtattattacttattaaatgcgatcaaggggggtattcttctgcaaaatctgtgtgactaaaaatagctttcagtacaattacatgaaatgtgacagcaactaattcaaaagcttcatgaaagcggttcttacagcattaaattctgaagttacaaagctttaaccgcccatgtgcttgagtcatggatcaggccttggagctatataaattgtttgccagaaatcaaactctaaattccaaacatgttgtattcatttgaataaacaactgttccaataggttctgggtgaaaatgataggatatatgattagtttaataacaaaacattatgtggattatggaccattacactagaaatccacaaacaatcaaaatgcattaaagatcaacgaaaatttaccttctcaatctgcacaataataatcctgtttggactgttaaggtcaaccttgtgaggttgaggaacagatttggatactgcattgataattttcatcctattgattcttgtattcgaccttgcttcataaaacacaccaaaactgcaaagattaaaatatccaagtaaagaagcataattttagcaaaataacatggggaaaactcaattcacattttcttagtactacagtcagctcttgcaacttcctgtatttacttggcaatcgtggtgtatgtcgcatatatttttgtattgggtggataaggggcataaaatattgtttggtcacctctactccctctgttcccaaatataaacatttctaggtttttagcagagattaaggttaaggagaaaagactatggtgccctcctaactgagaataggagggtggttggggtaagattggaagaaatttgactgagtggtggttggtgggaatagtactctaggaatgctttatatttgtatacaccagtaccatattccaaggctcattatgtttgaacttcaaatggagaacaatgtaatgaaattaggaaaccaaacttatagggaaattaaattgaagcatatgagcccacagacaaatcaatgtaccatactcaaaaaggaaaatagatcgaatgtacataccagtcaacctacacagcaatagaaaaggacgttgacccatttggcacaaacaccattgtctgagattttcattagtagcccaattcctatcaatatgccaaatcaaggccaaaagcatgaatgcatcaagagtttagtggtagaaaaaactatatgtagttctttccaccacactttataatttaggtgtgagctgagctaagataattaaaataatacaggcaagtggtgctatttgtagtattatcaaaagtcagtaaagcaaagtgtcaacaggcgagaaatattcacccagggagaagaaaaccatatgttgaataaccaggcctttgcagtggtgttctaccaaggtagcaatggtacattagcaacgaagttatcggtatagctagcccaataaggcagtcatagaaatattttcccatttaaatcagctattgcaatatagaaaacttgcattagctttttttttctccctaaccaggattattggcaattgctctggcatcccaactaataaatcatgctataattctaccactaaactatatgtaattacatctaccatatgatttgcaagaaaacagggcgatggattttgcctggtgttgccaatgctgaagcttgtcagtgtgggtatcctggtcaaatgtcagctgctgattttgctccccattgccaccgattttggtccccattgtcgctaattcaaaatccttgacaccagtgcagcccaaaacagagcaagttctgtgggagtgaacacacattagttttggttcctggaggtttaagttcccttaaaagacagtacatgttctggattttttattcagtaatatgtgtttcagcattaacaccttaatctattctccccccatacatgctactaaaaagtgcaattattagtggtgacatatcctgtaaagatgtagaagtatatgcgatcacaatacccaagtcaccaggcaataatgcctcagagctagggagaccaacctgcatgcactgctttgaattgtgtccaaacaacccacaaacaaagcaaggcttcttccgccttttcattggatagctcacaactacatgatcctccctcctcagcaaggtatctcccaggatcaaaatatcttggtatgccctgatcatgagcagaagcaactaactattatcttgtgcagcttgtacatatatacaaggaaattcactttgaacttacagtactgtcaaataaaggggcatcaggcccatcttcagtgagcactgactctacggtgctggtttttgcctcctgaataatccattcccaacaaagaaacatctgacgtcaattccaactcacaaacataaatcagttccctatatgtaaggtttccataccataataaattcacaattagttcaatacgcatattttctaagagataacaacataagacattatttttaacttggattctacagaactgaaagagcctttccattaaaaaaaacattgcattgtctttcagccattttcaaagacagatattactcagtatagctcacaatccaagtcgattctggctgcgtttgtttaaataaggcctccgattttcttagtcatccatgaatcacagatttgcttgctgaactaaatgcataaatagtacatgaacaagatcaagggaaaagacctactcgtacctactcctcgatggcggccggttcagcctcgggtgcctccttccgcgctgcttctgctcctcctcctccttgcgcccggcctccacgggcacggcgcaaccgggcccgccggaatcgcgcggtaggcggcggcctagcggtggtctagtcacggccatggaaaagagaggagtgacggacgacggactgccgtgcgaggtcggggagaagggcggtcggatcttggagtgttctgcgacgagggcgagtcctgcgatcggctgcagcggctgaacggagcggcgacgacgacggaggtgatcgggatcggcgacgagccgcggcgctagggttagagcgggggaggggcggagcagtgtcagcgcgtcctctcgatgatggtgaggagttcagtgttttgtgtacattttctttgtgcatttaagaaagaaatgaacggcttcgttttatattaaaaaaatagaaacattatattagcatagataaacaaagaacaatagcagttagtatacccacgttactacattcgtcccaaaatataacaatcgaatataggatgtgacataaacaaataattatagtgacaaaataggtagaaaaattcaactcaactgtgcggtcaaatttatcagttggttttataactcttaatcactatctgacacttgatgtgtatggagtgcttgggcgagccggccaagcccgatgaacacagcggcgctgcccgggtacagcgtgatggcctggtcgtactgtcgcagcgcactcgccgtaattgtccttgtaccgctcgttcccagccccgggtcacctcctcctgaagactcactccctttgctgcattgatggggcaggtcaactcgccggagaccttgagtagctgccgtggtacggactagctcccaccacaaaaaagaagcagctcttccacgactctgtcaccattgactctatttattattatggtaaatcattgtatcaagatgtcaatcttagatcttattccagttcgatacatccacctacgattggtaagggggtcgacgattccatagcttctcgaatagtgagattcagttttaagggaggaaggaaattaaaaggaaggagagttgggaaccaatggcaaaaaaagtagagagaattctttatatgccactgaaaattggtctga

SEQ ID NO: 83607 - DNA, 9944 bp, Oryza sativa
  unsure (1)..(9944): unsure at all n locations
cttgccgccttcggcctactcccgcctgttgccgtccactcctcaaccgcgtctccgctgcttccatagccaccgccgcagcgggctcgccttcgccgccacgtgtcgtcttacctcacgcggctgtcgccgtgctccgggagccccgccatgggcgtcgtcctgctcgtgtgcgtcgatggccgccgccgctccggttacgctgcgccccgatgccgccgccgctctcctcgtccgtgcgccgtcgcgatcatcagtggaccccagcggtgcgccgccgcctccccaccgaggccgagccgggccggccgctcgctctcgccgccctcccgcccgccgccgaatgggaagaaggggagagattgagagaaagagagagaagggagatagggaggaggaagaggacagacatgtgggccccacatgtcagtggcccacatttctttttgtgccaatgactaatgggtcccacgcatattttttaatcctactgccacgtaagtgccacatcaacgccacgtggaccgaagactcggtcaatatcgccacataggcgccacgtcggcgaaaccacctcccaaaaccggcgagggagtcaaattgcaccggttttgcaagttcgggggtcaagatttctggtattgaggttgggggatacgatttagattccgtggtcagttgagggagtcaaagtgatcttattccccagcaagaagtgagtgtcattgccacgcgatttcaaaacaggcccaggaacagaattgtcattcccgtgataactgaagatttcgtcagctcagttgtgcctttccgggagctgtaaggcggtgttcttttctcaagaaaaaaaattaagtgttttattcaaaataagttggtatttacgtatgattaattgagttttaatcattacaaactaacaaaaatagattaatttggtattttatagtaactttcatatagaaagttttcatacgaaacgtaccgtttgactgtttggaaagtgtgtcacaagtattcaaaattttatccaatttttattggagaaaagaatagaccctaagattttctctttaatagaggaaggagctcaaaattaagcaatttgctgggtagtcaacgggtgaaaccaggttacctagctataattttctggattacatagcaactgattatcggaggttgcagctagcagagctcccaaacagggtttaggtcctgttttttttccaagagttggaagaagattaaggttttcatggcacgtttttcaagctgctaaacggtacgtttcacacaaaaactttctatataaaagttgctctaaaatatcatattaatctatcttttaagtttataataattaaaactcaatcaatcatacattaataccacatcgttttgcgtaaaaaatttagttttcatcttcaagagaaaagaacaccaccttagtccacgttcggttggagaggttggaaaccttttctctggacacggaaaacagggctatttattaccatatgattattaagcattagctagaaaataacttaaaaattgaattaatatgattttttacaataacttttctatatgctacatcttgattaattagttgataaaatggataaaattaaaggtgacaaccacctcactataaaacttgctcttaaaagtttcgggagaaggtacagctacaaaaagctccaattagagctttttagctcttgtttgtttcatagtcactcttatgacaagattctttctcgttttttaatccaaaatgtcaactgttcaaaaaagtgtggcgcaatcctacttttactagttaaaggtgtgactcacctttttttattagctaaaatttatacatgtatgaaacaaaagtatagaaaatgatgacaaacttagtatggcatccaaccagaagttttcggctaagccggcttagctgccatgtaagaacttcacacatggttcttccggtcccggcctagctgtatactcgaacggtatgaagaaccatgtgaagttttcgcttagctgcatgcctacttacatcagttctttctaatgttgagacgacgacgacgacgatcaatacagtcagctaagacaaccgatgacaattttgacgattagttgtgccgtagctttcgtgggtgagctactgactgtgaatgcacccagccaccacctcgtcgtagaggcatcctgacaggtctcactcactcacggcctcagacgggacacgggcatgtgcacaggggctctgatcgactcatgccgtttttgggtaaatccgttatctgtctacgatagatgcggttcgtgatcactgatcgccgtgttcttccaaattcgcgaaacacgctagtctgtagggctcactcccgtttgctttgcatttacgcgcggtactggctgttaattatcgttcgaagttgacacttgacactcacagatcaagttggtttgtcggtgcgcattgtgaacaattcaacgagatgaatttcgtacaaatttcataggagatcgacagatcgttatattctcaccagatcgaatttttatttattttttaaaaaaaggcaataacacttctggactattattaccgctcactaggttaattttcaagctgaagcctatgtccctttgtcaaagagatatacactctcgaggctagtttcttaacgtggtgtcttcgataatgtgtgtttggttgaaaggatattttgggataaaaaatgttgatggaacttttatgcatgtttggttgatgtgcaatgatggatagggtggtcggaaaagggaatatttcacaaaggtgctggatgagtgtatatgttcaaattaatcgattagcaataattaatatatttggttgttaattactccatccgtttcacaatgtaagactttctagcattgctcatattcatatagatgttaatgaatctagatatatatgtgtgtctagattcattaacttctataaatgtggacaatgctagaaagtcttactacctccgttttttaatagatgacgccgttgactttttctcacatgtttgaccattcgtcttattcaaaaaatatacgtaattataatttattttgttatgagttgttttatcactcatagtactttaagtgtgatttatatcttatacatttgtataaaatttttgaataagacgaatggtcaaacatgtgaaaaaaagtaaacggcgtcatctattaaaaaactacattgtaaaacagagggagtaataattaacatgtcattattaatgtttgattagatataactggtcaatgttgttatttattagtatagattagggttcaattagtgataattaacatattttgttattaatatttattatttttatttcatccattctcatacatccaacgaataaaaaaaaattcttaaccatcccacgataaaaaattgaataaccatatccttgaaaaaaaaactgagacatcgtactcgtaagcacgatgtccctcatcatatcaggtcgtgtttagtttctccctattctcaactttccatcacatcatatcatatcaaaaaatttcttatacacataaactttcaactttttttttccaaaatctcaattttttttaaacttccaacttttctgaggaactaaacacacccacaatacactgttaataaagaaaacatagacctgtcaactttatttcatgtcagccgtcaactttgtcaaactttttgtcgggctgtaaagtcctaaaaatccttctacagtattttccctagcactagcctcgagcactcgatggagtagcgcgcggagaagcaatagtggcgacccaataggtttacaataggattttattgagaacgagaatatgtcacgggagtataccaaatgacgtattcacaggacgtgaatgtagtgttccaatctaaacaaatatataccatgcgagcaattattcaattaagcgtatctctcatcttttattaccagcaaggaagttttgtaataaaaaaaatggtttacatctccgaattgccaatgagcaaataattcatattcattgtgtacacgaggtaaatccattcaaaatactcctagaactacaaatctagacatgttcatatctagctttatagtactagaatacgtcacatctaatcaaaatactttatatttagagatagagcatactcttcctctgtccctaaataactcaaaccctagcttctcaaggagtttttaagaagagaaacaaaagaccacgatgcccttaattaatgtgaatattgtattgaataattggtaggtaagggtattaaagtaataaaatttctcattttgcggattagtggtaagtataagaaggtagaagttgatttattttggaataaatttgaactcttcaagttgatttacttcctcattagnnnnnnnnnnnnnnnnnnnnnnnntaaaacgtgttgttttgaggtttctcaccaaaattagtatccagtgcaaatgactgatttaccctcatttatttcattcgccacacacaaaacaaaaccgccgttggagggtggggggaggcgaagagaaagacgaagccgccgtcgaggacaccgccacaggcgtgctcctcggagtcgagcacaaagccaccaccgggatgcccgcgtcaaagttgtagccacctgcatgttgctcctcggtgagggagtagacgccgtcggcgccgagcgcccaaccaggacttcgcctgcaacctcctcgttctcatccacttgcctttgcttgatgcgcatcgacatccgcttccgccgcctgtccattgcgtccggtcatgctagccagctgcattgtgatctccacggcggcgacgaccggtgaatcaacgcgcgcctgccgcgccactcccgcgttggagaggagaggagataggtgagggagagtgggatactaggattggggattgcatgagggacggggagggggggtggtggcgatggaggagttgaggcgagagggatgacggagaagtcgatgcgagagtgcgagacagcgagaggataagatcgcattaagtggtgagaggtcgctcgctggaaaaataataataaaaaagaaacgagtgattgagggaagtagacttgagccgttaaaaactcaaaagttcgaactgacacaggcgagccgtacacactgtagttatgtggtgcactggtcggttccgctgaccacccgtgactcttaccacgaccccgtccccggtgtggccccacctaccagcgacacacgcaggcggcttcttctcgtgagctcgcggtgaacccgaccacccgccgctgataaacgtcgccccccttgccacgacacgcgctacgcccacccatccactcgcaccccgcgccgcaccaacacacgcagaggtggtgaactggttgatcgatgcttgctgctgctgcgcgtcgaggcggctccatcggcggcaaccgctgatcgatcgatcgatcccgcgggtttcgtagcacccgagcaggtgagcgagcgagcgatcccctcccgcgcggccgcgcctcgatttggtcgcgattggtgctggattttctctctctctctctctctctctctacctttcctgtttcggtgggggttttggtggggttttgtggctcgaggtggtcggggatttctggggtgatgggagaggggctcgcgtggtggtggattgttcgctggaatggcggggaatgctgtgccgtttgggggattgatgccatggtgatgggtcgaaatgctggatggggttgagtttgttcaagtggttttgaattggaatctgtggagtttggggggaaatggggaatggggcttcgagtgcgcaaaggttttgcatgtgcggaattgcagctcgaggttttcgctggatttaggcgtagcttctgtgcgcgtgtttgtttagcgattttagcagttcgtgggctggtgccgccgcgtgtttgaatggtttagcgctttatttaccgttacagttgatgtctgcggtttttctggtgatttatgccagtttttagaggtgaatcgctgtgttttgggggaattctagagcccagggttgggtttatgggggcgagattttagctgttggattttaatcctatattgcgagaagcatgggagaactgcgatccgtcgtcagaggtgaacgctttcgaactctgatggttttaatgtggcagatattgtgaagcttatggtagcttcgttaacttgatcgacgtttttacttgtgctgctcgtgcgttgtggtagatttggcttgtgagagagcaggtggatggggtagattcagattacagagtggtttactgcatgtagcgatgtgtttgagttgtaacttgtgaggctgtaagattaaaatgttggcatgcgtggggtttttgggggtaatattttgttttgtttttgtttttgttttttgctagtgttttgacccaatccatctcccccatctttttttagtggaaaaccgctccctgttggtactactcaagtaaacttaccagaattacaatcctccaacaaaggaataataccctgtgctgtttgttgtgacaacttatctgtacatgatattgctagtttgctactgcagtatacctacatgctcacttatgtttgtttcttttagataatgtcacttatgtttgtgttttgcataatgttgataatttctcgaagaatgggtgctggaaagaagactcagaccgagaacgagttccgtgagctcccggaaaaggagctaggaggggtggtcttttgttgcaataacaacacattcgatgaatgcttcactaaacagttatttggttagtaaaagtcccttttcgcctgtcctaatttcatctaaatgatatgtaaaatccatacgcgtgtgattacttttattcaagaacattgacattgctaatcaacattcttttgaacttctcgtttaattgggaatccattcgtttgccttttgtttgataggtttgcctcaacgcaatatcttgtatgtgaagaatgttaaacctggcttgcctctctttctgttcaattatagtaacagacaattgcatggcattttcaaggctacaagcactggccagcttaatatcgaccgatttgcttggatgtctgaacagtctaatgatgcaaagacaaatgcaaagacaacaccatttcctgcacaggtataatagaaacaacatatactggtctttgttctggttatagtttcataagcattgtgagtatttgtgttcttcaggtccgcttctctaccaggacagagtgccctccacttccagaaagcaaatacaaaagtgtaatcataaacaattatcgcaaggataaacctagccacttccgttttgagctagaccatcgaccaacaagagatttgatttctttgtttctacctgctcctgttcgcgctaatcaaaacaaacttagtattccaaaacctcctgctaccgctcatactgttccaaatccatggaatcgacctctgccatttcttacagcaaaagcacctgttgtttctgataaagtgaagagtgaatccaatgtgaaggatgtggatcagttcaatgtttcatcacactcacatgatattgttcctcataccttgcctgatgtagaagtcgaccttgctagcacaagtacaacatcaaggagcaaccttaacaaagatgcttctggctgtgatgacctggttgctggtttgatcaaggaagataaagaatctgtggatgatgaccagcatgctaaaatggatttaccagtaaagctgcaagagctgtcttctttacaacagaaggaagccaatttcttggaggatgctcctgtttctacttcagctcaaagcatacgtcaagatacacggtttgctgctactctccccaaagattcatttaatgccacatctcaatgtgacacatcattgaaagatacatcctttgtgcaatgccatgaatatgctgaggtgccttaagctattccatcccttattaccattttcccttacgcaccatatttcagtgctacaacttatatattttggtgcgatgtttatggcctgctttttggcatttgtctgtagctgtatcaaattatcaatgatttatccaagaagaccgaagaaatggaaaagatgaaggtacttttcttcttgcttaaaatcagtaggatcttctcttttaaagaagaaaaggtataaatagatgaacccgttttcctaattggttttatctcttgtcagtatgtctggttttgtgggttttaaaccatgttcaaattttaaccggaaaaccaaactagtatatatgtgtttgatattgagttaattacgctgttcaagtgtgcaaactccgatcttgattatggtttgaacgttctaggttgattcagatcaagaaattttgttgttgaagaaattggtaaaggttatggaaagaaaagttgaacatctggaacagcagcttgagaaatcgcatagctcttcagcaccactcttcggtgtaacaaatgatgatgtagaagggccatcaatactcctaacaggtggccataatggcattaactggctgtcatcccttgatcatattgccctgcaacggacatactagaaactctaatgccaatgagctcagcccgtgcatatgcggctgttgccacattaaaggaccatgtcttcatttttggtggttggaatggcattcgcagttgtggtacaacacaggtaaacattcttcaatatgccaaacgtagtgctctatataagcaagctgttgaccatctgcatttgtttattgcagtggagtgctacaacaggggagccaataagtggataggattgccctgcttgaatcatgagaaagggcatcttgctggagctaccttgaatggtaaaatatttgctattggtgggggtgatgggtctcagtctttttcagaagtagagatgtttgatccagcagtggggaaatggatatacagtttgtccatgcagcaacctgtatggttctacttctactcccttataacacttgtatagagtagaatgtaccagcctttttggccaatttaatagggtcctggtcttcgctatgttctcactgtgattttcttgataaggctcaagatttattagatggcccaggaaaaaaacatgttgtgaagagaggctgtttgaactgcatttcctataatcacttacatctttgggttcttaatcttttacaagatgaatagtgctgctcacagaacagtttctactattatttcaatcatttcttacgtgtcgtaaatcagtaaaaaagtttgttctcgtggtgaactatgctgagtgatttagaatttagatagctgtttgagcagtagtgggcaagctgactgtgagttggacattcgcttgagcactagtcttacagggttggttggaccatttgcaaatctaatctaagctacattttgagcacttgaataggcaataaatatttttcaaattcaggctatttcaaattatggaatgcaaattgcaattcatgtaatttcatgggatttatgaggcatatacattgtaactttccagttcaccttgcatgaaatattatcccatatttttaatgtatttttatttttgaccaatatacccacctcaccaacatgtattttattgttccagcgatgtgctcctgctgcggctgaattaaatggcgttctctatgtaattggtggttatgatggcaacatgtacttacagttacgatccaccctcaccattctctccatgctttacttgattttgattctgagaccttcctattgaatgattgatcctcatatgcacaggtcagcagaaaggtatgatccaagggaaggcttctg

SEQ ID NO: 83608 - DNA, 5298 bp, Oryza sativa
agcatttggcaacaggaaaaatggctctaatgaacccagaaatgcagaaaagcggttcgcgtcatggtcctgtttctttcagcttgggattattataatccagattattagtagtaagctgaaagaatcagacaacttattgaagtagcttattataatctggagcccagcttattataatctgataagctcatttaggtgagctttttctagattattgggtgaaaaattacccaccatatgccaccccactccctcattatacttgcaaactcaataatctaggctctaataatctaggaaagaaacaactaacagcttattctactatagattataacaatctagtttatagtagattataataatttcaagctgaaagaaacagggcctatagttagagagaatcctccacctgaatttcgtgtactacctgcctctgaaatctcgtacacgcagcttgtccttcaagctcgagcaaaacctttgctcctgtgctagtactaggcagttaggcagacctgcagctgcaggttaggatatgagaggttaggctcatattcgttgcttagcatcgttgcactgcattccacaccaacacacgaacactgcattgttccacagtccagattccccacgaactgatctgcctctgactagtacacggcgcaaaggagaattcagcaccgccaacagtagcagtaattcactggattactggcgaaattgttgcagctattattcccgcctgctcccagcaagcagaacctgaaaagttgcttcaaaaaaaaaatcaaaaattataccagcttccaagcctcccatatgtactgctatcaccagctaaagtttgttcattcgaacttctctaagtaactagtgtcctgtagacagttcagtttgctccgctacaatcaggtgacaaccaacaacacctatcttcagtgagaaacaacaacgggcagagttaacgcataccagaactcgctacggtgttgtttctaaaatgtaaaaaccgtatgactgggatgcacagaatggatgggccgtcaggcgtcagtgctcagcaatgagcggcaatatttcgcttgagagaaggtaatactgtgaggcggggttggggactggtgctgtacaaaaccggcccgggggttcatctgcacttctgcaatcctgtcaaatggcaacggcgcatgcgaaagctctcttcccggaatgccttggaaccagagatggaccagccttggccctccttgtaaacctcaacctgtgaaataaaaaacaaaacaaaataaaacgagagaaggatgtgagagttcggcgagttgaagcaacagcaatggatgatggagagagtgatcttgggaaagaactcacagtttcaacgtattcttcactgctttggataccaccaatgaggtatgcgttgccgtccaatgtaaccgcacatccgtgtgctcttgggacgctgagtgggctcccccttctccatgagttggcacgggtgtcaaaaatctctacgctggaaaacgtggtatttctattcaggccacccagagcatgtctgaaaatgaaattcccatgttggatgttaagtcgtatattatcaggtttatatcgagacgtcaaataaaagatagtgatataaggctaatagtagcatctaactgccaggtggaatctgtgtgtgtgtttttttgaaatcacatgacctctctgttgattacacacacagataaagcgagcgaaactcacagtgaatcccccaagacaactactgaatgggatcctcttcttgtccgcatacgtggaagttgggtccagaagccttcccttggatcatacctttctgctgacctgtgcatatgaggatcaatcattcaataggaaggtctcagaatcaaaatcaagtaaagcatggagagaatggtgagggtggatcgtaactgtaagtacatgttgccatcataaccaccaattacatagagaacgccatttaattcagccgcagcaggagcacatcgctggaacaataaaatacatgttggtgaggtgggtatattggtcaaaaataaaaatacattaaaaatatgggataatatttcatgcaaggtgaactggaaagttacaatgtatatgcctcataaatcccatgaaattacatgaattgcaatttgcattccataatttgaaatagcctgaatttgaaaaatatttattgcctattcaagtgctcaaaatgtagcttagattagatttgcaaatggtccaaccaaccctgtaagactagtgctcaagcgaatgtccaactcacagtcagcttgcccactactgctcaaacagctatctaaattctaaatcactcagcatagttcaccacgagaacaaacttttttactgatttacgacacgtaagaaatgattgaaataatagtagaaactgttctgtgagcagcactattcatcttgtaaaagattaagaacccaaagatgtaagtgattataggaaatgcagttcaaacagcctctcttcacaacatgtttttttcctgggccatctaataaatcttgagccttatcaagaaaatcacagtgagaacatagcgaagaccaggaccctattaaattggccaaaaaggctggtacattctactctatacaagtgttataagggagtagaagtagaaccatacaggttgctgcatggacaaactgtatatccatttccccactgctggatcaaacatctctacttctgaaaaagactgagacccatcacccccaccaatagcaaatattttaccattcaaggtagctccagcaagatgccctttctcatgattcaagcagggcaatcctatccacttattggctcccctgttgtagcactccactgcaataaaacaaatgcagatggtcaacagcttgcttatatagagcactacgtttggcatgttgaagaatgtttacctgtgttgtaccacaaactgcgaatgccattccaaccaccaaaaatgaagacatggtcctttaatgtggcaacagccgcatatgcacgggctgagctcatcggcattagagtttctagtatgtccgttgcagggcaatatgaatcaagggatgacagccagttaatgccattatggccacctgttaggagtattgatggcccttctacatcatcatttgttacaccgaagagtggtgctgaagagctatgcgatttctcaagctgctgttccagatgttcaacttttctttccataacctttaccaatttcttcaacaacaaaatttcttgatctgaatcaacctagaacgttcaaaccataatcaagatcggagtttgcacacttgaacagcgtaattaactcaatatcaaacacatatatactagtttggttttccggttaaaatttgaacatggtttaaaacccacaaaaccagacatactgacaagagataaaaccaattaggaaaacgggttcatctatttataccttttcttctttaaaagagaagatcctactgattttaagcaagaagaaaagtaccttcatcttttccatttcttcggtcttcttggataaatcattgataatttgatacagctacagacaaatgccaaaaagcaggccataaacatcgcaccaaaatatataagttgtagcactgaaatatggtgcgtaagggaaaatggtaataagggatggaatagcttaaggcacctcagcatattcatggcattgcacaaaggatgtatctttcaatgatgtgtcacattgagatgtggcattaaatgaatctttggggagagtagcagcaaaccgtgtatcttgacgtatgctttgagctgaagtagaaacaggagcatcctccaagaaattggcttccttctgttgtaaagaagacagctcttgcagctttactggtaaatccattttagcatgctggtcatcatccacagattctttatcttccttgatcaaaccagcaaccaggtcatcacagccagaagcatctttgttaaggttgctccttgatgttgtacttgtgctagcaaggtcgacttctacatcaggcaaggtatgaggaacaatatcatgtgagtgtgatgaaacattgaactgatccacatccttcacattggattcactcttcactttatcagaaacaacaggtgcttttgctgtaagaaatggcagaggtcgattccatggatttggaacagtatgagcggtagcaggaggttttggaatactaagtttgttttgattagcgcgaacaggagcaggtagaaacaaagaaatcaaatctcttgtttgtcgatggtctagctcaaaacggaagtggctaggtttatccttgcgataattgtttatgattacacttttgtatttgctttctggaagtggagggcactctgtcctggtagagaagcggacctgaagaacacaaatactcacaatgcttatgaaactataaccagaacaaagaccagtatatgttgtttctattatacctgtgcaggaaatggtgttgtctttgcatttgtctttgcatcattagactgttcagacatccaagcaaatcggtcgatattaagctggccagtgcttgtagccttgaaaatgccatgcaattgtctgttactataattgaacagaaagagaggcaagccaggtttaacattcttcacatacaagatattgcgttgaggcaaacctatcaaacaaaaggcaaacgaatggattcccaattaaacgagaagttcaaaagaatgttgattagcaatgtcaatgttcttgaataaaagtaatcacacgcgtatggattttacatatcatttagatgaaattaggacaggcgaaaagggacttttactaaccaaataactgtttagtgaagcattcatcgaatgtgttgttattgcaacaaaagaccacccctcctagctccttttccgggagctcacggaactcgttctcggtctgagtcttctttccagcacccattcttcgagaaattatcaacattatgcaaaacacaaacataagtgacattatctaaaagaaacaaacataagtgagcatgtaggtatactgcagtagcaaactagcaatatcatgtacagataagttgtcacaacaaacagcacagggtattattcctttgttggaggattgtaattctggtaagtttacttgagtagtaccaacagggagcggttttccactaaaaaaagatgggggagatggattgggtcaaaacactagcaaaaaacaaaaacaaaaacaa

SEQ ID NO: 83609 - DNA, 2401 bp, Oryza sativa
tcttaagatgtccatctagaaaaataaccttatttttttttgcggctgcttaacaggatcgtctgtaaaaatgtgagtcgatttttacagacacagatacttggtccacctgcaatctattgatgtggtcgtccaggaaaattatttttaagtagtgattatttatgttggtagctatattattctccatacagataggttttgctattttacttgtgacaggttttggggcttctttttttatattttgtttataggattttgcattaagattcgtgtttatgtaattctaacttgcaattacactcatttatttaatacgtttcatgtagtattaaagtaccatgacgtcttttttctttgggcctgaaactgaacgaaagaaaatggatgtatttttctcattctttgtagaaaggagccatataaacgctatgtcagctaaaattgggaagctgaggaattttgtttgcacttgttttgaatgttggaagatgcattgtggctgtgcttagttcccttcaaacttccaaatattccgtcacatcaaatatttggacacatggataaaaaaaataccaattgtacagtttccatgtaaattgtgagacgaatcttttgagcctaattacgccatgatttgataatatggtgctacaataaacatttgataatgacggattaattagatttaataaattcgtttcgtagcttacaggcggaatctgtaatttgttttgttattagtctacgtttaatacttcaaatatatgtgtccgtatactttaaaaaagttttggctgtggaactaaacatggcctgtctctggttttcgatcgagggatgattttctaattcggtgataagatgagggatcttcgcagtactttttccacatcaaaattacagattttgtatgggcctcagacatctggcccaacaagggtccgactcattcttcaattttcgaaaatacgtaacctctggtatctgactaagcaaattatgtacgtactcaaaattctaaacttacagtatagttaaatttagcacggttttccaaatagtaagtgatttttaatttgtcctatatatttcgatgtttgtaacaacaaagactaattatagaaaattacattcaaatctcagttcaacggtattaattttatcaaataaaatttaatttatattagatttattggtcgtgagatattaccagggttgaattaatatttatgcataccttgtattttttttggaaaagagggtacaaatggttgactgaaaaccacaacaagttttcttaatcgaaaattacatcaagtttgatttgcagcaaactaataaaatcataaaaaaattacaacacaagcacacaagggcaacaacaattaaaaaatagaaacacaaaagaaccacgtatccaccgtccaattagaactccatgccttccaaattgatgaaactgtaagtgtcgcaaatgcaggcacattcatagggagcctagcccttaggagggcagatcgccggccggaaagcgagtgggccggtggcgtacatgacgttatagtagtcatggtcagcccaccgcttgccctcgtcatggagcggcgcaccctcaatgctagagtagttgatgtttgtggggttgttgcattcgaagtccggcgaggcccgaagccgcacatagcacgccttgcgcggatcgcccatgtagaagtcggtgactttggtctcatcgagctccgcgcggaagtagccgttatcgttggagacggcctgacgacacctcaccatggcacgattcttggcgtcgtggcagatgatagacacttccgccttaggcagcggcttcgcgccttcgaggctgtgtgtgttcctttgcgcgcagctctggcagtacaccataccctccaccttcaccagcagcttgtcgctgtgggccggcggggtgtactgctgtggcggaggtggtggcggcgatggtgatggtgtggtgtagccatagtttgctgtggcgccggcggccatgagggacgcgaacaggatcgcgagaggaaggaagtcagccattgctctgagcacagctccgtactcgactgatgagatgttttgttttgaagctttggctgtgtcgaaacgtagagaagcgtgtgggttatatactgcatgccatagactaaatgtgcggacatgtagatggaaattaaacttgattttggattaagatcacagtttattttttgttattcgattctgacaatatatgatgatttgcccggcgaaagaaatgataacatgtaacgattgatctgtaaggcactttaagagaagaaatgacatgctcatgatctgcttggtgattagttttgaatttgtagactataattctataaagaat

SEQ ID NO: 83610 - DNA, 5475 bp, Oryza sativa
tgagtctagggctgtgtttagatccaaaatttggatccaaacttcagtccttttccatcacatcaacctgtcatacacacaacttttcagtcatatcatctttaatttcaaccaaaatccaaacttccccctcaactaaggttgcgtttagtttagcgaaaagtttggattttggttgaaattggagatgatatgacttaaaagttatgtgtgtattgatgtgatggaaaagaactgaagtttggatccaaactttgaatctagttgagggggaagtttgtattttggttgaaattgaagatgatatgactgaaaagttgtatatgtataataggttgatgtgatggaaaaagactgaagtttggatctaaacacagcctagatgcatttgatgcatctgctactgcactgcagctgcacagttggtaatctgtccttaacttgactggatgacaaggaatttcctcgtaataatatcgcttgcactgtaatcaatccatcgccatctcttcaacgacaagatatgagtaccatacgagctgagaagcctgagatagaggagctgatgtgacagcactcttgaaaggcagaaaaaaaaaagccagcagcatcctccccttttttgtgccatatttttcaaaaattaatgattctcactttctttagcagcgcaaacagatttagtaaagaatttataacttaaagtttgtactgacaaatattctgagtataataaataatttagtaaagtaaaatataaaaccttttcccactgttttggctacagttaattatatactataacacttattaaaggtaaaaaattatgagtaagacttttagatgtgtattacgatgaaaaggcatcaaaaattcaaaatcaaatttctttcttagcaaacaaaagtattctctttgctacttaaaataataagtagtactatactattactttaaaaccaataaaaaaaataaactacaatgaaaagcataaacaatccaatatcaatactgaaattaaggtttgacattcacttttttactgtgaccaagttgaaaagcaaacgccaattaaaatttttcggagcacattcgttccagaaaaagaaaagtttgcgctttgcagagcactcgagccagtaccactcctcccttttgttctccagcgtccaatccgcatcggcgacgacgtcatcggctaaccgatgggccccacgaagcggaactcaggattcaggaagtgggtgggggcccactgggcagctgctcgtcggggatccaagtcatccgtaacgcgtacggacgtggcaatccgagttgcacacgtggccttctagaagcccgagttccagcccccgttcacacctcaggcctggctgtcttccccaattctcccttttccttccccaattcttctggtcatctcatctggtcatatggggtctcgtttggttcacggaggcattgatgcgtgtgtgagtgtgagatgcggtcaagttaccagtttttgccgctcgtggttttgaaaaaaaaaaaaaactgcaaaatccgctgcatcagaaaacggcatttgagtgcatatgaattccaaattttgttctaaatttgaggagaattcgaaatttcgaaccaacggaggagaggagagagagagagagaggcatcgcattctctcgtcgaaatggagggccacccaggcaaagcaaagcaaaaatcaccctccctatcggcctatcgctcgcctcacgccctcaccctcttttgtcggcttccccgtggtgggtcccacctcccaccatccttactatcccccgcgcctcatcggacggtcgaggaagcgagcaccggcgacggccgtccgatcccgatccgacggacagcatcgccgttcaaaccccccatccacgtcaggtcaaaggcgcgaccgcgtacgtgtccctgggccgcgccgcgcgagtcacgcgtgccgtggcgctcccctcccctcccctcccctccccgcgcgccgcacgtgagagggcctctgcaccgtcggatcgcgatcggacggccccggatccgccgtcagtggcacgggcccacggcgtcacgacgcggcagcgctgaccgccgcggcgggggagacggggccgtgacggcgtcaggatcacggcgaggggaaggggagagagagagagagagagagagagagggggggggggtataaaatgcgtggcacctccggctcgggtataattatcgcagcacacgaaaagagaaccagagagagagagagagagagagagagagagagaggagtggaagtggatcggggcatcgctgcggcgtcggggctgtgcagatcggaggaggtgagagctctcgtcctcgtaccatccatctcatcggattccgtgctgccgtggttgctaattttggcttggtttgtcgaattctttttgggctttttttggggtgctttttttggttggtattacccggggtttgcttcttgagggtgaaggcggcgtctccgagcggtttccggtggaagtctagtggtttttcggcgaggagatgggtttcagttgggtgagctaggtttattggacgaatttgttggggatttctgttggtttgagccgattcgatcgcgtccgagagcattttgctgttggggacgagagggcgcctccattttcgggattactgagtttatcctgtgcaaattttgcaaaaaaaattctactaattttggtccgtttcataggtgaatcgtcgcttattgagtggttcgttaggttagctcttaactgcgccgcttgcatttgttgccggaatttattattatctactccacgggtaactcgagggcgtgaagtgaaagctaattatgtcgcccaaagttactgatccctttttttttttgttgaaactgagctagcttaatttgcctctgttggcttgtggagacatgatgcagtacaaccaagtagcagcaacagtttttgccctgtgaaacactggaaccatgatcccccttttttgtgtgtgtttgattaggacataacttacaaaattctatgtttcacctgattagtcaattggcttacctctcctcccgatgacaaatccatcaaagaaattttcttgctggggggtaaagtgccactggagaagaacaaatcgaggttgttctgtgacttggttgtgtagttttatatagtttttagcattgtcaaccaggctccaggatcccagaaatttcactcctttgcttactgcatagactatacaagttgccctcttgtttgagcgatgaaggcgacgttgattccacacggttgattggtcaaacctcttgttggcggaggtaccttcttcagaattcagaggggtgatagaccaatagtcaaacaactaggttggtcaatgatcaatcgtcttcatccaactagagaatcttatagcctgcttgtgagtagtcctaattgtgtattttggaaggatcaaagaacagtccacgtcaattgtcttcaaccaactagagaatgtttgagtctgcttatcttaattgcaagggaagtcgatgaatattttgatgggggatgtataactttttttccttatcttttctcctgttgtttgctctccaaacctcattgttaggctggttctcctcggtagtacttagaatagcttcatttctccagagcttgttgtcctctagttgtatgctatgtggctgagcttgacattctggctagattaattggagttatgtgggagtgattgggatatttcatagataatgttcttcttttggagttgcgagcacacggtatgtgatgcaatgatggacttaagtaagagaatcgctatcagtttgtcttgatctatgttaaataagattagaatgaagatctaatactctttagtctttaacagaatagtataacatggtagtgtgtaagatcataacgtgatgggattctagtcaattggcatgttgactctggaaggcgaactcttgtcatgttggttgtttgcaatctttcttcctatatgatggtacatgctggaaattttggatcttaagctttgacccactcatgaattcatgattgacgatcacttcttttggccgaaatgttcgattttgacttctgtggttctcctttaagcttgaggaaagaaggatagagtgatgacggggacaccttgacagagaaacattgcggtttatgcataactctagagagctactttacaaattgtgctctatttatagatgaatgccaagcagaaaattcactaaattgttttaagtttgttttgataaaataaaaaaaagtgctcgagtcatgaatgtttaattttggtatttaagaaatcacggatgctgttgccgagaattctttttaccttgttagcattaatttcatcatgatctgaagtagctctagcttaatttggtattctttgttagctaagacatgatatttcctcttttggtgcatatgcaaattcctatcttttccccctaaaatctgcaaatgtttaatcagatttttatatgccatctcaattaacatttatatactgttatggattcatctgggtaaacttttttagtcttatctcagtctggttgattcatcttgttccacatgtgacatgtcttgataatgtagtgacagacaagccatttatgctaatttcatacatcctcatgataaccgggctgcgtttgtgtgcaatgttggctgtctgtttgatgtgcttttctttctttctatgatttatatgtttgtaatttgcactgatagagcaaaatgttctgttctgcttgtttgtttttaccacctcccatggaataaatggtttatagtttccttcttttgctatgtacaggtcatgaacgactaatctccgttcatttattatggacttgcaccagttattaaagtacagattgactggcgctaacgttgtgtacgaaattcctacagagaacaacttgcaaaactctccctggcaagctaacccactgaagtacgagttcagcgattccccatacacccctctctcttcccaatttgagtgtgacaatttgtctgctcttaccaacactccagataaccagagctctacagaaaccatttcagcccaaccaatctccccattggaagcagacagctcatatagacaggcgggtattcttctccaggagaacattcaagtgggagctgatccgttgtatgctacatcaagacataatatgcaacacgccttacgggagattgagactgttctgatggcacctgatacagatgatgcaacaactagcaccaagcatgagtttgaggaaatcaagcctgctcagcttgtgaggcagcggtcgagaacatggagtcatgaatcacggcagccgttacctggagttggtcggtcacagtttgcatctggtggataccccacagcaagctatgaatt

SEQ ID NO: 83611 - DNA, 3713 bp, Oryza sativa
cagtagcatataagggattatctcaaaaaagtatcatgttgctcctcggaaaacgcgtatagtagtctcattggccttcgtcgatgggatgtgtattttcatattaagagttcttaaaagttatcaactcaaagcccaaacgctacaatgttcgaaattctcaacttaacactagcgtcaatgctgcttcttgtgcacggagttcctaacgtaaagtcagagagatgtgggagccacttcccttcttgggagccacactgtccctcactagaccattcacaatgctttcatgtgacattcagcagaagcagagggaaacaaatattcgctgccacctcctccaccagcggagctttgccaagactatgtagctcaagtttgccaccggttcctcgtcagtttttgcaggagtggcctacgctagcactccgtgctaccgaaggagaaagagagaagaggagagagatgtgtcgtcgtccccatgctccacgtcgctgagctcgtcgcgaaggggaggagggtgaccgggcaccgtcctcgccggagaagttcgccggctcgatggggaaagcgacggccgcggtgaaggtcgatttggcgccggtgaactcaagaaagaggggagatccggcgagtcgtcgccatcgccgcccgaggctagatccggcaagcacaagccgaatatgcctgccccgccgccactccgcctggcgccatcgctgctctactcagctccgcgaggaccaccacgccgctactccactcggctccgcgaaacgttgctgccgctgtcgtcgttggggaaggacgagagtccatcggtagtgaggaaaagaggggggggtggggagagagaggaagaggagctcgagactgagacgacgaggtggagccccattccatgctgctcgtcgccaccactctgcttgccgccactcgggccgctcgaggaaggggagatgaggcagccggaggaggggaggcgtgcgattagtgggggaggagtggcgctgagaggataaggagagagaaaattacattttttatttgtgtggacctcacttaaagttacaaagcactgttaaacttgtggcaaacattattcttaggtgttattgaacctacgtgtcacatgaggttcggcaaaacatgaagccgcactgctaatacccttatgctaacatggtcatagtccccctcgccggatccaaggctggcgcgtcgctatgaaacaaaaggaaagcattctaggtgcgatatgacatggctggaatgctacgaaactctgctatccttttgttgcatgcattgcaagttgtgcaatatgcttgcaatgggaaatctgagcttaattttatatgagtttgcattttcatatgttcattgttgtgtatgctggttaaattgcgttgaatatgtcgctatatttttttatgaacttataatgtgacttgtggtttttcttataaatttgacttaacataaatccaaactgacttgtaatgtgaataatgtgcaacaaaagaagtagcaaacactaagtccgtcctaaaatataagaaattttgtatggatataacgcataagagattttagatggatataacacttcccttgtccaggtttattgtatatcttggggcggagggaatatacatacatacattcgatgctatataaccaattttatccatatataaaatcttgcatagccaacaatggttgaatttgataacttaaagtagtaatccatatgtcaacaagatacaccactttacacaaacacttatgttgctggtgagaattcaacccccaaaaaaaaaacactaactggaccgcatgtttttcttatcacgctacatcatcatcaatcaataactcccctaaccccaccgtttttcttatttttttgaatttttttaggctttctcgttgttttacacgtagctgctaacccctcctgctcctcgcgcgcgtgggggcaaccgcccataagaggtgcgccggttaatcaaaatttggtcgctgtggtggtgtgcatacgtcgttgagaaaatggggattataccatcctcaaaacagggcttcgctgaaatgccatcctataattgggattcgcccaaataccactttcaactgagcccaacccgctgaaatgccatcccaaatcattttcatcaaaaataaaagattttactctacttttcacatgagttgatgaaattacccctcagtcaatttcatccttagaaatcaatcggctgggagagcgagacgcatagggttagggtttcgtccgcggcgccgatctgggtgccgccgcgcaacctccctagcgccgccgcgccgccctgcccttccctccagccaccgctccgtcgtgccctcccctcgcaccgacgcctcccctcgcgacgacgcggcgcgcctcccctcgcgccgccgctccgtgtcgtcgtccttcaccagcgccaccgcgccgcgttgcggccgtcccgtggcgccgacgaggtcgccgccctcccctcacgccgcggctctcccctggcgccgacgaggtctcccctcacgccgcggctctcccctggcgccgacgaggtctcccctcacgccgcggctcggccggcgccctcccctcgcgccgacgcttggccggcgcgccctcccctcgcaccacggctcggctggcgccctcccctagcgtcgcggctcggccggcggcctcccctcacgccgtcctacgctcggctgtactgcggcccctctccacgccggtctgtcgccgtcccggatctacttgcaggagtgatgcagatggattccaatgtttatgatatatgaactcagtttgagtgattatgcattttgtggttgggagtgatttgcgaataatctgggaagcatgctcttaatgatgcttaactggtgttgtttgaatgctgttaatgatgcttaatgagtgatgcttacgtggtgttgtttgaggcacgctcggtgtggtagttcctaggatgtaaaggtccttttttcatatgttcatcacatcctgtgtatatggtactctatatcctctaaatcgaatgaaccaggggtattttggtcatcaaagttgtgagaaaagagagaaaatgattttgatttactacaaaggaagagaatgacatttcagcgggttgggctcagttgaaagtggtatttggacgaatcccaattgtaggatgacatttccgcgaagccctgttttgaggatggtataatccccattttctctacgtcgttgggtggaggggctgctcccggtgggagcctgggaggaccgggtatttttgtaaaaaaatcctcgtgtttgcacggaatatcacatacgtcctcggacagcctgacatcccgttttatttcttgcatataacccctcgtcttccaagaaaatacaatgtgaagaagagaaaattccgtttctagggataacgctgtaaacataaaaaccatagggggttttctgaaaaacgtcctacactaacccccaatcccgaaaccctccgccgttctctccctcccctcccctcccctctcacctctcctctctcggcgcgggttccggccggagctgccgccggagggcggtggcggcagcggccctcccctccggatctggcgagacggctacgtccgcggctagatccggcaccgccgccgtcggatctggcgacctg

SEQ ID NO: 83612 - DNA, 13115 bp, Oryza sativa
taattttgatttttacatatgcttttacctttattttatccaagtttaaatatatttgtgtattttttatgaattgtaaatttatttcatgttttggatagaataatttattctttaaccttttgtattaaaataatatataatttttgaataagtagtaagcgagtgacaagaaccattggattttatccatgtttaaatattttttgcgtatagttttgtattttatttatgaattgtaaatgtatttcatgtttaggctagaataatttatcgtttaaacctttttttcttaaaagaagatataatttattttgaataagtagtaagggaatgacaagaaccattagattatcactaaatggatttttaaaaagaaaaattgtaaaagcttcaagcatttttttaaacacagaacaaatgcaagtgctcacagcgtgtgcacaccctacccttatgagcatatttgaaaggctgggtcggtatatattgagattggtaaactcatcactggtatctcgctgtcaatgggtatgttacctatcactgaaagaataattagccgtaaatacgagcacccgtgttaagtgtacgacttgagccgaagtgggttagttccatcataagaaacctaatcaattgagttacgctcaccttgcaaaagttgagtatcgagatcacactctattgcctaccggagatgtgtagtggaagtaccactagtcgagatggctgacgagcacgcatggaagtacggaaaaatagaaagtggttttcattaaaaaaacataaaactctttttcttcagacaaatttcataggaatataagtgcaacatcaatttaaatagacatatataagtttaactgtttaagaggagggcatgtggtctatataaatgttctacttactccatcttataacaaatcaacttacttacatgaatttagatataaatgtgaccagattcgtttaaaaaagttaatttgttttggagtggaggaagaagtaggtgatcagtatgtgtccacgtacatacacatatgtgccccacggccacattggcagctaattaaatgtaattatggcgaacgaccaggaagtagctaggaacagcaatatgcaaagctttgccctaggaagcagctagcctatctcaaaataaaaagggaagcagatagccgacgatgcatggcacggcacggagcatgatgtttgtagcgtgtatgggcgcccaccgattcatttcatctgtatcgtccgcacttgttggtcgttgccctcgtgataagcaactaacctagctcgtgataatgatgaatcacaccaccgtccaccccacacccacagtcacacgttcacgtgaataaatgaaaacacaaaacagaacatgtactatgctaaaactagtactaatctactactataccccacgtcccaaaatataataaattttaccccctccatttactttttgatagttatattttcaaatctaaaaaaaatatttttgataggtatattttaattcttaatgactttttcggatttaatgcgtgactctccattcttccacacaagattggctatatggacatcgagaaatgtaaatattaatgaatcgtttgtttacgagaaatgactagtagtatgtttaaatagatgataagtagaattacttatccttgatctgtgtgccaagatgaaatatgactattaaaaatagatggagtgagtagcatttaagatttatcacaaaatataagaactttttcattaacattttttccccaaccaatcacaatcttctaccattcaatttattcacctttcctcacttctaaaccaatcataatatttctctattaaattacaagggcatctttgaatcgcagggttgaaaaaacggtggaataagaaaaacacagaattctgacaggaattgaagtgtaaaacaaaggtttgcaaaacacaaaaatgagattgtaccgcataaaaaacgtaggaatcagatgaaaaagattgactcaaaggaaatctacacggaatgtgttattccatatgaatttcatcggatttgaaaaactacaatattttaaattaaatggtcaaatagaaaacaatttataggatttaaatcctatgaaatttctaaataaatcctttgatttcatggagccataactttttcttcgcacctatatatattttgttggacagagatagtactattagctcgttgatcgatgccgttatccatgcatcttactcctgttcatccgtcgtcacacccaactctttgtgtcccaccagatcgggtgtatcgatcgatctatccgtgtagaaggggccggatatgtactactctgatcctgtaatctacttgagtatagttcaacgcacatcgcctcgtgcggatcaaatctgtgggcatgatcgatcttatgggcaatttggcaccctccgaatcccctgttctacacgtatctggtatacatccatccaaggcatcaattttagcgcacgttcccagtttcgccagtgcggcgccaagttgccagttgccctcgtcaaatcgccgaaaggctgcccatccgccacgtcccgatccaattttatccaaacaccccatgatatccgagagtccacgagagcgaggcataggtgtcgcatctaattttatccacgtaagataaaagacgacatgcatattatattacatctacactatctttaacatactaacccaatgattttattttatttgtttgatcactatactctttcttttttaagtttgtatgtatgctacttctttcaatctactcatatgctctttccttacttctcttcgtcacctcatcatccaatccaatcactataaaaattgattttcctatatgagcccctggttagattccagacagtccataacagaccgcgtctggaaaaaaatcatcctcccatttttgcatacggacccttataaggaccgcacatgaaaatcgattttcgcgtgcgggcctctttaagggtccgcacgcaaaaataagactattttttgcatgtggacctcttaaaagactgcacgcgaaaatattcgcatgcggacatctttaagagcaccgcacgcgaaaatacgggcctcttaagggtccgcacgcaaaaataagactattttttttgcatgtggacctcttaaaagactgcatgcgaaaatattcgcatgcggacatctttaagagcaccgcacgcgaaaatactctccctcctcggtcaaattttcctctcaaccacttcaaaaatttctatattatcctcttcacctactcatccttatcctcatttcttctatctctctcgtcactcgtctctcacgggtggcggcgggctcggcgggcgacgggtgcggggcagccgagagcagcggctggcagcggcagcgtggcctcccatgcgggctgtggccaggaccagcggcgggtggcggcaaagcggcctcgcgcacgctccccggcagtggcgcccctcgcccgcctggacatggaggcagcgcccctctcccacccggatccggtagtgggcggtggcgacatgaccgggagcggcggagggctcggtagccgcccgcggcggccggtcgtggcggaaggcagcgacaccgacaacggcggacgacgacgacgacaacgacgaccacgaggagggcggtggctaggtttaaggtttggatttttttttttttttttgcgtgcgagtgatataagccacccgcacgcaaaaatcagattttcgcgtgcggatgcgtcaccggcatgaaaaaatcggatttttgcatacacttcggtgtagatgggcgggagatccgcacgcgaaaacccttttcgatcgcacggaaaaaatgttttcgtagtagtgaatgtagcacttttagagcaacacgtcaaacaatcttataatacgaatttcatgcaaaaactccaaagaagaattgtgccacgtggcaacaccggtttcacagaacggctcgatcctgcttgcgcgcgtgcagcgtgaaacgctcgtgtgcgtgcgtgcaacgattgtccagaaggtcgtccagaagtttctatcgatggagcaattaggtccatgggggcacagcagaggctatgtgatttctcgcgtagtcgtgttgcgccgtacagctattgcttcctcctaccaccggatattgaggattaaagaagtaatgatacatactttggttagggactaaaagaggattaacatgatgcaatcaaatcacccactaaaattactacgttgcaaacatccatccttttacagtgcttgtgtttccttattttgtatccgtgttcatgtgatttatattatttctttcgtgtgttttcctctaccgaaatcataggaccttttctctttggggcaattttattctttctcctactttaatgtttaatattgatgttgcccagtattttagggttttgtttttgcccatggttttttaaataaagataaattttgcccctacttttgatggacagattaacgatgttaaatctttagcgagaaggcattcaatacccttgctcatgttgcaaacttcccctgtttttatttatgattgagaatttgcctacatttagcacatgaaccttacaattttgataaacttttaccaatataataattttgataaaaatatcaacaaatgtattgcctacatgtgccaagctgtcatcgtcacctcctctcacgaactgccaccaccgttgttgcctcctcttctcaccaagctgccgctgcctcctccgcacgtcgagccgccaccaatatcatctccccgtgctaagctgccattgtcgcctcctcttctcatcgagccaccgccactcctattgacccgttgtcctcctccctgtcgcctccttgacacgtcgagcagccgcgccttctccctgcgctgagctacagcagccgccattgtcctcctccctaccacggcctcttgcgcaatgcctagccccctcctgcacgctgtaattgggttgggtggcctacacctggccgggtcgtccccgttgcctggccggcccacggacactgccatcactatttcacaacggggattcgggttcgggaagggaatagttgatgccaagtgcccaagcctggaggtacaccaagcggtacttgggtatttttaggggtaaaagggtcgatcaataatttaaaatatcgttatctctttctttctctaattctttaccgcattaagtccaatcccactcatttccgtcaaactcattcgtttaaaaaagggcaaaaaacaacaaccctaaaatatagggtaaaatcggtattggatatcaaagtaggggtacaaacaaaattgtccctttctcttttctccctcagtcaaatgcaacctatatatgtcttgtaagggctactttgaaacgaagattgtgggatgaataggaaaaacatagaattctgacaaaaaatcaagcacaaaacaaataattataaaacacataaaaatatatgaaatcatcatttgattggaccgtacgaaaaatgcaagaatttggatgatatagataaactcataagagtctttgcatgatattggacctcacgttaaaaatactccaaaacttatatgaatttgggcattccttagaaatttgataagattcaatagtattcaataatcctttggttcaaataatcatatagaaaaaaatattgtttctatacagaataaaagttcctatatttttctatatttttctttcaaataaaagggccctaattagttactccactaaagttgaatgagctgggttcactttaccatgcgtggcaaagccacgcggtttttctagtatagtacttattttgatgcgtcgtagccttgccaacgaatacacacgataggtcccattattttctaataacacgtggattctactttagttttcattagtatattttttaaactactaaacagtatgcttttatgaaaaatttctatagagaagatgctctaaagtatcaaataaattagttttttaagtttataataattaagagttaattaattatgtgataattataatacaattaattatgtgataattataatacctttctcattttcatcttgtacttactcgtgaatccgcgatcccaaagcggggcacggcagccatatctattaggtcacttccaatgagagttccggtgcgacgttagcaatttgaataatgtgctaaggattaatgaagtgagagataaaataaatttcatctgaatgaaattacgactatattgtttccaatataacttgtctttttttaatacacaaaagaattgtgcatatttgtactaagattttgaaagacgtaaaatgtttacaaaattatattcctgagagtgcccacacaaccaccacaccctgaggaaacacaaccacggccaagaacctcaaaaaacggtgcatccaataagattccaacactaaaaacacctccaacgcccagcccaaaaagatatgtttttcacctagaggattctattaaagaggggaaaggaggcacctcgacaacactctcaagagtgttgcggcgctcaaatgcatcatcattgctggtccaaagttgcactggcttttgtctggaacctgtttgcacctctcttatagcttgtctattgcatgtattgtccataaagacaacaaaattgaaatagttcattatggaagatattttgatcatcaattaaacacattcgccctgtttagagaacttagtattttttagcacaaggaaatagtcctttaataaaatatccctaagttgtttagatccaagagtattttgagagctatttggcctttaatacattttcccatggagagagggggagagaaaaaacacttttcagtgagccccacccgaaatagctctcattaatactcttgatggggatagttttttttaaatagccgtgaaatagcttaactgtttaaaacatgtgagctttttcaggactatttaagaaagaataaaaaataacccataaatccgaacagaatcattgttgctcatatatgatgccttgggaatggaccttatccaaattggaagcacgcaagcacctggctggctcctggctgtggttggctgggtcgatgtggaccaacgttgttcgcgtcgaaccgtgcgctgttccaaccgctgcgcatacgtggcggcccgagttcctaggtgggtccgcgtggcgcggcgtttgttggtgacgtgcgcgctcgcgtgtccgaccgtggagcggctggcagcgcgtgaggaagatgcagtatatgtgaagttgtgaacaggtgtgagcgcctgctaatttcaccgatgagccttttgaccgcggtcaaacaccgtcgtggtattgtgatgatactagtactatacgtgtggtaatgtggtcggcatcctgttaattttgaagtggtcggtactaggtcggtaatatggtcggctaacgcatacactaagtatatactacctccgtttgtttaataaataacgccgttaactttttcttacatagtcatatatttgaccattcgttttattcaaaatatttatgtaaatatattttcttttatcgtggtttgatttatcactaaatgaactttaagcatgactaatatttttaagatttgtgcaaaatttttgaataagacgaacggtcaaaggttgtaacaaaagttaacggcgccatgtattagaaaatggagggagtaatttagtttgtacaagtatatttgcttggaagtcatttcaatggaaagactaatccaacatgtaagtagctttttccttggaacgaatatatacaattaagcaacttgtaactgcagattagtagtattttttttatagtggtagcagtaataaagatttatgaagtctctaaagatactcatggtagcgagcaccatccgtacatgtgcggaccgtggacaagtaatgcaccatccgtacaactgacatggtactccctacgtaaaaaaaaaaggagataatgaatttggataaagagtagaccagattcgttatgaccccttataagttgatttttttttgacgggggagtacaccagaagtagcttcacggtaggctgcgttcgttcacgtaggctggaaactcattccctccgcacggaaaacggagcagtctattagcgtgtgattaattaagtattagctaaattttttcatggatcaatatgatcttttaaaacgactttgatatagaaaattttgacaaaaaacacactgtttagcagtttaaaaagtgtgcgcaagaaacacaagggagatgggttaggaaccctgtgcaaagaacacgacctaagggcccctttgatttgtaggaaaagtgtaggaaatttgaaggatttcaatcctatgaaaaaaattcctatgaaagcctttaaattcctatgaaaaacaaaggattgaatcctatactatcctttaaaattcctatggaatggctaaccctatagagattttggaggaaagttagcaagaggtccaacctcttgaaaaaattcctttgagtctatctctctcatccgattcctgcggttttcctgtggtccaatcaaacggtcattcctgtgtttttcctgtattttccaatcctctgttttacacctgtattcctgtcagaatcctacgtttttcctattcctccattttttccattcctgcgattcaaaggggcactaagtagtacttcttccgttctagaaaaaaaaatcaacttctagagtttgaattttatcttacaaaaaaccagtttctaccatcctactcctcagcacgtaaaacgagatgttttatcccttcaataccctttacctacctaccaacttctattttaataattctccacctatactaagggtctgtttggatcttccaaaatggtaaaagttttgtcattttgaagcactttttgccattttagatctaaacactagtagcaaaagttggcaatttggcatttggcatttgctagtccatggtagcaaattttgccaaaaagtgctccgggaccacaccctctctctttagtgctaaaatagcaaaattttaagatgcatataaacaccaattagtacttttgcaatgttaaatcttttgctaccaaaacttttgttatttgccatttgccatttcaaatggatctgaacatgccctaattccaccttaggatgctaggaatggatatttttgagacggagggagtatgttcaaatttattatacgaagaaatatcgtcacattttgggttgatttttcatgtaaagaaaggagtagttcttgctttggcctcgtcaacaaatttcacaggtcctctccgtctgctgagaacaagctattagagcaggtacaatagcaggctataagccagctgcaaacatattttaagaagataaatcaggagagaaaagagcagcgggctatagatttgtagccagctatagcacggaccccaagacgcagtgtgtctatgacaggtaggactaggtattaatagtgtagtacgtaactattgtatgaatgagttattagattggccatagatgaattggagctagtagttggctatactattgaacttgctcttagcagatcagatcagactgagcaaaagcagattagggggtgtttagatggggctaaaattttttagcccatgtcacatcggatgtttggacgctaatttagagtattaaacatggactaataaaaaaactaatttcataaataagagctaatccgcgagataaattttttaagcctaattaatccataattatcaaaagtttacggtagcatcacattgtcaaaatcatggcgtaattagactcaaaagattcgtctcgcgaattagtccaagcttatagaatggattttgtaattagtgtatatttaatactccaaattagtgtctaaatatccgatatgacagggatttagaataagtcgctggaaatcatacagccctgtcccaatgtcactgcacacgtgtgctggcaaatgtctggtcagtgtcagacacccacagaccaacgctcccgcgtctgttcggcccgcctaaccatgagcatcaattcagcccaaaagtgcgcctcgattcggcccaaacgttcggcccatatatgggcctgaattcggccgtatgggccaaatgtcagcccatccccgagttcccgacgagactcgtcatcctcgacctcgactccgccgaccgccgactccgagttcactctcaccgaggccgccgccgccgccgccgagccatggaacccggggtgggggggtgggggggtggcgcagctggtacgagagggagaggtggacgacggtggcggccggccttgatccggccggtggcagcgggaaaggggggagccggggaggtggcggcgtgctagatatggaaacacttcggagatggcgatggccgtcgaggcgcgcggattcagggtgggggtggtcgagctcaccggcggcaagggactcgccgggtggtcgaggtctccgatcatccgacgcggagagttgcttgggttttctgtttctccatggttggtaaataatagcaattccatcctggaattctcctcctcccattcccgagtttccgacgagacgctttggcaatggcggtggcgccagatcacgcgcccgtattcgtggcgctgccgccgcggattccgcgggatggacatggggaggaatttcccgggcttggacttgcctgtccttctcttttcctcccttgttcttggggtggggttggcggattggggaatcggcttcgagctgattggttttgactgcgccatccgatttcttcgcttttgtggaggggggcagcacggctgtgcatttcgttctcttgtcgtggatgcccccggaatttatccccaattctcgctatacttgctcgtctacatcggtgtgtttcttggagcatttcaagcacttctcgtcttcatcgatgcatttcttggagcatttcaagtgtccagcgtctaaatcgctcaggcgaatttggaggagcctttaggcgcattccgctcaaaatcaagtggaattgttgcatgaatcttcagattgttttggctggattgccaggtttcttcgatcatttttctctacggggctgaggaatttttcgccccatgcccggaaagctccaaaggggatgtttgccacaattttcagagtatctgtgttgagatgatcggtgtggtgtagaaggaagcacgcaaatgatgaggcattgtaggagagaatggctcctcgccctgtgcctcatctctgtgcagctcctcattccaacaggctgcgagggggttctcgtcgcggcaagcaacatgtcgccacctgctttgacaccactcctcatcaatcaagtagaccaattggtaagcacatttccatatattttgatgcatacgtaagcttcaatttgtgtgaaaataccatacaagagatggcagtagcagcttttgtaaggagatgtaggcatagtcgtgtttgcattcagtttcgaaccaagaattaggaccaagtcctttccaagtggatgtgggttgcaagacattaatcgggactcgggagtatgctctcaggagcacagaagcccatggcattccctcctatacttattacggtgtgtgtcgctaggcattaaacgggaatttgctctcaagagcacagaaacacatggcattcacctcctaacggcactgatgtttttgggtaatgcaggactcagggaatcaggattgattcatgaataggtccacatttacttatttgttgtgggacatgcagagtattcttgtactcttgtagtctcgtgtttcccaaattgcatgaaagacagacgaataaggttgctgaagtctgtaggtgattcccaaaggcaaccatgattttatttgtgttgtgtcttatagttttttttttttttttttttggctttggatgacagatcacataaggttaacctttctgtgaacagagttttgaatcattttcttcttgtgttttatggctgaggtagtctgtttgtttttttagaaaatggcagcctctacatccaaaccagtctgataggtgtgcaccattgcattgattgtgatggtgttgtgatttaaacactggcttaacagaatcaaactgttaaatttggcttgcctccttctctcccctccccctcctggcctcctctctcctttaacagcaggtgctagattcctccttgttatgacatgacaaatgaagactcggagagaggaatgtgactagtagtgaatataattattttcgatccaactagtagaacctaacattttgtggcatcaatggctgtttaattcctaactggtgaatgttgccttttgttggatatgactacaaatgttgggtatatccttttttttaaaagaaaaaacattcgtactgattagagtgactgttaattacatttcatacaggtagaacatgcatgggtcaagtgtggattggacaagagaactcttgaagatgttagacgccacttcaactacaaccatgtattggcaattctccgtagaatgtctgggcaagacattaaggacacctctcctgacattgatggagggaccagtgtattatcactagaaaggagggacgctatactgaactgtttaagcaagcagaatttcatgagtatcgctggacaggatggtttaaaaatcttgtccgctgattatatcaaagcacttattgcctcacttagaacagaccttgctcaggaatcttcaactacaaagtcaatacctgaacaagcaggaaaacctgtcccagggaaaacttctacaccaaaacctgtaaacaaaccaaccgacagtgtatcatctccaccagatcgttcatataaatcagctcctacagaaaaggaaaaccctcctactaaatcagtagcggaaaagaaaaaggacagcagtggcatgccaaatgctttcattggtttgt

SEQ ID NO: 83613 - DNA, 2860 bp, Oryza sativa
ggaagcgacggcaacggcgtgctcaggcgctcgccctccccctcttcccaccaccctctcctcctcggccgcgcctcctgccaacgtccccacctcgcgcagattgggggaagtggattcggcagggaggcatgcccacatggaggtcgtcgacgcggaggagctcgcggccctcgacggcaacgcctacagtgcggagtttgccggcgcggggagcagcaggcggcgactgccgtcctccccgcctcgcacagccctccgcctgctccgctcttccctcctcgccgaaccgatggcgccggctgtcgtcccctacctcacggacggcagggcaccgggaaggactgatcgtgccgatccgacctctccgacgggaagggaggggccatatggctgggctgcagtcgattcgtgggaacgacggcgaggccggaggtagtgctatcgagcgggtggacggtcgccgcggctaccgcagctcgcgtcatcggcggatccggtgccgttgaccaccctccccccagcctcgctccacctgtcggcgtcgttactcccggcgctcttcctccgtccgcgccctcctcctccactgtcgagtttggttgttggtgccggcctcgccgtccttctgagccggccggcgcgttggttgggcgttgcgggcgagacgatgcgttcgtctgacatgctgcgcactgcctcgctgtccacaccatcggccccggtctcacgttgctcaatcctcgtcctggatggacgctctcggggtcactgcccccgttgtttgggtctgcgcggtggtcgtcaccattttttttcgggctgcgcgtggtcctcaccgaagctcctggaacacgtcgtcgactcaagtgccttgccttcacccaccaccaatgcagtttggtttcagcctgagccttctcttctttttctttcgttttttctatgtttctatatcattcactctttgagctgtcactggacagtaatggtttgtgtattcttctcgctgccaaaaagtcactgacgatttgcattctgcattgaagaaccaaagcaggaaagtgtgtgcatcatttctacattactgctactgaagatttagataaccattacagtatgttactgcactgctgcttttaagtgaattcattccggtgaaagaagatgtggattccttttagttgttacaggattctgcttttaaagaactgcttgctgctacaggattaccgtttcagtgctgtgtatatttatctggttttacttgctgcagatcttgaggttgaagatgatagttgaggaatactggttgccaatcctgtcactgctgtatggctcttcctcaacctgcgttggtggaagaatgcagttttggatgcatgaagtaaccaattgttaccttaataagtattgtggtttgatgaagaaaatttactcacagctcacccccttttttttttctcttggcttttattcttgtggtgatgtttttactggatgctcgtcagtgaggcatgtggtttccgaatttgttggcagaaatatagttttgctccttgatgttcaacttttaatcatctattaatattgtcaaaatgaatctgtctatcttattaggcaaaaggataaggtaatgacacattttttgtttcaattttccaaataagtatcaagttgttgatgtttaaagaactcttgttcggtattttgacaaatcatgaataattccagtccttgcattagtgaacgattctgaagctacgccaaaaggatctctaattggcgagaagatcccaaccaactttcctattgaccttcttgagtgtattgttccattgcatttgtatgtaatactgcagaattttggacagaaaatcatgtagcatgttggcaccttggaatacacgacaaatgagcaggagcagtcagcagacattttgttattgctttcatttgtgacctctttctttatcaagaagaagacaaatcagttactctgtccagtcgtatttggagtctgaaaatatggacaccgatccttgaatgccgttgctgtagatgaccatacaacataatgtaactcactgtttttttttcaagttgtgtaatgcaattcactgtatggtagtatattacaagttgtgtacatgacataattacacgtctacttgtgcaattaagagtaattaaagagaaactctcttaacaagattccgattatttatataatgtttgtgatcatggtattaacctttttaggtccacatagaatgcttttgctgttaaccagcccaataatgtttacaagttttttcacttgaagttcatcgctacttgaataataagttatgtatataatatgttgtgagattacctgtttaggttaaatgaaatgaaggaaaacttctaatcagtagcaactaatttgtgtttgatagaatctctggcagcttaaaccacctttgttttggggtctggctaaaccgtatggtcaaactgaccttaattacgtatacttttacctatgtaagtgttagggtgcgcggcgtggcgccgcgctcacatttctagtccatcaataacacccctacccgtaccaattttctccgtgttttggaatttttttcggctcctcgggaagggttaagcgtgatttgcaattttgtaaaaggctccttgtgtttgcacagaatatcgcatatgtcctctgaccgcctgacattccattgtgtttcttacgtataacccctcgtattctagaaaaatataacgcgaagaagagaaaattccatttctaaggctagcgctgtaaacacgaaaaccatagggggttttctacaaaacataccctccccat

SEQ ID NO: 83614 - DNA, 12200 bp, Oryza sativa
ccctcctcgccggcggatccgtcctccgctggcggccgcgtgcaccggccgtcgtccaccgtgcggatggcgctgcgggaggacgggccatccgtggccatcgtgggcgcaacgagcgttgtcggccaggacttcctccgcgtgccgtccgcccgcccccagtcgctgccgtcgtcgtccaccctccatccgccgccgcctacctcgtccgccctccccccgctctcctctacggcgagacgtccgcgctgctcgacgcgtggcgcctcctccgcaccgcagactggcgcgcctgcgcggccgccgtcaccgtccgccgcgccgccgctgggcgcgcgccgcgcaccgtcgaccagtgcaagaatcgcttggattacctcaagaagcgcctcaaggccgagcgctccaggtccaaggggaccccggccccgccgccaccgcctccctcggtcgaccgcctccgtgcgctcctccgcctcgccccctccattctccctggattcactccccggggcggcgccataccaaaggtgggagaggatgccccgttcctggccgtcggtgctgaagcggccgaggacggcggtggcgttgctaccgttgagctcctccacggggcatcagcacggagacggaaggacatcgtgcacggaggtggcggcggcgctggataggctcgccggaacatacgagcgggtggaggtggcgaagcaggaggtgacgcggctggaggagcgacgcctggaggccatgcccgacctcgagatcgagcgcatgcggattctcgtccgcgtcgccatctccgcctccgccgtggccgacgccgccactgccacggcggcgtcctctaattggtatatgccgtgagtcatttcattccgtatttttcgtgtgtgtgcatctgtacattgtgcagcagctcgttgggtggtcataacaagcaaccatgtttgaagattcgtgattctggttggaatttaagcacaacatggctggaaaatttgcacttcgctgataccaaaagcttatcatgataatgtaataatcaaatttggtcagacaataatccatcatattaacaggcaatgctgatatttctgaaactactcacgtgcaaaaactgctttcttgtgatgctctgctcaatctgattttagtagaatcccaattgcaatgttcatgtccaatgagcatgaagtgtactgtcaatcaatgatcttttgatcaccttgatggacttgtcatttgttattcacgatgccattgctgctttgtactcctacaatctgtggaggacacaatcccctgatacttttgtttgtcatctgtttcttgccagaggaactaggacagtagactggccatggtagccatccagattccagtctacttttttcaagagacaattgtagtgtggagaaggcaattgacgtgatgccccggccaaaatttacatcggtttagattacagggaaaggttagccagatataagacaatacatggtgagattttttttttctttttagttcactgatagcaggttagcagcaatgcaagatgagagacttgatttcctgaactgaacatatcatctgatttagagtcagttaatggttagctattgctgtaatcccctcttgtattgaatacaacagcatgccccaaagcataagcaagccgctctgaaaagggcaaactgcaagcgttctgcaatgcctccaaaaccagaatctgcatatccaaatggtgcccagaccaagccaccagttaggttgacaactggtgcactcctctgaccataactgaactcgagtagatgatatcatgatattgctgattaaaaacagtggcactctcaattgtggctaggaacaataaaggtacttatactagcatagaaacttatgtaaatatattgatttttgagtaaatcatcaataaaaaaaactcctactgataccatttttgttggcggcaacgatgagcaaggttggcggatgggagcaggaccactggatgtgtttcgtgtggactccggccccacgctcgccctcccttctgcactttcctctcctcctctcctctctggcggcagaaacagctcaggatggcgcggctcgaggcgacgacagtagagcggtggggctgcacgcgtctacaagttatgaaatggccgtatctttttttaaggaaagcaagaaaggtccattcaaagaaacaaaatatcattttcatgctaattagagtttatgtttttggggagtttaattagtattttcaatagcaatgttaaatcatagttggatgtgcaacatgtaggcgaggtatcgtgagtcttgtggtagatacatatatatttaagggttaatttaatacatgccattaaaaatttgccggtttcaaaatataccactaacattcatatatttggaaatataccattataattttacacattcaaaagataccacaacttactccttggatacatttccaaaaaaaaaaaaaagaaccaaactaccccttttcccctcttcttccttcttcccctttctccttcctcctatcttccttctcagcggcggtgagtggcggagcgagtggtgcgtcggtggagcaagtggcatggcggcagagcaagaagcaacgggaagagagaggtagaagataagggtattctcgtccaatacatgcgaaatacatatcttagtgacaccattgagattacaaacaagtagcagtggcatcgttacaaatacgcaaatagtaatggtatatttttaaaccaacaaaatcttaatggcatagatctaattaaccctatatttaaccgtaatgctttgcttataaagctattataaaaccatatttattgatttgtaatctgagttagtaattggtttccatgccaattcatcccctcacaaacaataagttgggtttgatactcttggttcaggcttacaatggttgtggctgcgcgtgtcgtgtcacggcgcattgacattactgagagatcaatgagtaaatgatagttgttgccgttccacattgagcaaggtggtgttttttttttccagttaagaattggaaagaatgctccatttaagcaagattatgctcttttagtttgagaattggaaagaatgtgatctttggttcacatttaattatgctacgtagccttcactaagctcatgcaaaacattgtcgtgcgcggcgtggcgccgcgcatatccttctagtatctataatagatgtgtagcatactgttaaagatggggcaacaaaggtccgtcaaacagccaagaagaaggcatcaaaggtccatgcactaattggacgattaatccagggaagaaggcatcaaaggtccatacactaattggacgattgatccagggactttcaatagagaacacatcgactctgttcggcggcatcgctgccgcagcagttttgaactgctgcagccgcagccgctgctgtaaaatgccccctccgaacacacccatagtttatttgctcctctagatattctggaggaaaagacctcagcggaaacaagagcccatcaagcctacaaaaagggtacaaaatgaattgcaacagccaatatacaaacaaaaccaatatgttcagaactaaaagaaaaggatgtgtatgctaacacaaaataaatgtatcacattgaacagttaaacatattcaaaaccttcccacagctgtcatttttatcataagtaaaaattctattgcatgaccaggtcatcacatgaacacagcaccctgaggaagatgtgtcaacaattaacctacaactgccttttatcataagtaaaaattagccaggtgaacacagcaccctgagaaagatgtgtcaacaattaacctacaactgccttttatcataagtaaaaattaaccaggtgaacacagcaccctgagaaatatgtgtcaacaattaacctacaacttccgaacaaaaggtggacaccacaagagatcttactgaaattgaatacctgactttacgctctatatctttttacccaatatacatacaaaagatataaattttatatcatctttattagtgactcttgttgggtttcatctctagcctaccaaaacttgtttgggacatataggcttttattttcatcatggttgtaattatgcgcttttgcaccacaaaagagtggacgacatgatttttgtgattaacacaaccatgcgattgttaattttaaactattagtaattgtgatgcacaaagctataaagtgcacaataatcatacatctagcaaataacaaagctaaatgcagaaggatatttctaaatttctcaagacaataaactatatacataatgctaggttgtaattgcataggaaataccagcataaacccatcttgatgctgaaaaatttgacatcttaagccaatattgttgctatagcatcagtacatcacagttacagttcatccaaaccaaacaccgtctaacagcactagttactaatgttaactgagtttggaaccaaacagcacaaacttgtatgacacctgaatactactccatccatttcatattataagttattaatgttaactgagtttggaaccaaacagcacaaaattgtatgatgcctgaatactactccctccgtttcacattataagttactaatgttaactgagtttggaaccaaacagcacaaaattgtatgacgcctgaatactactccctccgtctcagtcaaacttatttatgtttggccaagtttatagaaaatatattaacattttcaatacaaaacaaacatattatcaaaatatattcaatgttaaatttaatgaaactaatttgatattgtagatgttgctaattttttatataaacttagtcaaacctagagagttttgactaagaaaaggtcaaaacgacttgtaatatgaaatggagggagtacgtaacaagcaaaagtatgacaattgattatatgagaaaaaagagacagtgacacataacttaccccaaaccgcagttcttgcttcaccaaccaaataggctgtcttttactgcaatacatgattcctttattcctacaggacgagaaggattcatgttcatcaactcctcgaaaaaatctctgggagctaaacaaatatgcagagttgagggctcgacttaccaatatctgcgattgcagcaagtaaagatatgatggataagtgtatggggactcggtggtggtttatggaaaatgtctccgtcactagctggagcccaggtaccagtacctaggtcatattgctcaaaacgaaatatatctagtgaactaggatcgacctgcaaactatgcatgcaaatgatagagttagacaaatcggagggaaggatcttactcccctccttgttatttgagagtgagacacagagacaacgttcatcaaggaacaaggcgtggtctccaatggtcgttactggctcaatccttccactgacaaggtcagcaagtctgtatactagcagctttgaacgagaaacaccattataggcaaccagcaagagctctgaaccacattcagcaaagttgagcaggtatagaaatttgtccattgggcattcagcaatcttcactggcaatggcagatgaagcaatcccttgtcgttatcttggcatggtggattaaactggtagatgtataccttatgtatgtcgtaagatgagagctgcaaagcatagagtttgccttggaaagatacgggtttgacaaaaggtttgagcgtccaggcagagagagtccaccgttggtcaccgggagtggcgtaggctacgcggtgcaggatttcaagggccagcatgacggtgatggtgccagtggaggtgacggtaacagatgcgcaaactttcattagtctgctgtgcttgcttcgctggctgcggtcgcggctctcggattccatctgtggcaggagggaagccagcggcgggaggtcggcgacatcgccggtgaaggggtggaggaggcggatggctgtgtcgtggtcgcggtgcaggagcaggaggccgtcgaccgagtcgatgatgacgtggtcgcgtaggagcggtagatggacacggaccaaggcggcggtggagaggttgaagaagcggacgtagccgcggaggtcgggatggccggggtagaggccgtggccctccggtagcatcatccaccgccgcgggtggaaacgccggtcggtgacgccgcggccgagtgggcggacggtgcttgcgctccagtgagagcagacggcgcggaaccggacgtagtcccgcatgtcgtcgccggcaagcacccgccccccgatcagccccaccagatcctggtcaagcgaagcccaatccggcgacatcttgccggcgtcgctggggatgggcgtcaggcggcggcgcttgctgctccgaatcataggcggcggcaaaaactgcaatcaacgataacggcggatcgaacacgattaacgaaacccccctctctgttgttctctagcagatactcctatcctatatagagagtttggatcagatctaaacggaagaaatatcggttcggaaaacacttacgagacagactctccaaatatccgtccgctgtcgaatcgcatcagaattagtctcccggcctggaactaccagccgccccaaactccatcgatctacacggaatcaatctaaaatggattgctagggtaaacgcaaagggatgaggaggagaggggatggatatatcagccgccatcgccccccgtcttcagagaggttggggaagaggatacttcacagcctgggcctacttgggccgtgtggctcaccgacatgggaagcccctatcagttcactttgggtccctctatttgtcaccccgtccgaatttgaattttgtccctccatcgcaaaatcgagtacgacgatttttttttcccttcaacctatgaaaccgtttaaataagggccctaggcagtattgtgcttggttttgtctaaggtggcgcctacatggctcatgttgactaggttgtccaacgtgtcattgtcgtggcgcttacgtggcaattagatccgcaaaaaataacaaaacctgtggggcccacaagtcagttgcacacacaatttataaataatattgggcccatgtggacccacacgtcgtcctcactatcctctactctctatccccccctctctctccctcttctcactctccaaccggcggagcggggtgggtagtggccgaagtgggcgacagcggtggagcggcagccggagtgggtgacaggcggggcagagcggcggcggacggagcaaagaggtggagtggggcaaagcagaggggcggagtggcgacgaccggagtaggccggcggagcggagcggaccgtcgtcttcaaccacgtcactcaccacgtccagctcgaatggtgaggccgaggcctcctcgtcggcgtcaatcgtgctgctgctgacggcgtcgtcgtcgctcgtggcagacggctcaccacgcggacctcacacaccaaccgcaccgcgcacatctatcgcactcgccggtgaccgctcgagcaggccggagcgaggcgagcggatctatgtcgtcgcggccatcgaccttgccggggagaggagcgacggagccgggcgggagaggagacgcgagcgcaggagcagacgattcgatggcgacgacaacgacattgaagccagtgtgcgcacatgaagcactccagctactcaacagtgcggccgactcgagttacttcactctggtcatcggccgctccaccccgttcgtagcccgcttcagtcgccgcccactccgtcggagagcaagaggagggggaagagaggatagagagaagagagcagtgatgatggcacgtaggtccacatgggcccaccattttttattatttgtgtgtgcaactgacacgtggggcccacaagttttattattttttgctgatctaaatgccacgcaagcaccacgtcaatgacacgttggacaaagacctaatcaaaaagagccacgtatgcgccactttagccaaaaccgaacacaatactgccgagagaccttacttaaacggtttcgtaagttggaagacccgttgtacccggttttgcgaccaagggacgaaaatcggactgggcgacaaatagagggacccaaagtgaatttattcctaggtggaataagtccacttggataggtgaagcatctaagcccccggtgttaattttggtaattaatgacaagcgctaattgtggactaaccgttgtctttgagctatacattttaagttaggtccacgtcatatgtgcgcatggatgattatcgatggattaaaattgacggcgcaaagcaaagggaaagaagacggtaaaactagcgctttaatttagaattgatcgaggtgtagggcgatcaaatttgctagtttatttttagtttcgccgtactattaagaggggtaatgacctagcaaaaagatgattataattgccacattaggtcattgcattttcatttgtgctctcttttttatcacacacacattcacttgcaaattcactgggttcggcctgaccaggggcggtcagaccggccacatagtggcggtctgaccggcgtgccctggccggtctgaccggccgcaagaaggcggtctgaccggagcataaggccggtctgaccggcggcacttgcgcggtcagactggccccctggaggccgagatggtgctgctcgggatggccgatacagagccgacgaagccgtattcggtcagaccgagccgatggcggtctgaccgagccgaggccggtctgaccggccaccccatgccggtctgaccggccaggccgatggggtcctctgacagggctacaacgactagttttctagccgttgcagagtagcacggtctgaccggctacatacctccggtcagaccggcagagcacagagttgggggatttcgcccccaacggctagttttggtgggtgggagtataaatatactcccccaccagcagcaagggggttctcttggcacccaattcaattgcatatactccttgcacctctctcacactcacttgagctttgtgttcatccatctagtgtgttagagggttgtttagccaagagtcaagtgcatttgcttccattgtagagctagtgtggcacttgatcatctccacaccgagtcattgcttgttactcttggaggttgccgcctcctagacggcttgtagaggagttgctcggtgacctctccgtgaagattgtggaggaggcccggcgccggtttgtgagtggtttggagttcaccaccttcggagtgaaggaagaactaccccgagtgatcgagacttgggtagtcctctccgtgggccggctcccgtcttgcccaccccttgacgaagggggcgtgcggtggcttcgtggttgagcggtggagttgggctcgcctcaacggggagtaggaaaccggcgagtttccgaacctcggtgaaaaatctcttgtctcattgtctcatttgattgtcgcatttacatttgtgcaatttatatttctagagacatacttgagatcatatcaccctaggattgcaaaacattgacataggagtgtgatttactttcctagagatataattgagccactatcatcctaggtttgcaaaacataacttagttgcttagttagagttcaccctcaccaagcctagcaacttaggttagatttgattaggtgttatttagtttttaaatcgcctattcagccctccccctctagtcgacatctcgatcctacaatagagaaaaagtacaccgaaggtccctcaacttgtcatcgagttacaaaatcattcctcaactacaaaactagatatatgacatccgttaacttacaaaaccgttcactttaggcccttcagaggttttgactctggttttatccaacatagtggctgagtctgcgtgagacccacttggacccatcattatgtccacgtcaccacctactctctttcccctcttctctttctctgtttctctccttccttccttcctctcgctctctgctcttgcatgggcatagggatgccggtgctagggctggcgcccatggtggtgcggccggcgatgacggctcctggggggtcttagcttccccaaggtggtggcgcgcgggctcgagacagcgcgagctcgctggcctccccgtccccctcgtgcgggccggccggcgaggcgaggcaagcacgcggtcctgccctcgcctgcgacaatcgtcgccgggtgcgacgcggggatcacgatcactgactcctcactgacctgcaccatcaccttctggtaccttctcaccttctcgctgtgctcctcctcttcctgttcattctctctgccccactcatcccttctccttccgtgctggtgaggttggagaaggacgacctcttgccggtgaggctggacagcttgatttcccactcagaacccgagccgtcgccgccgtgggagcacgacttgcttagctcccgtgtctgctcctctagcgccatcgcgatctcgtcaccctcccactgcctttggatcaccttctccaattcttcccgacgaatctaatccaaacaagaaatccaagaacacaaatgaaatcaatcaagaatgttctagaagagccatggtgatgagcaccgacgtacgttgaacgccgcctcctccgcgtcgtcgtcctcctcctcgccgctgaacatcaccgagatggccgagctgaatagctgatgcgccggtcgcaggaaaaggtctgcctagagctcgccgaccacaacagggtaatcgaggacagcctcccaaacatttgaccaacgcttattataatataaattaaattttatttgctaaaaatatatcattgaattgacatttgaatttactttcatatggttataatttttctaccgcagacttataatatatgataaagtataagacaaagattagtttttgagaccgtgccaagtttaaccgtgccttatatcatggaactgagagagtatttactttgaaaactattgttttttctatatttatatttttttgaaaaaaaattaacttatcaaagtttaaatataaacagtggttggtgacatgtatttggaagtggatagagtaattccttgttgttagtaaggactatttttttttcatacaaagcaaatgggattttcctcttaaaactgtactacctctaattttttttataacgcttgactatttatcttatttaattttttttcataaatatgtaaacgtataatttaatgttagagtaatgataaaacaagtcataataaaaatatatactacctccgtttcaagttataagactttctagcattgcatatatatatatatatatatatatatatatatatatatatatatatatatacacacaaacacgtgggcaatgctagaaagtctaataatatgaaacggaagaaatagcatttatataaatctttttactaagacaaataatcaaaacgaatggcataatatattgcttcctccgtttcatattttaagtcgtttgacttttttttctaattaagtttgactaagtttatagaaaaatatattagtatttccaacacacaacaaacgtatcatcaaaatatattcaatgttagattttatgaaactagtttggcgttttaaatattgctaaatttttctattagattggccaaacttgaataggaaaaaagtcaaactacttgtaacgtgaaacggaggagtaaaaaaatggagggagtataacttttccatttcttattgtcaattaattttttttatcgattttgctatatatttgtcgacaaatttttcccccaaaatttgacagatgtaattacagtacaatcgtagtgtaattacactgtaacttgcatgtagttacactgtaactatagtgtaacttgtatgtaactttcaaaaatctctccgttacatgttatttcggtaaaatggaggtcgtgggaacaaattctttcacatatgtgtgtgctatgatttgttttcttcctcaccaaaacaaatcttgcactaaatccaacgattcaaaatt

SEQ ID NO: 83615 - DNA, 6957 bp, Oryza sativa
aatttgtcgacaaatgtataggtagtccctttttttattaatccgagaaataaacaagcacttgaaatggttttcgcagatgggctaattgggccggtggcccggctgattccgacccatccaagcatctcctctcctccgaatctcctccacctctcccacacatctcctctcctcccctcgccgccgtcgacgcagaggcttggctcatcgcggcgccagtgactgatcgatggccgcggcctccatccccgcgagctcccagcccttcaaggtttgctcccgggagcagctccgccgattaatctcttcttgtttgaggagcgaccgagcgagtctaatcaatccgttcttgctacttttgctgtggcttcgtcgcagctgatcctggggtcatcgtcggtggccaggaagcatatactcgccgagatggggctcgaattcgaagtcatggtgggtttgcgccgcttttctcttgcctcttgcccactcccgttctgcattttcgccccccttttttggtggggatttcttgctttcgggactgtctcttgggggatgaactgattctgtggtttcagactgcagatatcgacgagaagagcatcaggagggagaaccccgacgagctagtgacgatccttgcggaggccaaggtgcggccttttctctctttttccccccatttctttggaagtttttacagcttcagcattggcgtcccattcccatcgctacagtagcaaatgcgtcgccgagtgccatgtattaatattacttgtgcataatattagatggtatttatggtgatatttggtctgtaccaagtgcttgaatttctgagaaatgaaaccttggcagcttcaatgggacatttggatcggacttgaccgagtaggtttcgatttagttatggacttgaattgtaactctaaattaaagaatggaaggcactggttcatctctggttgtttctattgctgctgaattggtcctagaagaaagagcataccatgacttcgtgttgatctcctgcattgtgatgctgtttctatgttgtcaattttttccccttgtaacaaaaactgaccactttgacatctttcaggctgatgctatcatgtccagattgaatatttctgattaccagaaagaaggcgacaggccaacactcctgatcacttctgacatagtatgccttgatttcctttgctatgctattttacgtggaacttggatgctttattaatcacaaaatactatgtttgaaatttgaccatgcctcaatttcagttctcctttgatgtttttttcttagctaggagttccatggattgtacatcaatttaagtatgactattttggtgccatgtttttgttattacacatttgtgtagataggccttttcgatatcaccaaatccaaatgtcatacagataaattagtcaattggaatcaatcctgaatatgaaattttaaattcctgagatgtgcattgtcaatgctgaatagatcaatacattcgcttatttaagaatgatgtcctgtgtgaaccataagtttggtaatgatgcatagcgcaagtcattcctgtttcaactttttgttcggcatgttctcttcgttctagagttcatgggcatgtggttgaacatatctgctttaggacccccatcatttgcattatccggggaatagccaaacgtcatatttgcaaacaaaaaataatttgtgaataaaacttttatatacatgttcttacgatctaaaagcaaaggctgaaaaataaactttgatgaaaaaaaccctaaaatcaactccaaatttgaggttggaaattcaaattttggttgataagcataagcataagcgaaaagatgaggttgttatttactagaatgttgtcattcgcattactgtcatactgaactgaagttgaccttgaggtggtcgtccatgaagggattatcagagaaaagccaaccacgaaggaagaagcacgccaattcctgaaaggtgtgcccacatgtcgaggcaacatgcatcttatattcttgttctccaatattttattgtattatttattacttgaacttttactttctccaggttattctggcagccatgtcgcaaccgtggggtctgtagtcgtaactaatctgacaactgggaagaggcttggaagcctagacaaagctgaggtaatttacttttgtagttcagcacttatttgatgagaaaattcctttgatagaagctgtttgtattcaagtcagatttggcaatgcgggtgatcccattgatatgtgcgcccaaaggctattgatcaacatctttgacagaacataattcacccaagctctgcaaatgtgtaaaaacaccaaaggatattttcaccatccagtgactaatgacaattgtagttttcagacttgtttgtgtggcaagctttgttgtgtgcatctagctagatatagctactacggttcttggtcatctttttgttatattaaatcaacaataaaaagtttgtctctttgagtttcttatcgtgtgttcaggaggaactattaaaagatgatgtcattcaaattctattactgcaaagcaacaatttagtttgttctctaatgttagtatttaggacaattatgggaaaattcagtagataatatttaatttctgccagtcaaaaagtaactggattgtgtatgtatatcatggaaaatttagttaaggttgccttttgtcgtcattttgcaggtgtacttccatgatataccagatgaggtcattgaaaacctggttggcctcgtttattccactctatgtaatatattaattgattatttgctaaatctaacatttataattgtagcaacagtgccagttagaatactatcatcataggatccaatctttaaaaaattgcaaatgtttttatgccactgacctgctctctctacccgtttgaatgtcaacagatcgatgagggggtagtatttagggtcgcaggtggcctgttgcttgaacatccattgacattaccatttgttgaagcagtggttagtgtctatctcaccttatttttcacaagtcttatatatacacggcattttaaactaatgcaaacttggtctccttttcatgtaggttggttctagtgacagtgtaatggggatctcgaaggatcttgcaaacaaattaatccaggatgcattgtagcctagcaatatttggtgctctgttcattcatcacatttattactgctcccaaagagatactacctatcggtgaaaatatgtcagggacatggtggtatactggtatctcatagtcatttttgtagctcaaaagcttttgaaggatttcagaacctgacacacgaagacgcatggcgttcaagaacacttcagttcctctgtctactgttttgatgagatttttatcattgtacttacacctttactgaatatatacactgtcattgtgaagcgttcagtcgataccttaatggaaaacgaggatgttgccaaagaattcgcaatttaaatgttaaatcgagaaagacttgtgtcatgtttgcaatgtgtgaattgaactgtttgcagtgaacattttgcaaccattaccttgatgcctgggtataaaatgggctgggttcgatttttattaatttttggcctaaaaatatttaagggctagagttgtgaaagaacccatgcatggcctaacccattaccacccctacctacaaaattacagtctgatcttattgtatacgatctgagtgtgacaatacaggaagtactctccagcttccaaaattctgcaaattccacgtgaaacagttcatttatatgggcccagcccaactttatatgggcccacatgtagattacactaccgttccagaccaacataatatgggcctgcacctcggtgacaatccctttacggcccaacgtaatttgggaccacatgtgggtgaaatcccgtctcggcccaacttggtttgggcccgcaaagaggtgaccatccggtttcgtctccgtttcgtcttcttcttcttcttcttcttcggtgacaatctccgtttcgtcttcttcttcttcttctccgccgtgacacgcacacggcgaagcggaggcagccgccgccggcgaccatctcgcgtcgctcctccggccatctcttcagctcctccactccccgaagctgccgcccgcgcgatccaccgaatgaggccggcggaggaggcggcgagggcggcggcgctggccggcccgctcggcgagctcctcccgccggtggacttctgctgcgcgtacggctccacgctcctccacgcccgccccgaagcgtcctccatggtcgactacatcctcggcgtccccgacccgctccagtggcactccgaggtagggtgggtgactgagccccccccccccctctcctgttctactcttccagattattccatccaattggtccccttcttggtttgatactctttgatgcgatcttggttcttggatggtttcttggttggttaattggtgcagaatttggagaggaaccctgatcactactccggatggatggctcgcctcggccccggcgctgtaagctcccatttcccaccccaaattcacactccttttacttggttaccccggttgattgctcctctgactgtgtgattgattggttgttgcttgtgccttgtggaagttcagattactcgacttgcggataacatcggcgttggggtgtacttcaatccatttgttgagtggagggacaaggttagcatttgcaatgaagcctcctgaattttgtagcctgatgctttgtgtgcattgtggtttacttgtcttcatgtatgtgcatttagttctgagtgacaaaattgtagctatgtggatgcagaggataaagtacggggtggtgaggatgaaggacctggccatggatgtcttgacctgggaccggttctacctcagtggccgactacagaaacctgtatgtatgccctcttgttgatatctgtgggaaggaagatgcgagcactgataatcttgttttgccactgtagtggttcctgatccagggtgtatcaccattcatgtttagttcaacccctgttttaattttagtgcatgtatatgcctggtagtgcagatttgacatcagagctagtatttgtcttttgtattcatgtaggttcatgttcttgttgataattgggatataaggaagattaacacaattaatctgaaaatggcaacatcagcttctctactccttttgccagcagaattcactgaggtttagtgtcactgtatcagcattgttgttacaaccatgatatggttctatgcttgttttcaccttccctttttattccttttgtgcagtatgacctgtacgcccaaatttgcagcctatcatatatgggtgatttaagaatgctcttcgccgaagacaaaaacaaggtaaattgataagatgtatactacgttgttattcttaaatattttcctgtaatttatttcagctcaattaacatcagaaataacattccttcctcacaatagtgacgctgtcaatatggatgtctgaaagccaactctactatacaccttgaaaaatgaaatggcgtgttattttttttttttaaaaaagaagtggaccacaaaaaaaatcaaatattacatgggacgcttcttataaaaaaagcatgggatgcatggtacacagtagttcgtgtaattcattctaagtgtgatgcatgtcattatctaaaaaaaagtgtgatttatgtgatatgtttagtatgtcatcctgcacatacatgcacctatggcatataaaaaaagatgtacaatttggctgtattgagcacattagtgagttactgctgtttgctgggttttgtgggaaggactgacaagcaaattgactgtgtttctgttggaagattatttatagtgtctattgctgttgttagtctgctgtatggttgaaagatcaatatatggttgttattcttcatgctgttttttttttcccatgacaatggaacttatgaattggtgccaattatactctgctgtgaatcaggtcaagaaaattgttgagggtagtttcccatcatttcaatcgatgtacagaaccctgatacaagagtacattgctgaaggactactgaagacatcatcttatggacaacagaaggctttccatcaggcctgtgtttccttttgctcatgcatacagtttgttgaaacagtgttaaatgtttagcctctcactgagatgctttcttgctatcacaaatgcatcattggtggcccaccaagatgtttaaacttttctcgtaatgtttatcatattggcgtgttctcgcaaatgtggtatatttatctcctttgaaacttataagatattttattggcactctatgaaagtctttttcttttggaacttcataaactaaaactgataagagttttatatttgcaggattgtggtgcatctgcaacaaacgaactgttctcttatctcccatggacaatccaaaggcgaacgcaaggaagatttgcatcgaattgcaaaggtactgtcgtcatttgcgtcgagattagtaccgtcgaatctgtaacacattctgataaattgtttaatttccagaaatgccaactggtgccgcagtttcttcaaaaaatgtagcagcaacctgtgtccgcaaggctttgaggcgccgggtaatggtctcaagtgcacgtcaagcggtgtctggactgcttgcctctggtggcactgttgctgctagatatctggggaagaagatatccaaagcctggaaatcaagaacagtttaagttgttgctgacacctgatgctttatatacacctttgttagttacggatttagggtaggttttgctct

SEQ ID NO: 83616 - DNA, 6807 bp, Oryza sativa
  unsure (1)..(6807): unsure at all n locations
gcgccccacgcctgcgccggccgccgccaactcccccagccgctcccttgtgccttcctcgctgccgcggcctcctcgccccaccgcgtccccgcgtccccgacatgtcgtccccactgtcgatgcggccggcagctacggccgtccctccccccggcacgcgacatccctgcccgcgccgacagacgccgccttcccccagccgctccctcgtgccttcctcgccgccacggcctcctcgccccaccgcgcccccgcgtccccgatgccggcaccaccgtccccgcccttcaccggcactaccgtccgatggggaagagaaaaagggagagaaaagatagagaagggagagaaagggaggaggaagaagggttgaagagaaaggatgatacgtgggccccacaatatattgtgtgtgtgaatgacagatgggtcccacatatatttttttaattgtaatgctacttaagcgccacgtgggacaaagactgggtcagcgctgccacgtcagtaaaaccgccctccaaaaccgctggaggagtcaaattgcacttgtttcaatagttcggggagtcgtcatatccggttttttggttgaggggtacgaattagattcggcgcacaattaagggagtcaaagtggactgttcctatacttattccatccattaaggcccactctaaagaggtgagagaggtaatatagacttattagccacgtaggcacgacacaagaaagcgaggacaaaaaatggacttattcccaggacgagcatggtgggcctgtcgccggccccagtgttattggactctgtatgggccgtaggtgcagcccgtgggctgacacggcacggctcggcgtgtcggtcggcccgactgatatcttgccttggtcgtgcccagaccgggccgtgtatagcggcccatttgatcatctgtagcctgaagcccacattgccacggcccaataaatcgcgcgatgacgactcgaccaccggaaaccccctctccgcatcccacagccacaagcggcgccgcaccacttcgtcctcaaccaaaacctccgccgccgccgccgccggagaaggaggaggaggaggagtagggagagtaagcggggagaggaagatgtcgttccgtgcgcgggagatgtacaagaaggtggtgcggcgcgtgggcggcgaggggaagctgccggcggagctgatggcgtcggtgaagaacttgctgcctgacagcaaggtcgtcatggggagggccaagcgcggcatctacgccggacgccacatccagttcggcaacaaggtctccgaggacggtggcaacaagtaagccatctcgcccgtgcaaatcttcactactctactcgtcgtcggatctatgcgcgtagatactgtagggttgagttcgtggggtggaataaagctgtgtgatgcaacgaggtattccgaatccagatttggttggtttggattggagagaacacgattgcgaggacagtggttgagggtagtggtcaggagagaaaactgccctttgcactgtattggtttgattgcatgtctaattgatttgctcctagttactgacttagaaatggatgtgttgaggattaaattgggtttcatcctccattctggtttaccttagtagtttttaccaagattgatagagttattcatgtttgaaatgttcaaacctacacaatttgctagttattttttaatgatgtgcaaattgttagattaccaaaatagaataggtagcttgtttgcactcttttttgctagtgtaaatgcttgactagtatgttgcttacttgcttcatccattcactattgtacaatttggttctttgatcataatatttgaaacttcaactatcagtttcttttggaacgagggaaatgataatccacacaatcttgttaaatcccactgttcacttcctgaactgccaccaccatggcaaactgtcagaatggtttcatgagtcatgatcaacatgtgtaacctcaagacatgcaaagctgcttacttaacgattcctctaggcttgcaagttgcatcctttgatcaatgtagcacatctttaagtatctggagctgcattctggatctctttaagaagaaatgatttttttttcttactactgtaaatgtgtaattgtgcatttggcacacttaaaaatctccttgaaatttgtgtattcaagatacttccttttaaatttccatagttcatgagcctttcattaaaaaaatattgctcttgatttccccctaaacgtatttgtgtccgtggtagtttttgagcaatgtcttattttgttcaggtcaaggcgaacatggaagccaaatgttcaggagaagcgtctttttagctatattcacgaccggcacattagggtcaaggtaaccacccatgctcttcggtgcattgacaaagctggtgggatagacgaatacctcctgaagacaccttacaacaaaatggatactgagatgggggtagcctggaaggcaaagattgagaagatgtattcacagctagctcaaatggaggtaggcttcttctctcctgaggaagagactaagatcgaacagggttttgaggaggctcgagctgccaagagagagcaccgcagggaagcaagaagagctttggctaagcagactcagctagaagctggtaacgctggtggtgacaaaacagctgaagctgcttctaatgttgcagtgaagtcctagcttggacctatctgctcgtcatgattggtaaaatgtgatcatatatcctcattttcatgaatcggcatcacctgtgtgctatatgttgaaagtctatttatatggcaatgccactttttaataaatcaacttcttttggaaccttggtgatattgctaccgcaaagttctactttttacgcctgatgatttaaaatgcgatgtgtggatatggtaatttatctttagtttacatcattgatgatcaatgtgaaacctctttatgactccatagtccatattagtaaaaaccacagtatcattttcggcatcatctcatcaaaggtgttacctttctttgtgatatcaaatcagtgaaggataaaagtttgtatgcacaacaacttcccttgctaaataccatatactttttttgcattttggattgtactattacctgaatatactccctctgtccagtatttgttgtcatggagaacaataaaactactctctgttgataaatacaagtcatggtgtctccaacattaaactttaaccattattttcttttgaaatgtattgtcaacaactgtacaacttgtatgccaatgaacatatacaccctccattcctaaatacttgtcactgaatactattttagcaacaaacttgtatatattaaaaaacatactatgctattgaaaaatatgtttcatgctaaacataacaattcaattttcgtccataaaaatatgataatttagaagctatcaatggtcaaagatgaaacagcactagtccatatgtcaggtaaaagcacactagtcaatggtcaaagatgaagcagcatgttactaggccaatttttagtccaaaatcacagagtttgcacattttgagttcatgcttgtcttatattaatcaataggggataaaattagatttcaaacccactgtatgcatgcagggggccttttgtactccaaataactcgacatactcctcttgcaggtcaaaaggagaatcattgagtgccactgaccaaataatggaggattttcgtttcatataaagcagggatcatatgctgagtcagtaacccctgtttactggcagcagcagcagtgtatggtaagctggagtctaatactatcagcatgtgggtgttgtaagcagttgctgaacaaaatcagttaggtggaaattttgtacacttactgaatactcgtgtcagagttcagataactttcttgtagaattttgtatcttctactactgcccattcaacttaaacgtcgaaataatctatgcttgccaggatacgtggtaatgtgctacggagctatgccgtttttatgctgatttctgtttcgctgctatattttgttaccaattcaggctacaattcttacaaccaagaagaatgcttgacaagttacagatggcaacaccccaattaaattgttagtttggaccagcgatgtgcatatgcaagcgaatgctgctgggctagcatcgccccgatgaaattgtttctttggtttgacagtttttccttctctaaacttgtgatgtgaaatgatgcttctgaatatgaatgaattatgcgatgattttgttcagaacttttggatttctcccttgttttctgataatcgcgcctgcttggagatttagccgtcaacaacaactcaagattgaatcatacgtaagtgcttgctgatacaatatcaacatggagggtacattgccggttccatatgaacaaacataaaaacaccgaaaccccatatggccattatgccgatcctagcctagcttggcgaggacatcgccaagagcagatttggtcaacgtgtagtacttctccgcctcttcggggctcttgatcttggctgcatggtcaagctgcacaaatcacaaagggggattcttgtcaacaactcagctgagcaacagtaatactttttccgtttcatttcatattataaattgtttgtctattttcttaatcaaagtttttagctttgactaagtttatagaaaaaaatagtaacatatgggatataaattaattttattaaatttaacattgaatatattttaataatatgtttattttgtattgaaaatattagtatatttttaaaaaaacttgataaaacttgaagaagtttgacgaagaaaaaaaatcaaacgatttataatataaaatgaaatagagggaataataaattttaagagaagactctgtagtgaagtgaagctaaattagtttttttttgaaactaagtgaagctaaatttagttaccccgtcaatggtggcgaagagcttgccggtgaggtccttgaggcccttcttctcgtccttgggcttggagttgatgacggttttgaggtcgtagcgcaggtaggaggccctgaggcggaggtcgtccctgacgaacggccactgcttcttctcgatgagcggcttgagttgatgatgtcctgngccgactccttcgccctcgccgccgcctccgccggcggcagcggctgcaggtagaacctttccctcagcggcaggtccgtgtccctcgcctggtccgagttcagcgtcccagctatcaccacacaaatcaaatcaaatttgtaagtttcagtgagatattcgtgcgaaatttgtcaaacttaattaacggagaaattctacggttcttcaaaatatatcatgacacactaaaaatttaatataaaatttaatactttatagtatctcgataccaaatttacaataatacctcatgactctttcaaaattgctcaagttaataatactacacttacggagtccaccggagggcggtggcggggggccgagcttgatgggcttggcggcctcggcgagcgccgcctgcgcgagggcgccgccggcgatcccggtggcgacgaggccgagcacggcgcggcggccggtctggacgtcggcggcggcggcgtcggccctgacgacggcgagcctggacctgccgccggcgcgcctgggcccggccggcagctgcacgccctgcgacagcccggtcatggacgccattgcctgtgccatctctcaacctcagctcagacctcacctgactataagctgagaatttctctcttcagatgaaagaagcaaagtctcgagcgcgtggcggaaaaaaatatattgaggaggacgtgttggtgtgcaaccttatctgactggataagttgggggccagtggggaagcgccacgtggaccggcgagccgcgcgatggcctccgtccggattgcgccacggccaatggggaggcgacgcgtgtccgggagcgctcgtgtcctccactctcctttggcctccgttgatttcgatcggcggccgccgcgttggcgtggcagttggcaccgtggcggcagcggtaactcttcggatgatcgtgtggctttatccgatatattgctttcgttcgcacatggaggttcgccccggttgacgggtattttttagttttttttatttttattaatataacttttcaaaaaaatacttttaaaaactgaaccttttgttcacgctagtttggcaacgccagtcacggtgacgtaccttggtgtggcgtgacagagttatttggccacgccagacgggctggtggccaaaagatttagatttaaaaatattttcttggaaatgtttactaataaaacttttaaaaaataaaaggtctaaataataataatattaataagttctctgacggcgcctctacacttggatatgtattgggagcatttttttttacaaaatttgctatataacattaaagaaaatgtacgtaaatagataatggataccgtaagatcgtaaaaattctctcttctcagctaggtgtatatattattttaatctccatagtgtccactattaaattacatgtgttttgaagtgtctttcaaccgtttcacgatcttgcgatgcagctcagctaattacacgttttttcaatgttctatagtaaattttgcctttttttttctaataagagtaatggaaatatagtgactggacaca

SEQ ID NO: 83617 - DNA, 1110 bp, Oryza sativa
gttattctggcaatacatcctgtctaatgcctaccttggtaattttcacactgtttgtcaggtctgctgtaatgatcaggggccatacttttgctttgctcgcggaaacaacatatggctcatatatgacaacaacagaagacccatggtaattcccgatcaactttgcgtatttatgttttgactcacatttggtcgagcattactcgatatcattatttgtgtttgttttgtccttccagtatgctgaatcctgggaagcatcaatccagcagtacagtcaggccaacctctgtcctgaaatcatcttctttgagcgtgtcgaggatccagaattgggcacccaccgcgaccagactgcgccttgaaccattccattacttttaaggtttgatgtggctcagtggctgtagagattggttggttttgccattggaggcttgctgattgttgtggtgcttgtttgctggggcgttttgagtgggcaaactcctgtgcttttgagatcatcgtgcccacggcattcatgctcatgcatatatactggagtacttgacgttctctgcttggcgatggcgagatctggcatttctttgctggcctctggatcatgtagggtaggaaagtagtatcagtcgtttgtttgttcttccttgttgctcctgcaaatacctttattgctgtacatacaacaacgttctgtaacgcacaattctgggttcgtatatacggcgatagagcttgccttttctttgattacgagtactgatctagcaatggatatgcatttgcctgctctccactgcaattttgtatatctccggtactccctccgtctcataatataagagattttagatagatatgatatatactagtactacgaatctagataggcgtcacgtacctccaaaatccttagaattggatggaggcagtaccgcagtagtagtgattgttatacccacccaactatgctcatcagtagtagtgacgcagtttaggcccatccatttttaagcccgtacttcagcccatttttttcggccgaagcacgacgcggcccaaatacaaggcggaacattcaattttttacaaagcaccctcccc

SEQ ID NO: 83618 - DNA, 11010 bp, Oryza sativa
  unsure (1)..(11010): unsure at all n locations
taggggtgtaattcggacttttccctttagaaaatttaggtgatggacaaagcctaactaaaaccactacatatttcgctcaaattgttcttagattagaaaaaatacctgtgcgttgcaacgggtaaaggcgtttttcagtgatacaacggctattaagagccaaggaataaattgaaacattagtatcgctatacattataattgaaaaggcgttgcctcctacctccttttaaattccagaaaacaagttccccatcaaatcaaactgaatctttctcgatctcccaaaattgattaaggattttttatccacttgatctcttcttttagttttttccaaaatcggaacgaatccacgaaactcgggataaaaacagttgggggaagatcactggcagaccatcattcacaaccgttaaacaaatattaaatctagttaattaaatccgaattgaaaggggaaattatggggaaaggatgagggacgagtagagaatcgatttttgcaattaattagagaagaaaacgcacaggaaggtatagatcgatgtggcggcggcgttagggttcggcctgggcagcgcggcggcggtggctggaggcacgtggcaacggatcggacttatacggacgacgtacaaaatcaaatacacgggatgcttgcttattttttttattagatgtacagatagatttgcgataaagagaaatattagtaaaccaactccaacacggatgacatactaaaattttggcagaaacatctttaatttttataatagtagagatttaaatcagagtaattttgttataaaattgcgatctaacacttatataaatgtggaagattttctcttaataaaatataattggtcccttgttatgtctttcctggactatggtgtagtatacatgagttgatagtcagcaatatcaacatgattaagtatttaagcatacacaattaggcaaggtgattagcctggcattggttcaggtttcaagttgctcagtggaaattgcatgggcagccctaatgggcgattgatcgcccgccaatgggggtagcgatcagattcgctacccccctcccctctccctccctccacctggtttcctttttggcaccgtattactttcttattttagtaaatttatacacctaaagtttacacatctaaagtttagagacccaaagtttataagtcaaaagtttatatatccgattcaaatttgaatttgaattcaaatattttttatatatagtatttctatacatctaaagtttatacacctaaagttagtttatagacctaaagtttatacacctcaagtttacacatctaaagtttagatacatgtttcaaatttatatttgaattatatctgattcaaatttacttgtttcatatttgaatttgaattatatccgattcaaatttgaatttgaattcaaatattttctatatatagtatttctatgcatctaaagtttatacacctaaagtttatagaaccaaagtttataaacccaaagtttataagtcaaaagtttacatacccgattcaaatttgaatttgaattatatctgattcaaatttgaatttgaattcaaattttttctatatatagtatttctatacatctaaagtttatacacctaaaatttatagacccaaagtttataagtcaaaaagtttacatacccgattcaaatttgaatttaaatttaaattttttatatatatagtatttctatacataaatttttctaactttttgttttttaaaaaaaatttgtgtggtgtactgtagtaggggaggagggaggagtgtatctagtagtatagggagggggcgggcgggtgatcgctgggcgggcgggggagcgatcacccgcccattagcatttccgagattgcatgcattagcaaacattgatgtgtgggtcctgttgacagaaaacacgaggcctgggagatctgcttaacttcagtgcaggtccaaaactcgccttcgggtgtatgagcgtggtcgttaacaggtctgtacccataaatcagccactgctactgaatcagcagtactgtagaggatctgcattcaggctggtgccttcatgcagtaggacacaaccgcacacatttgttgccatgcgcccgcaactaacttgcatggtaatacatcgattggagtcaacccttacatggcgtgaagcccgagcagccgcccgatctgcccgataggtgaatcggctactgcttccgtgctccatattgtgccgccttcttctccatagcggcaccccctcagtggagatctagtggcacccgcaagatgaaggtctagcggcagcagtcttaatagagaagggcatggccgcgggcaaaaggcagaggagagaaacacgcggacgccggcgataggtagatgatatttttttctgatttctttgattattgtgatcttcttgtctgaaatatttcgtgatttttgtgactcttttgtatatctaaaaatattgattactttcagtcatgatagagaccaaggccgcattgcttagcgttggccatttttcgattgcatgttggttttcatttttagattgtaggaatattagcaaaccaccaatattttcatcacaaaatataaatcaacttcttgattttacatagatgaccaaaatttcttaaaagaccggaaatcgagaccgaccttactgccacccccgcgtaaggtagccaatatattagggaagttggtgttcggcagcagggttatccaaatgtgatcactctaatctcacttattcacgtagagatttacccaggtttgggcctcctgaaaaatagctacgacatcttggcctaataaggaggaaagtgcaagtgaggtgatttgtgtaagtgggcatgcctgttggatggattggactgcacggttttggagcgcgggtttttacaatagcagacctacacctgctttgatgtgttttgcaagtatgacaatggtgctacaatggagcggtagagggtgagtgtgtgaatggtcggtggtccagagatcccttctctacagagatatcaaagttttcttgatcaaaaatcacatcaagtttgatttatagcaaattaataaaatcataatagatttacaacaaatgtcacacaagagcaccaataattaagatagaaacacaaaagaaatacatatccaccatccaaattgaattccacacatcccaaatttatgaaaagcacgcgcatgtaaacgtcgcaaatatagacaccacatttacatggggtgcctagttttagtgcttgggagggcatatcgccggccggaaggcgagaggaccggcggcataaacaacgttatcgtagccctgaccagtccatcgcttaccctcgtcacggagtggcgcacccttgatgtcagagtagttgatgtttgtggggttgttgcacttgaaatccggcgacgcctgaagtcgtacgtggcacgccttgctcggatcacccatgaagaagtcagagactttggtcacgccgagctctgtctggaagtagccgctctcatcggcgatggcccgcttgcactccatgacacgattcttggtgtcgtggcaggtaacggacacctccgccttgggcagcggcatcgcgccattgaggctatgcgtgttccggtacgcgcagctctggcagtacaccatgccctccaccctcaccagcaacttgtcactgtgggccggcggcggcggcggcgatggtgtggtgtagccgttgttggcagtggcgccggcggccaggagggacacgaggatcgcgagaggaaggaaggcaaccattgctcggagtcggagctagcttggtgctcaacttaagatggtttatcttaacctgaagttttggtgtgagaaaatggagagaagcatggggtttatatactgccatggactaattaaacgtgcagacatgtaggaaatcactaactgtcttgattttggattaagattgcattttatttttgtgaagataacatgtcatgattgatttgcaaggcacttctaagagaagagatcgcgtgttcatgatctgctgtgattagttaagatcagtctgtagacgataaagaatgttcggtgtgaagatatgcagatttgtcagagaacgtgctgcccgtgtgtgttcccatctgcactgaaataccacaggttctcggcacaggcaaatgatttttggcgatatagagctacattatttccgttagtactctgaaaattaaggaacagcatatcatcttctgtgtaaaatatacggttcatgtagtatctatttcctttgggtctgaaactaactgaaagaaaacggggtgcagttttctgattgattgtacgcagagcaagtctgtttttttttacatgcggcagatcaatcgtgcgaagttttgtcatggtaaggctgcaacatctgttcgcgaggaggcccgggccaccggatctgacaacctcgacctccccgcacaacacggaaccgggtagcttaaggacacaagccactcccgccgccacctttttctatcactcttcgtctcgccatgcactactcctatcaacgttaagttaggagtgggcaaaatagaccagaatcgaaccaaactaaccaaaacaataatgaaaaaaattatggtcattagatctgactagccaaatttaattgatcaattcgataagtaggctcggtaaaccgaaataccctaaaaacaaaaatttaagaaaaagcacaacataagccgatcaaaccaacaaaagcaaaaccctatccacttttttctttgttccgtaactaccctttcccacccccaccaccctcggcatcgacaacaccacaacgcatcatcctaccgcatcaccgtgccgctccccacgctatcctgtcgcgcatcctaccactcttctgtactgctacgttgtgtcgtgccgccctgcttctccgcaacgatgcctcctcaagtggagatctagcggcactcatgatatggagatctagcggcaataatcgtgatagaggaaagcgcaggtgtaggaaaaaggtgaaggagagaaacatgcggacgccggcgaaaagcaaatgttttttttgttttacagtactgcgattttttggtttgaaattattgatgactattgttattcttttgcttctcaaaatttgttgattatcttcagtcatgacagatacggaggccgcattgctcggtgttggccactttttgaatgcatgtagaccaaggaaactttgatgtggttttcttgatctactcatttgacaatggctagaaagtatgtgattttcattgtacttgtgtaactcagtaaattatttattatataaacacatacaatgtaggagactctccttaaaaaagttttctagatcgaaaatcacaccaagtttattttgcagcaaactaataaaatcagaacaaatttaccacaaatatcacacaagagcaacaataattaaaacagaaacacaaaagaaacattatccacaatccaaattgagaattcagtgcctcccatattaacgaaaagcgcacgtgtaaacgccacagacgtaggcacatgcacggggcgcctcttaatgcttgggagggcagatcgctggccggaaggcgagcgggccagcggcatacatgacgttatcgtagccctcgccagtccaccgtttgccctcatcacggagcgacgcgccctcgatgctggagtaattgatgtttgtggggttgttgcacttgaactccggcgacgcctgaagtcgcacgtggcatgccttgctcggatcgcccatgaagaagtcagagactttggtcacgccgagctccgtctggaagtagccgctctcgtcggcgatggcccgcttgcactccatgacatgattcttgacgtcgtggcaggtaacggacacctccgccttgggcagcggcatcgcgccgttgaggctatgcgtgttccggtacgcgcagctctggcagtacaccatgccctccaccctcaccagcaacttgtcactgtgggccggcggcggcggggtgtactgctgctgcggcggcggcggtgatggtgttgtgtagccgttgttggcagtggcgccgacggccaggagggacacgaggatcgcgagaggaagctggaaggcagccattgcttggagctagcttggtgctcgattacctgaagttttggtgtgagaaaatggagagaagcgtggggtttatatactgccatggactaattaaacatgcagacatgtagatggaaatcactaactgtcttgattttttattaagattgcgttttattgtgtgggctatttaattctgacaaaatataatgattggcctggaggagaaaaaaaagaagataacatgtaatgattgatctgcaaggcagttttaagagaagaaaacacatgttcatgatctgcttggtgattagttaagatcagtctgtagacgataaagaacgttcggtatatgaagatatgcagatttgtcagagaacgtgctgcccgtgtgtgtcctcaactccactgcaataccaggttctccagagagacaaatgatttttgccgatagcgctacattatttccgttagtactctgaatagtactctgaaaaggaacaagcatctcatcttctgtgtaaaatatacagttcatgcagtattgtcgtaccatgctgttccttttcttttggtctgaaactacctgaaagaaaacggagtgcagtttcctgattgtttatacaaacaagagatgtaaagccaaattactggacgcaaagcaactatgtttttttacatgcggcggatcgatcaagagctaacactgcatgattcatggcgctatcgccattgccagtttgtcacggtgaggttgccagatctgctggcaaggaggcctaagccaatacaaccccgacctccctgcacaacggatccgggtagctagaagtaagaacacaagccactcccaccgccaacctcttctaccactctccattttaccatgcaccgtccctatcgacgttcggtttgggtggtagtggtacaaatagaccgaaatcgaaccgaactaagcaagacacaaacaaaaaaaaaaaggtcacttgaatctgtctagccaaatttaatcgattaattcggtaagtaggctcaataaactgaaataacttaaaaaccaaaattccagaaaaaaaacccaagaacagaaaaccaaactaacaaaaacaagccctacgtactcacttttctctctattacatttccctaaacccaacagcagtccaccaaatcaacaaaagcaagccctactcacttttctctcttttccatttccctaactaatctttcccaccccacgctagttggaaaccgccacactagcatcacggcattgagaacaacacaacgcatcgtcctgccgtgtcaccatgccattccccatgctatcccgtcacgtatcccaccacccttttgtgctaccactccgtgtcgtgccaccctgcttctccgcggcgataccttctcaagtggagatctagcggcggtagtcctgacagaggagggcacgggcataggtaaagggtagaggatagtaacatgcggacatcggtgatagaaagttgatttctttgtgattactatgatattattttgtatgaaattgttgatgactatattgtgattcttttgcatctcaaaaattgttgattcttttcggaccgaggccacattgttcggtgttggccaaatggccacttttcggatgcatgtagattaagaaaactttgatgatctacttatttcacagtggctaaaaaatttgtaattttcattgtacatacataactcaataaattatttattacataaatatatacacggtaggagactctccttaaaaagcgttttcttgatggaaaatcacatcaagtttgatgtgtatagtaaattaataaaatcataatagatttacaacaaatatcacacaagagcaacagtatttaagatagaaacaaataaaatgcatatccaacatccaaattgaattccacgcctcccaaatttatgaaaagcgtgcgtgtaaacgtcacaaatatagacaccgcacttgtgtggggtacctagttttagtgcttgagagggcagattgccggccggaaggcgagagggccggcggcgtaaacaacgttatcgtagccctgatcagtccatcgcttgtcctcgtcacggagcggcgcgccctcaatatcggaggagttgagtttgtggggttgttgcacttgaagtccggcgacgcctgaagtcgcacgtggcatgccttgcgtggatcacccataaagaagtcagagactttggtcacgccgagctccgtcaggaagtagccgctctcatcggcgatggcccgcttgcactccatgacgcgattcttggtgtcgtggcaggtaannncacctccgccttgggcagcggcaccgcgccgtcgaggctatgcgtgttccggtacgcgcagctctggcagtacaccatgccctccaccctcaccagcagcttgtcgctgtgggccggcggggtgtactgctgctgtggcggcggcgggggcggcgatggcgatggtgtggtgtagccatagtttgcggttgcaccggcggccaggagggacacgaacacgatgatcgcgagaggatggaaggcagccattgctctgagcctctgagctagcttgctgtgctccgtggtcgactgagatattctgttttgaagctttggctgtgccgaaacgtagagaggcatgtgggttatatactgcataccatggactaaatgtgcggacatgtagatggaaattaattgtgctgattttggattaacagatcaaactttatttattgttagtcgattttgacaatatatataatgattagcctggcgaaataaatgatctgtaacgattgatctgtaaggcacttttaagagaagaaatcacatgctcatgatctgcttggtgattagttaagaatttgtagactaccgaaaatattcaggatgaagatatatattgagatttgtcagaacgtgctgcccgtgtctgtccttaacggcactgcaataccaggttgtctacacaagcagatgatatatatggagattatttagtagctacattattctccataaagacaggtttgctattttacttgcgatagatttttgggcttctatctttttatactttgtccataagattttgcgtcaagatttgattttgcgtcaagatttgtgtttatgtagttctaacttgcagttagactcatttatatagtatgtttcatgtagtattcaagtaccatggcgtcttttttctttgggtctgaaactgacagaaagaaaacaggtgcatttttctcactgtttgtagaaacaagagctttacagccaaattactggatccaaagcaagtctgctttttacatgcagcggatcgatctagccaacaccacatgatgcacggcgctatcacccttgtcaccgtgaggctgatgcatctactagcaaggagcccaaggccaccggatctagtgacctcggcctctgcgcgcaacagatccgagtagctggaggtgaagatacaagccactcctgctaccgtcctctttgatcatcttcgtcttgttgagttgtttcgcggaggcccatcgtcgggaggcttgggccggagcgtggcggagactgaagctgacccattgggccgtgcacctggggacgcctggaggtgcgggggcggagcccccgcgaaacggatcgtcatccattttagggttccaccatatatatacctcatgtaagccgccgtgcggcgttgtaacctctccccagatatagtgaagatattttgctggctagcgtccgtggttttttctctcctactttggaagggttttccacgttaaaatctcgtgtcttctgtgattgatctattgttctttatcgtttgtttgcctatcgtttcctaatacgtctcactctacaccgccctatcgatgtttggttaagggtgggcaaaatcgaactaaccaagatagaaataaaaaagatatgatcactgaatctgactaactaaatttagtctatcgattcggtaagtaggctcagttaaccaaaattccaaaaacagcccaataacaaccatcaagaaaaaaacaaaccatactcacttttctctctattccctaactacccttctccgccccaacatcccaatcatcactcgtcacgataccacatcgacggcatcaacaacacctacatcgtcttgccacttcgttgtgtcgttccccacgtagtcccgctgcgctgtaccaccattctttcgtccatggccgagctaggaattttagaaagggaaaagtccaaattacccccctgaactattgagtgagtacgaattatcctctggacccgaaaatcagacatcattcacccttgactattaataacagacaaagatcaccctgagcactattttggagcggttttgacctaaaattgtacatgtgcatcaacgtgacaatccagtcagtaaaaaaatagaaaaaaaatccttggacccacatgtcatctctctccctcccctgccctctctctctccacagcacccaacatcacttgttacaaaaaccacttcactcctccattaatcagaagcagaagacaacgacgaaggatcgtgcgttgcaggcatcgggagagggagaggaaggcaaggtggacggggatgtgcctcgcatatatgtgtttcacaccgtcgcatggctagtgttgctcacgctcgcgtcgtgccccacttttgcctctgtccccacccccgcccgccgctaccgtgcttggctccccatccgccagctgagagagacggaggtgaggggagggacaaga

SEQ ID NO: 83619 - DNA, 9194 bp, Oryza sativa
actggagactgacatcatagcttttaatttcctaaaccattcatcaggcaatatgcccgagaaattgtttgaagctagatcaagaattcggagatgctgtaattcacagtcatcatctttggtaagagtaggccccaactgtccgtagaacttattggacttcaggacaaggacttgaagtttaggaagaagatgcatccaacatgggaaagagcctccaatttgattgttcccaacatcaagtaccaccaagtttttgcaagcaactaatgatgtgggcagttgcccttcaaatcgattgtagctgaaatccaatgcctcaaatgcacaatcttccttgatattgtgcggcaactctccgttaagttggttcgccttcaagtttagtacttttattgttgaagaattctccattaagcaagaaggaattgaaccatttaagatattgtaggagaggtcaaggatttgaagactcttaacagtgcagaatgttgatgggatttctccagagatattgttcctagaggcctttagagatagtataccggcaagataaggaattaaatcaaatggcatatacgaaaaccgattatttgagtaatctaactccaagtctgaattctctttaggtataggtatgggcccttcaaacatgttataactgagattgatgtatcttgtgtacaagcaggggagcaaagagtcgtgtcctatactggtaaacttattatttgacaggtccaagaagaacaattccttccaagtttcccatgcccatcgaggtattggcccatgcatttggttatttgaaaggtcaattacgtgtagctcatcttgatgctttactgcattgggaaactttgatatgttgcaggatgctaggctcaattctgctactttgggagaacgcactactgagtcattgactaaaccgtccaccacagataatttattatttgaagagcaaggtctgataaatatggtagtctccagaatgaggtaagttccactgtccccacaaagttgttgattggaagatgcaagctatgcagttgtgtcaagttaaatatttgcaatggtatgtttccagtgaagttgctcttgaataaagacattcttctgagattcttgagattgcctatggaagatggtaaagatccagacaaaccacaatgagaaatttggagatctgtcaaagatgttagatttgttatccaagctggcattgatcctactaggccgagccccgaaacctcaaataagttcaaggatttaagcattcctagagaagacggcagttctgtagggaaattatttgcactcagactcagctccttcagatccgtgagattagaaatagagcttggtatgtaacctgagaacttggtgccactgacatgcaatttgatcaaactgctattaggtggaaaattgggcaaatcaccataaacttcatagttgtagctaatatcaatagctgtcagttttctgttctggaagatcctttgtggaaacaaaccctcaaacttatttcttgaaagctgaagaacaccaagggatgacaaatcggcgaagaactcaggtcatacaagtcattttcttgcaagtcaacaacagagatatggcaagctgaagagagactgacagatgggacctgagatcttgcaaaatggtaggctcagaacctgatcttttggagtggaattaaccagagcgttgcaccatccttcccctccattggacatatacacaaagccaagatagagctccctcagattgtcaagatttgcaaccaacctcagaaaatctaccttccagaagccccagttgggaaacgaaggtgccatgattcggcacgatcgtcttcttgattgatcacatagaaaagagttgataaatcgagagaaaccaagttggtgaggcttccaatacctgctggtatctggcctgcgaagctgggtggggagatgttgagatgggtgagctcagtgagcctctcgaatccggtggccgggagctgtgacgcgttgaagtcgttgccgccgaggttgagataccccagcgacgtgaggctgaagacggcggcgtcaaggccgccgctctgcaggcgtcggccgcctagatcgaggaaagtgacgcggccgccgtcgcagcggacgcccgcccagcggcagcagtcggtgccggcgcgccatgaccggaacgcggtggcggacgcggtggtcgccgagaacgatcgcttcagctggagcagcgccgccgcctggtccggcaagcatggaagcgagctcgcgatcaaggtttgtagtaggaggaggagtacaagtaacaacggctcgtactctcgttgggctacccgaggtgacatcttggcgggtggcagctgaatgaatgactatattgtatgatgcttgaaactgatttttttttatacatgtagagctagagagagcctgttcagtactccaagcctgacttgtatgactgaattgtgatagtgtgatggtgacatactatatcaagtcaatgcaaatgcaaataatcaaagatgccgttggcatcgtagtcgtatcgtacgtgggacgtacttaacagattttgatcgtgtcattatgtgaacaggtgtacatgcgtgtagacctttgtcatgatcagacaaatcacaaactgtagcacttatggacgaaaacagattaatccgagagcatatccgctccttgcagatggctgtagtgccgcacacgtgacacgtcgcgtatccgtagattcgtcaattcacctcggacactaatcgtgctacgtttggaaatactgttatttgagaaggaatagtctacttttatctcccttaatcgcaaaatggatgtgccctcacaatcttttaaaaagaactttttttagaaataatacaaatttaatgaaaattgtaagtggttgtctgaaatcacaaatttagcaccttatagaacaccaggttgttcgaccaagcttaaaaaattgggaatttgggatgtgtgtgcatacatgtgagtgggttgtgagattgttaacgaccaaatttgataatatcagcatcggaaagggagattagatcgaagcggaatctaagatgaggattgtcgcgggaacagagcaagaattggctggagtccggatcggctacgattggatcggctaagttcgagtcagacttggttaggtaatgcagccgatttcgataatacgacttggtgtacaacatcaggttgggttgatatgcttcaagatgattgccacgcatggatagagtcctgagaaggcaattgtatctattaattaggatattttatgtaatttccttagagatatatttgggcaaaagtctgccgcaaagacttatgatatcttagagtttgttagagataagagtcgtgtccggtatggacatattttgtaattctcgggtataaatagacccgaaccccatgtaatcaaacaacatacgttcaatacaatctcggcacatcgccactctttttgctttcgttttatttcgacgagttcttgctttcgggttgagctgtatcggtttcgatcttcaacaggaggtaaaacttgttatgacggcttgcgttctcgggattagtgcttccatctttatgacactctaatcttgtttatgtaatttatcgagttatcatatatcttacataatcttcggtaatatcgtcatctaacctacaatcggctaacatctgttaatagaaggcggccgattaggttaaatagcgacgttagcttggattatataagatatccaccactctatgaaacatccaacgacttgattgtctagatattgttctttttttcatacttaatgttgcaacagttgagtttgatctattaaatcgtgcttagaatttcaatctctagcctgtcttccggttgccgattaggatagcatcggggtttcagccgatcttacctgatttaactatagttattctatatgcttgatcgacatgttaaatctgccctttatgttaagatcttgttgcttttaagtatattaggcttctgcttggtatgttctacttgctttaatatcttaatattgagcggtattggagtattagccgatgcatgctagatctatctgatcggctatgctatgaacatatataattttgttgttaatatatatttcgatttaagtgatttatactgtatcggcatggcgaccgatctatcccaatcacttgatttaagtatatatcgacataaggattatatattgttaatatctacagccgatcgggtagatttagttcttttttacttatcaatgactgccgatcaatgcttatatgacatcggctcaaagataaatgatatgtcatcggcacttagccgatcggctatcatttatgggtttaaccacggcttctttgtttctatttcttgttgattgcaggatcaaatcaactggcacgctagcatacccgaaggcgagttttagacctgcactggagttaagcagatctcctaggcctcgtgttttccatcaatatagacctgcagcatagtacttgcttgctctctttttttataatcaagccacctaacctgtcgaatggctgttgttcgtcaggtataaatttatgtctgtcaaacaatggttgtttgatataatgctaaatttgtgatttttatcaaccaatatctgtatagctgagatctatataaataaactttacatatagcaatcctcataatgtataaatacaagatatcattaagagaagagagagaagtcgagatagataatattatttattccatatgggtagtccatatgcatacaagtatcttttgttattttttttatatggaccagttgcacaatggttgtaggtggctaaatgtaatgttttattgcttataaactacttttgcactgcattgtaaatgctccttggttctttgcttaaagacgacggttgctgatgttctggatgactggatccttttggttttaggcttttgttgcaagttagggggtgtttagattaagaggtgtaaagttttggcatgtcacatcaggtgttatatagggtgtcgcatggggtattcgggcaataaaaaaaaactaattacaaaatccgttagtaaaccgcgagacgaatttattaagcctaattaatccgttattagcaaatgtttactgtagcactatattgtcaaatcacagagcaattaggcttaaaagattcatcttgcaaattagtcataatctgtgcaattagttattttttagcctatatttaatacttcatgcaggtgtttaaacgttcgatgtgacagggtgaaaaattttagggtgggatgtagaggctgcgttcggtgggacatgttcccaacttctcctcctcgttttccgcgtgcacgtttttcaaactactaaatggtgtgttttttgcaaaaagtttccatacgaaagttgcttaaaaatcatattaattcagttttgaaaaaaaattagctaaaacttaattaatcatgctaaatgctgcttcgttttgcatgacggggaatgagggttcccgaacacagccttagttccgatggcaacatagttttgtcgaaagtctgcagattttttgtgttgccttaggccatcaccaatgcggtgcttcagcccgtgcccctagcgacggacatcccctttttcatcggtgtcgtcccctgcgatggaacgcgtccctctgctgggggatgcggctctctctgtgcctcactagcttttcgtgggaagacgcagccaggcgccgcgttgtgcgcgtgtggagctcgtgggcacggcgtcgtccccccaaatttccccttacacccttgtctctctcgctctccccttggtctcgtcgcgccgcgcccgacaccgctggcgccgcgcctaccaccgccgggaccgccaccgtcggccttagagagagagagaagagagaggcgacggtgatgacgatggatcggcgacgaccggatccggccaccgcgcgccgcggtagccatcgaccaccagctagcgacgggcggagatggcttgaggcgcctgtgctcgccgcctcgcgcgccttgcccggcctcctccgccggtgccttgcccgccaccgccggcgccacggggggcctagatccacccactacggcgccggatctggcgctcccgactgaccacgacgcgaggcggaggatgccggggaggacgccgacgggagagagaggaagagagaggggcggtggtggacgccggcaacaggagaggcggccctcctcgtcgtcctcgccgtcgctcccgctgctcctgtgacgcaccatgacgccgctcccggtccgacgaggccgccgcggccaaggaccgcgccatcgccgagcacgcctcgagtctccggcgagcggcggcaacgagagggagaaggagagagaggtgagcggcggaggggaggaggcgcgccggtaaatgagaagagagagggggggggggagaacagaggggtagtatagtaaaatacctacgtgggctttttgggctaggggcactcgttaggctactagggtatctttcattgtgagggggggtttcccagagagtactctcagttagtgagggtagtcttagagtgttctgattgtagatgcccttagaccgagttctcctttattcttgaggttgcccttagaccgagttccccttttttcttgaggttgctgcgttgaaattctggatcttttgttttctttagagcctgtttagattgtagccaaagtaaaccttaccaaaggcaagatggtaatattgccaaaattttgacatgatttcttatgtatttaccaaatatggtaacaattaaacgtagatatttttttgacaacttaattaaaaaaaattagtatggttgaaaatggtgaacaggcgcttagtccttttgtttcctttaagaatcttgtactccctccgtcttaaaaaaagacaaatcttagatttttgtgtccaacgtttgactgtccgtctcatatgaattttttttataactagtattttcattattgttagatgataaaacatgattaatactttatgcttgacttatctttttaatttttttcataattttttaaaatgaaacggacggtcaaacgttgcacacagaaacccaggatttttctttttttttttttttttacgaagggagtactagctttactatgatactatctcatctctgtcaatggaaattggggcctcaaaagcccttgaaaaaaaaaactacttcgacggggaggcgtagggcaggatgttgcccggcgacgacgaggatggccggcgccgccgtttacaacaccagatgaccagacgcgaggcggccatgtacgcctccggttgctttgcctctctgcgacgcctccgaattgagagaaagtgaagatgtgcagcggcggttggaggcggtattggctgcaggcgggcggggtctctcccggccatcctcgtggcgagctcggggcgatctccctctcctgtacgccgtggctgaagcgcatgccgcgccctggagtacttccactcctcgtcatccttctactccacctcatcccactcgaagtactcggcggaatgggggcgtgtggtggtagaggggtgagattgaggaggcgacgagggagagagatggtatccaaggttccagatcgtcgcagtcggcaattaacggggtctccatggccatggacatgtccaaggaaatgcgcgcagttcatcctattgccatcggtctcgtcgtcctctcctaccaccacgtgttcgaggaaatgcgcctctcagcggctgcaatgtacaggtgagagcacctgaagcgtttcattttccaaatttggtgtatgcggtgcagtatttgggtttaggattcctagaatactcttccattgttgattgtgcttagcatctatcgaaaacgagctcttactggatgtttgatgccgtggtattaggaatggcagtttacttgcatatgtgattgttcagcacctacaatgacgaactcttgggtcactttctgttggtatcatcgcctacatgctaacacgcacatgtctatttcaattctcactgcatttggcctataagaaaatagtttatctctaatactgaaaatgttgtcttctattaggtcattgtcaatctttctgagaaatcataaggaacttcacggacaaatatgacatatagctcttttattgatcatacaataaaatcaatatttttagagttataccattcctccaaaatatcaggcatactttccaatgaccatgcacaaagatataggatgtatttcatattccaattattcccctagtaaccatccagctttaccttttccattcatgaatgcaatagatatagtcactagagataataattgtagctattctagtcattttcaatgtctcaattgtcatgtacaaggcaagatacaccttttctttggacaaagggagtacttggtgcttggtagatccttttgtttttcagcctattttcggccttgattttgcattgttcttagacgagcccagcttggacttttggcttctgtttttattaaatggaattcataacactggatcatatttagaatgcctgttaatttcttctatgaagccataaaaagggaaaataagaaactggaaactaatagcttctgtggatgtgagataaaactataaaagtttagctgactagtttgctctgtagaaaaacagtatgcaaggtgtatgagagctcacttggagattgtgctatttcttaaaaaaattgttgtagtttggacattacaaaatttaactggctgctctgattggtacccagtaacagtttactgttttcataagttctaattctttgttggactcatttaccaattaagaaaaccataacattcttttaataagtaacatctacaagaaacccagaccttaatttcaacaagcattttatatagcactcataagtgatacctgggaaataaggtcatttctaagttcacgctattattttaggtaaggacacacagtgacggggcaaactgcttttaagtaataactacactattttccaaagccaaagcaaagtagattcagtgatatttctaaca

SEQ ID NO: 83620 - DNA, 10464 bp, Oryza sativa
  unsure (1)..(10464): unsure at all n locations
gctcgnccgagccgccccaaatctattgggccgcgccctagccgcccgagagaagtctatgtccctccctcccttcttttctttttctttttccaaaaaggatttaactaaatcctttttcctttagataaaaaattcaataatcttagaaattcaatatcttcccgaccataagtccgtttgactccgttcaacttccaaaattcctcaaatctcgagatctatctaatggcacgtttagaggtcattaatagggctttattttcgccgtttgttgagttgtcccgtttcgcgtgtagtttcggagcccgaagacccgcagcgcgaggatttcgaggatcaagctccagatctcgagcaaggcaagccacctcgaacatcttgagcctatatttgaaatttaagtatattgcttgcaaaatattatgcattgataggatcgcacttaatctgttgtcccgtctgcaaggcagattggcggacttacctaacttgttgcatttgatcctcccattgttaattgctataccatgtccccttgtaaccacccagttgcgcctcgatattcgtgcactctgtacgagtatcggcggacgccttcaaacttaaaacctgaaaaacaatttgggtaaaactggagttttacaaaagacttggaaaacccgacacctgggtcggtgcttgtgaactaaatgattttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagcatggtctgggacctaacctgttgttggtctgggacccctctcgtcggcatatggtaaacctgtgtcggcttttgaaatgccttgtcatgaaagcttggaggtctcccgacgtggctgatccccacgggctgggtgacccgggttagtaatgtcatgtgggtaaagtgtaccccctctgcagaggtcattaaactgttcgaacagccgtgcccacggtcatgggcggatgtgaggtgattcctagcgtagttttgtttgactactgcttgtgaaattgctgttgtgaaaaggggttcgatgtttgaaaaaaaatctgcagctgatgggatcagctaggcccgggtggccgtttgaaaagttgttggcccgggtggccgtttgaaaagctgttggccgggtgccaaccttgtttcaattctaaagactgatacattgcacatactccgaccggacgagatgcactgtctcatccgtgtcgtttgagaagcactcacctagttgttttagaaaagagatcaaataaaataaattgcaaaaacaacagcctttccttgaagcctgcattaaacacttatttcccctggcttgctgagtactcccgtactcacccttgctctatataaatatcctcccccccagttgctgaagaagatgaagcaaatcctgctgatgaggagttcttccaggagcaagctggttacgatgagttttagggtttcagcctagttcccaagtcgcgcctgtgatggttggtccaagtcctggcttccatttcccttttgtaatgcagttgtgagctcgggatctgtccgcagcccaacatgactgtactcttactctataataaagagacctctgttgctgtgatattctatcttcctgtgataccagcactgtttcctgggactggtatcgattaacaggttaatttggaacgtcacgggctagttccagtcgggactagttcggggcgtgacaagagatggtatcagagcacaggctttgccctagggcgaaacccgacgcttaggacgaccctaaggatactaagttcaaaactacttgcgaaaagctaaggtttcttttgttttctttattttcaatagtttgtttccaaaatggttactgatctttctccctctttcaaaattgtagatggcagtgaacgccagcttcagttcccacggttttggtgagggtcaccacgtcgcccagcttcgtgacctcgcccgtttccttggcttctcgtgtcccgagtacacggggtactccgtggaccgcgttccccctcactgtgagctctctgtgtacctttacccccgtggaggtatacacggagctggccttcgcccacaccacttcactgtggccaggcctactctccagatcgcgtaccaggacctctcctggactgcgcttcgtcgcctggcccacgactacagccaccgtctcggaggctccgccttccggcagtttccacgccttccttctggccactcagacgccaggtacccttgcccgtacagcgagtctcagccagtgctgactcacatggttgagctttcggaggctcaggccacccagcacgacctactccttgaggcttaccgctctcttgctcgccgctacgccgctttggaggcccgtctggccgaggagggtgtcacctcagttgacactatctcttgggactcaggtcgcctctgccacgccagccacctgtcctcccacagctcccgcggctctgctcgcactcccagtggcccgcgctcccccagctcgcgtgcgccgtactcaccagtgtactccccctacccacacccagttagcccttcctacacccccggtcacaccccagttgcttcctcccgccgtggcccacgctttatccgcactgcgcggaagcgtgttgttggttcttccaccgtgttccgtttccactacccagctcctccaccgccagcggcccgtgctgctgccggccctcgacaggttccgccggccccttcgcgccagccgatcgacgtttcttcgactgaggagccgactacaggaggcagccaggccgacgaggagtagaggaggcagtcttcagcagccgtccgtgtgttaggcccttttgttccgccgccaactcttttggagtcgtggcgaggtagtgcgtgcgtgtgtttgttgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctatctgagttgctatttactttgctccttgccctcctaagtgcttatctaactcttacctcgccctcttctgggagtttagatggctagccgcccccgccgtgcagcccgtgcaccagctcgctttggttttgaagatggtagagtcgaagcagaagcaaatcatgaatcagctaatgagcagtctcaccacagcaaccgttcgcaccgtactgtttcccgcaacgcagaagttgagcaaccccgccgcagcaactgctcgcatcgcacagtttcccgtgatgcagagatggaacagtctcaccgctcttaccgcactgccagtcacaattctggagaagaacgcctcccttccccacctcatgtggaaaacaacatgcaacacttaatggcagttcagacgcaaatcttgcaaggactaaccacagccatagccagttttcagcataatgcgcatggaaatggccacccccacatgggcaacaacagatccaagctgatagactttctgaggtctcgtccgctagagttctctcagaccgtcgagcccgtcgaggctgacgattggttgaaagatgttgatagaaaactcaacttagtgcagtgtactcctgttgagaagacgctctacgcctctcaccagctaagaggacctgccgcagattggtgggaaaattactgcaatgcacatcctgaacccactaacattgcttgggatgagtttgctacggctttccgtgcagctcatgtgcctgaaagcaccattgacatgaagaaagaagaattcaacaggcttaagcaaggcaacagcagtgtcaatgagtacctaagtcagttcaacaagttggctcggtacgcccctgaagaagtggacacagatagaagaagatcaggaaattcttgaaaggtatcgcagttggaatgagactccagttgcttgctcatgacttccccacttttcaacatatgatcaacaaggcactcctacttgaggatgccagaaaagaggctaccgaagaatacaagaaacgctagtctaaccatcagggaaattcttcccgaggcgcacctcgccctcgctacggtcaacccatgcaataccaccagtcggtcactcagactaaccgccagccaggctacgcccctcgtcctcagatgaaccgtccggcacctccgccacagcagcgtgcccctagtggcaatactgcgccaaacagtgttacctctttcaagtcaccacagggaccgtcagcagttcagtgtttccggtgcaaccagatgggtcactatgctagacagtgccctcagaatcctaccaacaccaactcagggcatgctaatggcagcaatgccagaactcctactccagcggcagctcagtctcgtcctagctctcaggcaagtggacaaggttcacgtgcttccaacaacttcggtcgaggccgtgtgaatcacattcaagctgaaaccgctcaggatgctccagaagttgtgatgggtatgttctctgtcaactccgtacccgcaatagttctgtttgattcgggagcttcccattctttcatatcgcaagcttttgtgaaaagaaatggttggaaaacccaaaatttgcgtgtgccaatgatagtacattcccctggaaggaatataagggcaactcaaatatgcccggaagttaaccttagaattgaggaagttgacttcctagccaaaccgatagtcctagactcgcaaagcttggacatcatcctagggatggattggttggcaaagcacaaaggacagatagattgtgccgaaaagtccatcactttgcaaggacctggaggaaagcaagtccgctttacccctaacactcctaccgcaaatcggtctattctaacctgtttacaagtcacctccttggagtcggtgcccatagtctgtgaatatcccgacgtatttccggaagaattaacaagaatgccaccagaccgagaaatcgagttcgccatagaactggcaccaggcactgcaccaattgcaaaaagaccctaccgaatggcagctaatgagttagcagaagttaaaagacaaatcgaagagttggagagtaaaggttatgtgcgacctagctcatctccttggggagccccagtgcttctggttaagaaaaaggatggctctgagagaatggtaatcgactatagagccctgaatgaagtaactataaagaacaagtacccgttgccacggattgacgatttattcgatcaacttaaaggagcaagagttttctcaaaaattgacttgaggtcaggttaccaccaactgaaaatcagatctgaagatatcccgaagaccgctttctcaacgcgttatggtctatacgagttcacagtaatgtccttcggactcaccaatgctccagcatttttcatgaacctaatgaacaaaatctttatggaatacctggaccagtttgtcgtggtattcatcgatgacatcctgatatactccaagaacgagaaagaacatgctgaacacctgaggctgataatggaaaagctcagaaatcatcgactattcacaaaattcttgaaatgcgaattctggttggaccgagtagcatttcttggacacgtgatctcctccaacggtgtcgaagtagatcccagcaaagttgaagctgtacttgcttggaacccgcccaagaacgtgtcagagatccgcagcttccttggcttagctggatattatcgaagattcattgaaggattctctaagctagccagacctatgaccgagctgttaaagaaggaaaagaaatttcaatggtctgcagcctgtgaagacagctttcaggaaatgaagaaaaggttgaccactgccccagttctcaccttgccagatatccgaaaagatttcgagatcttctgtgatgcatcaagacaaggcttaggatgtgtcctaatgcaagaacgaaaggttgtggcctatgcatccaggcagcttaggcctcatgaagtcaattatcccacccatgatctcgagttggcagccgtggttcatgctcttaagatctggaggcattatttaatcgggaacagatgtgaagtatacaccgatcacaaaagtcttaagtatatcttcacacagaccgagttaaatatgaggcagagacgatggttggaactaatcaaagattacgatcttggaatccactatcatcctggcaaagccaacgtggtcgctgatgcgctaagtcgcaaggcctattgcaatatagcccaaatacggcctgaccaagatcacctgtgcaaagaattggagaagttgagggtgaccgtggtacagtcaggtgtccctgccagcttgacggtacaacctaccctagagtcgcaaatccgggaggctcagaaagacgacgaagggataaaagagttaataaaaagaatacaagaaaagaaagacaccaatttctccatagacgatcaaggcacagtttggtgcggtccacgcatctgtgtaccggccaagaaggagttaagagatctcatcctaaaggaagctcatgagtccgcctactccattcatccaggaagtacgaagatgtaccaagatatcaaggcatacttctggtgggctggaatgaagcgagatgtcgcagaatacgtagccttgtgtgacatttgccaaagagtcaaggcagagcatcagaggccagctggtctgctgcaacccctaccgattcccgagtggaaatgggaagaggtcggaatggatttcatcaccggtttgccaagaacccccagcgggtacgactccatctgggtaatcgtggatcgactcacgaaatcagctcatttcgtgccagtgaaaaccacctatgatggaaagaaactagcagaactctacatgacccatgttgtatgtagatttggctgtcctaagaaaattgtgtcggaccgaggcactcagttcacctcaaggttctggaagcagttgcatgaagccctcggaactgatctgaattttagtacagcctaccatccgcagaccgatggtcagaccgaaagggtaaaccaaatcctagaagacatgctacgtgcgtgtgccttggatttcgaaggcacttgggatcgttgtttgccgtatgccgagttctcgtacaacaacagttatcaggccagcattcaaatgtcgccgaatgaggcaatgttcggaagaaagtgccgcacccccttgtgctggaatgaggtgggcgaagccctggtattcggtcctgacatactcaagtcagcagaagaacaagttaagctgatccgagaacgtttaaagacagcgcaaaaccgtcagaaaaattacgctgacaatcggagacgtgaccttgagttcgaaaaaggagatcatgtgtacctacgggtatcacccctccggggtatgagaaggtttgggatgtccggcaagttagcaccccgctacatcggcccctacctcataaccgccagacgtgacgaagtggcttatcagcttgagctacctgaaggtctcgccgatgtgcacaacgtgtttcatgtatcccagttaaagaaatgtcttcgagttccagaagagcaagttcccctgggtaatatcgacctggaaaagaatctgaccaacaaggaaagaccgatcaaggttcttgaagaggcagaacgtcagactcgaaggaagaccatcaagttctacaaagtccaatggagcaatcattctgaagatgaggcaacctgggaacgagaagatcttctccgcgccgagtttccggagctgctcccttaggtgctaaatctcggggtcgagattcttgttaggtgggttggtctgtagcgcccgttccgtcgtggcgcctagcgggaaaattatctcttaaaaaccctaattgcgaaatttgtttctttgcttgttgtctagtgtccgtgccatctcaagatctcaatccccgatctatcgtcgagttcaattccgaatccaattccctccaaatcaattcctccgcaaaagtctagtttgcctcccccgggtttgatgggccgatttccgctcggcccatctctcccccggccccctctccccgggcgctctctctctctctctctctctctctctctctctctcctctcgctccctccccaccccggcgcgtttccccccccccccccgctcgctgctcgcgcgtgcgagagccgcgccgagcgcctctttcttcgctcccctccgctccgcccgcgcgccgcgcgcgcgtgcgcgggtgtcaaccgcgccgagcgccccctcctctcgcgcgagctccccgctcgcaaagccggccccgcgccgttgctcgcgcgcgcgcccgcgtggtttcccgcccgagccgcgccgtctgcgccgtcgtcatcgcccggtcccgctgcccagccgcgccgcccgttgcttcccgcgcgcgtgtgccgagtggccgaccgcccggtcgccgccgtcgtcagcgcctgcggcgcctgacgcccgtgtcgccgctccgctccaatccgctcgccgtcatcgccgtcgtcatcgcccggcccccgccactccgcgcgcaagccgccaagggacggaggccgagctctccttttcctctgccgcgtcgccccgctccctcctctttttcccgtttcggcaaaggggcgagccccctttctctccctccttttccccttttctccttctttccctcgccggcgtcaccttctgtcgccggtggggacgctagccggagcgccagctcgccggcttgaccgcccatgtcggttcctctctcccaaaccgacattgccgcccatttaaacccgtcttccccctcccttcctttcctctcccattcgcctcctcaccattgccgccgctcctgtgctctgcctcgcctccgccgtccatcgccaagcgccgggagagccggtgcgttcgtggacgcggaaggggactccgggcgcgccctcttctcccttttcctcggcctgaggccggagagattactcccgtgccgtcggcctctcgtcacagcgcccctcctcttctcggtgatgcctctctccgttctccctcctcgctccatctcctcccccctagctttcggtagtagctcgagtagaacccccgtagctagccggcgccgccccaaccgtagccttcgctcgccgtgtgctcgccgccgtcgccgcccgagctccatagcacccgctcgtcgccggcctcgctcggcgtagttccgtccaatccgacgctagcgttgagttcccgaagccgcgtagatgctctcaccgccgggaattagcccctcgtggcctcgtcgccgtttcccctttctcccgccgccggttgccgccgccgcaatccgccgccatcgagcaacccccggcaaatccgagccgttggctcgtctcccctcgtctcgagcaaccgcccggtgtgctcgcttttggccgtatcgccgtggttcgctccgccgctcgccgctgtcgcccgccgtccattcgcggccgggtcgtcgtctacctcccgccggcccgcgtggctgccacgtaggcgccacgtcggcgccacctcggccgcgaccggatcagccgacccagccagccgctccctccgtttttccccgtgcgcgtggtccgcggtgagccgtgaggttgcgcgtgggcccgccgcatccgttcctccgcaaaccgcgcgcgtgcaccgcgtcccaaccccgcccgcgcgcgtgcgccacgtgctccctccgcacggtgagccgagccgctgacaagcgggtcccacccgggaccgcgcgtggtgagcccggtccaccggactctctctcctccctcccgcgcgcgcgcttgggccgtcttgggccggccggcccgttaagctcggccgagccgccccaaatctattgggccgcgccctagccgcccgagagaagtctatgttccctccctcccttcttttctttttctttttccaaaaaggatttaactaaatcctttttcctttagataaaaaatcaataatcttagaaattcaatatcttcccgaccataagtccgttggactccgttcaactttcaaaaatcctcaaatctcgagatctatctaatggcacgtttagaggccattaatagggctttatttttcgccgtttgttgagttgcccgtttcgcgtgtaggttgggagcccgaagacccgcagcgcgggatttggagga

SEQ ID NO: 83621 - DNA, 10963 bp, Oryza sativa
  unsure (1)..(10963): unsure at all n locations
aacttgtccggtataaaatcgcccactctgctgcaagataatgtaaaaatttcatctagtggtggtattaactctctcttttgcagctgcttttaaatcgtcccaaggaaatccaattgatgtcaataagcttggggtagtgtcgttgaaatcagaggctggtcaaaatggaaatgtgaaactaatttcgaaggaaggcacaaacaatgtgaatgtggtgcacccagtgagttctgtgtcagaatcaacattgatgccacctccggaaggcgcaaacaacgtgaatatggtgcacccggaaggcgcaaacaacatgaatgtggtgcacccggaaggcgcaaacaacgtgaatatggtgcacccggaaggcgcaaacaacgtgaatgtgaatatggtgcacccagtgggttctctgtcagaatcaacaccgatgcagcctcctgtgatgccacctccaattccgaagcttctttctccaccagcaccccaagctcccatgccaccattaaaggcttctcctgttcctcccccagaaccttcaccacctcctgctccaaaagctgcacctccaccgccaccaccaaaatctactggccctggcccacctcgcccgccaccgccagccatgcctggttcttcgaaaacacgcccaccgccacctcttaagccaggcgctaaggtgggtgctgttgaaaattctaatgaagctaaaacaaagctcaaaccattcttttgggataaagtaactgccaatcctgcacgatcgatggtgtgggaccaccttaaatcaggatcattccagtaagtcttcagattaaattgaagctgtgcctgaacttactattgcaagaacacactagtttaaagtatctgaactgtttcacaggtttaatgagcagttgatggaaaacctttttggttataattcaactgacaagagcagtgacaccaagaaagatttatcatcgaaagatgccactcaactcataaggatacttgaccccaaaaaggcgcagaacctagctatatcattgagggcgcttggtgtttcacctcaggaagtatgtagtgcagttaaggaaggtaaagttcatcctgtatggaactcgtcttttttattcttagcacacactcacagtgctttctagcttcatatttatcatacatacagtatctttgtaaaagttggagaactcagctatgatggaatgctgatgctctgaattattatcagacttctagtttactttgcttgcaataatgtatatggcatacattgtagatatgtgcctatttcaatttagttttcaaagtgacgagatgagggttgctctcttctgagctaagggtgacaagattaactttttttcaccaaagcgaattgtgcaaaagatatgataagtgaaatgattcatttcatctacttcaaccgctactattgagaaatgatttacaggattatactgcaaatagatgcatgttactagccattagaagttagattggtttctggtatacacaaatagtgcctccaaccattttgtttcaagaatttgatgttggatttcaccttaaccatttttcttgccaatttgtaggaagtgaacttccatctgatttgatacagaccttaataagatggtccccaagtaatgatgaggagctcaggcttcgattatacagtggggaactctttcaacttggtcctgcagagcaattcttaagagtaatcatagatattccttatattttccagcgcttagatgcattgcttttcatggccaatttaccagaagaagcttcaaatgtgaagcaatcctttgccactttggaggtaatgaaagattcattgtgaactctcaacttctagattatctcacattgttgtgccagttttgttcagttggcgatgtctagtattctattgatctaacatttccatgaagggttatatccaagtagttagttctgttacaataaatgcacttttactgcacagtttatgcctagcgatcggattcttaaaatatgagcctctgatcagttatgcttttaatgaattttgttccatattgattactattcttatctctgttggcatttcaatcccaatcaggtggcttgccaggagcttagaaacagccgtctttttatgaagttactagaagctgtcctcaaaaccggaaatcggatgaatgttggcactttccgtggtggagctcaggcttttagactcgacacgctcctcaagttgtctgatgtcaaaggaactgacggaaagacaacactattgcattttgttgttcaggaaatcattcgttccgaaggtgtccgtgctgaacgggctgcaaaggagcagaacagtggcgtttccagtgtgaagactgatgatctaggtgacaaaagtgagcaaactgaagacggttacaaacaactggggctgaaagttatctccagcttaggagatgaacttcaagatgttagaaaggcagctatcctagacgcggatcaattgactatgtcggtagcaagtcttggccacaagctcatgaaaaccaatgaattcttgaacatggacatgaaaagtttggacgaagacagtgggtttcaccgcaagcttacgcacttcgtacagcagtctcagactgatattactttcttgctggaggaagagaagaaaatgcggttattggttaaagacaccgtcgactatttccatggaagtgcaggaaaggatgagggcctccggttatttgtgatagtaagagatttccttgcaatgctggacaaggtgtgcaaggaggtgaaggaagcatcaaaagttgctccagtaaaagcaaaagccaaacagccctcccaatcattgcagtcattccgtgatccacgggttaatctttttccggcgattcaacacctgagggcagatagctctagctcaagttctgatgatgaaagttagatcaacatacctatgttttaccgtgcacactcagtgagaaaaattcatcaggaaatgataacgccaaaacaggttaaaactgaatcgatcttctatcgttgggttgttatctgttccgaccctgcattcttcacttttgaatttctgattctatcaagcaaaagagttgcacaaaactgaggctacacataattggaagggatgctatggaaagtaaaatttagcaggaaatggaaggaaactgacctcctagttctatgttagggcagggataaccggctgactgatagtctgacacttttttttcttttacacatttgtacaaccacagaaaggaagatgtatagacattagacagagatagaaaaagcaccacatgaactggcaaaacgggcaaatgtaacctttaaactgaaacatcatgtgttcctatcctgcgtgaactctcctgaaatgcttgttgcatggagaacaattttcaaaagaaaaggaaatatactaaatgtattcaatggtgaactgaatgaaactaatttgatgtcgtagatattgctacatttttatattaaaaaaggtcaagtttgactttagacaaaactcaacaaaattacttatgaaacggaggaagtacataatttcttttttgaatctataccaagtatgcatcattttgttggtcagacaataacccaattactctgacaagattttatttttcttccattcatctctcctgccgttaagccgtttctcctgcagctagttggtcaggcaatagcccagctaatggtcaggcaatagcccagctaagccgtttcttcacacgccaattttcatcttcccgccctggcactgtttcaaatcacaaaaatttcgccactgcccgcgcaaagctttaattttgtagaatctcctaaacctgcaccagatccaagaacagctatacactttgaacacgatgcaaagctttaactaaacataacaaattattcaggaacaccagccaagtcacaactttctatgccaggctccacatgctcgaataatgcatgttacattggaactcccaaaatcagatatacgaatttcacgaccgaagccagcatcaggctaaaaaacgaaaccacacatgaattatggccaagaacatttgccacgattcaaagacaacccgctcaaaatcaaattgaaaatttgagcaaccgaaagattttgagaaaatcatcaaagcaatgatacttaaatagatcatagcgacgatttagagagaagaacccgttcaaatcaaatcaaatcaaaaactggagcagcagttaacatttcaagaaaatcatcgaaaggatgatacttttatatagaacacaggtaacgaattacagagcaactaatccccctgtccatcatacacaagtgcaccttcttagttttagcatcggtacaagcacaattaagcatctaattcagatcctactagagatcaacgcaacacctaggcatcctagaacactactactactacacaacatatcatccatccatccactgcatccacatccaccgccgccgccatcgccgggaagcgtcagaatctagttgtcatcgtcgccggccgccgccttggcgctgccgccggccttcttggggaggagcaggttgtggatgttgggcatgacgcctccgctggcgattgtgaccgtgccgagcaggcgggatagctcctcgtcgttgcggacggcgagctggatgtggcggggcactatgcgggtcttcttgttgtccctcgccgcgttcccggcgagctcaagaacctacacagtagacacagattccaccgattagccccaaatcctcgctaattcgagcgaacaaagcgaaccaatccacgcaaacacacccgaattcgaatcttccgactaacccccaaatttcccccattggaaaccctaaaattctacccccaattctgtaaccgcgaaccccccgcccaaatttcaccgcgcaaaaaccaaaatcaagaaataggaggaacagaatcgaacatacctcagcggcgaggtactcgaggacggcggcgaggtagaccggggcgccggcgccgaccctctcggcgtacttgccggccttcaagaaccgggcgatcctgcccacggggaactggagcccggccttggagctccgcgacatggccttcttggcggcgcccgagccgatcgccttccctctcccggccatggctaaaccaaaccaaatcaaccaaccaaaccctccggtagtagtacggaatccgcgggcgaggcgacgaagcaacagcagcagaaaaatctgtggagaaagtgcggcgacgcagcgagcgagcgagcgagcaatcagtatacggcttggtaggttggaggtgggggtggggagcagaggggattatataggagggcgcggccaatgagacgcgagtacgcggatcggtgacgtggcgttggagggcgtgggggctggggatccatcctggccgtcggatcgggagagagccgtgcagcggttgggtttttggtttttttttttttttttttgccgcgcacagcgtttcgggcgccagcggtgggccccacccgcagggccgtatcgatcgtgggcccggattctcggcctgtgggctgcgggatccatggaaatgtaggagtattcgcccggaagtcaagttacgactagtttggaatttttcaaatatttcgtcgaaaactgtcgattttttgcaaagactgccttcttttagaatttgatttagtagtaaaataattttatttttcacccatcgcataaatcttaacgcaactataaatcactttatctatttctaatataattattttttactttgacaaactccaatacaataattatttaaagataaatttattttgagaagctaaaaatgaatatggaacggaggaagtataaaaacgaatctagaaccgaatgtaacatactaatattataaatctgaacatatgtatatttaaatttaaaatattaagatatgtcacatccgatattaattcgattttttatatgacgggggagtagtgcagtgctagcagacttgctctgctgttcatactcttcggccgtatcacgaccgaatggattggtaaagataccgtcagttcgtagccatcaatcagtccagaaccctagatgcgcgagtactaggtgacacgtggagcggggagggggcaagtgtcaagagcgtggtaatctgagccgtcggttcggtttactcgaccatgacgccagcagaggtggctcgtctccaagaaccacgaattcgcactaaacctgcagctagtggtaaacagtcaggatcaaacgagcgattgcactagtagtgtcaaccggcgactctgatccaggagtgaggagagagcacccggtgaaaattactccctccgtcccaaaataaatatagttttacacggttcatgttcaacttttgaccgttcgttttatttgaaattattttatgattagtatttttgttgttattagatgataaaacatgaatagtactttacgtgtgactaattttttttaatttttttataaatttttcaaataagataaatggtcaaacgtcggacacagttccccatgactacacttattttgggacggaggtagtacaaggattgcagcgaatggatacattgttgacaatgaacaatgaaaatccatcttcggtcagttcagtgagaaccgcataaatttcgttagttcatcgcctggaggactgaccaaattagtacaaaacaattgcgtatcgggaattcgagaccgagcaggcaaacacgataaattgtttctaatattacacaaacaaagcagtaatcttgcattgcgaaaacagtttgttcagcgcaacgcaacgagaatgcatcaacgaccaaaatgatgaggcagagacaaatagtggctcaaagtttcagtttgttcctcatttcttcaaccattaaacaaaccaacccaacatgatcatcagttcatcacaggcttacatctttagataaatacccacaaaaatttcgccgtattcacatcctgatcaggccaccaaaccaccaaccaagaacttctctctctctttttccccttcctactgctcagcgcaacaacacaatgcaaatccagacgaacagctagcaaaagatcctactaatgcagaaggcgcccgggcggcctagttgtcgtcgtcgtcgacggtggatgccttggatgacccggccttcttggggaggaggtgctggtggatgttgggcatcacgccgccgctggcgatggtggcgccgccgagcagcttggtcaactcctcgtcgttgcgcaccgcgagctggatgtggcgcggcacgatgcgggtcttcttgttgtccctcgccgcgttcccggcgagctcgagcacctgatgtcgaacaggagaagacccaacgagttagcaaaagagaacaatgcacagttctttctttcaatctacaagatgcgagcaattgaacccagcaaatgcaaatctagaatacccaaacatttgttccccgataacctcaaatccgtatggatttttttcaagcgaggcaaacctaatcgacgaaccaaactgaaacaaatctaacaacacccgaaataacatcgcctagatcggacgaacagaaaaaaatccccaaatcacaccgacgcatacctcagcggcgaggtactcgaggacggcggcgaggtagacgggggccccggcgccgacgcgctcggcgtacttcccggccttgaggaacctcgcgatcctgccaacggggaactgcagcccggccttggagctcctcgacgtcgccttcttcgcggcccccgcgccgatcgccttcccacgtcccgccatatcactcgccgacgagaggagaggagaggcgcacgcgctacacaaggaagaagaagaagaagccggcggcgagaaggggcagcggcagcggcggcggcgctaggtcaagaggcggcggcggcgtggattcgcgtggcgcgagaagactagggaagggaagagctgagatgctgggatatataggggtcgggggggttcggggcggcagccaatgggaggcgatcacgcggatcgcggacgtggaccgtcggatgcgtttggacggacggcggatgcgaggggggttttcgatccggaagcggcgggagtaggaggaggcggtttcgtttggatttttttgggagcgcgccaagtggaaattgacccccggatcggtgacgtggttctctcttgtgggtcccggcggtcagtctctctctcgtggtttgagttctttgttcctcgtgggttgaacacgggcttgggcctcttttttcttcttcgcggggttggttacttgggcctcgaggtaatttggggataagtccaatttacacccccgaacttttatgtttgtctaaattacaccccaaaactataaaaccgggtataatacaccctctaactatcaataccagctatttcatcccctggagcggttttaaagactggttttgatttaattggacgccacgccagcattgtctcaccaagtcaaagcaacgccagcatgcatctcactgtggagatgggcaaccgagcaaggaggaggccaggagggagtggcgacgaggaaaacgagcagcggaaggtcggaggcagccggcgtgctccctccctctgtccnngggcatcctccctcctccactccccacgagcccatccatggcgaggtgcatgcagcagcgcgggagaaactacgacgagcggcggcgcggcatcagatagggcagcgcgggagaagctgtgacgagcacgagacaagctgttggatcttgaactcgtgctcgccggcgacgaattcaccggtgctcgggagtgcggctacagagggggacctgggggaggggggaggggggatctggaggtcaccagttcttggaagggcgatgcagagggggagatcaagctcaccggcgctcgggggtgcggcaatagaggaggagctcaagctcaccaccggtcactcggggacgagagaaaggaaagaaagagctcaccgccggctgcactgtgtggggtaagagagaaggaggagaggaagagaggaggaagaagaagatgacgtggaattatttgacaggtgtcatcctacgatacgtcctcgtgtagcaaaaccacggtaaaacagcttgaggggataaaatgtccggtattgatagttagggggtgtattatatccggttttgtagttcgagggtttattttagacgaatataagaattcgggggtgtaaaatggacttatcccgtctgcaaagctagcctataaaaccgggggctcctagctagcgcgtgctcggctgctcgctgctatcgagcactcctcccatattaactacctctattaaaactattagttaatatacttaactacctttattagtatttagtaatgatagtaattaggaaagattgtggagatttttttactaacaaattgaaaaaattttaagttaaatttgaaaactttcgatttaaattttaaattagattaaaaaactttcgatttaaattttaaagtcaaattttgaaaactttcaacttaaatttgaaaactttcaacttagattcgaaaacttttaactcgagattcgaaactttcaagtccagatttgaaaaatttgaaaagtttcaatttgagatttgaaaactttcaactcgagatttgaaaactttcaactcgagattaaaaaactttcaagtccatatttgaaaattttgaaaacattcaactcgatatttgaaaactttcaagtccagatttgaaaactttcaagttcaaatttgaaaattttcaactcaaaatttaaaaactttcaaactcaaaacatgctaaagattacaaaaaataatcagaaaaaagtggaaaaaatgaaaaaaaatgggtaaagaaaaacgaaaaaaaaccgtgggagggggcgcgcaccggcgctgggccttatggcccggaaacgcgcgccgattagcgatcgcgtataaaagcacaaaataaattggatgtgagtatttataaatttttgaattcataatataataactataatagcaataataaagtcaaagtcatctttgagaagtgctggtttctctagaacttatgaggacgtggatttgttttcatggatgaagttacgaggttttttacttagatattcaacttgtttgtacatgatatcattgttctgttttaaattcattatataatgaatttatagtttgaataccttattaaaacagtttacctgatgtgatttatcctcacacccatataatagttttttcaggcgcctgatgtaacatgctcgcttgtgcgatgagagtatctacacttctacatgtcatgatcacactaaatatatggagtacatgtttatgatggggttatagttgagtttgttatcctagtgtattagtttaacactagatatgttcatcattattaaatgacttgtttgccaaagttttggttctccactacgaatcatacgtttccgttgcggaagttaccaaagaagttagagtctctttcaaccatttttctccttttcgctatcttgcttcttcccttgcagagacaaagtcgggtcttcacaaattcctcgtggcataccacaagcttgggtgctcgccgatgactcctatccatctaggaacctatatctctaagagtaacaaacacgatcgagtatttacatgctatgaactcaatggctcaaacaatacagtgaggctcgctagctctcaaccttacaacctctcaatccaacccttctcttttcttctcatatcactctcacaaagagctaacactaagataaggtatttgggagggctacaggctttggataggtcttctcttgcctgcccaagaacaacaaggggctgcaggaa

SEQ ID NO: 83622 - DNA, 5457 bp, Oryza sativa
aagatggttgattcggtttgattgtgactatatagtatagttgcctaaactggcaggtaacattggaatgttgccattcaaacaataactggtgctgggttcttagaattcatggtagatagcttggatccttatattagtattggcaattggctgatgggtattatctattagattactcttgaaatcatttggccattttggtgaggcacatattcttaaaatcattattatatactaagtcttagggggctgtaaatattatattatggattgtattttgatgcatatagattgtgttttagattcacatgtgagggaagaaaatatcatctgctggaacaaaatgttctttcagcatgctaattaaagttgaagcactgtgcttttattttacgtgcgtcactgcttatcacctaacaatggcaacaaaaacagcaatagtaacaagaagatgacgaaagagacatgagaatctcatctgaacacaattttcccacaatgcagttgcgtgctgcagtttggcttgagtcttgaggtcaacagatagggaaatatcaacttagggagctgccaatgttggtgccaggggaaatgttacatgcagggtatcaccataaacgcattatgcatctttgaggtggcgatgattaagttatggcaaactaactcctgctaggtttcaaacccctctagcttttcttcttcatggaaaacaatggttccctgcaaaagaaagagagaatgggaaatttggtggtatgcctgatatatgtttgtctatttgactggtttgctacattaattctgtgtacatttggcgcactgtgaaaattaccccataagggagacatgccacgttcaaccccatggaggatataaccctgcaaaggaaaaacaaagaatccctagccacatttaagaagtaatattagccacatgtacaattaaattcagaaacttccttaacaatgaccaaattgatgagaaaaccaaccacaacattgaaaaaaaccaacaaatgccagagataattcactataacaaccccccaatactaggcaagcaagaatgagaagctatgctcatctgaatcatcatccacacctacctaatctgcccatgggaaaaggtggatcctgcgctgtttgggcaaacaagcctaagctggccagctgtgtttttagggtccataagttgggatttatgataatctatttggtaggtttcagtacctaaactaccacaaagcatttagtgttattggaatgattttcttagatgatttatcctctgttgcataaagaagtttaagccttttccttctggttagaaattattttttcttctaccacttctctcaactagtgagtcaatgtggcccatctgttcagtaattatccatgcctgttcttttgctccattcttgaatttttttctgaagttgactcggttgtctgctgaccatgttattttataggaaaatcggaacctgctgttgaggttcagatatgcagggttggaatagcgccaatgttttatcggtcttagcaaggtatatatatatatcctgaaattgggattctgttaaacttctttcagtatctgatgcacacctgtgattgctatgaatgttagttaggttattcccaatttaggttctagttcattatctttgagtttttcactgagacacttatttgtgactggctacttttgttacagtaactgaaccatgcttacgatatctatattttacgttgactaatttctggtatgtactgcactgactatctactttttcatagttcagtgggttttgcaaagtttgtccatctagggttgtaacttctatatttgttactggtagccagggtttcccttaccgcctttaaccgcgcggttaccatggtaaccggtcttaccacgggtgtacagtaatggttaccggcggtagggtttggggaattttgaccaaattcaaaatttccaacaaaactgaaaaaaatccaaaagaatcatggatgtagttcttgctttttagtggcggatggtgaagaattttttttgaaaaagagtaagataacacatttgagggcaaaaccgaaagtagtttagaaaatgggaaaaaaagaaataaagtaatgggcctgaagttgcaatgtttatcggacccattaaggcccaatagtggagaacatatctcccgtgtggctagggctctcctctcgttctctctgtcggcatgaggtgagggggcagagtttcccttaccttttggagaggggttatcgcatccccgtggtaaggcagttacagcggtaaccgccaaaaaccatgtgaaatacgtcgtaaaacatttgaattcaaaaattcggcggtttcacggtttggtcacggtttggcgcggtaaccgcaatatttgcgtgataaccgtgatttgtatagtagaacataataatgctaaaaaaattgaaaaaacactaagatgtgtagaaattagagataattataagattatatatgatactttaaaacctaacttttcgatgaaaaatgcaaaaaatcggcctgaccttttctatattatggactttgaagcaattcaacgattcatagcatgataattaaacaacaacaattcaacaaccatttcaaagcataatgatgtccacatgtagctcaaacaatagagttcacaatataatgtccatgactacatatatgatagttcattatgacaagcaacacgaatataaaaatagtttgaaacgaaggatataaataaggacatactaacatagtgcatagctaggtgttccactgattgtatgccatgttgtacttctctgtggacatgagcaacaagttgtgtgagtgtagcaacctcgccttgtattcctactaactttgacctgtccatgatgctgttgattgccactgaccgtacaattgagcataccacttgggctcttgccactcatacacccatgtaggaggataatcagaagcttgaggacggttgtacacgtacattggatatcaacatttcaatgctaaaggcactgaatgagctatagctatgctatggtgtgtcaagctgctgttgttgttggcctctcagagtaacggtagttcattgagagcttggagcaccatgatcttggtcccgagcatcgtgagtgaagtcagtctcacttgcaaatcaaatagtaggaagaagattaatcggtcgtgaattgcaaggtgaaggttgaaataataagtaaagaattgaattaggttgtggtcatctaacactgttgtgtgacccctagaagtcacattagtggcaccttggccttcttgaccatcgtcgtctccgttatctgtatcagttcttgagctactttcatcggactcttgatagtctgggctcccttgagtctcttcatcgctatcaacactccttgaccgtgtagctaatctgattgttagtgtcgtagaatgataggtccgctggcctttgaaggggatcgtcatcgtccttcctaacttgggtatttgtttgctgaatttgaaggcgaaggttgtagttgacatagacaagtttgttgagcttgttgtgtgtaagtttgttacggatcattgtatgtatggatgcaagtgtgctccaattccattcacatccacttgaagagcaacactgatcaatcaaacgcaacacaagtttcttcaaattcggcatgcccgatgtaaacatagaccgccattgtgctgcaaatgccgagtaacatgtcattttaattttgaatacgtcgaaagcattcggacttttgatagttgcattatctgaaacataccaagccaacttttcccatccatcaccatctttcttgcaagcggcctcccaaattcgctactcttacatcgatacatctcaacctccagcaaagtggcagcaaccatttcaatgttcgtcatccgctcgaaggcctgacggaggtcttggaagacggtcgcacttgcaatgtacgcgtagtgcatccgagggtttagtgctgcagctacaaaacatggcacaagttaggtaaagggttatttactatgaatacaagattatgttaagaacataagtgctagctacttgctaacattgatgagtgtatcattggtcaggtcgtgcaaacttctgtcaacaatatccatgtaagctgcgtactagtccctttcactcgcgaatagactgacatactccattttaatcaattgatatctcagaagaacctcactcaaattggggttcttgtcctcgtcagcaaagcggagggagtacattgcttgggtcgttattgcctctatgttttcccaccaccccttgctagataggtaggtgtgtgcatatctaccttccgctgtgccactgaattcgctttgcatgaagctagaggaagccatgcacttcatgaactgatctcgcttcctaaggaaactctgaaggaacatgtagtttgtgccgaaccgtgtagcattccacttaaccaattcaccacctatagttgttgtcaccatagcatgaagcttcgaatgattgtataaccatctgcaaattttcctagcactctgaatcaccatgtcatgatctggcatttttccaacctccttaagaatcaagttaattgtgtgagctacacaaggttgccacacaatagttgggtactcttgccgcagtagcctgcaaacctttttatagtttgacctattgtcagtgataatttgcacgacatgttgagggcctacttcacgtaccaccttccttatctcttgcattagaaaattacaaaataaacataagtccattaccctaaacttgataacatatggggtaaatttactgcatcaatgtcgtcaccttctatatgaagttagcattctggctttggcccgttgcatcaatggacttgtgaaaaaacattattccattgcaatatatcaaaaagttgatgacaaccatacccgttggtcgagttgaggaatcacacattagagtaacaccatactcagcaaaatcacgcttaaacctcttgaattgcttctttacgtaccttctctgtagcatcaaggtacttgccatctatctccctaccagttggagaagttatgttttcacttttcacctataattaacataccaaataattagtctctaatctgttagaaaaatgtaaatccatattaaatgcatatgtaccccacttctgtgtctctcatacggtgctgacgaagtttggattatcggcatttcttgcaaggataccggagataaaaaaagaaacttatcttggactcaccaatcacctccctaccttggtttccctctttgtgaagaatcctatgtcaatgcatagtagggatgtgtgggagcatggggagaacataccaccatgctttcgttgtaagtattggggctgcaggaat

SEQ ID NO: 83623 - DNA, 608 bp, Oryza sativa
cataaatttagcatattcttttgataaaagatctagtttatatattgattttggaagcacagtataagtggttttcatgtttcgataaatatttgtggttgtattcattccgatttatatttgctatatatgtatctttattcagtaatattcaatcaagtttcttaattttatctgaaattatcgtttactattctaatttgaaaaaaaatatggttagggtagtgtcgaaacatgaattcggcaataataaaagggggtagcgcacgagacctaaaagtggatggatgcggagacaaatgatttagacaggttcaggccctctcaatgagaggtaataccctactcctgtttggggatttgaatccgccgagtatgtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatattccatagatataagttatccc

SEQ ID NO: 83624 - DNA, 7406 bp, Oryza sativa
gagcgcgatagaccgatggtgcggtctctgaacaggccgtgatgttgtcggcccatccatgtgtccatgtgctgtctaggcagtgggccgtttactaggtcaactacttcgacatgtacgggccgagatgtttggaggcccacggaaagcctgttatgttgcggcgaacaccagacggggccgcggccatgtcccgcctccggctgctttcccggcgacccggccggcgattgaagatgtgcagcggcgggtcagaggcggcagcgtctgcacaagggcggggatctctcccggccatcctcctggcgagctcggaacgatctccctctcctgcatggtgcacgccctgcctgaaggctgaagcgcatgccgccctggagggcctgcggcggcgccgccaccagctgcggcgagacttccacccctcgctgtccttctcccccacctcaggcggtcccgcacatcccaatccgtgataaccgccaccacttggacctcgccggaatggggcatgaggttgtaagggggtgaggatgaggggggcggagaggaaggtgagatggtatccaaggttccagatgttgcacttttcaagcagatattgcagtcggcaatcaatggatcgctactgggatgtcccgtcctgtccgtctgcttcgtcatcgccctcttcttccaccaccacaccacgagggccaccaggtgttcaagagaatgcgccaccggcccaccgcacaggttagcgcaaagagcacattgcttatagatggcgccactagacctgataatcacatatacaaaactatgcaaagcagaaggctgcattcttatcaacagaaaatgaatttaaattctcactaattacgagtacacacatacacatatatcatgtccgtaggtggataaacaccatacatatagtgtatactaacaatcatcgttttttgcgattccatcgttctatgtggcacaatgattcgaaccagactgccaatatgaagcccactgtgaaccccaggccagaaaagatgaacaaaaggatcacgccaagtctgtcctgccagaaactgttggtacctgaaggagctgatgcacttggagatgttgagcctggagtatcacattgtttagagagtggctttccacagaggttgacattaccttcaaaggagctgttgctaaatgacccgaactggttaccctgcggtattcttctggtcaagttgttgtacgaaagattcaaccaagcaagagaagttagagaagctaactcaggagggatttcccctgagagtttgttccaagagagatccaatgactccagctgagtcagagaattaagctgcgatggaatgtgtcctgtgaaggcattgtgtgacaggttaagtccacgtagtgaaacaagcttccccaatgactttggaataggaccaccaaatgagttatctgagagatcaattactttgaaggtggttaggattttagtgaacataagagtgccccctttgtaattgacaaccgtaatatcctgatagagcaatggtatttttgtgtttgtggtatgctctaatatgtgtccctcatcgttgtcattttccatcattgattgaaaatgctcaaaccattctggatgtatgttgccagagaaatggttggaggccaaatcaattatttgcaaccttttgaagtgattacaattttggtgacaacctttaagaccccttattgtgccattgagtttgttggatcttaagacaaggactcggagatttggaagtttacccaaccaaaatggaaaagaatcaacaatctgattatttccagcatccaggagctccaaatattggcagtatgatagtgatctaggtagtttaccttcaatttggtttccattcacatctattgactgaagattgcacccctctctactattgttaggtaacaccccatggaattggttgtctctcaatttcaatacgcttaagtttacacttcctgtaagacatgctggtactgatccactgtagttgttgccagataagtccgtgataatggctttgcttgcattacaaatcgaagatggtacattgccacttagtttattattggagaaattaatatagctggcgttttcaagatatatgccaaagttcggtactattgaaaagaagtggttgtttgagtagtccaatgcgatctcactggatgtggttagctggtattggtatgcttccttgaagtctattgaaactgagatcaagataagctaaattggacatattaacaagagaaggagattgttccaaagtagttaacatgttgcacgagaggttcaaaatattaaggtggcccttccaattctcccatatccaatttggtatagcccccgttatttgattactcgaaaggtcaagaagggaaaccgcatcaagatattttaatgtgcctggaatttttgtaaggttgcaagatgacaggtataagtacttgatgttaggaagataaggaggcactgtttaaccttcatcatctatgagtgatatcaaattgtttgacaggcttaggataaatagattcttctgcttccagacagagctaagttcaactgtgcctgtgaatttatttgattcaagaatgagataattaagatttgtaagatgaaaaagtgagttgggtatcgggcctgatagttgattgttggctaagtcaatacataacagagatgaagttaaagggtaaggaatgtcttctagtgaaccagaaagctggttttcttgaaggtaaacattttccagcctcggaagagcgaacaacgattgtggaattttccctgcatgcaagtgcagtatactagtcaaaaagttcaaagatgaatgttcactgaactgacagtctggtaccttaggacgcacttgaaccaagacaactcattcgtccgagttaaccaaactaagctgattttccgtaatattgcacatggttacattaacatttatttaaaatattgtatttgataaaaagaagcattgcttttggttctatatatataattgtttgctagagatactaaaacattttttataaaattctactaacaaagtttgatttagttacttggaaggcactaataaagatttaaccatgatcactactacaaaatcattttttgcatgtgatcaaaatcaattttcgcaggcagctagacggcccgcctgaacctaggtatatgcgaaaatcaacattttcccatgcatgttgagtaaccgcatgcaaaaacatgatgttcacgtggtcacctatgccaaccgctgcgaaaatgattttggagaaaacaaataaaagttcccaaaacaatttcggccaaaactctagcttcccatcctctttgagctcgtcgttgcccctcgaggacggcgctgtcggatccaccgcccgccattgtcgtcgcccctcccggggcatagggcggcgccaccggatcagctgccctcgaggtcgttgctgtatttgctgtcgccggcactgtcgtcacgcgcgtcaacatcgcacctgagtgagcctactgtcgcctccatctcagtcgctgaagaagagaagggagggaatgggaaagagatgaggagagggagtaggagaggagtgatgggaggtggagccaaggagagaagagaaaataagtagtgtgcgtgagtggagaggagaaaaaaatatgaaaaaatgtagtgcggtgacgcgtgtggcccacttgctctccatgttgctcacttgcgaaaatctattttcgtaagagaccccttaaggtgcaacattgcaggcaggcctcttaagggtcatctgcaaaatatatttttgcatgcgacccttgaaccgtactcaaaggagcaatttttacaggcgaaagtagttatggtccacctacaacttggagggggtctcgtccaaaaatcaattttgcagtagtggatgtgtcacatcaacgtttgtaaaaaagttggtaacaaattgttcatacgtttagcttttcccttttatataataaaaccatggaccaataagcatcttccctttaacttattaaataaataaaaaagaaggctccatattcgctcttatggcctagaaattctcatattaatcgaagaaataggaaaaaaagagtccatacaggaataaaatttaaaaataaaagtagagaagataaaatttaaaaatagctgaaattcagaattaaaaagaaggaatgtagtaagagaagactagagtccataccattatacaatagaactaatggaagttcggaattaaaaaaataagaaaaaaaataaaagtagaggttagagttcatatagaaatacaatttagaaataacgaaaatttgaaataaaaaaaattcactctcatggtctaaaaattcttatattaataggatagaaagaaatagacagagttcatatagaaatacaatttaaaaatagctgaaattcagaattagaaataaggaatataggacgagaagactagggtctgtaccagtatacaacgcagtatacaatagaattaatggaaattcggaattaaaaaataagaaaaataaaaatagaggttagagttcatatagaaaataaaatttagaaataacgaaaaatcgaaatttaaaaaaaggaatattgaaagaagaatatagagtccatatagaaatataatttaaaaataattaaaattcagaattaaaaaaaagaaatattgaaagataagtttagagtctatatagaaataaaatttagaaataataaaaattaggaattaaaataaggaatattggaagaagagtataaagtctatataggaatttagaattaattaaaattcagaataaaaataataaaattaaaagtagagtttagagtaattatggaaatacaatttacaaataactaaaattagaaattagaaaataaaatttggaacaatagtctagagtccatataggaatacaattccgaagtaactgaaatttgaaattaaaaaataaataatatcgaaagatgagtttagagtctatatagaaattaaattagaaataatgaaaagttcattttttttaaaaaagcaatattataattatagtctacagtccatatagaaacacaatttataaataacggaaattcggaattgaaaaatatgaaatattggaagaggagtctagagttcatataggagtataatttagaaataactaaaaatttgaatttaaaataaaaatataggaacacaatttataaattatagaaattcataattaaaaaaaattaaagaatgttggaagaggagtctagagtccatctagcaatataatttagaaataactaaaattcggtattaaaaaaataattaatacctatcacatatatacaacataatatgaatattgcacattgatagtttattcaagttagtacaattttaaattatcttgttatttatgatattttaataaaaaataagaaaaaaaatatatgctactataatataagaatgctagccgcgcaatttgtgcggggcaccatgctagttgttataatataatatggacccgttccgattaatccgtgtgcattattctctttttttcaccaattaacatggtaacttctagggctctcaaaacaaacatgttactccttttagcattctattataatattttagtagcaatagatttctaagctcctagattagttgtagataggaaaatgttgtaagtttttgaaaatagacgccattgatttactgtaggtggatgttaatatctagatgcgagccacaattatcaaacagaacgtggaacttgctccaccactaccagtctatcatgttatctactatgtgtgttttcacgttccaaatcaaaatacagaaatatatatattactacttaagcttttgagtgttcgacagcactcgcttggtggcattttgaataaatttattttatgatgatattttaaattgcatatgtatgaaggaagaagtagccgtcgtataaagacttaccgttgagttggggattagatgtgatccgcagactttccagttgggtcagattccctattgttgagggtatcgacccagagaagccacaactatccatctctaaatttgccaacttcgtaaaattaccgatccacggtggtatttgctgtccaaagaactcgcaccctctaaagtccaaggtctccaattttgcaagattgccaatctgatatggtattattgacccagagaaattgcagtcccagatccacaaaaacttcaaattcgtcaaattgcctatccaggagggtgccgattcagagaaatcgtacgatacaagctccaaagcagtcagctgcttaaggttgcctacccaagataataccgccttctccaagcctgattccgatccttgcaattccagttctgtcaatgaaggaagcttatctaataaagagggcagctccttggaagttcgtgccgtgctcatacccaaacgcttcaaggacttgagattggcaaatgaggacggtatgtgataagataaattggttgctgctagacctagtgtttctagattatttccatcagggaattctggtaggttaatagaaagattggggttatgagacaaatcaagcgttctcaaactttttaggtggaagatttttgttgggaactgcccttcaaaagaattgcctgcaatttcaagaatgctcaaagaagataattcagcacagaactcaggaactttgctggggagtccaaaattgtatccaaggttgatcacctttaaggaacgaagccttgagaaggaagagtgaataggaccagatatacggcacgcaaacaagctaagaatctcgagttgaggaatgttgtctgctaaaacaactgaccaagttgatccgaaaatttctatctcatcaagatggagctccctcaggttgctcatgtttgccatgacggtttggaaacttggttcatcgaaatacaacccatcattactagaaaagtcaagagtgacaagtttcatgaggcaagcaagtccaatggggatctgaccataaaagttgctgtgtgagaagttgaggtggatcatatctgtgagcctctcaaacccagatactgggagttcggctctccaaaagtaattggaagcaaggttaaggtttgtaagagaggtgaggttaaagagtgcagcatcgagacgattgctcatcaagttcaactcactgaggtcaagggaaatgaccctgccggaggccataccacatgtgatgccctcccagtggcagcagtccgatccagctcgccatgacgataagtttgcattattgatgaaggatttttgagctgtaggagggaag

SEQ ID NO: 83625 - DNA, 1671 bp, Oryza sativa
  unsure (1)..(1671): unsure at all n locations
cttcagggtaccacaaagaaagaatgattttggttcgaagatcccaagttttgtgggctttttttttgaaatagtatgtatgaagaatgttcatttttggtttcagatttcgtatgcacgattctatgccagccagaatgggagctgtgaggtagatttgtttgctgtgcaatcagatgggaagaagatcgttgaccagcacaagcaaagagcgctgtgttgtcggctgaggacaaagctccaccgtccgttgcgcgtggcattggtaaacagaggccctgacacggaactgctggtggctaacccagtggaggtgtcgggcaagggtagaccgctggtgttttacgacatcacccttgctctcaagaagcttcacaaacggatcttcttggtacgcatttcaacttactactgtatctgtataacttacttgcatttgtgccttgagtcctttaccatcgattgattgacgacacctgttgcatgcatgtaggctgagattggtcggcatgtggtgggtgatagggaatgggaggtttacagggtgcaccttggtgagggagatcattcttcattgcggagcaagattgttgatggagtcaccaacatgctcatgggctgggacgacactcctccatcctaatcctactagtagtagttctagttagtttttttatggaacacacgtcctttgccttgtacatagttggtagtggctgctgtaaattgtgtgccttgttaagtcgttcgtggtagaatgcgttggcagtagctagctttgactaatcaatcagcagctaatttcagtctgtttagttagggagcactcccctctagttgtatcactatcaaaactgaatagtgctcaagttatctaacaggaggaaatgcttactcctaattactaaagtggtagtgcccgcaattagtaagcaagccagtgaaccaattgaatgcattcattcaatagccttgttggcaaatggagctttggttttgagtagagagttgactggtcgtatagctgagggccaacatgcacgacactcgtctcttgtccaaacacttgacatatggcgcattggaatgatggggccaggctcttgtttatcgggacgggacgggagtactccactccactggcaagtccaaggcagggcagctggtgtagtagagagaggggtggaatcgtgcagaagttaccacgtcattcctgggcggctgccgcgtgttcacccgtatgtgacgtgccgcgcccccgcgtcgccatggacatggaaatggtttgcagcttcaacccataaatgaaaggaaaggagaggagctttggtaaataatccactgacttgaagcagaacccaaataagccacaggttgacgtaggtaaatggctccgaagcagaaggaggcagcgaacaagaagaagaagaagaaggaggtggcagtgttggtgaaaaccaagaccaaggtggtgcagctcaccaccaccaccgcggagctggagctggagcccactgtcactgtgcaggtggacgacaacaagacaggtgcagctgcagatgagacccccccgttgtggcgcttganaagcaagagacgccagaccccaacgagccccaagcggcnggagcgaaaaagaagaagcgcgcgggcatggaagaaaaagagtag

SEQ ID NO: 83626 - DNA, 1640 bp, Oryza sativa
tgcgttaccgttacccaacagctgctagctactctatatatgtatgcaataagtctattttttctccctcattcttgccttcgtcgcttcgcatccctcagccataaaaccaggtataacacctccccaaatccgaaaaccggagtaaatatactgtcggttttagcttgtcatgtccacatggtatattgactaggtcttcgtcctacgtggcactcagcgtaaaaaaaagtggaacccatataggcctcacctatcagggattcatcttcttccaccagcctcctcctcctccacctctccctctcttcctcgtgctctccagaccatagaatgacagtgagagcggtgatggtggagaactcgaccccgcacacggcgcactcgtggacgtgtgccctgtccttctcggccgccgcagcggcggggtcgctcagcagcttcgcctgtagccgcgtgtggctcgtcatgtacccacccagtgcctggaacgacgggaacctcttgttgcacgtcttgcactcaaacaccaactccgctgccaggcgccagcgtggcccgtcggcgtccacgacgacgtcggtgctgtcggcgcgggtgacgacagcgtgagcagcgggctggcgtgtatgacggcgacgatgacacgggaagactgctccatcatctcccgctcacgcgcgctcaagacgctagcctttccccttcatctactccaaaacaacggcgcacggtgtgcggaaggcggcgcctagcgagagaggagtcagtgactccgcaacaggcagtgggcggcgcatggcgggagaggagtcgacggcgtctgcagaagcggaaggaagcggggcacgaggttgtgcacggtggcgggagatagcttcgccatggctcccctctcctttcctccgttgctgcgctgctctgccacacgccgacgccggcctcctgcggcgcctcaacgacctgcttgatctcctcgaatcggagctcggcctccttgatggagttagaggtacgcacgagcaccgcgcgcgcgtcccgcgtcgccggccgccggacctcctctcccgcctcgccccgacgatctcctccccaccggacggccggcttgcccagagagagagagagagaggaggaggaagggagaggagggggaagaggtgtgcgctgacgtggtatcctgacatgtgtggtctacgtgggtcccaagctgactcagccgccacgtaagataaaattagggtcaaaaccactgaagaatctattgtgactggttttgattagttgggggatgccggatatctggttttgtgtttggaggatgattttgtaactcgatgacaagttgagggaccttggtgtactttttcctattagatactacaagcccatcgagtaatattattgtgggccgtctcggcctgacccatatcctcgttcctaaacttgttaggagtagagtattgagtatcagtacgtaccattgtgtgttttaacgtactaattaaatggtactccctccgtcccataatataagagattttgagtttttgcttttaaagtttgaccactcgtcttatttaattttttttgaaattattatttattttatttgtgactagctttattatctacagtat

SEQ ID NO: 83627 - DNA, 1132 bp, Oryza sativa
  unsure (1)..(1132): unsure at all n locations
ataaagaaagatttacaacatacaccaagtcaatatcctagcaaccaatcagcattacaaaaattacaggttgatatggcaaatattccatgtggcagcaaagcataagttcatgggttatatttacaagaacactttggttaccatgtgacagtaagatcacctgggtagagaaatgctggtgtctcaaaactaggtaatagacaaggtattaaaaggataatcattcacatatcttcacaactcacaaggcatgtacctttcaagcccaaagcgtacgaggcaggaggtggcatcatcacttttgcagtatttacagcccttganctatcttgatggaacattgattatctgctaacatctgcaatatacaggcttcaataagatatgactcaaaactctcaaagtagggaacacgtaaaacaattatgactattcatccttgccaagctatgtattgacgattctacatgaattctgacagaggagaaatgtgattaatcattagctgctaaattttggctgcagttctgtttttcatttgtgcaaatttcaacaaatgggcaaagaggaaagtaacttaacatacacacacacagggaaaaaaagagagagaagccaaacgtactttaaatagcaaagagcggtgtttgcagaaaccgataggtaactttcccagatggagaacgatagaccctgtacttgacttgatagcatcactgcactctttccagcgtggaagaaaactctcttcattggaggttgtaccccttcatgattgaaacaaaaaaaatagtattagaaaccacagaaacaagacgatacaaagacacttttgatgagtagattagttgtacaatagtcaccccattctggaagacacaagcttggctagctggtttatcacatccttcatgtcggcagaactggacaagaagctggaagcgtaattctccagcatacctaaatcgaaatcggttcttctatcgatgagaatggcttgcatggaagaatcatctgggcggacagacttgagtgaatcaatagaaggtatgcggttctcctcgagtagatcagtgcagagtgaccagacaaaggggtccatgccatgaatcaagtaaaaaccatctgg

SEQ ID NO: 83628 - DNA, 1818 bp, Oryza sativa
cttcttagtctgttagtcatgcaacctaactttgttgagtcaagtaaaattagtagtattagaaggacaaacatcatgccattgggtcagttctgcagttaaagatagttgtctgaattgatgaaattattgactgcaggttatcttttaagcagtttgtagcttcttgaacggttatgtaggtgccatggccatactattgatcttgttagaacaaacaagacaacctgaatgtgcccaacaactagacaataccacataacttctgaattctgatattaacgttagtgctgcgaaaatcagggaattgactgtattgtttcttcttgattcagaaggcgctctcaagctttcagcaagcctcatcttctattgattttggcatgattgagcgcaccaagttagcctcgctaaatgaaagtacccaccgttattgactactatgatacacattagttactaaattttcagaggcttttaccttaactttgttcagaatataatggagaactctgttaacaggactcgtaatggggcgcatcatgctatgattcataccagaagtgatgttgacgtcactcaatgaagctacgtaggtcttgcataaagggattgatcagcttttctctgatgcttgctcatcaatgaaacaacaggcattaggcctttttattttcaatcaagcatttaatttgctaacattgacgccgtgtacccttagtagtattatatactagaaaattatttatatcatgtctttgggacaaacttacaccgagcagtggcggacgcaggtttagaatacagatggggcggcagagttagccttaattaggttaatggcggacgcaggtttataatacagatgggacggcagagctagccctaattaggtgatggcacaatgcacaaaaaccatagtcgctggttcacggcattggcgcaacagcgcacggcacgaacatcgagaaagttaacaacaaagattgatagtcgaacaaacatatatgacttatatgtagagagataaaaaaaaaagagaaatgctgttaaacaataagggcaaccacttccaatagttttggggggggggtataaaatgagatgaaaacttatttaggggtttaagtgcttcgtcaaaatagttcaagtgagtaaaatggatttttttatatatttaccaatttaactatttactatagactgtattatgtgctaaagaaatagaaagaaaatcgaattttatgtatggcaaaaatcaggtactacttatacacgaattttcataaatgtttttcttcctacttaaaacacttgatttatctgattattcaatagtagactgataactaatgtgttagaaatagtactaaaatgaggtttggaggcgtggggagacaaggactgtagctgggccagccgacccaccctgcctaatgggtgtgtccgccactgacaccgagtgattattttgcctggtgtgatttgaaattgaggcatattctttttcccgttgcaacgcacgggcacccaactagtagagattaagctgaaaaaagaaaagataagataaacttatttggatactgacaaaaaatggagaattcacagtaaaatctttctaccatgccatgaaaatgcaggacagcggtttcccttttaaaagactttggaaatttaggattccagtaaaaagtgaggtgtttgtatggctggctcttaagaaccgtattttgactaaagataacctcatcaaaaggtggtggaagaagttttttttgaactttgtgtttttcttaattttaaaaacaaaccatt

SEQ ID NO: 83629 - DNA, 559 bp, Oryza sativa
gtttcactctactctgaaacgaggtgatattgttggtgtatgtggttatccaggtttgtaagcatctattcaagttcattttgaaattattacatagtcagatgttccaacatcaaaattaagtaggtacttatattctttcagttggaatgccaataggacattttgagtacatggatccttatctgattgagtttgtaattttatttaataaataacttaaactttatttgtagcttatgcccatacttgattgtacagtttgtttgttttaaaacaattaggagtataaatagtttgatggttactggaaattcttatattgttttactgtgtctgataatgacgacttctcaattttgatgaataccaggaaagagcaagagaggggagctcagtatattcccaaagaaaattgttgtgctctccccatgccttcatatgatgcctccacaggtgagaatcagatttttttaggaagagatgtttccagatgaaatacctaatatctcagagcaatttacttcatattgggcatcctctagagtcgacctgcagg

SEQ ID NO: 83630 - DNA, 646 bp, Oryza sativa
aacaggatcatttaactctgtatatgcattgcacacctaaaaaatggatttcataacactgtaaggaaacagaaagggggccaagtatgaaagtatcaatgaagacttagtatatacctcatgcttgttaacaaagagctcaaacctctcagtcaatccaggtcgagacctatgccactttgccaatggactcattatctctggatggttgataataaacgtgggattcacacatgtctcctccaagaaatggccaactagctgttagagcagagcatataccttattaatttggctaaggaataccaaaagggaaacaaaagcaaaaggtatattaaaatttaagcaaatagcttcaggttggattttgcaatataccccagatcttttatttgtttgtgagctaatgtgaaaatgttcagaaatgtactgtacattatggaagcaacaaaaaggattacaccggacattcttcttcatatcaaagtggctagcttatcatatatgtaaataagatattataagatagcaaaatcacctaacgaaaatcatatcaaaatacagtgtaaaaagaatgtgtagtgggtaaagaaacaaccttatcaagcaaccgtgttgtagtctggggatcctctagagtcgacct

SEQ ID NO: 83631 - DNA, 749 bp, Oryza sativa
gcttccgcaacccgctgagcatgaacatgagcatgccgatgcccaacgccaacttcacggtgaccaaggccaccatggccgagttcccggcgctcaacggccagagcgtctcctacgccgtcctcatgtatcccccggccaccctcaacccgccgcacacccacccgcgctctgccgagctcctgctcctcgtcgacggcgcgctctccgtcggcttcgtcgacacgaccaacaagctctacacccaggaccttgccgccggcgacatgttcgtcttccccaaggggatggtgcacttccagttcaactccgggaaccagccggccatggcgctctcggcgttcggaagcgccgccgcggggctcgtgtcggtgccggtcaccgtgttcggcacaaacatcgacgacgccgtgctcgccaagtcgttcaagaccgacgtgcctacgatccagaagctcaaggcaggcctaactcctcccaagaaagcctaagccctccccgttggtgttaattattcttgtttttcatcctgctgctgctgctgcttgaaataagagaccttccaggctaccaactactgaagaaggtaaattatgatttgtgtggtgaataattctgaattgtggttgtattgtcttgtctgaagagctttgaaccatgtatctatcagtattaattaaggcgttgtgggaatatatatagaccagttcagttgtaagtgttgagagtttctctgctgtaacggcttt

SEQ ID NO: 83632 - DNA, 1479 bp, Oryza sativa
tcaagatacatgcaattatgttaagtcaaccataacacaagtatgactaaaatgctaagattgctatagaaaatgctcttttatttggcaatgggatagaaattcctgaaatttcaatttttatttgcatgtacctgctccaatcttctccttcaaaatcaattcgttccatggaatgatcagatcatccacagcaagtgagagatcactgactgtacttcgtaagtactgattcccctctattaatttaaactctttctttttctcagctttcaagttggaggaagtaataagcggtaaaacttctcggggagcctctggcagaatagcatctgagcttacagctgcttgacctacataaaaaaaatgactcaagacaaacacacacacacacacacacacacacacatatcgaagtatagtggtcatgcaactgtttatatctttggactttctagcctaggcagcaaagtgataattttggagtacatactttgttgtgccattatatggatataagctggttcagaaaagaagatatatttaataatagtcaacaaaaggaaacagtttgttcacgaatcctagtagattgtcatgagctatattaccttttactggcacccagctgctcataatgtcatcccttgtgtcatgctttctagtagaatacggttggtccatagcaactgccgcattactattagcacctgaaacataagagatgtggggtctgtgtcacacctgatagactgcatagacctaactatcctagatgacaatcctcttttcggcctataacgaattaccaactacttcatggaaaattatatatgtgatgaagcactatttttttttttgcgggggtgatgaagcactattgacacttaaacagtgaagagataaactcagaaaaaagaagtgataaaagtaatgaagttaaaaacctgtggaagcttcgttaaataagagattgagagagtgacaatctgagaaatactgcttggcaaccgagctgaaatttgatgtgatctccaatgacctaaattttggaggccggagaggtgagggcactgatagtgagtagggtccattgacaaacgaatcaggatcagataattggcctggatccccaattagatcaaccaaatactccctgccaaaatgaaaatataaagaaagatttacaacatacaccaagtcaatatcctagcaaccaatcagcattacaaaaattacaggttgatatggcaaatattccatgtggcagcaaagcataagttcatgggttatatttacaagaacactttggttaccatgtgacagtaagatcacctgggtagagaaatgctggtgtctcaaaactaggtaatagacaaggtattaaaaggataatcattcacatatcttcacaactcacaaggcatgtacctttcaagcccaaagcgtacgaggcaggaggtggcatcatcacttttg

SEQ ID NO: 83633 - DNA, 641 bp, Oryza sativa
cgatcacggcgcggatcctggcggggctccgcgggcacggctactacaacctgggagtgcgcgccgacatcaacgaggtcatcgcggcgctcgcccgcgaggccggttgggtcgtcctccccgacggaaccaccttcccctcctcctcctcctccgtttcccagccgccacccacgcagcagcagcttcaggtatggaatcgaacgaatgcagcagcagatgtgttcctgtctgttcccctccctcccactcttctcttctccttgtccgctctgctctgctatgtttaaagctggctggcaggcagctgagcctgagctcagtgagctggaagccaagtaccggagagttatttaccctgttcctttcattattttatttatttttgacgtcataaataggtcgcatccggtactgtaggagatatgttttcaagtgatgatgacaaaagcacccctcataactcatttatgagcccttttcgcctcacggagagtagatatatattcattattattttaaatcaggcttccgtatccaacttacggagaagcatatgtttgtctggaaggacatataacgctgaaattatagagacggggtatttcatattatggtaattttgaattaaataggtacat

SEQ ID NO: 83634 - DNA, 678 bp, Oryza sativa
gatggcttgatttttccaactaaaactaagttgcaagcttgcaatttctgttcagtttcatttctgttattttatcttcgcaactttagataatgtggtatgcttgcataatttcaggtgccttatggcattggctgttgtgagaaacgacttctatgatctgcgcaacaagtttcagactatgcttcaggtagtaccttatcttctccattggcttttgacttacaaaaattcactaactatgaggtgccacacaagggtcgatagtatatcatataactcaaataatgtcctttgtttttttttagactgataatctccttggttatggcatatatgatttgacagttgacaccaagttatgttggaagtttctgaaagctttacttgagggtgtgtttgttaattttcttggatatgtttggatggttgtataggatagtcccaagcagtcatcagtgtttttctttacctgcttaaaaattgaagtttaatatctggatagcaaccaaaactttggaacttgattgattttttatgtgaattttcgttctccagctgctcattcagctttcatgttgagcatcataaagctgctgttgatggttcctggatcttaattattgacatggtgtgttttgatgtagctggagcagcaaatccaggcttatgatccca

SEQ ID NO: 83635 - DNA, 534 bp, Oryza sativa
ggtgaactccaaaccactcacaaaccagcgctgggtctcctccacaatctcctcggagaggtcaccgggcaacacctccacaagccgtctatgaggcggcaacctccaagagtaacaagcaatgacacagctcggagatgatcaagtgccgcactagctctacaatgaagcaatgcacttgactcttggctcaacaatcccgcaaacacactaaatggataaacacaaagctcaagtgggtgtgggagatatgcaaggggtgtatgcaagtgaagaaagtaccaagagaggtcccttgctgctggtggggatgtatttatactcccaccaaccaaaactagccgttggggggtcaaaatcccccaactcagtgcactgccgatcagaccgccgttgtgtagccagtcagaccgaactactatgcaacggctagaaaactagttgttgttgcagtgcatttaatgcactgacacaaggagggctggtcagaccgcagtagtgtgggtggtcagaccggctgcgactctggcggct

SEQ ID NO: 83636 - DNA, 769 bp, Oryza sativa
aacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatagtctacttatatatacaaggacctaattaattaaaggagacgtatagtaagaaatctaactgaacgatatacttacaaaatccagcaactcataatagagacgtcgagggcgtccagctggtatagttcatagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttc

SEQ ID NO: 83637 - DNA, 529 bp, Oryza sativa
gctttgtttatataataatgttgtgacttgcctgtaattagaatagggattaaattttatactcttaccactggatcactgattagcatgacagttcaaccatgccattgctccaaaaaaaaaaagaaaaagaaaataagagtctcacaagctattggcagtgaagtgatataatgaagtaaattatatttaaattaaaatagtattctgctaagtcatcagactaggcttgcattgcctacacaaccactttgtaaaataaaaaggtttacagtggcctgcccttcccctaagaggttaatagtatctcccggctctgaaactaatccaagggctagctttgcggtactgtacattcatctgtcatttcccctgcgggcaacacaattgtacaaagtttcctcagtcgagttcaattcccagaagttgagttgaatgaaaatcatcttggttcaaaaagatacctgtcctgaaaattattaggtagaaataacaggccttggaggagggggaggaagaggcatccttg

SEQ ID NO: 83638 - DNA, 534 bp, Oryza sativa
agtccctgtaaagattgagacgaatcatcctgatgtcgtgtcaattcttatgccaaaagaaggcaatggtacacatggtacccatgaacgttttgtgttacaggtatgggcttgcccctctaatcgagcttcaatattgttttggaaaaaaaggtccatttttataaccctgaacttttgcaaaagtctgaaaaaaaaagagtgagtctggtgggaagttcaggctgtaaactgggtttttagtggatcttaacgctttctcaattgtaatgattgctttaaagctgtgacaagaataatcaaggaatattttggtgaaactaattctggaagttgtaacaagaatttgagtcaatcttgagtacggataatttgagtgagacttccatgcaaaatgtgttgtgttttgttgtcctttgcaggcaagaagtcatggaactgctcttgtaaggttgcaaatcagccatattcccaagaaagccgatttcataatggtaaagtgctaaagttcaatgctactatcccagagttctt

SEQ ID NO: 83639 - DNA, 1238 bp, Oryza sativa
caaccttaagagtgtacataacacgtttagtcgttggcatacaagcatcagtgtaaaataactcggaaaagaaaggtgtgataactattaaacctaaaaaaatcagtagtagaaaattacactttcatttgccaccctttccttctcttcaagatgctttatttgcttccgtagctgggcaatctctttttcttgcccttccagtcttgtccgaagtagaccagactccgcccttgaaacaagcaaagcacacaattaggataagtttaaaaaataattatatagaatcagtgcacgggctggaacaaaatcaggatattttgaagaagaaaaatgcactaggtgataagtgatagcatttagcacattgcagctcagttgtccatatcgagatgtcaagagtgttgcatttcccaatgtttcattgtaaatcgtagatattattgtttcttacacagaacttcaaaagacaaatgcttcagaccacatgtctaattgacagcaagtgtgtcttggtcttttaaaattctttgttgccatgtagttcaacaggcagcgaaagtgacaacacaataaaggaaacacacagttctagtgagtttcctgctacccttcaaactaaacttatggtacactgggagtaaacagaacaaaaattcgtcagtggagatagctaccttagtgcttcaacaagatgttgcagctcaacaatcttaacttgggactccttcatgctattctccaattcccctgcctgcagcattgagtgcatgatagataatttagttgtaccgtattaagtggtccatgaacctgcaacattatagcattacaaagatcttactagggtatagacttcatctttctccatgctccctggcctgtgctccctgcgctctttgagcccaacctcaattccggcctcccttagtccatcctcagcaaccttgagcacctcgctggtgtttgattgcagcgcgctgcggagcaacaccccaatgtgctctttctcccgcaatagctcatccaccctcgcttccaaatccctcactttgctttcctttttatcaacccatgccccaaccttgtgcagggcagtggtagcgagatcgtacgccatcttggtcccttccagggacaccttgaggctctcctacacgtaaggctccttccagaccaacaccgagtcagaaagcgcgctcgcggaatccgcgtgcactaacttgaccacctcacgt

SEQ ID NO: 83640 - DNA, 571 bp, Oryza sativa
ctgaaagaaattactgcatatcaccacagttgaagcagcaggcaacttcataggccacaagttgacgattcaggtttttctcaagaaatcttggagcaaacttattccgtttagttgatcattgtagtaccccctaccattttaaattgaattagcaaacgtcaaatacaaaaaacagagggagtacaaccttttcaccccagttcttgaaataaacttgtacagttgaatttcagtctgaatatctgatgaacatcaaggatgatgcaatcaaagtttcagttactcagtgaattcaaatctcatattggttctcaagaagttttatttcttctcttgctcagcactttctacaatataatccttaacctgctacacaagtgtttgttatctcacagggcacaacacacaacgtatgcaaccataagagaatcaacaagtatgcaaactcaatgagatacaaatgacaaaaaaagtacaattctcatacaacagttattggttcaaatattacccaaccagaagggcatttgaataacaatcatatattcgtattggtgtacctgaacaa

SEQ ID NO: 83641 - DNA, 573 bp, Oryza sativa
tctcttcaagactgccacatcacctgagcggcgaatgaatctgggcgacccgatttgcttcgcctggagatacggtaatgtcgcttcggtcggcgagcgtaattaacgcgcgcacgatacgatctatctcgactgccgcaaccgcatatccacctcacgcgccgcaagcgggcgaatgggatcagtggaagcgtgggcgcgagaaacgagggggcgaaataatgggcgcgagaaacgagaagccgggcacagcgttggcaagggtataaaggcactgaggataggatttgtttccttcctttcgccatcattccccttgccttcgccgcttgcgccctaactccttcttccctgcgcccttctttcgccacacgcgctcgctctccatcttctcttcgtccggcgccatggcacggggctccgcactgcttgatggtagcgtgctgccgccttcccgcatcgtgagcgagaagcaggctgggttgccgcgccgctttatgccggaatctgccaccggccgtgagatagtcatgctgggcgagggacgcccggcgccagactacccggggaggt

SEQ ID NO: 83642 - DNA, 5440 bp, Oryza sativa
gaacgggacgtcgtgagccgacgccgccaccgccatggctgcagctgccaccaccacacccagcaccaccaccaatgatttcctcatctctccgtgcatacagtatatgactatgctggattgctgatgctgctagctagctatagtagtcgattgacttctcagatcagtcgatcgagcattgcatgaatatcttgtggaaggggtgcatgccatttatagagctccatcgtcgactaatttaatcaaaaccatgggcgaattgacgacaacgtacgactatttaatattatatactcaattttctctttcagattattctcactgggattcctatctttaggagttaggattaggatttagaagctagagctagagttaggattaggagacaggagtaccgtttgagaggtgaaagatttaagagtaaatttttcacataacttcatctattatggtcaaaattcgtcaaaaacataaggttttgccacgtgccatattcccttaggtattgtggccataaagtttcacaaaaccatatgctagtactatttattattttgactttactttattaaaattttaagttctacaatcacatcttaaatttatgggttctttatataaatgatgcatcaatataagtaatgttttttaaaaaatatataggagtgtgttaaattggttaatgatgttgttttgtgaaactctagtaccataatacatggattatgtatcatgtgttaaaatttcagtggtttcgtgtaacttggaacataatagataggattttattaaatttattcaagatttaaatcaaatcatccaactgaacacgcatgcaccgatcagaatgaacatgactgttatatttcaacataacactaaatacatatacctcacaccttatcataattttgacagcccaataaccaaatttcttactagttaggttaaaaaaattttcaaaaatatacatatatacatatttgatgtatatatatatatatgtatgtatatatgtatgtatatatgtattatgtatatatgtattatgtatacatgtatatttcaaaaatatacatatatacctttacatttcgtccgtcttatttgaaaattttttgaaaaaatttaaaaccataagacacgtataaagtactattcatgttttatcatctcataagaataaaaatactaattattaaaaaagttaaataagacagacaattaaagttgggcacgaaaattatggttgcacttaaaatggaacgaagggagcagcattaactatatttagtgaggatgaactttatagatatatagaatgcctcgtcgataggttaaatctacattcatctttgatttggattttctttttagtctagatagatactcacttcttctcatattgatcatcatataagaaaatgcaccaagactaagagcaagtataatagtgagctataagcctactataagcttatgtggaggagagagataacaaaaaatcatggacgttggctctcagagcaagtttaatagtatagccaactactagctctaatttatctatagccaatctaatagctcatttatacaatagttacatactacactattaatacctggtcccacctgtcatacacactgtgtcttgaagtccgtgctacagctggctataaatttgtagcccactacttttctctctccatgtttaacttcttaaaatatgtttgcaaccggcttatagcatgctattgtacctgctctcatgcaagagctagcttaacacaagctcctaagtaaatacattaaatgcataggtgagagatagagagaggagaagataattgtagccaactttatagctaatctattatatatattggctttaagatgggctaatagtaggaagtgagctctactattatccttgctctaaggacagcacagcctagttaattctggcattaaaaccacatcgaacaattaacagtcggtttgggtctcatgcaaagagtgtcacgcctaccgtcggatgaaagtgcattgtggcatgcaaactcctttgatccagcgattgcatgcaaacgcctacacacattaattccatgcaagcatgcatacgttacgaggaggcatcagcgagattatcaatggcactagctctatgcgacgatcaatatgacatttttagtttctgctagtaggatgggaaggagggagtattgtctttaacatttttttctgatccggtctgattttgtatcagttttgtcatatatgacgtggtgtataaattaatgatgcatgagaatttggttggatcagtttgtttgcgcgtgcgtcgcatagaacaggaaccgatcgacgaccgacgggccggcctagcgagaggtcggaatcgcaactacgccagcgcggagaatatgaggacgatgcggacacaggcaagcatgacacaacaagcgacagacgaaaatttaaaggtgatgattgaagaattattattcatttttaaagtaggtttgattagattagataggctcaaacgtactctctccgtctaaaaaaagacagatctctggtttccgtgcccaacgtttgaccgttcgtcttatttgaaaaaattataaaaaaaattaaaaagacaagtcacgcataaaatattaattatgttttatcatctaacaacaataaaaatacgaattatacaaaaaaatcatataagacggacagtcaaagttgaacacggaaactcagggtttgtctttttttgggacagagggagtactacgttaacgagaagtatacacacgtacgtaactacctggggttaaggatatagcaggccaaacgggcggcccggcccagcacgacacggcacgccgacggcacggcccactagggcacggcccattaggcacggctcctgtagcgggccgtgccgtgccggcccacgtgccaaggccacggcccaagcacggcccaagaaggtgctgggccgtgccgggccggcacggctactgtagtggcacgtgggctggtagccggcccactaatacatgtggcccataaaaattgaaatttgaggggaaaaaaagaaaaaaggcagaaaaaacataatataaaggaaaaaatgataaatataggataaatgtgaggaaaatttaggaaatatatcataaaatatatggtacaaatatgataaaatgtggaaaaaaataaaaaatatgagaaatatatggaaaaattagaaaatcgtaggaaaaataaatgggccggtgggccgtgccatgcctgggccgtgccgtgccggcacgctacagtaaacgtgccgtgccgtgccagcccacgggctgaggcatcggcccaaacacggcacgggataacgggccgtgccggcacggcccacaggctggcgtgccgtgccgggcctgggccggctacagtactgccgtgctcgggccggcccggcttggcacggcccatttggccaggtatagttaaggatcgatcgatcgatatgtgttgcgtgtaggttttaaaatcgatcgatgaaggcatgaagcatatgcatgcatgcagccagcatgtgccattttaaaacatgatgcgtttgcacgtcgacaggtaacagaggcgccgcaaaacagctggccaagtcaagttgaactattttactatccttaacaggtagtacgtcaggtatcatatgttcaatatctcgatcggtacctctctccagtataaatttaatatatagttataaatttttgcactaaaatttttatgttttttaagagctattaaatttctctaattaattagggtatacttcactgtactgtgttaatagagtcacatgattcatcaaagcataagcgaaatgaactaagtactcccaccgtcccaaaataagcatttttagaatagtgacaagtcaaactttttagatttttactattaatagaaaaaaataaaaaacattaatcatgtaaatttgatgttattatattagcattaaacgaactaccataatatataactctttttatttaaaacattttacttttatatatattatcggtcaaagtagcatctcggagaccttgttgaggtcaaaaatactccttccgattccataatttttaatattttaaacaaggttaagctcaaaattttattctttttttgactatcaacaatcttaaaaattattcgaaataaaggtactatataacaacatatataaatttatcttacaaaatactataataaaagtaaaaatatattataataaaaaatataatcaatgatgtaatttaaataccatgtcattatccaaaacgttaaaccttataaaaccggaggaaacagtacaagttctatcatgggtgatatggaatcggggaactagtatagtttggcagttcactactaccaggatatatatgccaagttcccgagaaaaaactcttgggaaacagcctaaatttccctgggtaaagctgtgtttagattcaaaatttggatccaaacttcagtcattttcgatcacatcaacatgtcatacacatacagcttttcagtcacatcatctccaattttaactaaaatctaaactttgcgctgaactaaacacagtctaaggataggtatctcttgcggatagatttcaaaacctatggacgatatggtaatatagatctctaaactgttgttacaaagttgctcttggttgtacctgtcttttaattgagtacggtacggtatatatgttgggttcgcattatttggtcgccatttaatttgcagtcaaaagagatcgatcgaggatcatgccaatcatgcgtgcatgcatctacttttcaatttgctttgctaggacgatggagacccagctttcgctatccgcctatccgttacaaaaacacattgttttggaaagtcaaaaactccagaaaaactttcagtattaataatactaccttttaagacatttagattggattcatgatcaattcatagatattaatttgtatacatcttattataataatatactgaatatgtatttcatagatactatatatataattcgttgagatcacttgtacatattttaatttgcaatatacaaatatagtggtcaaaatatgtattgaaagaacgtaacacatcggtaattttccctcgaaaaaagaacacatccgtgtacgtactcaaaacgacatattttcatgaaaagggagcgcaatacgcagtactcgtgatacagcctacaaggcgatcgagtattaatttatttctgcacgtaatacgaacgttcgcaggatggacgtatgtcagcttaatctgaacgagttaataatatataataattaattaattgatgatcacttcgatttgtatttctactgacttcgtcattacg

SEQ ID NO: 83643 - DNA, 2393 bp, Oryza sativa
caagaagaacgccaggtacatccatgactttaacaggaagaaaggcatgtcctacaaactcggcctcaacaagttcgccgacttgacgttggaggagttcaccgccaagtacaccggcgccaatcccggacccatcaccggcctcaagaacggcaccggctcgccgccgctagcggctgttgccggcgacgcacccccggcgtgggactggagagaacatggcgctgtcactcgtgtcaaggaccaagggccatgcggtacgtacctacgtactatacatgattacaattaatcttaatactccctccgttcctaaatgtttgacgccgttgacttttttaaacatatttaaccgttcgtcttatttaaaaaatttaaataattattaattcttttcctaccatttgattcattgctaaatatactaatactaaagtttttgaataatattcataaaaaatcaaatgtgtcaaacatttagggacgggggagtacaattatacaaatacacacatgttatttatgcatatatacatatataggtagctgctgggcgttctccgtggtagaggctgtagaggggatcaacgcgatcatgacagggaacctcctgacgctgtcggagcagcaggttctcgattgctccggcgccggcgactgctccggcggatacacgtcctatgcattcgactacgccgtcagcaacgggataactttggaccagtgcttcagtcccccaacgacgggggagaactacttctactaccccgcctacgaggccgtgcaggagccctgcagatttgatcctgtatgtaattcattaatttaattgtctcaacatattatatatatgatgaatggactgataatacagtttgtgtatatatcgtacgcatgcgcagaacaaggctccaattgtgaagatcgacagctactccttcgtggatcccaacgacgaggaagctctcaagcaggcagtgtactcacaagggcccgtatccgtcctcatcgaagctagctacgaattcatgatctaccaaggggtaggctatactgctgtttgtttacagtacttctccctctatattttaatgtatgacgccgttgattttttaaccaacgtttgatcactcgtcttattcgaaatttttatgcaaatataaaaatacttatgtcatgcttaaagaacatctgatgataattacataaattttttgaataaaacgaaaggtgaaacgtttatcaaaaagtcaacggcgtcatacattaaaatacttgaagtactaattaattttctcccaaatatatatatatatatatatatatatatatatatatatatatatatatatatatatatatatatatatatatatatgaccagaatatatttacattatagaaaatgtggacacatgcatatagaaacatatgtagtcatgtattaataacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgtgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtttgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcagaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagc

SEQ ID NO: 83644 - DNA, 1404 bp, Oryza sativa
gcgaattcgataaatttcaacgaatcggcagacaaacaggagttgttatgttattatcccacccgagccacgttatactacccaacaagtgatgaagtaacccactcctcgaaggcttgtgttccgccgcgtcgccgtcgcaaccgaatcgcatcgcatcgcatcggtccaaactcccaaccggcgacggcgaggccgacgaaacccaaacccagctaagcttccctcttcgattccccccatggacgacgacggcgacgccgtcctctccgacgtcgacgaggaggaccctctcccgcccccgccccctccctccacctacttctaccaaaaatccccatctccttcacaaccccaaccccaaccccatgcgcaggcgcagcgcctgcacgacctggccgccgagctggaggaggagcgccgcctccgccgcaaggccgaggaatccctcgccgaggccgagaagcgctccgaacgcgtcaaggccttagcgcagaacgtcctccgcaagcacgacgacctcaagaccgaggcctccaccgcctcctccatgctcacttccggcttcgagaggatctccgccaaggcctccccctccgccgccgcttcgcccgcgccgctccccacttcccaaaagtactcctccggcctccccgccatcgcttacggcgtcctcaagcgcgccaacgacatcgtcgatgacctcctctcccagatcgacgccgccaaccgcgaccgcgacagggcgcgcgagcagatggagcaccgcaactaccagatcgccatcgaggtctccgagctcgaggcgtccctcgcgtccaggtccgcccactgcgactccctctccaagtccctctccgacaaggacgccgagatctcggacctccggaacaacctcgccttcctggagaccaagctggacgcgcagaggcccgtgctcgccgaccagatcgcctgcgcctccaaggtgtacgacgagatacgtgaggtggtcaagctagtggacgcggatgccgcgagcgcgctctctgactcggtgttcgtctggaaggagaccgacgtggaggagagcctcaaggtgtccctggaagggaccaagatggcgtacgatctcgctaccactgccctgcacaaggttggggcatgggttgataaaaaggaaagcaaagtgagggatttggaagcgagggtggatgagctattgcgggagaaagagcacattggggtgttgctccgcagcgcgctgcaatcaaacaccagcgaggtgctcaaggttgctgaggatggactaagggaggccggaattgaggttgggctcaaagagcgcagggagcacaggccagggagcatggagaaagatgaagtctataccctagtaagatctttgtaatgctataatgttgc

SEQ ID NO: 83645 - DNA, 826 bp, Oryza sativa
tattttcttagcacaagagcaattattcacaatattcgtaataattttattcttgtgccgagaaggaaatcaaaccacagaaattaaattagtggctagatcaaaaaggaggaatttggatattgggatttagaatcaaaggatagggttaaaatcaaaggatggattaacaaataattctaatgagattggaattattttgggttaggttcaagggcaaaattgggaaggtttcttggaccacaattcataaaaataataaaaaggggttttcaagcaaaattgactaaaaggaatttagtcaaaagaccgttttgaacgaaatcaagaaatacctcactttaaccaaaacatatttttaagtgaaaaacacaaaagagattaaataccatagaggctttcgtacaagtcatttttaggaggtcccgctaattatattttcctaggtttagaaggttattaataacataagaatcagcatgatgcaaaattagcagagggctaatttttgggttgttacacacggctaggccatatcactttgtgcaatgagtaaataagctaatttagagtggttgcaaaagagggtgcaaaaatatcggtctacaaaaaacgatattggtgaaactattgaagattttgataaagtagaaaagcttggtcaagggtttacatcggccgatccgttggaggaagtagacataggtgatggaactaaaccaaggccgacttttgtaaacaaaaaaatgagagccgattataaggttaaaataatcgagctacttaaggagtatgttgattgcttcgcatgagagtatcatgagat

SEQ ID NO: 83646 - DNA, 680 bp, Oryza sativa
atagcatagatctaattaattactatataatttctcatcagatcgtccgacctggtggcatggagaggccaacggacgctttcaaggagacgcacaacctggtggtggcagttgaggacacctacgtcggtggactcgtttccaaccttcaggtggcggagctcatcgcgtgcatcgccagcaacaggagaacggcctactgcaaggtggtcgaagcgatcgcagagaccaccgcgccattgctgcccacggaggatcagctcgccaacataccttcaaagcgggtatacccatgcctattattagcatttaatttctccatttcatattataatttgatatttttcacagtcaatattttttattttaagctcaatcaactttattagaaaaatatagcaacattttcgataaaaaatcatatattatcggaatataatttaatgttagtttcgacgaaactagggctgcattttttcgcttagatttgagagagatttttcaatgcacgcaaaacgagaaagattattagtatatgattaattaagtaaataattataaacttgaaaaatagatttatttaatttttttaaacaacttttgtatataatttttttttgcaaaaaaacaccattgaacagtttgaaaaatgtgctaacaaaaaaaataagcaagttaaa

SEQ ID NO: 83647 - DNA, 998 bp, Oryza sativa
ttctgagtttcttacccataaaatatttgcaggaagaagatgccatggacagggatggaaatgatcttgatggtgatggcttacatccacagaagcatgccaaaagtcctgaactggcaagagaatttcttttagatgccgcggcagttatatttaaagaacaggtaatttgtaatcaaagtatagaaaagaaatgttggaagcaatacttgttgtaatgattgtggctgtacaaagaaagaaaaaaaacttgattttctaaaccacagctcccaaatttgggtgcacaacctgcatatcatacattccatttcaataagatatattttccttcaattgctacttcataatgaaggaacagtaacttaccagtgtttgtgattgctatatgaagtcctccacccacatacaccgtgtgatttgtctatcttatcaaatggcaactgagtggtatgttatttccagcagcactactcctttacctaaggttcatgaataaaagttgttttttgttgttcttgtttctacccgtcttgcccccatcatagcattgtcagtcactttagtcacttctgaggttgtgttttctagccactgttgtagccattaagtacatgccaatctagttctggacctccacatatcaaagtcaattttctttttttattattcaagatatttaatgcaataaaaaaattaaagaacgattctccacagagatatgtacataaggggatccatattcttttatcctgtaatattactagtagtggttactgtagttactaagatcaaatcaagatttatttattgagggttttgctaaaatttcagatgcttatgttacaagcttaagcatatgctaaatatgggttattgcaggtcgagaaggcattcagagaaggtacagctcggcacaaatgcacacagtatttttgtgtctcttgcattagaacttttggaagagcgagtccatgtagcatgcaaagaaattatta

SEQ ID NO: 83648 - DNA, 567 bp, Oryza sativa
aaggtcctccttttatatcttaaggggataccacatgcaccatttctctcttttttgtggggacttaccccaccttttcataaacagacggagacttgtatggttgctgtccgaatgaccttctgatgagacgggccacaactacctccacttccgccggaagcaggcgcgacgtggaatcgtggctgtctgctgacgacatgaccggtatcagaccagtcacgtcggtcattcttgtccaccacgtgtcagcttagcaacctacatgctcacccttcttcacacaacatcttgcctgtaatggttaggatgaagcctggcatatatctgaccaggactaacgtgccatctctgggaggtaacacgctagctccagctggggacgagcgcctagaagccctcgtcctgacgggatggggcgaggcgtgcgtcagatcgcctgttgccacctaacccgcgatctgaccggtctgtgactggtcacagaccggataaacgagtgcactgcactgcgttacatacggcgtgacacgctcagcccaaccgcaataaatgtggttaggtgag

SEQ ID NO: 83649 - DNA, 684 bp, Oryza sativa
tctagtagtagcaactaaagtgaggtcgcagaatattatgcctaactagcgatggttttgtcatagtcacgtcccttttttttatctaatcattctcttatttttatgccttactctctccgtttcaggttataagatgttttgactttggtcaaaattaaactgcttcaaatttgacaaagtttatagacaaatatagtaatatttacattaccaaattagttttcttaaattaataattaaatatattttataataactttatcttggttcgaaaatattactattcttttctataaatttgattaaacttaaagcagtttgactttgactaaagtcaaaacatcttataagttgaaatgtagggagtattagttagaaaaccaaaaattttgcgattttgctaaatatttatttacagatttttttttggctaaaaatcactcggtattttttaccgtccgattcattgatgatttctgtgcttcgttattagccgcacagtttctttgcgtgtcctctttccttttccctgtgttgtatgcacatatttattcgttcactacccgtgattggttggctatcgtttgagagatagaagatgcatattctctatttactagctgctatatgactatgcgaatggcttctgctgttcttttgtgagactagcatactactttt

SEQ ID NO: 83650 - DNA, 532 bp, Oryza sativa
  unsure (1)..(532): unsure at all n locations
tccagctgttgatgcttatcagaagattctctcgtccattcctgagttctccgggtttggaaggctcttcaaggtctgtagcttctataccattaatgattttgattgagtacacatgctaaacccctctctttttccccagtcctcagaacctgtggagctgacagaggcggagactgaatatgcgattaatgtggttaagcacatatacagtagccatgttgtgttgcagtacaactgtacaaacactatacccgaacaactgctagaaaatgtaagcagcaaacaattaagtacaattaaatatgttcttggaggcacagctgtcaactcacactgaagattttttttcatatatgtatgttgattcttgtaggtgactgtttatgttgatgccactgatgctgaggaattttcagaagtttgttcaaagccacttagaagtttgccttatgattcacctgngcaaatttttgttgcttttgaaaagccagaacatgttcctgctactgggaaattttcaaatgtgctg

SEQ ID NO: 83651 - DNA, 507 bp, Oryza sativa
tgaattagaacctgtgaagaacaagccattagtcaactggaggagagtaccaatctaaatcctctttaagtgaagatgcatgtactctcatgagctgcaaggcaggttggctatatgccttaatgagttctattagctttaattagcaaagatgctatcctgtagagcattcttaaaagaacacacctttgtgagcttgactattggttgtactcttgatattttaggtgaatcttctagtaagcttactaagagaccaatgagtatgacttatacactctacccgaggagcagtctactgacggtctagtaccagataagactctgtgtgaaacttgcttgcacaagacttgcaattcaaggcatagtccattgttcaagttgtgagtaagtgtagcttgaagttctaggtggatgttcaatcttaatcggtctccatcaacagttggtatataaacagtacattggaaaaaggcaaatctcagtaggattttgagatttggtggg

SEQ ID NO: 83652 - DNA, 1217 bp, Oryza sativa
catgattctcaatggtttcaatggtgaacctacggaggcgaaaggtatctttttgatggagcttaccgtgtgaaacaagacgttgccaaccgctttcttcatcgtcgatgtgcaaggtaactacaatgttattttgggtcattgttggatccatgccaattgttgtgtgccttctaccttgcatcaatgtttaattcgatgggacggtgatgatattgaaattgttcaagcggatatgtcggccaaagttgcaatggccaatgcgacattagagtggcgtcatgggaatattcaatgcttatcggggatggatctttctagctatgattttattagtattttcgatggcaaatttgtacctatctctgtaaagccagctagtgtagcacggtgtcaggtcctgaaactaatgattcggaaaccgacatgtttaaactgtatcaagccctggattagtaaattggtacatgttcaacaatctggatcttcattgcatacgtttgaataagactccaaaggatatattattacaaaatatatgggtatttaaaaacttgtggctaactaatacagcaaaagctatagaatgacttaactctaatgtttggctatagacctaaaccatctatctaatctagacttgagaattaagttagaatgaaactaacttatgtgattgaactcccagctttggcaagaactccaaaatgactctgaaaaaggtggggttgaagcaagggtgagtacaacgtactcagcaagctattatattcaatatgaatgtatgaaatagtagcatttaagtagggctagatttaattgcagaaagcagaggatgtagaagaagaaagcctgtaatgactttaatgcaacagtatttagtaaaatcttgaattaggtttctaatcaaataccatatgagtcccggtactcaattccgtgagcacgactattcgaatagtttcatgaatattctactgcagtagatgtacgctttacccgcagtccacgacttgccaattcattaggttagtcatggcctattattaggttattaacaattgtggcacttggtccatgaactctagtccccatgcgctctgaacgtaacgttatcagcagcgagaggagttctggcgttcccggggtctttagagagaactgatcgtatgacaccatgtcatcgcaatcagggttcacaaacagactagtcatca

SEQ ID NO: 83653 - DNA, 617 bp, Oryza sativa
tcctccgacgggttcaaagtcaagcagggcgaaacaagctctcacccaaatgggaaggaccgtacacgatcacacaagttctgcggccaggcgcattcaaaattgcagacggcgatggtcgcgagttgtcaaattcctggaacattgatcaattacgtaaattctatgtataagttaatagtatccatgcttgtaagacatcttacagcttcaataaagcctatttttaggtacagactacaatcaaagtgttccttcccgatgatcccttacccagatgacacctagcgttgaaacctatcctcatgtccctttacgccgtcttgacaaggcctccgaggaacctaagggaacttcggctggggatgcccagagccgataaggccttgtcggatcctgtagagacgaaagaccatgtaagatctggtcgtgtaagagttctcgccgtgcgtattaaccaagccgtgtaatcaaaaataaactttccaacttcacagctgggggctaggattagtgcttgttcaatcgaggcaggtcaaaggtacaagagccttatctcccgagaagaattctccgatgacaaggctgggggctagggagagtgtataagtcaaacg

SEQ ID NO: 83654 - DNA, 509 bp, Oryza sativa
tcttcgcgctcccaagtagcttcttcttcggcgtggttgctccactgaaccttgcaaaaacgggttactcggttcctggtcctgcgctccatggtgtccaggattttcactggcctctccacataggtcaagtcttcgcgaacttcaatttgctctgaatcggcctgctcggatggcattcgaagacatttcttgagttgcgacacatggaacacatcatgcacgttacccaaggaggcgggcaactccagttggtaagcaacttctccacgtcgagcgatgatacggaagggacccacataccgaggtgcgagcttcccttttgtctgaacctgtgcacacctcgcaatggcgtgacccgaagatacacaaagtcatccaccgcgaattccagatcacggcgacggttatctgcataacttttctgccgagactgtgccacctttagattatcccgaatgattctgactttagcttcagcttctctcaggatatcagtcccgaacact

SEQ ID NO: 83655 - DNA, 614 bp, Oryza sativa
gaactgtgctatgctgtcatagcatcttataagcagcaaaaagttggcattattggtttccggtagtatgttcctttctaattcctttaggataatcatgtcaaaggcactcaaacaaaatcatgttttgcaaaactaccatagtatttttctgcacaaaactggttcagctgctcacattaaagagcactaaaatccagggttaatttggagttaggtgcccaattgcattaattgttggattcaacagctttattttttttcctcatgtatgcagcacagctgcagcatggtcaattggagcatgctgatggaaatggagactgggttttaactatatttaaagctctgtcactggtaagtatatttttttatagatttttttgtggcatacttgttaataagcttaaatttattcatagttcgttttccgggtccctttaatgatagtccttttttttggttgcttcacctaatgttcgtctgaaacgcatcttctacgcttctagcacaatggtcttcatctgtgtttctagttaaggttgactatggtacatgtgtttgtattttgttctcattacaaatctatcatcgtacaagtaggaagtgcaaca

SEQ ID NO: 83656 - DNA, 1226 bp, Oryza sativa
cctgcaatgccaacaaaaaattgatgtttaagcctaggttgaacaccattcagccaattaccaaaaagattagtaatgctagtaggcggatggatcccaaaggttatagacacagcattccagattaatctaaccaaatgacaatcaataaaaagatgttgtatcgtttcattagaatcacaaaagaacacttagtgctacctttccaccttcttttttgcaagattatcttttgttagagtaacccctttttttaagtaccacaagaaaattttaatcctcaatggaattctaagccccaaaggaaagatttccttggaattactccgttaaaaatgagagctctgtacatggagttgacggtaaatatttcctttttattggctttccacacaaagacatcattttgttctgtaagttgagttgacataacttttgagaccaagttataccaagctgctaggttatcccctacaatagctcttctgaaaaaaacgtttaggggcaccttttccaacacttcagccaccattacattttttttcctgactagattatacaacgaaggatacatcttaaaaagaggaatcaccactccaacaatcctcccaaaatctcagttgtgtgccattacctacttgaaaagcgccacaagaaagaaaagagttcttaacctccatcagccctgcccaaaaatgagaatcccctggttgtttttctacaagtgtaattgttttcttagccaagtattttttcctaagtagtttttgccaaaccccatcctcattgataagcttatacaaccatttactcagcaaacatttattctgcacatttagattctgtattccaagacccccacaatccttaggtgtacaaatcacactccatctcgccaacctatattttcttttatgtccatcactttgccaaaagaatctagacctgtagtagtctagcttcttgaggatacctttaggtacctcaaagaaggacaacataaacatggctaggctactcaacaccgaattaatcaacacaagccttcctcctactgagagacatttccctttccaactactcaacttcctctggaacctctcctcgataatttgccaatccttattagagagcttcttgtggtgcataggaattcctaggtatctaaatgggtaagtcccagatctacacccaaaaagcatgacatactcattctctgcaaattt

SEQ ID NO: 83657 - DNA, 1535 bp, Oryza sativa
tttcttttagctgtttcactgctcatgtggtttctgtaatttttcaattgaaggccaatgagcaaaatagtatttggagatatgtcacgactgttctgcttatcaatctccaataaattagtgatgcaatgtaaatttttgttcctagctcttgtgatccacgccatctgtaattttctaccacatgataatcgtgaacttttaaaattggtaatttacttcttaatttttagcaaattcatgtcgttgctttaaggacgaattcttgaaattcttcaggttatttttgacattttcttacagtagatatatcatttttcactgtggcgtgtgattttttttaccagatggcgtgtaattttcattcttcattcgtagattattgagctgttacttctaataagtaggagatttctgtaacaaaatgccatgaatacgggatgcctaatctgtgtagagttcatcgaatactttggtcattgcaaccttcatgtttcgtttgttgcgattggctgttgtgacaggcatttagtgccgtggtttatttttatttttatttttatttttttttcagttcagttccagcatagcattcatgctatagggctgagcggatcacagtcgtatcactgaccggtgattgcgctccagtgatgcatagtaagagcttgatccgttggtctaattagtcaatgccaaaaatcaaaaattgaattttcatatttaattttaaagttaattttaagaaatttttggcacagttttttatattgacttttaagtcactaagaacatttctataaaaagtttatctataaattaattcttgttctttaacaagctgtttttatctataaaagtacgaattaccctctgaactatcgtggtggtccgaattaccccccgaaccacaaaaccagacatattagacctcaaactattgaaactggataaattacccccctcactcaatatgaagtggtattgatcctacgtggcatatacatggcgttgaggtggaaatccgatcaacattttcttttttaaaaatggtgggggccacctgtaagacctcatcttcccatcttcctccctctctctctcatcatcttccacgcggtcttggttcccgacggcgtgcggccacggctgcgcggattagacgacccccggcgtgcccaccgccttccaggaccccgacggcgtggtccagctcggtcgcccgccccgcacctcccgctcctgccgcgggcagaagtagaaccacggctccccctcctcgccgctgctgcccagcatctcgtggtgaatctctgcaggtgtatacaggtgacgcggcgctcgcgcgacgacgtacgacgaacgcaatgcacacgtgtgtgctggtacctgagagctgcaacgggtcgacggagtatatgtcgaagacggggatgacgcactcgatgtcgtcgtggaggccgtcagcttgttgcggaggtagaagcatatcagctcctcctctgttgggtagaagcggaacccgagagccagcc

SEQ ID NO: 83658 - DNA, 1823 bp, Oryza sativa
cagttgctgatcaataaaagctgatgctgaagccgtctgcttgacattcgctgttgtcgataactctctgccgcttctccttcctcaacctatttcattctgttgttgctacttttgctgctcctccctgcagttgcaaatagcttctctgggaagcttgctgaggccatctccacctcctattgatgtggcatggtcacggtctggttggccaacaggataaagctgatagggagatgtcgaggtggccgatgatgtggggagaagcctgtgagaaacaaacggcatggggacagagagaggtggccagctatttatagtgataggctgagctgggctaccccacctgatcacctcttctcttccagagggcaaaaaccattgtacaaagcatggtgagagactgagcttgcttggcccacctggctatgtccattcttcgctgccgtccttttgttcgccaatcaccagcaccacctctgttctctgcagcatgcatggcgctctgttgctaacataaccattacctttcccttttcccctccgttattctagcatcatgcttttcggcctgcatatgctgttcgaagtgaggagcccaactacgctagtatgcgttggttcacatgtccattgatgattttggtgagacaatccatttcctcatttccccacataagtaaacttgcggtttcaagttctgaggtattgattatcaattcatcgtctcattcttcaagccaaacatgacattttcaccagattctgtaggaaaggttgagcttttgtaaaccttatgtgtccctcatgttatttacagactacgggaagttttcaatagtcatttttctaagtagttctagaattgaatgactaagctttatgtgtttgtgcagcaaagtgcagccttcaagatcttgagaactcggctgaagactgtgcctttcagtgaaaatttgaaacgcacatcttcaacaaatccatactctcagattctacaagtgacagaagatggtaatcgaaatcacgacactcagagctacaatgcaatcaatttcccatcccggctccaccagtttgagagcatgcagcagcagcacagagttcatctaaagaatcaactgcaatcccaaaaatctgcttcagctatagtattatcacaggtaatgtttctcttgcattaagccattaacatatatctgattatattgtatacctatacgtagttgcttcccccattaaagtgtaactaggtttttagttgcgtactgaaaatggttccttagcttacctatgcaactaagatctgtgttttcttggtgttgaacacttcttcttcttcttcttctttttttttttttggggggggggggatgggggggggtggtctttaatcctttcatctacaattggttgtgagagtttcttcgtgttaagttgtaaatccttctctttgcagatatattaaatatctgatgtctcccgtatcaactgtaggtctacctgaatcatcatcgcatcataatttaatcttgtaacacatttgttagtccctttgatttgctactaaaatgttatttcccagaaacctgactgttttcagaaatctgccaactgcaactaggaaaagttgctcttgaatggcttctttgattgtgtaccatagtttctcactgcaaaccttcataacttagtcaaacaaaggttgccactaagatgcttattctttgataggaaaaccgctatgtaacttttgtgaattgcatgcaggaaattcaaagatacgaagaagcacattcctcctcgacagggctgcaggaatt

SEQ ID NO: 83659 - DNA, 556 bp, Oryza sativa
gtccccaagctggagcatctggaaagcgagtcttcacaacatgatagtcctcccaagtagcatgatctgctggtaataaagaccatttcagcaacacctggacatgagctgcattgccgcgcttcactagtcgacgctccaaaatcgcctcaggaacaacgtcagcagcatcaagaaccactggggatggcaaagaagtataaacaggagtatgatctggcacctgagctttgagttgagaaacatgaaacaccggatgcacagtgctgctggcaggtagatccaaacgataagccgccactccaatgcgctccaaaacagtaaaagggccaaagaacttataagccaacttaggatatggtctattaactactgaggactgagcataaggctgtaacttcaagaaaacagcatcacccacagcaaaaacacggtcagaacgacctttatcagccttgttcttcatacgcagctgggctcgagttaactgctgctgtaaaaattcagacaagccctgccccttcagtctaaacatccaccacatcaggcagagtag

SEQ ID NO: 83660 - DNA, 532 bp, Oryza sativa
ctgttttggaaccagacctccacctgccttggcctgaggttcagttgcttcgctaaagcgactttctgcttctgctcgaagaaacaaaacaaaagcggtggttcagtgacccatatatattcgatcaaaaaagatgaacaaaacacaaattaatatgcgccatgtttttatcttaatttgctccttgtgttctactacaagtgcagctttctgcagctaggctaagcggcggcaagtcaatagaacgtaaggagaacgcgcggacgtacgtgacgtaccgggttgagcgtgctgtgctcccggaagcggtcctccaggagcgcggactgctccttggtcagccggagcttcttgcgggtgctcccgtcgtcgtcgtcgtcacgcccggccgccgtcgacgacaccctctcgccgtcggactcctccgcgcgctccctcttcacggccgccgccgccgccgcgccgacggacagcgacgacacgctgtgcgcagggccgtccccgccggacgcggtcgcggtcgcggtcgcgg

SEQ ID NO: 83661 - DNA, 1968 bp, Oryza sativa
ggcgcctgctcctgctctgcctcgtgcccccgcccggcgtcgttgtcagatggcgcgtaggaggaaggcgaggccggcagccagggcgaggcggcggccggtggtgtgcgaggtggtgctggccggacacgcggccttggcccgatgtccggcggcgtgaggctgtggaggtgctgcgcgaggagcaagccggcggtggtgacggggtcatcaagtggctggctgccattggtgacctcagtggctttctgcagcatgcaggaagcggtttggcagtgaagagttcatcctctgtattgccagcttgacctgcggggtggtagactgagcttgggtgttgaagggatggcgtggtggtctggcgatggtcgttgtgcaggatggttgtgtggggttttgatgggaaaccgctggcgaaagccttgccaggccatgggctggcatgacgacggcgacgccatttggcgccgttcccctccttggaggcgtcgtcctggcattgacccctcgtaacacgaagaaccctctacgcgcaatggtagccttggtggactcctgcaatgtccccaaagctcttcaggtctagggtgtttgacgaggcctcacttccttggcttcgttccttgctacaacgggtgttcatcactcttatctggttactgtggggtagagtcggaactgctttgctgggggcgacgaagcttggcaacaatgacacactgcaatttctttataggattgttgatgctagctgtgtgtaggagtggttccttggtagcttgggctgatgtccttcgtgggtgtcgttcttgtttgttcattttggcgttgggatagcatcacattgaagtcgaagctgctgtgtcacttgggtgacaagcttggcaacgataacatgtgtaagctgccgtgttgtctcaaatggcaagcttggccgatgccttgtgtcgggctctgtcgtggtagtttaggataggttagctgttggtgtggtgttgtagttgtggttttcgctcagttttctctaattaactgaggtgttgtagttgtggttttcgctcagttttctctaattaactgagcactgtaaagtttgatcccgttttcttctcaaaatgggatatcttcttcttaatataaaatgtcggcaacggcctgaccgtaggtttcaaaaaatatacgaggcagtttctcttttgcttttagcctgcaacacgctagctcaaagtgcaacactttgcacatttggcacagacgtttacatccatccatcgaagttattcgcatcagtcagagtgacatgtaaagagtggagaagatgtaacccgatcgaacaaacagacaagctgatcgaacaaaaaaagacagcggttttccatatatataaatcacgatataggaaaatcaagaacatccgtccctacggaaaaagcaaatccgttttacaaagcattattattcagagtacacaaaatgacactcggtgaacaggacagactagtaataaaattcaaagggccttgtcgacgccaaggatagaccgagaccgaaatccaacgttgacacatcacggctgatgcacgcacgcgtacgtttcttttttttgttttttttgggcgcagaaatgcacgggagaggcccgccggacggcttagttctgcttccacagcagcgtggtctcggcgatcatgccggtgacgacgtatgggtccatgttggacgccggcctcctgtcctcgaagtaccccttgccctccttctccgtgtcgcgccccacgcggatggacgcgccgcggttcaccacgccctgcacgcacgcacgcaaaaaatggttatgatctcatggtaggctagccgatcgatcaacgaacggggggggtatgcgtggatacacgtacccattgaaggtgttgatgtcggcggtctcgtggcggccggtgagggggcgctcgttgccctcgccgtagg

SEQ ID NO: 83662 - DNA, 982 bp, Oryza sativa
tatggtaagcctcaaatcattgcacgtttctttcagacgacaatgctagtcaatttgaaacagtgggatgtgagaaccccacaaggaataaagaagatgagacagatcaatataaaaagacgacttgggcaaagtcttccagtctacatcttcattgataatgctaagcccatccatggcatcactattaggcaagagaagcacagctatatacatcattatgcatagcaaagcaccttattagcattgatccattcacaacttggagtacctcctttctgcttctatctctcctgcaaatggagaatagcgagcaagagaggacggactcaccattggagtatgatttgaggaagtacctccttctgttggccacccttgtggccacggtgacatatggtgcaggattcagcccgccggggggtgtctggcaggacaccgaggccgggcacctcgctggtgactccatcatccgggatagccagtatcgccgataccttatgttcttctactgcaacgcgactgcattcgcgctgtccatcgtggtcatcatcctcatcttcatccttgctatcctgcatgagaaggggaagttacagatccccatgcttccactgcgagcagccatggtgctggacctgctaagcctcattggggcctatgctgcagggaccagtcggggtgttctcacagccggcaacgtctctgcacttgtggctactttcatctatatggtggcacagatggtggtaactttatggcttgacaagaaacagactcaggatataagctcaggtaatctactaatcctcctaattcagcgcactaaatatggaccatgtcaatattcagaggggaaattgaccaggtgatgagaagaaaaaacggcaccgcaaggtactgatgcttctcgcaacatttgtggcaagcatcaatacatggctgggctgagagcaccgggtggctactgggataacaacca

SEQ ID NO: 83663 - DNA, 889 bp, Oryza sativa
tcaaaaaagaaacatgccacacgcaaatacttgatgctgctaggagtcttggctgcaagtgttacttaccaggccggtctcaacccacccggcggtgtgtggcagggaaatagtaatgatcatgcagcaggtaacccagttatgcatgacaaaaaaagataccgttatctcatcttcttttacagcaactctacttcatttgtggcatccattgttgttatcatcctgttgctaccagagaaactgctgggggaggcatggtcacttaatgtgatgaacataacgattgtgttggacttacttggcctcctactagcctacatggctggctcaagaatgaggttgcagtcttctggatatttcgtcgtgtttgttataggtgcactaggctttgctgcaattcacaagatttggtcatatttgcaaaggaaaagaaatgatcagcacagactgttagaccaacccagatagtcaagttagggagtttagatgttctagtgtgctttgtaattctatccatccatgctttctttgtttagtcggatgcattatgttccaatatatcattagctggttaaagtcagactcaatcacgctactacttcattcttatctccccattaacagcccataaatcaaacaagagctacaaatgttaaaagttaaatcgctatacatattaacttaagtgctttctaaaatttttaggactttaattaactctgtattttttgaaagcccttacccattttcagaatccaaaacagatttttcttttccaaattttcaaaagtatgtgacagattaagtcttgtacttaatatatgctagtatctattttggaaaatacttgggtgccttaggatataagctactagtccatatgtct

SEQ ID NO: 83664 - DNA, 621 bp, Oryza sativa
ctgaagtcattaaccatcttcagatactgaagaacacaagaacaccgttcaattagtctgatggcaaaacaaatatatttgcccaaactgctagctattattcaaaattgccgagattaatatgcttttatatatactattagaatgcacaaaagtaatttttgtggggaatattagtaagacacaaacaaagataattagcattaattagtataccgtttagtggcggcgtagacggagtagagtgggaaggaagggatggcctccgtggagccggagccgatgttgacgacggcgcccctcccccgcgccaccatccccggcagcaccgccgccgtcacctccgtcaccgcccacaggttcacccgtatcatcctcacccacgcctccgccttcgcctcgtgcaggtacaccgcgcacggccgcgccacgcccgcgttgttcaccaccaccccgacgtccagccccgccaccgcctcccgcagccgccgcaccgcctcgtccccctccgcggtggacgccagggccaggtcgaacaccacgctcctggtctccacgccttcgtcgcccagcttggagatggcctccgagacgtcgcggagcttggccgggtcgcggccg

SEQ ID NO: 83665 - DNA, 6251 bp, Oryza sativa
aaaaaaaaaaaatcaagaaaccggagattgctcctcctatcctatcttttttaactgcagcttgtggttcaggttggaaacatggaagtggtcgttgaactcggagaaatcaagaacgaactttcccgcttgctcttgtccaggaaacaatccactctttcccgctcgcaccgcctccaatcaatcaatcaatcaatcaatcagtcaatccatcgagattaaaggcgccacgaactcagcgggaaatggcaagaaacgagggcataaactagaaaccaacccccaatcaatgagaaaaaagaaaatcaggagaaaaaaacaaacatcagcagcaggcagggcgggcgtttgcggaggccaatcagaatcagagagcgattggagggggggagcctgggtgaggttttgtgtggaagcaacggatgggcggtggtcggcttcgggcacggaagactttgatttgagccgccggcgaagaggaagaggagaggaggtgaagaactgaaaaatgaaaatgaaaaaatgagaatgaaaatgttttgaggactcaacacaacagtcaacacaacgcgaggcgtacggtgtgtgtgtgtgtgggtcttctctcctctgctgactttcaaaaccgctccgctgcccgttagcgtttgcttttagcactggtacagttttactatttcgacttttttttaaaaaaaaattacacttttgttcctctatgactacaacctctccactaccaccgagaaaaaaaaaaactctacctcactttacctggcaagcacgaatggctggttcagtttgttatcatttctaaccttttcaaatttcaatattttaagggtaacaaactaaacacggttcaattttattgagttttgacattttccgaaactttctactctcaaatcattaccgaaatagagtctaacatcacaattctcaccttatcttatatgagatacacttgatagtacatagtacattaataaaggtgtgtagttttaactatgagttcctgtattcaatcccgtacacggacatctctacccctctaagcctctcttttttttcaccttacatactgtactaggtaatacctcattttctgtgctttatatgaaaatttgtccgagttagcttaacaactctatcatttcacttatgcttgaatttataatttaatatttaatatttaattttgtggtttttttactgtggcttatcttatagcattttcttttgaatagttaacgacatgtctataatatttttacttataaattattttttattgctaataagcgaaacgatggacacgtaaggctgataagacgtggagaaatgaactaaaaaataatagtttagacacctttttatacacatattcttagctatctaaaagtcatcgttgaaaatttaactacgatgaaaaaaaatcttaaattaaatatacaattatgttttaaaatttaaatttcggctgtggctagcaagacaacaagcagcagacaatgaaaagcgccggccaaagggaggaagagtgcaagacatgaaaaaaatactattgggtttttttatgaatcatttagattttattagatattcataagaatctttcaaaattttatagaaatttgtgaaaaatattatgtgtttcaaaagagatttgtgtttagatgagtatgctgggatctgtttatccctgcacgcgaaatgaaatgacccattagcgtatgattaattaagtattacctatagaaaagaaaacttgaaaaaaataaagaattccctatagatttttttaaaaacaactttcctatagttttttttaaaaaaatacatcgtttagcagtttgagaagcgtgcacaagaaaaatgagagaataaaagttgagaaaatgtagtatcgaacaaagccttactagtcgaataaggtcctattcaaaggcaggaaaaaaaattcgggacttcatttgaacacaggaattccacgtgtatcaattctaccggatctaaaaaaacacgtggcactcaaatgagggtgttatatgggaattgaagtgtttcaagtgaagttattgggtttcaatcaggccaaattacgagttgtcaaaagattttctttttaggacaaaagaaattgtgcacttgttaatccctgtctagaacgcaggaaaaatccctctttcctgtggaaaacataattattttatatgaaatcaatgtgttctagacaatgaccagttcttgagcatgcttcaattatcaggagcagtagccagtaggattggagtgccatgttgactttttttttaaaaaaatgggattactgttttttgtccttttttttaacagggataagatcactttgactaattatgcccatcttcagatatgttgactaataagttgggtccatattaaggtacagcactgacagcagctcttccttcttgaatgccttcatgtcactgtgggttcttctgggactaatcattatattcttctctataaagttcatgtgaaatcaagcttttaaaaaataattaataatcctattagattaaacaggtaatcaagtgccaaatgcacccaacagtatgcagcacgagaaagctggaagctgtcataaaaaagcgtgacacatcgacacgatgattatccaagctagaggcaagctataatcataattccacaggacaaaactaaattccaaattagcagaatgagtagtgtcttttttaaataaaaaaaaatctcccaagaagtactttgtcggttgcagctgtgtggtcatgactggactgggtaaagaagaggcagcttgacagcaaataattttcagctaagaaagtttgacagggagcatttgtgtcaacgtcaatggacacagcacacggacagttcgaagaatatgacaataattaatagcttctctctagatgaactgtgctaaaagatggagtattccttggaacaaccaatatgacctctagaagaagtacaggttttacaggtgtgctagccacaagggctgttaaacaatcaactctccagatgcagataaggtttagcaacttgatagatatacacataagattatgacgtgatttttccccgtaaaggaagtgttggaaaaaatttcaaaactaaggagtgtactggttccagtttcaatttttcctggaagttgcagaaattcttgcaaaaaccgaaaaggaggttaggttactccatatcaactgaagccatgtttagatcaaaagtaaagctgcaaagcttttttgagcgcaagctaacacggcagatgacatattactccagtatttgccccaaggaacaattcagggtaatcgttcacccgcaaactcaagtgtcacattaagaagcgaagtaaaaaaaaaaagcacaaacctagagtaggagcagaaacagaggtgattagctatctgaagtctggacagttaccttttgcagcacaagtgcaaggaacaggagtcttttgtgaagatgtccaggtttgactctatgaattcttccagactgcttgatattgccatattggaacctttcagcaagcacagcgcgaatcgaaaacaacagtgaaagaaaagagagtgattcctcaagactaatttcattatttgtactaaaaattacagaagttggatgcaggtaataaggcgcatcagaactagataacataacaacatcaacatatcaacaatgctaatatgcagtttattcatttcattgaccatagcaccaatcttactaatactgtacattttggttccaatcaactagaggggattttccacagataacaaaaccaaaactatggaaagatcaaatgcagattaagtagcattgtagcactacagagagggaaaattacaaccaggataagtatcacaactggtgcaatgcaaactcaactatggtacaagggcaaagccatcatggaaacagagtaaaaatcctacatgtattccctcaggacaagttgttttccatctcatgctagctgctggtctcctctgaatcagcaagcacaaactctgtgtacaggttcttcaatgccatcaccactgtcattataaggggacctaatattgcaccctgcagagttacatcagatggtcagcccaatgtgagtaaagaaaatatcaattctcagatgctcggtggaatggcactctagtacattggtgtgctccatgttccaaggactagaatgattccataagaattttctggacagtaaacaaacagatgttgtacagagtacaagtgtacaacacacacagactatacagaaaatcattcaacataatacattagtgtccattttttgtagcctagaagaaacgcaatcttttcagattttagctactagattatttaaaagacttccgatatagaagttacttttaaaaaatcaaacaaatccatatttcaagcttgtaatagttattacttaattaatcgtgcgttaattacagaacttcactgataagatacgtggctgatcagccaaaaccctcctcaacagggccttaaaatgtataacatcataggcatgaaggccagatagagtataacttttttttttggagtacaaaaatgattggagttacacccataaatagggttgaaaaggtatagatttttggagcaagaaaaaagcagcatgtatgaataggggatataggtaaaatagatatgcttttggtgcccacagtaggagattctttagtatcaaatgcaaaacgtaaagcatttattctagattatgtcttctgattatccacaccatatgtaaaatcatacaattgaactaacaaaagttcatcttcaaagcacctaaatgttgtctgaacgaaaatggtgaaaaacatttaacacaacaaaagtgaatagatttggtataaaaagtcagtacctccagagcattggggaacaatgccatgccaccaattatgctaaggccagtgagatatccattgtacccgggtatatcctcctgaatgactgtagttccataatccatgattatgagatgaaccactgtcaccacaatagcgagcacatatctcccttccatgagcagctgtcctgcggcaaatatcgaggacaaccatggtgggagtattggcagaagtgcactgatgattgcaaacacagttgatgtgtacacaaaatgcaccttgaagagcttgaacaacagccatgtcaggcatccctggaaaatggcaatcttggcagtggctaacaagacactactaatggcatggtcgatgacctcgacgcatcgatcctttacttgttttgacaatggcaaaagatcaatgacctgctctgtagccccacctccctctacagtgatgaggtagtacagcacccacaagaaaaccatcaactgtgacacaaaattgagcacctcagctgcaccagagacaatgtggagagtaatggataacatcagattggcactaccaccgagcaccgatgtgctgctagacagcagactttttgcgatctcagccccctgcaatgccaatcccttggccttcaccaccaaatcctcccttgtgattaacagctccctaaagaatgagtccagctccctgtaaatgtccatccactccctgttcttcacatgcttcgcaataacctgtagcttcatcgagtacgggtgtggtccggatgtgatgagctccttgccctttgcaccagatgggtcaactgattggctgatcaagaaatgccggaatccgctagtgaaatcggtaaggttgtactgcactgctaactgatctatctgctcccacacggtatcgtagagcttcgcggaatactgatcaaccaagccggggatgtcattgtcgtcaagccacttcttgaggccaatcttttcagagtagttgccattctcgacatgggacttgagggacatgacagcgtccttgccctcgagcccaatcttgtaggagaagaagacgctgccggataggaacccgagtatcatcccgagcatgaggccgacggcgacgagcgtcttgaggtggcggaggatgccgccggtaaggaagaggcagcgggaggagggtgttcgtccggcgattcgggaggaggcggcgcgggataggaaggaggagggcttgggggatgcggcgaaaaacgcgagggagagggcgaggaggaccaacgcggtggcggtgccgaggcggtcgagcaggaggagg

SEQ ID NO: 83666 - DNA, 5995 bp, Oryza sativa
agcgccgtggcgagccccgcgtgcgccatcgcaatgtacagcgccagccgcgcgtcgggctccagcgacaagcccccgatatcgtcttccgccggagacgccttccccttcccctggggctttttggtcgtcgtcggctcctcctgcttcggcagccgcagcgacgcggagcggaacatctccgaccaggggaggtccatcacctccccgtccttgcacgcgcctccgttgggctcacccttagccacgagcgccatgtcaccggcgccggaatgcctgcgccgccgacttcgccgccgccgccgcggagggcaagctccgcctccgggtggtggtggaaatggaatgggagggaggaggggatttggggggtgattagcgcgggtggggtaaccatgatgggagagattaaggaaagattaattaaattaagcgggggattaattaggattaagatgtcgcgttttggaaagggaggggaaggagacgggttaacgccttaacggtggctaaccgggtacgcgctccgaggctgacgtatggggccccaaggggatggtgacacgtggcaactccctttctcgtcgtcggcaatggggagcgttgctctgacagctgtgtctgtttgggcaggagaatacgaggtggactgttgatgaataggctaggaggttttgcttaaactgattataaaccataagagtaaaaataatgaaaaaaaatactgttcgtaatttaaaagttaataaaaaaataataaataaaaaacttttaaaaccaactctagaattagcttttaaagtttaaattttttttatggtttattcccttcattccaattcccaaatatttatggagtttttcaaggaaactaaaataaataaaattgagatgtctaagtgattccaacgatattaaaacatatatgtcataattttccagagattgttatattttgagacaaattttaaatgctagaaattactataatttttgataaatagagtaacaccctaaaattaaatccagtatattttatagagacctatctcgcacttgttataattttatttgttgtcaaaaagggttagaatctaatatttaagtatattagcatatgcaacccagaagacaccacattcatttctcgggaagactagttcgcaaacgctctcaaactaggcatctcacgaatgggttttcaaccgtgtcacaacaaacacacgggttaggattaaggtagggttttagggatgggggtagtgattagggagaagggtggtgttggggagagaaaagaggggatcgggtttagaggaatttaacctgaaaaacagcagatcggtgatgggcggtggaaagggtgggcgcagttgatcaacgaggctatatatgcattaaatctgctgattaataaactgtctagttgacaaaactaattaaagtgtcactaattaagatttagactatgcatcaacgggtgatcaacgagagtcacgtggaatcggatcttatagctagagggcagttccaactctgctaattaaacactccttgtcaattatatgtttttagtctcattaaggagaggatggcaaatcactgtcacgcatatgcacgtttctttcttccctatctgtccgagaccggcaaatgctgtcatgcatatgggtccggtttacagttgcattattttgccaatatacagctggacgcatctacgaagtcttcaattgattttggggagaaaaatacttgagaagccttttttttccgtttacacgtggaacacacaaacaccactacacacataataccacactcgcacactgtaaatacgttcactaacacatgcttaaaaagacgaaaacaataatacatccttgatcggtctcactaaactcgtgttcaaaacctatatacttgtgtgtgcgtaagtcaccaccacaacactagtgcttttgtaaaagatggtattttaaattcagagagcatgcatttttatgtattaaactacgtatgccacaatacaacatgcattttttatgcaagcctcaatgggatgcattttgtaggcagcgatttataaacaaagatatctatatatttaaaaataatattgacataagattcagtctgctaatttcacatcacatatactatggtcagacaatgcatgtgtaatactacttctcatatgtaggtcccacttgctcttgctctcaggctcacatgacagtgagcagcactttgctatatggcctgtggaggatctcaatccactattttgaccgattgttgcctataaatactacggtactggtctgtgatctaggatgaagagctgcaaatttctacactaagcaaagaaaagaagaagaagaaaataagctaaaataatttttatactagttaagtttgaaatttgacattgtcagccgcaattcaaacgagagcatgctccaaattaaacactttcaacaatcaatatttccagaaaaacaaaaccatcaatataatttcttttttaaagaaatgtttacacatggtctggtgcattggaaatggaaattgtacggcatgattgccaggtgcgatgcacatcctcccaaacaaaaataatgtactcctactagctaggatgaacataatcttctgagaattttttacttaaggactaaacaacatctaatctttatcctccttattttagagatggtatgccactattgtaccacactaacatgattccagacttccagcatatacaattcatatcagttgcaccaactttctggagctttgctaagaaagctggcccctaacgaactttgtcgaaaacaatctgcatcgtgctgctgctagtctttggatgcatggatgtgtttaatttatgggttaatttgatccatgccattgcaagtttatcgatttagaaaaactaccactactattcacgatatcggttgggtatcactgatattttacaaaattaaaaccgtaccattgtcatcacattttccatccctttcgtctttttccttcttctccccatcgaggggttaactgcaaggaggccgaccaaagagctctagcgaagcgagcggcgccgaagcccgggagcgagagaggtcaatgccagagagggatgacgtggtgaggacagcgtcagggacgacaaagcagcaagtgacaaggacagcagccggtgcccatgaagaacatggaggcggagcagcaagtgacgccagcggcgaccaccatcacctctccattcacggtgaggagtaggaggtgaagatagtagtggcgcctagttttaataggaatataagcataaaacaaatgattgaaaaatttaaaaattgttacaaaattgaccatttaagtagaccgcaggagaaaaaacacaggaattgaatgaaataaaaagacacaagagatacttttcaataggtttggaggtcttcctaaatttcctctaaaatttatgtagtctataggattgtggataaattttaaagggaatggtaggatttaattcttgatttcttggttttaaaggtttttctagccatttttcctacggaattggaatcctctaaaatttgaaccttcttttacaaattatataaattaaggcggcttactgtttacatgattaatttgagtgggtatggaaaagtgaccacgcatgataatacattaatattgtagaacaatgcttgctagggcactgtttacagtcggtcaatcccaaaataagtcaccctttatatataaatctaaacacaaactgtgtcaagatttatgtacagagttgattctttttgacaagggtgtactatgcatgcacagtgatagtgagtgtacagattgatctaaaattctgaaccattagatttttatccgtcgatagatacaagaacctaatgtccatgtcaaaatcccatggtttccttgcattagtacatatactccatccattcatattataagtagttttttctagtagtcaatctttttttatcaagtgtataaaagaatttaacaacatgtgtaacaccaaataagttttaattgaatataacattaaatatattttgataatatgtttgttttgtgttaaaaatattactatatttttctattagcttttaaatttgactaagataaaagttaaaaaaagaggttagagattataatacaggtagtatcaataaaggtagtagagtaataaatacagagtataatacttcctgatgaaatttatagagatagatgggccgattaatctgtgggccctaattcttggtactattgcgaacataggagaagggtgcatatggaaaagtgaccacacatttttaacaattatatatgtaaagaggaaaacaacattacaattttgtactggcaaaagagaaattacctctacaacggtagaattaattttgacttgcaggtgatggtattctttttcccctcaaatctaatcgtagtctgtggtggtggatccaacacttatcttaagcctggcaaaccttatgtaagtacttgcaaatctacatttactatagaagcacaccaatttaatcgattatagtcttatataagagaaaaaacaatgcttaaaatatatcgattaaatgatgatattatattgttgatgcgctagattacattgagttatttaagtattactccctctataccataatataaggcgcggttaaagttgacatggtcctcaaaactaatctttaacttataatttctcatatactataaagtttgtagaaaaaaaattataaccatttgaaagtaaatttaaatctcaatctaataatataatttttaacaaataaaactcatttcatattatgctaacggtttgtaatgcgtgcacgacttatattatgggatggagggagaatatactctacttagtgttcacctagaagccagacgttcactagacggacccatggtctagagtctagacagtctagagattagtctagacgatatatcatactatatactatcaacatcagtggcggatgcagaaagaaatagcagtgtggtctgagcaaactagatagagttacagtctcaccttcaatctatatatgctaaaaaattttagtggggtcttcgtgggggctctcatagtcttcacgtcagtagtgggggctcgagaccccgccgcccctgtgctggatccgcccctgatcaacatgacatgtagatacacttaacttgtttcatataatattggagaacatgtggtgttgtgaaaggtgtagccactcgcatagagccatgggttggagagaggaggaagcaaggtccacggtgacaactagcagaggagaggtgacatgacttcatggcagcgcgatgtttagagcagagaagaggggtttggaatggtgtcaaaaacccaaggcacatggacctagggtggaacacaaagttttagttactaccacacaaaaaatgtattggttgcctagaccatagtctaaacgatagttttatagtctacatttatctcgtttttgtttaattgtgtggtctagatagtctaggatcatctttaattatctagacggtcaaacggtctaattcacggattaggtcctaaactagacgataactcatcgtctagcttttagacgcggtctaaaccgtctagactacggtatttggttagacggtagacactactacagcatatggctgagaagattggtgcctaactgtgataattaaacactaatactctactactggtacatataatggagcccttgattcaccattatcataaatgcttatggcaactataactttttctagaattttctaaaactttctttagaacaaaccagatttttttttcaaaacatatagttataagatccaaaatatgaaatagaaggcttgagaaaaaaaaatctttttcagattctcgcaaaccgtttctatt

SEQ ID NO: 83667 - DNA, 665 bp, Oryza sativa
ttgacatagcgcaagatgcgcttgaccaaggccaagtgagcgtcacgcggagagtgcatgtgtaggcacacttgctggacggcgtaggcgaggtcgggccgggtgagagtgaggtactgaaagccccggcgaggcttcggtactccgttggatcacggagaggttctccatcagaagccgagagcttggccttgggtatccaccggggtggccgtgggatggcactcggccatgccagcccgctggagaaggtcgacggcgtactgtcgctgagacagatgaaggccgttgggggtgcgctggacggagataatcggcgtcgctgtaggctgtgagcgtcgatgccgtggtagcatggagaaagagcccttgatccagtgaccccttgacatagcgcaagatgcgcttgaccaaggccaagtgagcgtcacgcggagagtgcatgtgtaggcacacttgctggacggcgtaggcgaggtcgggccgggtgagagtgaggtactgcaaagccccggcgaggcttcggtactccgttggatcacggagaggttctccatcagaagccgagagcttggccttgggtatccaccggggtggccgtgggatggcactcggccatgccagcccgctggagaaggtcgacggcgtactgtcgctgagacaga

SEQ ID NO: 83668 - DNA, 1906 bp, Oryza sativa
atcttcttacccctcgacaagataaagatcaccatcaccgtacggacttatgtgctctacgcgtacatcaccattgctcttttaggccttgtgggggcctatgtggctggcagctgcagaaagcctgacactaccatctatgtactcagtctggttggtgctgttcttttatgcataggcgccctccaggcagtcctattttttctgccacaactttcaaacatatcctgcttgccaataattgcaaagttatcatgttcaccgggagggccatcagatagcaggtactgaacacaaacatttttctgctgcctatcctgttgccatctttagtttaatgttaactttgtttgaattaacagttccagaaagaatacaagcagtaagacagatattctggagaaggcccaatctcttgttgtactgcttgccactcttgtggcaactgttacttaccaagcagggctagtcccaccaggtggtgtctggcagaaaaaccaagatgggcacatggctggcgaaccaatactcttatccacacaagccaaacgttacaaggtgttcttttactgtaactcgacagcctttgcagcatcattggttgtcatagttttggtccggtataaacctttgctcaggcgccgcattctagagataactatgattttggatctgtttggtctcatgggtgcatatgctgctggaagctgccgggacataaccacatcagtttacatcattgccttggcaggcggtgttctagtctatgtggtgattcatgttgtgttcttcacgcttgaagacaatgacaaggagaaggaagttgggaacacgaattctgtacgaaatggttcagttgtgcgcacccaaaataattcagctgagggcaatcttgctgagaaagattcatgtattgacaaaaggcgcaagaggctgctccttttcgctgttttgggcgcgaccctcacttatcaagctgggttgaccccaccgggtgggttcagagttgtggatgatggttttgggcgccatgctggtgatccaatactcttttacaactttccacgccgttacaaggcatttctctattgtaactcggtaagcttcatgtcatctctttccctcatcatactcctcgtgaacccaaatctgtataggccagctatacaaagctatgctctttcggtttgcactgtagcaggcttgtttgctcttctgggagcctatgctgccggaagcactcaacatctgaaaacatccatttatgtctttgtgttggtagctgtggtgcttttcattatgatcatactcctggtgtgtttctatcaaagtgagagcaaagagaagcgagatgacatatccaaggagcccgttgagaaagacaaggacagagccaaataccatgccaagcgcaagtacttgatgttgctaggggtcctggctgcaagtgttacttactcccaggctggtctgaacccacctggcggtgtgtggcagggtaatagtgacgggcatggtgtgggtcactcggttatgcatgacaataagaggtatcgctacctcaccttcttctacagcaactcaacttcttttgtggcatctattgttgttatcatcctattgctaccgacggaactgctaaagaagaacaggtggctaagggtgatgaatattacaattgtgctggacttgctcggcctactgctagcctacgtggctgggtcgagcatgagatgggaaccttctggatatgtcattgcatttgttattggtgcactaggctgtgctgcaatccacaagtttttgtcatttgtcagaaggtctcagcaacaggggcaaggaaatgatcagccttctcggttaccagaaggcggcagtcaagcttagatgttgttggcatggtaac

SEQ ID NO: 83669 - DNA, 5843 bp, Oryza sativa
actcttgttcgccctgatgactcctccctcgtaggctcaacgagccaggcaagccgccgcttctctcgataccaccgaaccagatctcctactttctcttatctggtggatcgtttatcttaaccctatatctcttctccacagagaattgtcagtcagttttgcatctcactcttccttctttactaagctctataaagacatgttactaaacatattttacatgtactctgtcgaagattcaaggtcgttaaatttaaaagttttttttgattttggctaaacgtttaaggctacgagtataaactttctaaatctgagcagaaagttttgggtttttagttttagttgaaatatttagatttcaattaagttttccagtttaattgaagttgaaagttttcatgttattttggctaaacatttgaggctatacccggaaactttccaaaatcagagtagaaagttttgagtttttagttttagttgaaagctttagatttcaattaaaagtttttatgttttagttgaaattttcaaattttgaattaaattgaaaagtgaagatttctctattgaaatatttgcaatttagatcttactttagttacatatattattatctatagaataatactcaaatgacaattagatcttactttagttgtatccagtgcttccttcatcagtgaggcctttgttctcttcagcctcccaattaaaacatcggcaaatatctctccttacactgtagcctttatgtgtacccagttccatgaagggttagcaaatataaacttgcaatactcctcagtaattctccttgaggtcactctcttaggatcaattttgataaagtttatcacatttcttaggcttcagttgtgtttagttccgcgccaaaattggaagtttgactaaaattgagggcctctttgaatcgcagggttgaaaaaaatggaggaataggaaaagcacaggattccgatgggaattgaagtgtaaaatagaggattgcaaaacacaggaaaaacacaggaatggtcgtttgattggagcgcaggaaaaacacaggaatcgggtgagagagataaactcgaagaaaattttccaagaggttggagctcttgctatattttctccaaaatacacatgcaatgtgccattccataggaatttcatagtatttggaaagcttcaatcctttgaatcaaatggccaaataggaaaattttctatatgatttgaatcatatgaaattcctatataaatcctttgattcaaagaggccctcaaagtttaaagaaaaaagttggaagtttatgtatatagaaaagttttgatgtgatgaaaaagttagaagtttaaagaaaaagttaggaactagaccgggccttcgtttgtagtatgtaagtactagttggcaactcatttttgcggttaggaactttggtactgtggatgcactattgcgcactgttcatggcagacagacggggaaggcatcgacgacgctgtttgcccgccgacaaaatccgtcaagatgcaggcgatgacccggcttggcgcaaggctttgctacacgcacatgcgtatcgtcgcttgattgaaaaggaaataattttgtgaagggcaattatatcagacgataagcggaaggcttgtaatgcaaacttgcaaagagaaaaaagaattaatgaaatgaaacatttatttatatggtttaaatttcgtaattatgcgatgtaacatcttaaaccatgtcattagtctgttgtatttgttaagaatttattcttgataagatgttatgagttcttgcaatatattgagaagaaaatgattatttttgttgccgaaaatattactagacagacaattatgaagaaatgatttatcacacaattgacacaaaaatgagtgcatcaaaattattgtgaaactgatgacataaatttgtactctttttcggtgctactatgaaaatcaccacacaaatttaagccttattgtaatattgcaaataatatgaaaaaaattaacacagaataatacaaatcccaatttataagatagctcacttctgaaatgcgaaatccatgcataataattaaagacaacacaaattgaatttcacaattcaaatctcactactgactagaccgtacataaatcactactagttgaaaccatacaaactcttcgggactaataaaaacagacgtaacatgcattagggataacatgtgggtcacttagcacctactgatagcgatagtaggcctcatcggcaatgcagtcacacaaggtgctcatagcctgcttgctatttgttgcatagtacatttgatcgaacgattcgttctgcagcggcacgggatagccgttgtacatagcattattttgacaggagttcacatccttactatccaacctgaaattgtgcagagcaaaagcagcacgtatgaaatgtgtgtggcaacaccctcctctggtaatacggtatttctttcattatttttcacattttttttgacgataccaaatgttctttcaacgatacctcgcaacgacgagtgtcaatggttaaatgtctcttctcatccttcgggtggcgacgctctatcatcaccaagttgatccatgtggtatcatacatgtgagtacggtgcaggaaatcccatcctactaggaaatctagagtccacaagtagataccttcctgtttaacgtgagagaatattttttttgctttacaagtcaagcttgaaatgtagtaacatatgccattcaaatattttagggaaaaaattgaactcaccaaacggtagccgtgggaaatcgtcggggtaatactgcactgcctcgttcagaatcctttggtcgtgaaccgatcctggtcatctagcaacgcagaaaataattctcccgtcatgatcacatatgactagaacatttttcatcgttatgtggtgctgattcttgtgttgcataaacctggctgaagaagtcacaactgaaacatgcatgccgtcaataacacccactgactggtaaaatggtttgaaccaacgttcgttaagaatcaaagggtgatattcactgaagttgggatccattggtttcaaaattttcctagccaggtcgttcatagacaccaaaacttggtggaagtaaatagacattgttgagttggagcggatccaccgattgtttgcatctctgcagggacgatttccagccatagtgtacaagaaaatcccaagtttttctagtgaacataccctggatgttccttcgaggccgtacgacgtgatcgggaggtcatgtaaactgtgtatccgttctgcaattagccggaaaattgcccaacattagcttcgatttgccatcgtttccaccatccaactgatttcggtttgaaccggtattctcttggtgctctctcgtttatctcaatgctagcggctagtatgtcactgatggtatcgtcctcgttgctgctaatgtgccctcctgtccagctcgatccaccagcgacggaactcatgcacggatatgtagaaaaaaatacttgcaatttgcacaaatggagtaataaaaccgcaattgttggacagcacctcgtagcaaatgttagcacgcataaattgataaacataatgacatgtttatttttaaaacaacacactgcacaattgacagtgaattggaagtacaaggtacaaactaatgcgtgccaccagatgaggaatctgctccgtttccacgagtagagatatattctaggcgagttgcggcgtcctggaggcaaacgaaacagtggcagtggaattcatcacggaaaagacgacaagtatcataccacactagccctccagtacggtgcccaacattttccaccaactccaagcaagcctcaagccctttagccttagcggcatctgcctcccttgtgcggctctgcatggactgctctcgcagggctgcaagcctccctatctgcagtcggtggtgctgatggagatggcatcggtggtctataagcggcactgtactgctccttgcggtgcggcgctggggcagcccccgtgacggccgagtggttgccgacaacggtgcgcccactgaacaccgcttggtgaaggtcaatgtgcttaagaggatcatttttgaaggcgctcgcacctttcttgacctgtcacagttatagacatgcacaagttacataacagatgatatgcactgatgcaagcaaagacacagacacaaggatgcaagaaagctgaatcaacgtatttcctaatttgtgtgtacactgttattcttaattagtaataaatacttcttttggctcatgtaatatagattatcagtgcaagtactcacgctgtgacatagcccaactgctgctgcaactactaccacacaatataaatgacaccatatggctagcatcacccttcctagatcttttcaatttcattcataaatatgaaacaacacaatattcagagtttcagacaacacaatattcagatctcttcaacaagattttcagataagagtttcagacaacacaatattcagagtttcagacacacatccatacctctactccccttgacagacacgacaacaatggctagtaccaagctaaggaaggaggaagaggagatcaggctctgctcccatgcatccacaggtttctgcggtctagggctatggtcgttaggaagtgttgttaggaaacgataggcaaacaaacaataaagaactatagatcaatcacagaagacacgagattttaacgtggaaaaccctcttaaagtaggagagaaaaaaccacaggcgccagccagcaaaaatatcttcactatttctggggtgaggttacaacgccgcacgacggcttacaagaggtatatatacgggcctccgctccactacggcagaagctggcctttattaagtgcaaatgaatttggatcacaactcaacaaactccaccttgagacaaatttcttcttgtagcatgaaacaatccttcaccctgaacacaacaaagacaaaaaaacactttcggcgccaaatagcctcttgggataaaccactataccaattaagcttgagcaaagctcaaacttagcaacaggaacaggctttgtcatcatatcagcaggattatcatgagtacttatcttgcatacctttagcttaccttacacgactacatcgcgaacataatggtacttgatatcaatgtgctttgtcctctcatgaaacatctgatctttagtgaggcatatagcactttgactgtcacaaaacaagttaatgcaagaatcaactccacaaagctcagcaaacaatcctttcagccaaactgattctttacatgcttcaacaatagccatgtattctgctttagtggtagactgggcaacaacagactgcaatgttgccttccaactcacagcacaactaccaatagtaaacacataacctgtgagtgaccttctcttatccaaatctgcagcaaaatctgaatccacatatccaacaagccccttatcagtcctcccaaacttcaagcaagcatcagctgtgcctctgaggtacttgaaaatccactgaacagctttccagtgttctttaccaggattagccatgtatctactaaccaaactcatagcatgagataaatctggacgggagcaaaccatggcatacatcaaagaaccaacagcactagaatatggaactctagacaggtattctacatcctcatcagtactagcacattgtaaagctgataatttaaaatgaggggctgcaggaat

SEQ ID NO: 83670 - DNA, 2072 bp, Oryza sativa
acatttagaaattttatttcccacatttaactttacttgtaaattaatgaatatttaatataaattgtagaaataatttattaaataatttataaatcctgaaacgaaaatcagggtgtgtgttgatgcgaaaaacacacaccggcctgagatatgcttaactctagtgcaggtccaaatcttggtttcgagttcgagggtatgccagttggtttgatcctgcaacgaacaagaaataaagaaacacatttaaatccataaacgatagccgatcgggcagtcaccgatgacatatcaattgtaacttagccgatgtaacgtgaattagatcagcaatgaaatataaggtaaaaggaaggttagacctagtcgatcggctatagatatcaacagtatataatatatacctcaagatatatttaaacaagtgattgggatagatcggacagcttgccgagatagtataaatcacttatgtttaaaagtaacttgaatcagatattatatatgttcatagcatagccggtgttttagatctaacatgtattggctaatactccgataccactttatactaagataacaatataaacaaaatatattaaatagagatcaatcaagtgttaagatgacttaacagatcaataacaagcttaatatatttaattacagtgatatcttaatataaagggcatatttagcatatcaagtaaacataaaataaggtaagatcggctgaaaccccgatactaccctaatcggcaaccaattaacaggctagaaattataattctaaacacgacttaaacacgacttaatagatcaaacttaactgatacaacattaagtataaaaagaagaacaatatctagacaatcaagtcattggatgattcatagagtggtggatatgctatataatctaagtcaacattgagatctagcttaatcggccgccttccagtgatagatgttagccgatttgaggttagatagcaatattgatctagattatatagaatatatgataacttgacgattcacataaacaagatttgtggacatccctagtattataccatccagtgtccaacgcgaccaccacatactattggagaagtgggatctatacacgcataaatagccactcatcctcaatgtgtccattatcacagttgacaccttctactataataaccggaatgccgagtagtgactgcgagagataaccataagatagcttgccagtccactccgtcatatgctcgtcaaaccatatgaaggcggcgaccaaaaacataccccagtaactcgatccaaaagcgctatccccaagtatctcaagcgatcaaaacctgttactcatgcttagctagtccccaggaatgcgactagcctcacactttcatcgcaagccattagtaaacatagcaagtaccataatagggtttaagtgcagcaagatacatgacacataatagggtccgaggtcccaacatacaacacataaatatagcagcgaaagtctcaaatagagttcataagcaaaagataaaaccggtggtgccacaaccccactagggcaaaccaaccgggcaagagccaaactgcaagagatcactcatcgccctcgccgccctcggcagagcaatgaccacacaagaagcataactcataaccggtatcctcacctgaaacagcggcgccgggttaagtacaagattgtactcgcaagtcttacccaaaattaaatatacataagggagagagaagtatgcaagctttctagccaacagtgggtctctaggttcaacatttgcataaagctaattttattgagcaattaatgagtaaaataagtaaggacaagtaaatctagcatcatttttatttatggacagcaagtatataattctgagatgtataagcaaatgagcccaaacggcgctctcattatcaaccatggactaccaaagtccataccaacatggcacaacatggcaacaccaccatcaaatagaatcccatccataataatccatatttggtgctaacataactgactaacacatc

SEQ ID NO: 83671 - DNA, 2121 bp, Oryza sativa
tgcatctaaacgaactaagttactgaaataaaaactacagggaacaaaactagtggtagcagcattcgcagctgctgaaggccatctcatccctacagaagaaaatcaggcgatcaataattcaaaatcggttagttgatcaattcgtttgtatataatcatcacttgaacctagccctcatagttttaatgaagcaaataagtaatttaataattaattcacttgccttgcagttagaatataacattccagaaaggaaaatttcattgagttttgcccccaccaccagagcacgctcctgcattacttcctgtgtattaagaagcaaatgttgaataaattgtaaattattattagatcatcatagtacccatattcaattagacatccagaaatataaaatcaagtaatttgaatacctaatagttgcatattaacatcatcgtcctcaaccgtatcagttagaattgaatagggatcaccaaaacctaaaacatcagaattccaaagttcaacataaataagtttatggcccataatataagtagcaatgaacaaggtaggctccataccatctgctcgcatctaatcttgaaggcaaaccaatgcctccacagttccattagccagcctactcctatagtcactaatgattctagatccagtagaaaatgcagaatctgatgcaactgaagatgcagggacagcaagcaaatcaagcgccatgcgtgataatattggatatttgcatgagtttaccctccaccactggagtatgtcaaaatcatcatcagggaaatcattttcttgaggaatatcttcgagatagctagttaactcagtctttctttactcttgctttgatcatgaagatattgcctccagtcagcaaattggctgccaccaacattcactccactagttgatgcttcttgagaattgattgcgcttggaccaccaatttgtgaagaatattcaacaaaccaactgcggactatcctcttaattctagacagatatccatttggaccagttgccttatctccaaaacctgctttcagcctaaactcaaggaatttcaacttaaatctgggataaaaaataacaggaacacaaatctgcaggaactgcagatcccaatatttctgaaattttgtatccattttagaaaccatgctagcgacaagaacatcctcactgttggactcatttagaagcatcaccttcactttccaaaattcatgaaagtagcgagaaacagtgggatatgatgtcccggaaaccacaacagttgcatcatagaagatcttgagatgtttgcaaagaacttctgcattgtcccaatcaaaaaatagtggagcatcttgaaagtttggatcaaaccgatccaatgaatcaaaagccctcctgaataataaggatgaggaaagcatcaaataggtggaattccaacgagtggacacatcaagtgaaggacgcttctcttcaacaattccgacttgtgcaatgatttcttcaaatttttgctcacatgcttctgatgcttttatatactttacactttcccttatcctagatatggcaccactgatagtactcaatccatcttgaacaataagattaaggatgtgagctgcgcaccggaaatgaaatagctcccctttgcaaggcatggcaagcttacccaagagatttcctttcaattccacaaccatagaatcattaacagatgcattgtctactgtaatactgaacaacttactttctatctgccaatcctgaatacactttagaatttcattgaagagagctatactatcatgtgggtacgcacttgagtgaatcttatgatcctcttttgaatattccattcattgtcaatgaagtgacaagttatacacatgtaacctaggttttgattagatgaccacatgtcagccgccagtgaaacccgagaatttgttttcctcagtacctcaaacaaagctaacttttgttcttgataggcagccaagcaatcaccctttatagtaattctggaaagcaccctaaagtacgggttcaagcttgcacaaaatcttctaaaaccagggtgttcaacaaaactgaaaggaagttct

SEQ ID NO: 83672 - DNA, 1412 bp, Oryza sativa
aatttctgctgaaactgagatgaaaattttcttatgaaactgaaccctaattttctgttgaaactgaactaaaaatctctacagaaactgaactaaacttctactagtaaagattcctgatgaaagtgaactaaaaacttctgctgaaactgaattatcttagctacatgaataaacaggggctaaatgaccaaatctccaaattcagaattagaattgcaggtgcacaaacctactaaaactaaccacagaatgtaagtttaatttgtttgggtggaagataaactacagaattatatatgcaatacatcaagagtaaagaactaaccagaacgatgagtcacaacatgaggtgttgattgagttgactcccttggctgagtttcaacatccagctcaattgggatagcagacggacttgatacgaaccttgccactggagacatagatctagctcttggagactctgcacttggggacatctgaccagcaacttgtgatctctccatgatgacttcattttgggaaataatttgtcgcactcctggagacctgactattggcaatgcaataggtgatcgtcttcgctttgctgttggaggattcgatgctgctaactttcgttttgtagccaataactgtgttgacgatgataggcctcccgaagagccctctgcaatgacctctttgatatgtcctccttgcggaacttcagctaatgatgtcgacatgggagaaaaccaaagtactgcatgtagaacaagatggacaaaattttaaataataaattaccaaaatacttgcataatatatgaacctcagcccatccactcggaaatcaaaaacttcatgacaaactagaatgtgccaaactgaagaccgattataaactaaaagatatgccaaactgtgcgctagtactccctccgtcccaaattataaggccaatatttttttacacggtcttcaatgacatactttgaccattaatttattttatgttatgttcccaacaaatatgaaattagcttcacataaaagtactttaaaagatgaatcttgtaatataacatgcataatacttaacatatatatggttagtacgattattagtcaaaagttaccgagtttgattttccttaaaaagatggcgccctataatttgggacggagggagtaatatttaggacttcacaaaactgaaccgtgcaagcatatatgactacaaaactgaattcattcttcacagactaatgcaatgagtaagaaccaaaaattaacataaccaatagtctcaactcctcaagataaaatcatgtaacatttgcagccaaaacactaatcaaaacacaagaaaaggcaaagactgatacgctctgttaagctagcagcttgaaatgagatacagatac

SEQ ID NO: 83673 - DNA, 1707 bp, Oryza sativa
ttgatgcaatattccttctgatgaaagaaagctactaaattcattgtttatatactcccctccattatcagttctaataaactggacccgagcattaaaatgatttttaatgtatgcatagaaatttagaaaacatttaagcacctcatccttatgtctcataagatataaccatgtcatgcgagagtagcaatcaataaagttaacaaaatacttcattccactcatagagaccacaggtgaagtccaaacatctgagtgaattagcataaatggtaacatactccggagtcctctactcacatatgatgttcttgtatgttttccatactcacatgcatcacatactaacttatgtttatccactctacttagttctgctgggaacatcttactcatagtttcaaaagatatgtgccccagtcgacaatgcaaaagtaataccttagcctcttcttcacttgtagaagccatcaatgcaagacatacatcttcacttgtcgcctttcgatccaaataccaaagtccatcacgcctgacgtcaatcccaagtttcttccctgtttccctctcctgaattaaacaattctcacgatcaagggagacccgacaattcatatgatcaacaagagaacttatcgaaaccaaattcactggaaaagaagggacatataacactgatgataaagtgattgaaggagtacactgtactgtaccctctcccttaactgggcatgatgtcccatcagcagtttgaattgtttcttttcgtgtaaatgggtatggtttatatgatgcaaattctccacacatacccgtgacatgtctagatgcacccgagtcaagtatccaatttgaatgagaactattgatagacataaatgtttggtttgagttacctgaagaagaatgaacaagattggcaacatcaacatttgtagatccagaacaacccttttcaagagtgaccacattagctctgtgatcacttttatattcatagcctctacctctattacctctacctgcataacctcttccacctcttgctccacccctatcaccaaatcttcctctcccataactaggcttgcgaggagcgcggcaatcacgtataaggtgccccatttcaccacaattgaagcactccctggtctctttactttgtgcaactacataggtggggcttggtgaagatggtgtggcactaggcaatactttcttcttaagctcctcctgtgccatagctgcaatagcctcatccaaggtagtaagggtggtttgatgaaacattgcatcccttcttccttcaaactccgaatttaagcccttcaagaactcaatgacccttctacgctcaatccattttctcatttttgctatacaatcagggtgctctaacccaagaggatcataatgatccaaatcagaccacaaatgcttcaattcagcaacatattctgcaatagaacgctccccctgtctcaaaacacttatcttctcctgtgcctccaccattaacatcacatttccttctcctgagtagagattagtaagagttttccacatctcacttgcactagagatggtctcaacagttgtagcaatagcagggataagtgaggttaacaaccatgctactactaacgagttggtagtcctccaagtcttccattcaacacttgatatgttctcaggctcctttac

SEQ ID NO: 83674 - DNA, 722 bp, Oryza sativa
cagaagatattatgcccatgtcgtaagtgtttgaatcggttacatcaatataaaggacgtgtggaggatgacttacttatgtacgggatgtctaacacatacactcggtggatacatcatggagaaccattggtcattgtcactggaaatgttgagcatttgaatgaagatattggctgcaatgttgagcatttgaatgaagatgttagctgcaatgttgaatttgagacgaatgagcctccggatgacccaaagatgatcaaatgtaccgtatggtacaggatctgtacccagatcaaaatcatggaccaagaacaaagtcaaagtttgccaccatattagaagagatgaaacaggtgctacaccccggtggtccctatactaggttttcttttgtggtgaagttgctccacatcaagtcattttacagaatcagcaatgttgcattcagtgctttttttgaccttttaagttcagcatttccaaattgttctctccctgcatcctatgctgaagcgaagaattttattcgtgcattaggacttggatatgagtcaatacatgtgtgtccgaataactgtgttcttttccgaaaggagttggctaaaaaggatgcatgcccaatatgtggtgcttcaagatggaaggatgcagatagccgaaggaagattccagaaaaggttctaaggcatttcctttgattccaaggttgaaaaggatgt

SEQ ID NO: 83675 - DNA, 670 bp, Oryza sativa
ttaaatgggcggcaatgtcgggttgggagaggggaaccggcattggacggtcaagccggcgagctggcgctccggctagcggccaaaacggcgacaggaggggacgccggcgagaggggaaaaggggaaaagagggagagaaaaggggagctcgccccttgcctctttgggaaaaaggaggaggggagcgggagcgtcgcggcagagggaggagggctctgcctccgtcccttggcggcttgcgcgcggggaggcggggccgaggtgatgacgacggccatgacggcggggcggtttggagcggcgcgacgacacgagcgacaggcgctgacgacggcggcgaccaggcggtcggccaccacggcacgcgcgcgcgggaaacaacgggcggcgcggcggatttgagcggcgcggctgatttgagcggcccggcttgggcacgcacgctggcttgcggggccgggcggctgcgcggctgcaggcgcggcagggcagcggggccgggcggcacggacggcgcagacggcgcggctctcgtgcacgcgcgcgcggcgcgcgggcggagcttaaggggaggcgctgggcgcgtttttcacgcacgcgcgcgcggcgcgcggtcggagcggagggggagggagagagaaagacccagcgcgcgggggagggaggg

SEQ ID NO: 83676 - DNA, 634 bp, Oryza sativa
aacgagcttttctcacctccctacgtgctatttgggagcaacgcggtgctgtagggcgatatgacaccgttcctcccagggtttcccaagtactacctcaagctcgaagggatctcctatggaattgttcgtcttgacatattcggcagcaatgccgctgccgccgaccaatatcatcagcaggcacaattttgtcgtggaccttaccttccagatgctcagttctatgccatgtcagtcgagtcggcaacatttccgctcatgctgccgagtcgcgcatacgagctgcttgaaaaggaatttgagcaagacaatcctcttcttatcaagtctcgcctccaacccatgaacacttgctacaaaggcagtgtcgacgatattgctgacaatgccactataacgctgcatttccatggtggcattgatttgcagttgtccaggaatgccacctttatggagatcacctccatgaatggcgaccaagaagagcgctatgtgtgccttatcgttcacaagactgtggatgggacagctgtactgggcttatcaccccaacttgaccacaacataaggatttgatctggagaacaagcagatctcaatttatcgcaagatatgttagtttgtcccctta

SEQ ID NO: 83677 - DNA, 618 bp, Oryza sativa
gagtaccacatagtactcaacaagtccattggtacctcccaaactgcagtcatggctcgcgtaagcattcggggtagaacacctttagaaagggatcgccaatacactggttatggttgggatagtaagtctgctatgcaaaactgtgcttatgttgctattacccaccttcgctgtgaattatctgagtggcaggaatgaagtcttgtgattttttctctggaagcttcactttctctattgccattctcacttacatatacatgggatgggccctcttcaatagatgggccagcacacaagacacacacacataactagtctatttacagcccaacactccccctcaagatgggtgatagatatctatcatacccatcttgtcacatgaacaattacactctttaacacctaagccctttgttaaacaatcagcaacttgtccaccagacgttacaaatcctaattccaacactccctcgtctagtttttccttgataaagaaacgatctatttccacatgctttgttctatcatattggactggattattagcaatgttaatagctgacttattatcacacaatagcttcatgggagtgttctccaaaattttca

SEQ ID NO: 83678 - DNA, 1249 bp, Oryza sativa
ccgtttagtagtttgggaagcgtgctaacggaaaatgaggaagttgaagtttatagttggagtatagaacagggcctaattcttggacatattgctactgtgtaattggtactatttgattctgagagaaaattaacaatatgccaccctattggatgtccttataaagatgccactccatagagcataccccttaatctgtttagaggttttttgacagaaatgacacgcgaaatgacaaaagtacccctagctcctttttgcaatgttcgggtcagatttctccctcaaattacagcagcatcaaatacaaatcagttactaccacacagcataaattgcaaatcagttaccacctcgtttagcacacagaagtccaccatacaaataaattgtgcatttagcacacaatagtaaagcatttgcagcacacatcagtatagcatttgcagcccatacaccatagcacgatctgtgctccctcaaattgcagcgcacacaacagtaagcatttgcagcacataaacaaataaattgcagcaagcacacagcagcacagaggtctccagcagcacatataggcatagtattgcagcacatagcacatagcattccagcacatagcacatagcatattggtacatgaagcatcaaagagacccaaaagaaatacagttcacaagcctaacaaattcagtagttcagtagcttgacaaatacattacagtagttcacatttacaactaaaatacattaggttgacttcattttcttgggagtcattttttcttggatggtcctgcagaagtactagccatctctctcggctctctagccccttccactccagaagtactggtcactcccaaaagcattgcaagtcgcctatgcatgtatacccaaaagccaagttacacacacaattgatttgaagcatgcacagcaaggagaataattctaacttgtcatttgaccatcaacttacctccttgtaaccattccgggctttcttgcattattgtagcttcattggttgttctttgtggtgtggaaggttcaggtggaaggttctttttgttgtttttcctaggcttccttttcctgcatatatttatacatataggatgaagtaccacaaatttaaaaggatgtaaagtgaaaaaaacagaaatattaaaaccttttttttggaccattcagtgggcaattaaaggtagcttgcctatgacctttttcaccacattttttg

SEQ ID NO: 83679 - DNA, 1529 bp, Oryza sativa
agatctgagctgaagtgatcatgttcataaattccaaggccaaattccagtgaataccaatgtgttgccagacattgttgtgctaatggacaggagaaaaacaaatgtgccatgctttctgtggtcatggaggttcacatcaaacagtttgtgccatcttatatgttgaattgctttttatgtaacatttcctttgtgttgagtcgattcattagcatgagccaaagaaaaactttaagcttcattgtgcatttgctttccagagtattgatagatgcctggcaacttgaagatgttcaaaaaacattgagtaaactttcttgggttggtattgatctgagttccataaacatgaccatttgtcaggctaattgttaatctgtaagctttgcaatctgtcatttaaataatgtcattagtatattccaaagcatttatagatatatctttcccttcctctattatgggaatttgaatgcttgttttgtgaaaaagataatcaggacttaattatgagagtagcaatataatttgtcacactttctagtttagtgtgaaatttactgtaatgaaaagttaatttgaaatggtacctataatttaattttatttatatcctctagtcatcaattaggaacttaactaacatatatatactccgtacataacattaacttttagtgccttgggccaaaataaactacaacaatatttttttttatttgtattaccctatatttcctctcttttttgaaccagtacacattgctgcctcttacagtatatgaggaacactcctctttgagtctctagctcctcagcctcattgtctagcacttgagatatcactagttcttactgaaaagctgagccaaaccaaaccagggaaatcaattcatttttattcaaactgaataattttaattctaaaataataaaatgggaatgccagacaatttcgatatatccaagacatcctaaaagcgtctttttttcacacttcatatatttttcgacttggtttttattttttttaagaactttgggcttgtattctagaggatgatttatgtcctagggatggaaaaggaacccatgcatcctgacccttgtcactacatccaaacgacacactgatatttgtgtagactttatggatctctagcaagatgcgacgtgtatgttatagaaatactatacatgaataatgtggggaggtttaaatatatgtgaatttattatttgcaaaccgctagtggtgcaatctcataaaacctttgggaataaatttagctctatttgtatctggggactagtccctgtcacatcggatatttgaatactaattagaagtattaaacgtaggctaatgacaaaactcattccataacatggactaattcgcaagatgaatctattgagcctaattaatctatgattagcatatgtgatgctatagtaaacatgtactaattatggattaattatgtttaaaatttttctcacaaattagctctcatttatgtaat

SEQ ID NO: 83680 - DNA, 964 bp, Oryza sativa
tcatcggtttttctttttcccgattttataatagattaaatcttcggacaatcataactaaataaccgtagatccgttttaggtggttcaagttgttaattttttctaaaatcaagatttacatgttaaaaatatccacatgtactgtttatgcttgtttttgtactgttttgttgatttttgtttaattgctttagtttctgacgttccggaggagagcgtttcctttgaggaaggttccgaagcgtttgcggaagcccaaggcaagtcacacagatcccaaacaaccctttgagcatgttgaacccgtttaaagctattattttatttcaactatgcattgttttcgaatgtcatcgggtggtgaacctttcccaattaaataatggccgaagatgactttattttcctatgggttataatttgattagcatgaaccttatatattggattggttcagctaaatgctatatgtaagtttgcttagccatgcctagaaacatagctaattaaagggattaattataaactatgttatattaatgttttaattatggttacattaaatggtagctcacgatggttaatcgtgtgatgttaattaattgataattaaaacctggttaaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtgattcattatagtgcgtcagactgagaagtggcgagaagtccacgggggtcgctggggagtccatgccttgtttataaggggggtgattatgatccaggaaaggtgcgctgtaatgggttatgttgtgcaaggggtattgtcacaactcctttccgaggtaccgtggtggtattgaggcccatgctgacatgatgtggggtt

SEQ ID NO: 83681 - DNA, 1342 bp, Oryza sativa
ctccaaacctttgcaacagatggctgacaatgagaaaggcaataaggtcagaagtcaggacgttggtacctcaagctcccgagtgaacgaagcaccagacaccagttgtgtgacactggtccaacacctgattaaccagaaccgattgcttatagagatactgcagcagcatcagacgccaattctgaacctgagtcagatacaacctcaagtgcagttggaggcagtccaagcacccacaccacaagtcagcatgccgccagcatcccgaaggacccatggtgacgtgccacatgttgactcaaaagaagcaagtatcatttgttttatgtgtgatgagcaagggcactatgcaagggagtgtcctcagcagaaaagagaaacaccaatgcgaaccgaagatgaagtccgtaagatgatcattaccagcacagaatggcctccaccaggaatgacaaaacgtcagagaagaaataccttccgaggtgcaccacagttgacagagcatcttttagctaatggaggtagagtgtctgatagtgaagattcagatcaagtctcctcagatgatgaagacgagaagtctccccaaggtttcaaccaggataaaatggaacgtaaggcatgctctcgttgtggagaaatcggtcatgttgccagctcgtgtgccactacatgcattcattgtgaggaagaccatccacccgacaggtgtccaacgagcaggatcacttgtttcttttgtgaaggaactgatcatgtaccaaaagattgtcaattcagttttctgttgacgaagaagatggccaaccaacctgccagttccaacggagagaagcatcaaggccacacaaatcctccccaagattacagtttcagcctaactccagtgccaggacagaggaatcaaaatgagaaaagaaaatgccgagtccgggaagatatctgttgcttcaattgtcaaggaatgggtcatttcgccgacaagtgcccaaaaccgagaaacatagctgccagcacgtcagtccacgcaactccctgcaatcagaagcttgctcctcagcgaattgtcatccatgcatcccgaagcagtcctatagcccgcggtgcaacagctccaactccagctagtgcattaccacaaggtgtcaatgctcaatttcagccgcagccaccagttgacaagacagaggccagtatcggcattgtacctttggatgttccagcacagcagccaagaaatcaagtacaagatgaagaacccgagcgtaagaaattattgtcggttacaactgtagtacctgttaaggaaacagacatgccaatcgccaagtggtcactg

SEQ ID NO: 83682 - DNA, 1107 bp, Oryza sativa
attttatgtctggttagttgctaaatgaatgaattttatttctggattttgtgatgcttgtggccttagcagcaccagttgaaggagatgcaatgcgggatgagttggtggtgatgatggggctggcgcgggagttgacggccatgcagcgagctcgagcaatgacttgatgacatcatcgttgcaatgcttaatagcgtagctcaatggcggccctcgctcgcctaatatcacgcccagaaattcacgagtaattttcgaactaatttgtacattaaatccttgtccaggaatcagcccaggtacacaaactgacaatttaatatacagattcatcaaaataactaaaacgataaatacttacataaaaggcacttagtcctcatcacgaagaaaactgcaacggaaaacaaaatctagcgaagcttcagctccactcccacaggcagctcaactgggatctaagccaaaggtcttctccttctggatcctttttcttcaactgagatttgatgattattgcaaggtgagtaaatgacatactccgcaagccacacagcaagtatgcaagtgcataggaataccaaaggatggcataatatagggttcatttgcgaaagcagcatttagcaaagatttaagagtagtaaaactgtagaataattaatcatcaatattaatcaatcactgaacagcacacccaatgctgcacaggcccaaccaaacctgaacaaccaactccggtcgtacagatcaaacctccaaaccaggaattagccattccaaaccaggagccaaattaactttcacattattatcattgatgagtagtgtgggactaatcacgaaaaatattgttagacccgcccataaccacgggcacggctattcgaatagttttactctggccagaggtgtaccactgtacccacaagacataacctcaacatcatgtctaccatgcgtcgccatactggaaagtacccgaatagaggctgtgacaatactccacacaacacaactcaccacagtgcaccgttcctgtatcataatcaccccctcaataaccagaggcatggactccccagcgacccccacggacttttc

SEQ ID NO: 83683 - DNA, 628 bp, Oryza sativa
tcctgcagccccgcgcgcgaggaggaggccgatgggccgcgggggagaggagagagagggagggaggtgggccgagccggcccaaaaggggatgggggaaaaagacttttagggtttttctttttataaaaccactttaactttgtttatttcttcttatttattatttgtgctctgaaaattccactaaatttatttacgcattttaggcttttaggaaatatacaaaaatcctccaagccttatttgacttttaaatttgcacattttaattgttggaggctttcacatggattttacttattctttgcataatttcgaggatgtattttagagtcgttttgggacgtgacagttattgtaggaggactcggcataggggagactcttatcccaggtcttcccgaaatgtaggacacatgcgcgaagcatatcttctaggatctgatttagacgctcggtctgtccatctgtctgcgggtgatacgcggtgctgaaatttaatgggatacccagctcatcttggagcttcttccaaaagtgagaggtgaattggcttcccctatcagatgcaattttcttaggaacgccatggagactcacgatcctagcgaagtagagctcggct

SEQ ID NO: 83684 - DNA, 1491 bp, Oryza sativa
accgaaccattctggccggtgttgaaagccggccaatgttcaggcgaaattcctgatccttacaagcaaatgaaatatcaatatggcaccgacgtttctggtgcttcaatcaacaacgtgcttgtgtggtgatgaatgctcaagaagctatcaatcatcagtgatcactaaattgtccacgtttatgtcctctttctgttgtctttactttggtcacatcaccattttgcaaacagtagatactgctcttccatatataagcttgtcagttgtcacacacgcacaataagaaagctgacatgagagaaagcaaattaggaaggaattaagacacatgtgaagaggcttatatatgagattaactgaattctaatttgaaaagagatatgctgcgctaactgttactctatgcattcatcaatataacgaattttgggtttcaattttatccacaaattataagaaattcgaaaatactattttacttaaatttcacatgagcttatctccaaccacctcccatttgatgagggggtatcctatttttttcccttcaatattaatcctcaaaaaatctagaatagattatatttatgaactgagagagtatatggtattttacttgctgtactaatataattttttataaaatataagtgaatcatcttatcaatttatatgcaccacttttttttaagatagtggatttaaaaccgggcctctaagtctaagcacggattttcacggtcagtgtaccacaatcttatatatgtactcccttcgttttttaatagatgacaccgttgactttttctcacatgtttgaccattcgtcttattcaaaaaattttattcaaatgtataagatataaatcacacttaaagtaccatgagtgataaacaactcataacaaaataaattataattacgtaaattttttaataagacgaacggtcaaatatgtgagaaaaaatcaacggcgtcatctattgaaaaatggaggtagtattaatttatacgtaccacttcatatgttcatgagtgcatattttcatgggatactgtatatagcagcatgtcttttttttttactggcaagtgcagactttcatctgtagccagtgaaaaggatcaccgacatcaacacatgcatacaaccatatattgatatatacaattgagatcctctgcagtactgcatgctctgctcaatgcctgaatgcaactttcatttatagccagtgaataaggatgatgttgccatcttccacttgaactccatctagtctaggacgtctaggagtatataaactagctaggtgatgactaatccaatcaaggattctgcagcttccacatacatcagttcagatatatagcatcaaccaagtgtatccttggagcgtcttagccatccattttttattttccatatgaattgaactttttgcattggtgttcatcatgggctctgaagatttctgccgtgt

SEQ ID NO: 83685 - DNA, 948 bp, Oryza sativa
cagtgtggtgaacatataaccatttttgtttgctaaaagaatagattcatctcattctatgaaacttctttttagataatgaaaagattctcagccttagcttcaaacaagctacaaccacttattactgaatggggaacataaaaaaaaatcaaaagactagacaataactaatgatatcaacacaaaatatagaagacatttattcaaatttatttgtaaatctccatccgatgttggcaaatatctgcatgaccattatttctagcttctggtacgtagtatatattagttccttgtcctcatcacacctttacacctttatagttgtggtcaaaattggagcagtacattatcctgaatagtacctgtatataagatttcattagggatttgttaaaaaccatatcatttctacttagccaaagaacccgacatatagtagatgctactagtagaatgtgtttctttgttttttagtcaaagtgtacaagccaattcccagaaacatgagaagtactatttggaggtttcaaaccaaaagaaatatgtaatgatctccacaggaatctagcaaacaatggcactcaaaaaaataaatgatgtatagtttcactcttcattaaaaaacaacatctcatattgtcattccaattcattcattattgctaaattatccttcgttaatattactcctttgaactgataccacataaaaatctttattttaagagatatttttaatttccataaagttttgttgcaacggtacaagagcttggtaggtgtgtgtgatttagtataagaacttgaaaaatgagtacacgggtacatgaacttgacaatcaagtgcattttagtcaaaaacactaatatatacctttgattaattctggtattataatagatcattggctcatggattcaattttgtgttttaccatgttc

SEQ ID NO: 83686 - DNA, 715 bp, Oryza sativa
ttcctgcagcccgctcgattgaacgatcagcggcttggatatcgccaccaattgactgatcgaaagcgtccgcttcatggcttggacagcagccgccgccgacaagcaccacttcagcagctggcaccgtcgccgcgctggacactttgcttggcgcgctacgcgccacatcaatcgattccctggccgcttccgaatcgcaagcctcgcactgctcgccgagcagatcgatccagccttcgtcggagtcccaatccggcaaggccgaaacagggcacgccaatgacttgatcctatcgcagaggctctctgttatctcgtcgacctcctcctcgtcgtcggtctccgactcccagaatgcggcgtccagtgtgctcttcggagagacccacctgggcttcggctgcgcggccttgacttcgtggcaggcgaatgccacgaacggatgctccaagagctgtgccgcggtgctccggtcgccggcgtttctcgcaaaacacatggccaagaagtccttcgcctctgcggacagccaaaccggcacctccggcacggcgtccgtgtacccaatccggtggacggcggcgaggacgtcgtccatgtcgctccacggcgcgcgcccggtggccatctcgatgaccgtgcagccaagagcccaaacgtctgccgctggcccctgctcctccccgcgggcaacctccggcgccatgaacgc

SEQ ID NO: 83687 - DNA, 500 bp, Oryza sativa
cgagctaacgctgaaactagagcatccttgtgcctgaacttcctcagcaacttatcgtgttcagcaaccttcaccttcttaggcttctcaatcacaaggtcaccttccttagccttcgcattttgtccacggaggaagtacctatagttggacggtgccaaccgccgcttctccggcttggttggtgcccaatcaagctcaccaccaacacccttaccctcttcctcgtcctcccctgtcgacttctttttcctcctacccatataaattgtgccctttgaagatccagcaaccagcactgtcccacacggcgagcacgccaaggaaagcaattccttaggatatcgcatcgagtgcgtgagcttaagctcgccataatcaaagctcttgacataaccatcactccccgcgctaagcagccgcgtctcggccgtgttggtcatcttggcgagcgcgagggccatcaccgtcttgacatggctctccaccgagtggagaag

SEQ ID NO: 83688 - DNA, 649 bp, Oryza sativa
ggcgaattcgagctcggtacccggggatcatatataactgcgcctgtgggaagatgtacttaacactattgtgagcggggtatgcttgacatatgtcaccggacaaatagagcctgccgatctgaacagcatgaaccacggctgccaatgcaagatcatgggtgggataatagacttcatgaggcctgagctgcctggatgcataggccacaacctttcttttttgcattaggacacatactaagccttgattcgatgcattacacaaaatatttaaatcttttgccatctctggcaaggagagaactggggctatgaccaaccttttcttcatttcttgaaagctgactacactggctgctgaccattgaagagtcttttgcttctttaacagctctgtcataagtctggatagcttatataatcctccaatgaatacttccatgatatgcaactaagccaatgaagctgaaaatctatggcacattcttgggcgggatccaagctagtgcagttattaacttgcttgtatctacctcgacaccgttggacgagatcacgtattcaaggaatgcttctcgggctaaccagaattctcatttatagaatttagagaatggttgaagatccctgaactattacattatta

SEQ ID NO: 83689 - DNA, 753 bp, Oryza sativa
aagaaatgcccattcactggaactgtttctatcagaggtagaattattgctggaacatgccacagtgccaagatgaataggacaatcatcgtacgcagaaactacctccattttgtgaagaaatatcagcggtaagtaaagcaatggaggactatgaacttacatttcttatctgtgatggcatcttatttagaaggtgaacttgttcatcttgtagatatgaaaagaggcactccaacattccagctcacatttctccatgcttccgtgttaaggaaggtgaccatgtcatcattggccagtgcaggtaatgttctctagctgatgctgtacttagtacatgttttctgttttgttctgcatacctgaatattgggattacatgacttgaaagttccactgaattatctgttttctttaaaatgttcttgaaaattaagaaactaatttatattttcatctgctctgtcattcctcttgtattacattgttgatgccataactcagaaccaagcatcatattgttttggatgaggctgttctattgtcttaaccaggttaaggtcctgtttggcacagctccagctccagctccacccctcctggagcttgagctcagccaaatagtttcagctccaccaaaactgggagtggagttgggtggagctctctcacagaatatactagagttgtggagctgggtttaggtagctccacaactccactccagactcaactcctggagcaatattt

SEQ ID NO: 83690 - DNA, 2077 bp, Oryza sativa
ctatacccatgactatgagtacaccttagagatttcatctctacatgtaatgtttcttggagttttgcaaagctacactctctcattcgagaaagttgtggtttcctgcctgcagagactaggcaaggttgatgagcactgaacagctgtgtttatattcttctacactatatcaaatgattgttgcatgggcaaattcatgcgtgtatcctttgttagttctgcgtaatgtttatcctttgtagtaatgccaggtatttgtgcacagtattatctctatgccatataactaactgatcatggtttctgaaaattcattttagttgctcgaaggagctcttgatgcttctggagatgatttggattcagcaataaagagtttaaacaatctgcgcttggagtctacagaggctatcttatcagctactggttgcaaatctgaaaatgggctccccacagcagtttatccgtctgttgaaggttcagcttttaaccaaaagctttttatttctaggatctgtgcatataattctcatgcactagtacttcttgcttttgtcacacttaaattttagacaccgcagtaccaatctatcataatgatccatgtgggtcatgatatactctttcaaattgtctatcaatattattcagagatctctagccttgctggtttctttgatgtctgttcttatgtttatattctgcaacagtttctttgatgtctgtcttatgtttatattctgcaacgtaatgcgctgttcaattaaagacactgcacacgattcagtcaattatgttatatggagtgtgcatgattaactagacataaattctgatgactgcatccacatatcttctatcttccattcttttgtattcaccatatttagaatagttgtgtattccttctcagtgtgtccccaagctgtcaagttctcgcgttgcattttctggctatatactacccaagttctttgtattttttctaccaaaatactgccaggctttgtccagcaatgttaaactatattattaaaagaataaaatatttacagaacgattacaaggaaagagaaaggaaaacccaagccaattctaaactatcgtttcctctcacaacacatgaatcggttgcatctcactcccttgtgcaaatgtagcatactgtatatatgacaacagcaactattttgcatatcttggcaggtattgttaataatggtggtgtgagtacagctaatgaacacccagctgctgcagatagttgccagacaggtaataatggttctgaatgggttgagctatttgtcagagagatgacaaatgcatctgacatgggcgatgcgcgtgctcgcgcctcaagagctttagaagttttggagaagtcaatcgtggagcgtacaggagctgatgcagcacaaaacttgcaaaaggtacacgtgtgtctatcttctctagggtgtaaaaaacatcgtagtgtttggtcagcaattcggcatgtagaaaacatgcatcaatgcatgatttaggagtaacaataacattgaatactttcatatttttctttctgtacaggaaaatatgatgcttaaggagcaattgaccgtcgtgctgcgagagaacgctgtcctcaagcgagcggtcgccattcaacatgagcgccaaaaggagttcgacgagaggagccaggaggttcagagtttgaagcaacttgttgtgcagtaccaggagcaactgaggaccctagaggtggcaaccacaatcctatctccttttgcaagtttctttctttttctgcctaacatacatactgatgaagaatctactggggtaaaaaatgctgcagataaacaactatgcgctgacgatgcatctgaagcaggctcagcagaacaactccatccccgggcacttcaatcctgacgtcttctaacttttgccgcaagacggtctgtccagaataataatctctgaagatgtcatgtgttgttggtgggaaatgaataataatctctgaagatgtcatgtgttgtgttgttggtgggaaattgcctactgcctctgcgataggaga

SEQ ID NO: 83691 - DNA, 600 bp, Oryza sativa
tgggccgccagcccatattcctccccctccccgctgggccggccgaaggccacggcccagccggccgcccgagcccccctcctctctcccagggtcaccgacaagtggggcccacctgtcgggtcctcccccaacctccagtcgccgccgcgcatcccgcaaccaccggcgccccctcgctcccgtgcctcccgggcaacgttgcccacatcgccgcccgcgcccgccttccccgcgcccactccctctctttcccgcccgcgcccgcgctcgagacgtccaggattcaatttttgaatcccgcctctctctcctctccccctctccccactccaccggcgaaatcgcggccatcccggccacgatcaacccttgcgagcctatataaagcacccccgctctcccctctctctttttctccattttcgccgagctctcatgtgccctctatcgccctagcgccgtcggcctcctcttcaccgctgtcgccgccgctccggtagccgctagccgccgtgccgagccgtgccggtgccgccgtcgggttcgcaagcccaagggccacgccgtctggcttttcggcaccgcttttcgccgcgg

SEQ ID NO: 83692 - DNA, 1211 bp, Oryza sativa
tttgtcagcgatgaacatcccatccaatgggtctgaatgggctgagctagttgtcaaggagatgtcctctgctctagatttggttgatgccaagaaccgagcctttaggttacttgacctattcgagaaatccactgcagcatgtatcagtccagttgaaatgcggaagatgcgcgaggtaacaaatactactccatccagttataataatgtcgtcttgaattatcaatatcttccagttatgaaagttatggaagcttgactgatcaacttgactgatacttccaggaacacaagatactgaagctgatgttaggaggccttctcgaacagaacggtgtcctgaagcgcgcatttcttaaacagcacaatcggctcaatgattatgaaaagaaaatgtcgcaggagcggtcgcagattatcgacacgtacgaaaaggagataaaggcgctacaggtttgtgcgtttatcacaacattcattaattttcagttcttttatgttatttctaatgcttgttctaacaagaatcttggttgttcatctcttatcttgcagcataggaattatgtcctgtcattacatcttgcccaagcgacgcaacacggcattatctccggccattgcaatccagacgtcttctaggtgatagtgctgctacaactgctaacttgtcatctacaccgcactgaagatactgagcttggaagatagcaagatactgaagctgcaagctgagaaagatcctattgtaatcagattatggcgcattttgatcttccgaaaactgtacttagacctcgtctatgtgaaccgaaatcgagtgaacaaaggacattttttatcttctgaattctgctagcaacctcgtgccatgcacagagtcctgtttgttatggaataagcatggcacaactgtagtggagaattgtttaatgctgtgtaaaatgacagaataatatatgtatgccctttgttttagctgccacaatgcttcttgatctgaatactaatcttctatagcatgatatactatagtccaatcgcaattcacatgctcatctttaaatacgatatcgtccgtaaacaattaacaatctgttccgagcatgtactgcatgtttaaatacaatatcgtccgtaaacaattaataatctgttcaaagcatctactgcatgttataaggtttatgcacaagcgaaattgcatc

SEQ ID NO: 83693 - DNA, 741 bp, Oryza sativa
ctgattaatattatttttaaaacaactttcatatagaaaacttttataaaaaatacaccgtttagcagtttgaaaaggagaaaagtgagttgggaaagaggggtaaacaacacagccttagtataggcatatggatttcagctaaggccttgtttagttcccaagaatttttggatttagttgtcacatcggatatacggacacacatttgaagtattaaacgtagtctaataataaaataaattacagattccgccagaaaactgcaaaacaaatttattaagcctaattaatccgccattagcaaatatttacggtagcaccatattgttaaatcatggcgtaattaggcttaaaagattcgtctcgcaatttacacgcaaactgtgtaattattttttttcttttgtctatatttaatactccatatatgtatccaaacattcgatgtgatgggtagaaagtttttgtttttgaaaactaaacagagcctaaacatgtgaaaattctaccttgaggtcagatgatgagatgagcccacatttaactcgcccgcggtggatgggattgccaaattaaccaagttggcctaaaaacatattacgaaacaaagctggtgaaagatctatggtgttaactaaatctgcgaggcagttcctatatgtagtaaaaaagaaaagttagtttttctatttagtgtttggtgatgtattatgaaagtacattgcatatagcttgtta

SEQ ID NO: 83694 - DNA, 569 bp, Oryza sativa
ctctttatttgattgcagattaaatcagcctataacaagaagggggcccgaaggcctcggaagaagaatgaaaagctattaagattggcggaggcctgggggctcactccgacgcgcctgggtagccggcctcgccgtcgctgtcgtccgcaccgtcgtcaccgcactcctcgttggagttgaaggcaaacgcgagccgaggggccgctccttattgtcggtcggttttcccttgctgatgcgcgcgatttgcgaccgccgggattctgcccgaagagagagagagagcagggaggagaggcccccgagccgaacggcggcccaaggcccccgacggccggagctggccctccgcctgcttgtccgacggtgccaggcgcccccgacccccaggatggccccgaggccactgcgggaaggccgcgcctgtcgccctctgaccccgaggtcgtcggcacagaagccgagtgcgccccgcgtggcctctcggatggagagcgccctggaaatgtggcccctgacgaagaagatcggccccgccgaaaggtgcagcggcccgtctacttcgt

SEQ ID NO: 83695 - DNA, 601 bp, Oryza sativa
gtaccacttctcaccgtttcactggcacaaccatcacgtgagtagagattttcgggtatcaattgggcataaaatttctagtgataagtgcttgacctaagctttcaaacagttccagcatgcaacactttgtactttcagcaacatcactcaagtattctatacaaaaagaaccattatcaattaatatagatataggatcgtcctatcactatcatttcctcataagcggcaatatcttcttcagttcattctgaaagagaaataagaagtatcaaaagatttgatgatatttttgtgtgataatccagctgattcatgtggccatggatttctctgtggttttgtaggtgggtggcggcgcaaagtgtgttctaccacttgtacaaccaagtgtcctacatgtcattggacgagatctcaccactgacattcagcatcggcaacaccatgaagcggatctccgtcattgtcgcctccatcatcatcttccacacgccggtccagcccatcaacgccctcggagccgccattgcgattctcggaactttcatctactctcaggtagattttccgcacatgttttaccaaatcacatttt

SEQ ID NO: 83696 - DNA, 607 bp, Oryza sativa
attttatgaaagttaattttcaagccagataaattctcaaacacaaataagatcaattttagattctttgcttgttgtaaatcttgctccaagaaaatgatagtatcatctgcatattgcaacatagacaaaccatcatatactaaatgagggattaccccattaagaaaatcactatctttagcccttttaattagcaaagctaacatatcagctactatgttaaagagaattggtgataaaggatccccttgtctaagacctttatgtgtttgaaagttgtcaccaatttgatccttagctttaataccagcatgtcccccttggataaaagaggatatccactcacaccatttgggagagaaacccttcatcctcaaagtctgttgaacaaatgaccattttatcttatcatatgctttctcaaaatcaatgttaaaaattactccactcatatttgtacgatgcaattcatgtaatgtctcatacaaaataaccacacctgcatgatgtttctcccaggaataaaagcaaagatggtggcataacatattttttgagaccctctagcgtgcacgtatgtgcgatgcgtgtagcataataaccc

SEQ ID NO: 83697 - DNA, 2420 bp, Oryza sativa
caggaatttcccagaaaaggaatcccccctgctccaccgaagcatgccttttcaagaataaattcaagcagggtgcttctagaagaggttagccgttatgtatattgattaatttttgctttgttcgatgtcaaatactacattcagttgtgcttagcctttttgaccggtggttcttgaaatgttttgtttgcagagaaggaacgctttggaggagtggatgcaaaagctactttctgacattgagttgtcgagaagtgcacctgttgctgcttttcttgagctggaagctgctgcacgctcatgtatgttccgcttgacatattctattgaagacactttttcctgattgtgcattgatccatttattaactaaaatttcttaacatttttagcaaatgtttaattacgctatttttctgaatgaaagattaccaagattggaatcagcgcccttctgaagtgggttcttcagcaaaaagtagtgcagattcttctccgcgtcctgatgaacatggttcaggtgttctctctgagtccagtcaaatgaattcagcctttgctcatggtaacggtccgacaggagcaactggtaatggtatgctgggagagtctatcttagatcagcccaatgagcgggctagtagcatgtcaaatcacaggaaaaagaaccatgtctttttggaacatggtgttaggaatggttccatagatacttataagggagtggtttccgaagaggatcacgattctaaccctggccatgccaggaaggactctgctgaaagtataggaagtgatttgagttctttgaggggcagtgaattatcggttcctggagttagtagttccctttgggatggtcctgtggatcttccaagtggaattgatggacatagccaaacagaacaatttacaggtttagatatgcagcttttatatgatatggatgcacaaatcatccttcctgctgatcaaaggccgaagttgactagacttttgatcagcatggacagaagacaggtgacagcaaaaactgatatggaggatctcatagcacgactaaatcaggaagtggctgtcaaagaatatcttgcgacaaaggttacgttttctacctgacattcatttgtgatgcctatggattatgcttaaacacatgatatgctttgttttatatgtcacgagtttaaaataaattgatttgtgtttttttgttcatactttattgatgtacgttgttcttgtgcttctctgctattctgtgcaggtcaaagatttggaggttgagttggaagctacgaagaaaaaagacaaagagattctacatcaggctgttttgaccgaaagagagaaaattacccaacttcaatgggataaggatgagctctacaggaagtactctgaaatggagtcaaacctgaagattgaacaagttggttttcctctttgtctcctctttgtcatcatggcttggtttcttactatccatcttacaagtattttcttacatttctttctacttaattgcagaatgagaaaactcgtgtgcagtcagagaaaacaactgctagcggtgaaaaagaaatgttactggaagagctagaaactaaacgaaaagaagttgagagtttgcagcaacatattggagaattcgaggcaaagtctaaagcagatataaaagttcttgttaaagaggtgaaatctcttcggaactcccaaaaagagatgaagaaagtgctgaatcagtatcatgaggagaagactgaattagaggtataaatgtaaatttaaagcttttctttctcgcagaactatgatagtatctataaattgtgtgaaattgttgctatggctggcctctcattgctcaaagccaggagagcataaccctttacaagttgcaaactagattttggttgtagctaagagaaagtggcttgtcaaagtcattagacaagtccccacaaaaaaaaaagtcattagacaagagtaagcctttgaaagcatgcaagccatcttgagtgtttgcttttccacttctaacttattaccctgatttctgcatctccaccacccatgcaacatgttgtccatttttggaatattatcatgaattgttgtacttgcctacttggtatctgacaagatgagcttaacagtcttcttttgatcaacaaacatatggaccttttcccttttttattatataaccagcacagccatctattctttatgtgattccttttgtcaaggccggctgaataaagatttctatctacacaagctagattcaacagcgatttctttatctatatataatcactcttggaggacaattgaattaatttaatgctacctgtttgtacaccacttaactaaagaaattgagagagagaatgaaggggtgaggtgttctt

SEQ ID NO: 83698 - DNA, 3637 bp, Oryza sativa
tgtataaccatattgcacgatgagcatactaagaagctaaagccataatgttgtggttgtagccatggctgccgccgttggtttgataattgtttgtaggcagggttgctagcttgctgattgctcaaatggcacataaagagtaaactctcgatttagttgatgtagtaagctctacatggattgatggatatgctttgaaccttttagattttcccctgtttgcaccaaaagagtaactcatatgcacttaacagactcatatgagtagtgttccgcttgacaaccaccaagccgaaataggtgctctgtgttatagctgttcacctaggctgccacttaggcgcttaacccacttggttaggcacttggcaccagcctgttgccagagcctagcaccaagggcagcaccagaatcgagatttatgtcggttattggtttaccctgataaatatttataggcaaatgcttgatttttttttatgatgatgtggaagctagaaattagctcaacatcaatcaggttgacagataacttctgggcagttgggaaatatgagctgaaattcctgattgataatcattagcctctcaacattttaacaatacaatagcctttttatgattggcatagtagtaagtaaagtttgcatgctaagacttgtgatttctctgtgctattagtaaacagctttcttcattttgtattatacaattattgggttaggggtaagtttatctaacttttttcgatacatggaaaattcagatttggaccatacttctgccagcctgttatcgctggacttggagaggacaatgagccatttatttgtaccatggactgcattggtgcaaagtatgtatcagttcaattgtgtttttgtttttattcaaattaatttcttttggatctattcatacacatctggatggttatccattgctcatgttctgcaatttactgcattgattaatatgcccgccttagtcttattccacatttagatggttaggtggggagttatctacatctttaatttataaatatgtttgtcatatctaacaaaggttacctcccaaatttctaaatcatcattaacaaaagaccccatgtgaatgaacaacgtgatttatgggttcaccattcttgtttctatcctgaattccatgacacccaaacacgattggctccgtctctgtcccagagaaatgtgtgcatgcttgacattggtaacttgctctatcagagatttgcttgattccttttttgttcctttctgaatttgatatattttttctatctgcttcatcatgtactgaaacaactttgatactattattccaatagcatgccacctgtttaagtttttggtctaagtccgtgtgcctgatatgtctgattaggcgtttgaacgcttgtttctcatattcttgtgagctgattgaggatgtttatttctgtgcagggaactagctaaggatttcgttgtatcggggacagcatcggagtctctatatggtgcttgtgagtccatgtacaaaccaaacatggtatgcatttgtttgtttgtatgatcacatttagcccgtgtaacattctttatgggataacatcatgggctatagcaatttcgcatttctgtttggatctgtataatatattataattctgttgcattgtactgtttagatttctaccactattttgaatgatagatgttacatgacaacatattatttttcttgacaaaggaacctgaagaactctttgagactatctcacaagctctgcagtcatcagttgatcgtgattgcctcagtggttggggaggctttgttctgcttgtgtaagttcacttcactaattcaagattggatgagtggcttcatttttcttctgttaaacagcttttgaattaaaatacgttatgcaccattattttatctaccgttctgcaataaattggtagaagttcatcagtaatgatttttttcccaatcaaatataattggagctcaaagtcctaccgcattccgcattttagttgtttcagcacttcatttgagcatcaatacgtttcttttacataatcttcttttgggttttcaggacaccaaccgaagtaaaagagtgtgtgatcaagggcaggatggactaaatttatcattgcgaagagttcttggaaccatttctgatgcctgctgttcctggtctctcagcattactatccgtgttgtatgtggattccgagggaaccttgtaatatcaaagatgttcattcacccgtagaagaaactgttgttttcttacttttctacgcttcctatgaatgaaaggacttctatttgttgcatgagatgtgcacttcttggcagtccttggccttgatgatgacgattatactgatcagtaagccggctactggttaattagctaagaatacgcgtatcgtggtgcaatgagctactcatactcacccttctcaggcatttgttcgttcaccgtttctatatcttggcaacactttttctgaaatggatgttagtgctttgtcgagtatggagccgacgatgtgaagtctattctgagtgcgagtcgttgcgactcagattttaagttacagtactaactacagttcatagcttgtagtgctcagagttcaatggtcttggctgctttacaaaaattggtaaaaaccgaggacgacttttggtcaattctatacaactaactaaaactgcttgtttttcacaaattggtctccaatgatttcatggaaatggagcgattttcgttcagtactgtaaaccctagtattgcaaaccctgttagtgcttccttcgttattttttactcaaactacaaaaaatacccatgcgttgcattgcaacgggtaagtgctattttaataataataataataatattatatatggtttgtgggaactcgcttggatccgtatttcatctcaagttagtatgcgagtttttttaaagagatttcttatacgactccttttgtattttcaaaatcaaacgagcttaaaatccaactcaaacacaacgaacttaaaaccgactcaaaacgtaccaaaatttttgcaaaaacaactctaatttttataatagtagagaagagatagagatatacatgttttttttgttattgtttcgagcatcaatacaatctcaaatatgtgtttggtcattgtttcctccaactatagatgtattgaaccccataattttttctacttagatattgtttagattctaacttttttcttcaaacttcgtgtgtgtttagttcacgttaaaattaaaagtttggttgaaattggaacaatgtgacggaaaagttggaagtttatatgtgtagaaaaaattagaagtttatatgtgtagaaaaaattgatgtgatggaaaagttgaaagtttgaagaaaaaatttggaactaaactccgccttataacttttcgccacatagaactttcgtacacacataaacctctaactcttccctcacatcgtttaatttctttgaactttaattttagtgtggaactaaacacagcctaatagtatgtactgaaccaagtcgtcactaagaagtgcataccattatctgtcg

SEQ ID NO: 83699 - DNA, 966 bp, Oryza sativa
atggctgttacggaatgtagcgaattctggatgaaatgtactttctaatattaattgatcaaatttgagtatggaggccctttgcttgtcgactaagtgacaacgtcatggctagggatgcactggtgtttttatatttggatctcaagccctcgtatctggttctccagctgaatgtgttgatgcgatgactgcagcttaccaatggatgactctgtcatcttttcgctggcttgaagaactctgcagagaagcagaggtaggatatgttgacatcaggtgcttaactgaaacccgaatagaatccatttattttgacttcaaactgatgttcagatctgacatttggtgcacaacatgcagttgggggttttgacgtttcttaagtttttttcattgaacttgatcagccaaataagctattttagacgtgattcatgacctgttagtctgaagcgaaagcaaaatcagattcaagaaatgcagatgtagaactatcccatcatatcgatcgagcacaatctggtcatgccattcccagacattcattcttgcacaaagcaaacttcactcaagaatgttagataatgcatgtacaaaatttttgcccaattaagatgaaaaggatatatgcttttctctgctgaactgcatattctgaatcaatcatccatggtcatcaatactcaaaaattttgttggtatatcagtcatgggaattacatttgattttttctccctttgcacgtaaactcacagtcggcataaattttatacggtcctcacctaatgtttgggggttagtattagagtgggcaaattcatacatgtgagtgttacctccatatgtatatctgatgtacacaagttcatactgagctggtattatccaatgtacacaaaataaaaaaccttaaatttttttgagttcttataatgaacttagtagatatgtacttacaaaat

SEQ ID NO: 83700 - DNA, 756 bp, Oryza sativa
gcaatcaacacatgtatacttttgttgccttatctctctctctcttcttaatttgttgcatcttacaacgaacgaataagcaacagttgcttcttgtatgtacaagtttcgacatcataacaatcaataaatccttgtcattaaccggacgacacggtaatatctcacacttgatgaccgactcctgcaagctaaacaaacttaaaaattttaaaaaaaaacctcacaaaaacaaaaccactcaaatcaattaattcgatcgtctaccgctgtatatatatgcttcttgtgtactctgctgtatcgaattatcatttggttcatcgatccatggagagaaatgttttcttgtgtgttcgatcgctagcttagctatggcgccgggcagcccatctcgtcgcgtgcctggatgaagacgatggcggcggcgtagtgcgcgagcgcgccggcgatgacgagcgcgtggaagatctggtggctgtggccgcacaggtcgaacatgccggggcgccaccgctccgggacgcgggtgaggtagaacgcggtgccggcgaggtaggacgccgccatggcgccctcgtacgccagcgtcacgttccggcggggctcgtgccagttgacggcgacggcgtgggcggcggggacgacgccggagaggcccatggcgacgaacagcagcgcgcggtgggcgcggtacctcgccgcgctcagcctgggcgacatgagcgcgtacacggtgccaccccggcggcggtg

SEQ ID NO: 83701 - DNA, 737 bp, Oryza sativa
caagcagaagagtttattccagagagatttgagaatgctggtattaatttcaaaggaacaaactttgagtatatgccatttggagcagggcgacgcatgtgtcctgggatggcgtttggtctagcaacgttagagctcgcacttgcgagtctcttgtaccattttgactggaagctacccgacggggtagagattgacatgaaggagcaaagtggggtcacaacacggcgagtacacgaccttatgcttgttcctatcatccgagtgccattaccagtgtagacgcacgtagctgctatctacgagttattgaaggggaaaatatatagtgcaaacctaaaaactagcataggatccaaaaatagacgtctaagatttgtctacatcacacggagtaaaattttcactccaaattttaaccatgagtaaaagttttactcatggtgatgtatatggataaatcccaaacatccattttttctattgtacggtaattttcaggtttgcactgtatatagagtttgcgctacatatttggatattccccctagtgaagcaccccaacatctttgggcactactgttcatataataagagtttgaacccaaacaattaattatttttggaaccagttcaattggctgtgcaacttacatgtgtaggccccattatgtatttgaatatatagttctatttgctattcatccttatcatttgtttatatatagttttattat

SEQ ID NO: 83702 - DNA, 1478 bp, Oryza sativa
ctaataaatatgacacataaatctgcaaatataacaataacaaaagatgaatagcacagagaaactgtatattaaaatacatatcggaatgtacaaatgtaattaattgcacagtgagttgaagtagttttgtaataatttaattgttaaggtttgaacataggtaaacattagtgaaccaatatatttggtcgctttatcaagaaataaaaaatcacaagctacttatctagcacctagctagctgcgcgagtctaacggtaacggcactcgaatcacagggacaagcaaaagatcatggagtcgccgtgtggtggcccccctctcctgcgtcatgtctaggtcaccgacttattttgtcagataacttccagtcaaagtgatataagagactcgctagtacgagctctaaattcactagaccaaatgccatcccagggcacatccgtcgtcccgctccaaacggcatatactcaaagttcatccctttgaaattgatatcaacatgctcaaatctctctagtataaactcttctgattggtcccagtacttaggatccctatttatagcccacatattcacgagcactattgttcctttaggcacatcgaaccctagcacttggcaagtagttcgacactctcgtggcagcagtggtggtcttggcgggtgcagccggagcgcctctttgatgaccaagtacatgtaactcaaattgcttaggttttcttctgtgactttgtgctgaccaatgaatactcgttggacctcatcttgtgctttttgcataactcttgggtttctcatgagtttagccataatccattgtagcgtcgtcgctgtcgtctcactgcccccattgaacaagtcctgtgtaccatgaagccaaattttcaggtaactacattttgtggaaaagccatggtaactttttgctaatttgcttggtaaccctgtaaaaaaattatggtgctgaaaaatatcattgtatcaaaaaacaaaattatagtatatatgtgtcattgacgtgtaggttcagtcctcacgcgttattcttactagcataacactactaagttacaacggatttcttttaataaaaatagctcattgtatatattttttgaagcccataacaaattatttttattatctaatatattatatatgattatgttaattttgctgttactttttaggtgcctattgagctagagctcttaggatttgtgggggttaggaaataagcaaaatctctcgtttgtgtgtcctacaaagtggcaggttattactagaaaaaaaatgctcgtacgttgcaacggataaagattatttttatcttattattattatatggtttagttaaggtgaaattcactgtgagaattcgtttcgatatatatttttctagaaaatcataagctgcaattagaaatctggtcatctcaaattagcatgcgagctttttaaaaagact

SEQ ID NO: 83703 - DNA, 1028 bp, Oryza sativa
cccgccttgtgctttccttcctatcctccatcaacagaatgtataaattttatgtagcactgtaaatatgcatgtttccttttaacatgcactaacatatgcatgacatgcattggccaggacatgtttgcaggtggaagtgaatcaacatcaacaacacttgaatgggccctgtcagagcttgtgaggaaccctcatgtgatgcaaaaggcacaagcagagatacgacatgctttgcaaggcaggactagggtaactgaagatgatttaattaatttaaagtacccaaagaacataatcaaggaaacactacggttacaccctgtagcacctctacttgtcccaaaagagtgtcaggagtcgtgtaaaatcctcggctatgatgttcctaagggaacaatcatgttcgtaaatgcatgggctatcggcagagaccctagatattggaacgatgcagaagtgtttatgccagagcgttttgagaaagttgcagttgatttcagaggcacaaactttgagttcaaaccatttggagcaggacggaggatgtgcccaggaataacatttgcaaatgcaacaatcgaaatggccctcactgctcttctataccacttcgattggcatctccctccaggtgtaacaccggatgggttggacatggaggaggaattcggcatgagcgtttcaaggaaaagggatctttatctacgaccgacactccatatgggacttgaaacaatatgatgaatacacgcgtgttgtcatggaaaatgttgataatagccgaatggtgtatgtacctagtagaaaaaaaatactttctgcaaattatagtacctatacttacaagatgtttgggaggtaggaactcctgagatattcagatattccagagctccgagtgcattagtatagaaattcatgcacgaacacaatatatataaggcgttgctgtcatgtacaagagctgtgttttttaaagataaaagtactgtacgtttccagttgtaatgtaacaaaagtttgca

SEQ ID NO: 83704 - DNA, 741 bp, Oryza sativa
tacgactactgcctggtcctcgaccagcgatgtagcgtttctcccactacttccaccttaagtggttgagttacgactactgcctggtcctcgaccagcgatgtagcgtgtctcccactacttccaccttaagtggtcgagttacgactactgcatggtcctcgaccagcgatgtagcgtctctcccactacttccactttaagtggtcgagttacgactactgcctggtcctcgaccagcgatgtagcgtctctcccactacttccactttaagtggtcgagttacgactactgcctggtcctcgaccagcggtgtagcgaatctcctattacctctatttcaacaaagttgatagcaggtatacaatatcgccaagtgttttacccagagatcccttaccacgacgacacctagcgttgaaacctatcctattgtccttttacgccgtcttgacaaggcctccgaggaacctaagggaacttcggctggggacacccagagccgataaggccttgtcggatcctgtagagacaaaagaccatgtaagacctggtcgtgtaagagttctcgccgtgcgtattaaccaagccgtgtgatcggaaattgagttttccaacttcacagctgggggctaggatcagtgcttgttcaaccaaggcaggtgtcacacccgaagttttcctcccaagtcaaaatggtaatttgcaaatgaccctaagaaaatgcaggtgaaatcagg

SEQ ID NO: 83705 - DNA, 749 bp, Oryza sativa
tttagtttctagattttacatgggtactcatatatttacggttattctttttaagtgatagacgacgtatacgtaaatagcgagacacatataatgacctcgttaattttaagatatgccggctcagtctcttctgaaggtgttcataagatatgagtatgtgcgttcaaggagtacgtgttatagcgtctgtatttatattgcctttaaaaagagtgtatacaactagacacgcatatttaatgtacgtcatactcccatcatcaaacatttagggtgttttggaggggttctctccgacacgcaaaatgaagtatacattaacgcattattaattcaatatattagttatttttaaaaaaactaatatgattttttataaacaattttttatagaattttcttaaaaaataaattgttcatagaagtttggaaagtatacgtgcggataaacaaggaaggagaagttgtgaacataggccctgtttaatttctaaaaattgtcgcaaaaacatcacatcgaatctttggacacatgtgtggagcattaaatatagataagaagaaaaactaattgtacagtttgcatgtaaatcgcgagataaatcttttgagcctaattagtccatgattaaccataagtgctacagtaacccacatgtgctaatgacgacatgattaggctcaaaagattcgtctcgttgtttccaggcgagtagggtaccgagctcgaattcgccctatagtag

SEQ ID NO: 83706 - DNA, 1037 bp, Oryza sativa
agtttctaacttcttttttactgagaaacagcgtgtcttgtgtttatagcattgatttccatgtccatatgttgctggtggttatgtagttattgtggcaactataacgcagatgccaactccgacttcgtataaaatgcctatatttatcctgattaatatcattggtcaatgtgagttgtactcaacgcagctgtagtttggtgtagtagctgcaacaattaagccatgttttcttcaacttcttttcacactatcttccatctttagtttaaagtctgatcgtttcgcatacaactgataaaccgtaaaatgcttatcagtaattaaagaataatttatgagtaaaacttttatatttgtgctaaaataaattataataaaaacccttaaaatcaactataaaattaaattttagccacagttgataagccaaaaggcgaagattgaagatttgatctttatgtgaactaaccaattaattgaagatttgatctttatgtgaactaaccaatttttaatgctcttaattttgttttgattttgctaaaagaagagtttgttattgttgatgctaacttatacttgttgccagaaaactttaggacagttggggcgattggttttgggtattggttatcggtttatggttggccatccgtatcagcttatcagaaaggctagtaatacagtcgacctgttagctataaggttctgtgtagtcttctcttagcttacccatataatagttagctctttacagttaatacagggcaaacttatctctctcacagagtttcttggttcttgtgtcaagtcggctgtaagtttacagcccgctctcctctcttctctcctccacctcagcatttagccggcttgtagcctactattatacttgctctcaggggattgtgatacgtctgctcatcttgaacaatatctagtcaaagtcacatcttttttgcgtaatgtcgcatctttgctgcgtaatggctaatttaatttaaatctgcgaaaaaggttcctgttcggtc

SEQ ID NO: 83707 - DNA, 632 bp, Oryza sativa
tgcttagaggtcattagtagggctttattttcgccgtttgtttcgcgtgtagtttcggagcccgaagacccgcagcgcgaggatttcgaggatcaagctccagatctcgagcaaggcaaccacctttgaacatcttgagcctatatttgaaatttaattatgttgtttgaaaatattatgcattgataggatcgcacttaacctgttgtcccgtctgcaaggcagattggcggacctacctaatttgttgcatttgatccttcctttattaattgtgataccatgtccccttgtaaccatctagttgcacctcaatattcgtgcactctgtgcgagtatcgacagtcgccttcaaacttaaaatctgaataacaacttgggtaaaacttgggttttacaaaagacttggaaaaccccacacctgagtcggtacttgcgaactaaatgaatttccgaaaccgcggaccggggaacgtaccgggcgtacggttttccgctcttgcacttaaggaccgtttccttagaatttcatcaaaacataagacaagtgcgaccacatgggtggaatgggacaccccttgctgaataactagcttataagggagcctcaatgcccaaaaacatgtggattc

SEQ ID NO: 83708 - DNA, 564 bp, Oryza sativa
ctatgggaagatatgtgttaaaagcatactgacaatatcttgcaccttatcaagaacactagttaatcccaagatatacctgtttcctatacatgacacatcatacatcagttcagacaaacatgtgctttttgaaaagcaacattgatcaactggctgaataagacgtatgatggatcagcaggaaacatagtaggaagtatgaaaatgttcttgttatagataagatgacaaatgaatctgcctcccaaccaaaacagaagaaaaaggatccaacacacagttacatggattaccttgagtggtgtacagggatgacaacttcccatcttttctcaacagactatgaagtggtttagacgtgcagttctcaagagccttaatccatatggtctcgagcacatctggatctcctaagttcatatctaaacaaccgattttgttctgatagcaaagatgagaactggtatctaagctttcgtctttcaagatagcagccccatcatctgcataataaatagctttcagtgagcatgagaaagtgactcagtcatcagagtttcg

SEQ ID NO: 83709 - DNA, 669 bp, Oryza sativa
  unsure (1)..(669): unsure at all n locations
atgtagtatcgactcttttataaggcgaattcnagctcggtaccctgtctatgactacgaggacaagatcaacttcgcagtgttcccgtcactgcaaggtggtcctcacaaccaccagattgcagcccttgcgggggctctgcagcaaaccatgacacctggattcaaggcctacgcaaagcaagtcaaggccaacgctgtcgccattggcaagtatcttatgagcaagggctacaaaatggtgactgatggaactgagaaccaccttgttctctgggatcttcgccctcttggcttgactggtatgcagactgtttttgcattcttcagtataattgctgttaatttttaattagtgctattaaacttgtcctaatgttggtttactcatgtaggcaacaaggttgagaaaatgtgtgacctttgcagcattacacttaacaanaatgntaacgggagggnnncaggggggagggaagaggaggggnnnnagggggtaggttagggacnccnnnnnnnnnagaannnaggnaatgaaggggagggaagttgctgccatnnccntnccctcnnnnctaagaggggnaagggnaaagagagaaaaaaaaaaaacaaaaaaacgatgtgtttcgattgtatacccnaaaaaaaaaagtcgtatgtgaaact

SEQ ID NO: 83710 - DNA, 1367 bp, Oryza sativa
aaaagcccatctcaaaattcgattccaattccagttcgtctcgctcgccgccaaatcgccccctcgctgcctccgtctcgcctcgccggcggcaatggagtggctggacgagtacgagaagctggtgatcaggatgaacacgccgagggtggtgatcgacaatgctgtgtgctcgacggcgacgctcgtccaggtatgtacggtggcgcggcgcggcgtggcgtggcgtgggtttggttcttgggtcaatctggtgcgtgttcttgcggcgagggttgctgatttggggatgtgcaggtggacagcgcgaggaagacgggggtgctgctcgaggcggtgcaggtgctcgccgacctcgacttgtccatcaacaaggcctacatctcgtcggatgggaggtggttcatggatgtcttccatgtgaccgaccgcctcggttgcaagctcaccgacgacagcgtcatcacctacatcgagcaggttggtgggtgttcttggtggtttctttgattctggcgcgggtgttcgacggagttggggggttttctgatggcgtagtacatggcttcgttgcagtctctggggacgtggaacgggccggcgcggccggcggcgctcgaggggttgacggcgctggagctgacgggggctgaccggacggggctcatctcggaggtgttcgccgtgctcgccgacatggactgcgccgtcgtggaggcccgctcgtggacgcaccgcggccgcctcggctgcctcgtcttcctccgcgacgaggaggccgacaccgagaggatggcgcgcatcgaggcccgcctcggtcacctcctccgcggcgactccaccggcgccggcggcgccgtggccgccgtccccgccgccgccgtcgcgcacgccgagcgccgcctccaccagctcatgtcggccgaccgcgaccaggaggagcgcgcggcggcggcggcggcggcgtccccgacccccgccgtgtccgtccagagctgggcggagcgcgggtactcggtggtcaccgtccagtgccgcgaccgccccaagctgctcttcgacgtcgtctgcacgctcaccgacatggactacgtcgtgttccacggcaccatcgacaccaccggcgaccaagcgcaccaggagttctacatccgccacgccgacgggagccccatcagctccgaggccgagcgccacagagtgagccaatgcctccaggacgccattgaacggagatcactagaggtatatcgaagccaaatcgacccaaatttccaacaccaagatgcaattcgttaattgatttggaagatgacgctaatgtgttcgatttcttgggtgtttcagggagtgagactgaagctgtg

SEQ ID NO: 83711 - DNA, 601 bp, Oryza sativa
agcaaaacccttcccattccatcctttgattcatcaatgctatccatgctcgtcgatgttgcacaccagtaaaagaccacagcgcattttgtacaatgtgctacagtgcccctctcatggatcttaggccctgtttagttacaagaaagtttttccaaaaaatatcacatcgaatctttgaacacatgtatagagtattaaatatagataaatttaaaaactaattgcgcagttaggggagaaatcacgagacgaatcttttgagtctaattagtctatgattagccataagtactacagtaacctatatgtgctaatgacagattaattaagctcaaaagattcgtctcgcggatttcaggtgagttatgaaattagtttttttattcgtgtccaaaaactcctttcaatattcggtcaaacgtccgatgtgatccccaaaatttccttttccttatgtatctgaacacattgatattagtagtagtactaacgtgaatccgcagacagacaaatggacatggcaagttggcaactgaaccacactagtcaattgacttgaatgtacgtttgactcttgcatgtaaacattgcggcaatg

SEQ ID NO: 83712 - DNA, 635 bp, Oryza sativa
accctgtgctggcttggcccgggagagagcagggaggagaggcccccgagccgaacggtggcccaaggcccccgacgaccggagcaggccctctgcccgcttgttagacggtgccaggtgcccccgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcctgcttgtccgacgacgccaggagcccccgacccccaggacggccccgaggccactgtgggaaggccggccctgtcgtcctccgaccccgaggtcgtcggcacagaagacgagtgcaccccgcgaggccgcttggacaaagagcgccccagggatgtggcccctagcgaagaggatcggccccaccgaaaggtgcagcggcccgtctactttgttagtgaggcccttcgggacgccaagacccgatacccttaggcccagaagatgctttacgctattctgatggcttcgaggaaactgcgccattatttccaggcgcattgggtcacggtgggtacgtcttacccc

SEQ ID NO: 83713 - DNA, 630 bp, Oryza sativa
tagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtgtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgact

SEQ ID NO: 83714 - DNA, 512 bp, Oryza sativa
caatctatcatggctgcaactgcaagagaacatgcggcatgctgccgagatcaagtacatgatccggcacatttccctgacagacttgttcggatgtaggctcagtgatgactggggttgcataactgcataagcagatcttggatcgggaggttgtgttgcatgattgtgcagtgaattatgactttgaggttcttgctgaacaatttgttttcagtcaaagttcgattactgaagtaaagactgaggttggacaaaggaagtaaaacttccggtctttgcatcagctaaggatatatattaagatgaaatctaaattataagaacaacaacaacaacaaaatatcaggtgcaaccaaaaaaagaataaaacaatagagatgaaatataaattacaagagcaacaaaaaaaaagagcagatgcaacaaaagaaaaacagagatgaattctgaattgttggccaaagattcagcttaacaaaagagagagtgtcctaagatgaaatctagat

SEQ ID NO: 83715 - DNA, 824 bp, Oryza sativa
  unsure (1)..(824): unsure at all n locations
gggaatgagngtgcacgtagatcggctncttgcagnagtccatcagtcatactcgatcaaagtaaaagttatctccttagaagatcaggtcaagagagagagagcacgccattacatgacctagggtgtccggggtcagggttctctttgtgcccgtgcgctacatttctagttaataaaaagtcagaatgcagggtagatatataaaacgtagaataaaaaacgatccattgagttatgtagaaatcacgctgaccatgcccatatcacacatcgctgtttttacgagttgctcctgttggccgtagcataaaccgtgtgcccattgaactgtgtcagcgtgtaaccgagctctcgtgagacctctctatatataaacacgagacgccaatcttgtatcagccgcgaagagaaataagagtccgatatgggtaagatcgaagcgcccgcccgccgccggcctgaaaggaagaacccggggggccccccccccgcgtgctcgcgattaaaatggacaagacgacgatcatcgtgtccgcggagggtgggtccccttgggttgctcagcgccatcctgggattctccgccgagggtgcgaaacgcaccaaggcaagttcttgctaacactagctacatattatctagactctagtgggatatatatgtttaccgatttttttttttgaacttgatgactactgccttagagattatatatgtgtttaatttcccagcgtggcgaactcgacctgtaccactttgtactaactcgtcgaactcatcgtcagaaggggtcgggctgggtgtctgcggggccatcttg

SEQ ID NO: 83716 - DNA, 568 bp, Oryza sativa
ccaaagtttcccctttccactactaagttttttttctcattctttggtccataaccttccaatctttgttactcaacttcctaaaatgccttttaatcccccaagatttttaaaaaaaaaaaaccccccagcttacaccgaaaaatactagaatatcgatcataaccctcatttgcctggccaaaaccaaataactccaattttatgaaagttaattttcaagccagataaattttcaaaccccaataagatcaattttagattctttgcttgttgtaaatcttgctccaagaaaatgatagtatcatctgcatattgcaacatagacaaaccatcatatactaaatgagggattaccccattaagaaaatcactatctttagcccttttaattagcaaagctaacatatcagctactatgttaaagagaattggtgataaaggatccccttgtctaagacctttatgtgtttgaaagttgtcaccaatttgatccttagctttaataccagcatgtcccccttggataaaagaggatatccactcacaccatttgggagagaaaccc

SEQ ID NO: 83717 - DNA, 620 bp, Oryza sativa
caaaacgaatcggatttggttcctgtgcagttcttggtattactgcaacttaggcggtcatattgtggctgtaggatgcaaatccaaaggcccaaatttaataggacactgtttattcagacaatccagcacaaaattattataacaatcatagtggcaattaaagcgtgtaatgatgcatctaccaaatgctaaattgctaatggtgggatattccagataacactagaatgattcagacaggccaagcctcccaaggttttccatctcaccagcaggtgggacccaccccgttttgctcccagccaatggcgtcgcgaggcgcgagataaggctgcaaacctggagcacacactcgcctccttccatcgctgatgcagataagccgcgatcgcatccaccgttctagaaacgcagcgacattgcactcaccatctcagaaattgcatccaacagcagctgccatagttgcaagtgagctagagctcagagaagaggaggaagaagaaggcgtcaatggcgaccaccatagctgcgatggccatgcttaagccgtccaagatcgtggcgcggtcatcgccggcgccgtcggggagcggcagggtgcctagcatctcgct

SEQ ID NO: 83718 - DNA, 630 bp, Oryza sativa
ccgcaactacagaaatccatccaccgtagtgccaattctattaggccctgtttagttcaaaaataaaaaattttatgctaccatatcgaataaattggacacatgcatggattattaaatgtaggcaaaaaaaaccaattacacaaattacgtgtaaattgcgagatgaatcttttaagtcttattctgccatgatttgacaatatgattcaacagtaaacatttgctattgatggattaattaggcttaataaattcgtctcgcagtttcctaacggaatctctacgtttaatacttcaaatgtgtgtccgtatatccgatgtgacaaccaaacccaaaaattttccccagttaaacaaggccctactcccttcatctcaaaatatagctacctttaatatatataatttatcctacttcacatattccttcatctcaaccaactacaaccattttctatttaatttcatcatatacttctttatcttaatcaaccataaccttcacagtttctatcaaaaacaaaaataaaacacaaccctcccatttaattttattgccctctccttaatcccttcaaaaaaacataaaggtatgggtaccgagctcgaattcgccctatagtagtc

SEQ ID NO: 83719 - DNA, 625 bp, Oryza sativa
acaaaatccttatgaacagggaaggaattgtgtaacagttaacaacaaaacagaaggggacgagtttattacaacatggcactagaaacatatttcatacttcaaatatatacaatcgcaaaactgcatagctctttatgtatttctttaactaaatgttgtatttaataaaaacccatggtagcaatacatcaaccgatcataccaaaaaatctgcagaatatcaattaccacatctacgcagtcctgatttacataattaccagtatgaaacaaacaaatagcagggcacatttatccaatcatatggatacaatcatcgaccatacagatgaggatacagaatcataccgttaccccatctgcacaaagtacacttgttttccctaatgatattcacgcaaccatgatttccacaactgacatgaatgaatgcgtgatgcatggaaaccacatccaacccagtaacaaacataccggatgaaatacatcccaaaaagcttggaacagaatgcacctcgagctattgaccaagaaaacaaatccagatctagcaataaccgcagatctgaatccccatcaagaaaaggtagggggggtaccgagctcgaattcgccctatagt

SEQ ID NO: 83720 - DNA, 613 bp, Oryza sativa
agagggatcctgcacaccgggtgggtgcagcagcagcacatcctgcgccaccgcagcgtgggctgcttcgtcaaccactccgggctcagctccgtcgtggaggggctcgtcgccggctgccgcctcgtgctgctgccgatgaagggcgaccagtacctcaacgccgcgctgttcgcgcgcgagctccgcgtgggcaccgaggtcgcgcgccgcgcccgcgacgggtggttcgggcgtgaggacgtgcgcgacgcgctggcggcggcgttcgccggaggagaagacggcggcggcgaggagaagaaatggcgggagttcttgatggacgacgccgtgcagaggaggttcgtgcgggagttcgtggcggagctgagaaggctcaagggctgaaaacggaacgtcacgcgtcgttaatcagatcgacagctgtcacaactctgaagaaaatcggactctgttctgaagactgtgaagagaaggaatcaacggctgtgattgcttgatactgcatcgcgggtctcgctctagggagtactacatccgtcataaaataaaataagtgcagttttgcactggttatatccaacgtctgacttaacgtcttatttataaa

SEQ ID NO: 83721 - DNA, 1705 bp, Oryza sativa
attttcggcataaatagtactgttgttttgcccagaaaatatatatagagagagactttatacattcaaactttatatatagaaactttatagatggaaactttacataggaatatcttcgtaccaaaatttatgcagataaaattaaaacaaataaaaataaaacatccagatggacctggggcaaaccacatgcatggcatgcctgctcgatgggccttccgtggaaaacatgcaagcaaaaagagaaaacactaactagaaaaaataagtgagagcctgtgattaatcaaattgttgctcgtatttgccaaaaagagaaactaaacaatcccgtatgtagtttgttgtgccaaaaaaggaactttaaatctaatcttgcgtggtgagcacgagcgattcgctcattagctttttttgacaataaggtggtcaagattttatattttctcctaaaactagggtggcttggttctacgaatcttttacccataattcaccaactcactcttacacctacattactcattcatcaaatccgacggacgaaaatcatccggccaaatcaaatgatcgctgcggcgtagggataacccgggcgaaggaatcgcgtgatcttttccctttccttccgtgcggacgcgatctttccttccacgccaatctgcgcgatctcctcccctttccatttcccttcacctaccaatctgcgctcatccgcgcgcccagcactccctgccgtgcgccatcgacgttcctccaaacagtgaagatcacatccccttctccaccatcaggcgccgtcgcattctccgccacgaagatcatcgtcgtctcaagcgccgttgttgatcccctgccgccagagcgcagcagcgacgacgacggcaacagtagccaaccagtgcagggggagacggcactgcgtgatcctcgtcctgctacagatatattgcagtgtttttttttcagtttcttaagatctcttgttcaacaaattctaattcataaaagttaacaagttttttagctgatcaaccgttgctttctgactctttgtttctttgaacactgatgttttgattcctctcttggagttcatggagataaacgggcaggtaaggtattggatcagccatggtcaggaggtaatggagatcctgcgagctgattcgaagtctatttcttatcgattggagtgtcgacttcagctcctgaatgaacctgatctttctgcagcagtccatgaggtaactcctgttttcttccaggtttattagggatgcaggagtgcagcacgacgagaaggaccgctgcatacgagatgctcgtgacaatgcctcacagcaagatgatactcataactttctctgacttttcttcttttgatatattgctgggagataaaggaaacttttaatgttagacatacgctgccactgttgaagtgaaatgataccatccgtcgtacatatatgggatttctaatgttcgtttcctatgtaagcaaaggagtgaacaaaaagctggtgtatgattactctaccaatacctgatctagacagatagcactatatgtaagcagagatgcatgctctgatgcagttgattttttatatttataatgtggcaattaaggttttgccactcgatgtctatgatatgtggtctctcttgtgtctatgacatatgggtccagtgacaa

SEQ ID NO: 83722 - DNA, 569 bp, Oryza sativa
  unsure (1)..(569): unsure at all n locations
attgttgagtcgcacgatccactataggccgaattcgagctcggtacccttcgttactagaggtgtaatagcgtgttacatcgggtatattatatagggtattgttatgggatgtnnccccactaataaaaaaactggtggggaatctgccagtagtgcgcgagaaaaatttattaagcctaattaatccgtcattaataaatgttttactgtagcaccacattgtcaaatcatggagcaattaggcttaaaagatttgtctcacaaattagtcacaatctatacaattagttatttttcagcctgtatttaatacttcatacatgtgttcaaacgttcgatgtgatagggtaaaatattttagggtgggatttaaacaggcccataatctaacttttttattattatgaacaaaacaaggnnnntaattgaggtacaaaatgtgccttcttttctctttnanctttaggggtggagagggaggagggccccccncaaggtggatagtatagtgaaanctttttttnnnnnnnttttttaggtgtgagaacatgccaaaatcatttttg

SEQ ID NO: 83723 - DNA, 1908 bp, Oryza sativa
cacaaaaaaggaaaatcatctagattttttttacctttaaaattacatccaacaaataccaaaggatttgaccaaatccatatttattaatatataattttaatcaaaattacagtatacttacatgtcacatcaactgaatttacaaatgtaattttagttatataggcctataactttatatttcacgacgacgatgatgagagaggcggtatcgctcgccgaacagctttggccgtactgccggcggccagctcgatcagaggccaccctggcaccgtgcttctccaacatcgcgcgcgggcgtacgtaccagccggccggcgagcttcatgcaacgttcgatgccgttcacattgcaagctgcatggatgctaaaacgtatcaaatgccagaaaaaaaatcacacgagagatggatagcaaaaccgagttcgatgggagtagactcaacttcggctgtgtctcgtgtttttttagtaagtttacctgacgtctctcaattatccacagagcagcccaacaaatcaggaaagacattcaagaaaataacttcgtttttcagcctccttgatgatctcattttcttcctcttctcctcccctattgttgtcccctctctatcgttatttctatttcctaagaatgtcgcttcatatctccggtaacagttcacttgtaagctctatgtaacctactaatttcaccccctctaatgtattcggcaataatcttgccgctttcacctaaaaaaactatacgctgagtatatctgagatcccctaactgcaatatcaaaaatgtgcaccacggactatgtaaaacagttcaaaaaaggtcccagattatagatggccaaacgggccacccggcccgacacaacccagatacaaccggtacggcacgacctacatgtcgggtcgtgtcgtgtcagcccgcgagctgcacacacagcccaggcacgatccaataagacttgggccatgccaggccggtccgaaggcatgacaacccatcatgtttctctataaaataagtctatttttcctccctcgactctttgggttgtgtcttatatggctaaaaaataagtctattttgtattcctcttctctttgggccttgtcatatatggttaattaagtctattttagatccctctactattttcttccaccgtgccgggccgggccagcccaccgtgccaaggcatcagccttggcacgacccaactgtcgagccgtgcaagcacaggcccgacaaatagtcgggccatgcaatgcttgggctgggcgatcgggccttaggccttatggccatctatagtatagatacctggtttcgctgacgtggcatcctagtcagaaaaaaataaaaaaaatgtaaggcccacatgtaagtgagaaggaaaatgtgggccccacgtgtcagcatcatcttcttcctttcgctgacgtgacatcctagtcagaaaaaatttaaaaaaaagtaagtggggcccacatggaagtgacaaaaattataggcaaaatttgctacaggacactgaaatattgcggtctttgctgtgagacacccgaagatcgtgtatttgctggtggacattgtaaagaagtggtaattagctgctggacactcctcccattattttattatttccggtcaaaatggagagagaaagagttgtgtaagtactaaaatgcccctggacacgtactgttcttcctctctctctccttttcttttccaattcttcctcgcgacggcggccggcccgagccgggatggctcggccacggcggggcggcggcggcggcgcatcaccggggttcaccgccgacggcgatcacgcacggcggtggcccggcgcacaaatgaggtcggcaaagcttggttgtcgacgatggct

SEQ ID NO: 83724 - DNA, 1359 bp, Oryza sativa
ggtcagcagcccgctgctccagtgcggctctctcggcgcggacgcattcaagattgcggcgcgcctgctcctcctgcgccgcctcgcgaagtgacaggctgtccgccagccgtttggtcgtggcctcagcctcctcgagagctcgctcccgctcagcgagtgcgtcctcgcggagacggagcgcgcactcctcctcggcgtaggcggcctcgtgcgccgccagcgtcgcctcccggagagcagcggcggcctcgcggtccgtcaagcctttctccacggcgccggcgtgttcttccagcgccatagcacgggcctcaagggactcctcgcgccgccgggacgccgcctcagcctctgttacccgccgctctcgggcagcggcggagtcaaggactccctgggcggcgtcgagcttttctttcagctccgcctcccggctggcgttttgaaggcggagggcgtcttgcgcctcaatcatcgtggtggtagcgatgagggcggccgctcgctcctcctccacctcacgagcgatctccgtcagcgccgccttccgggcttcaagctccgagacgtgacggcggtgagctttacggcccacctccaccatggcgtccaccgagcgccgcccctcctcaacgcgtgcccatgcggcctcgagctccgctcgttccgcgcgcagggcctccacttgggcgctgaacccatctagcaccgcggtgtttgcggcggccaaggcctgcagaatgggctcggcgctcagcggggcgacggaagatgaggagaagagccgccttggagagaaggcgatgcggctcggccccccggagaacgtgctgggctcggggatgtcccccgaacccgtttgatcctgggcgtcgcccggggaggtgggcccaggcgatgtgcccgcggcctcgtcgcgagcctccccggaggctgtcgcctgagggttgcccgaaggagtgggcccagttgacgcgccagcagcagctgttgcctcagcctggcgagcccgggcggcctcctccttagcggcttcctcagcccgggcggcctcctcccgagcagcttcctccgcttggcgaatccgggcggcctcccgggcggcctcttcagcttcccgaaggcggtctgcggcttcacgccggtcagattctcgcctccgctcctctgcggccgcaggatcttcggcctcggactggccggacttggggtggcgggaggaatgcgacgggacatcgctgaagcagaagaaaaaaccagaaaacgaacaaaatgagtaagaaaaaacttctttttgggagaaagatggttgcaatgagagtgagacgaacctgcgaaggggtcggttgaatgacc

SEQ ID NO: 83725 - DNA, 557 bp, Oryza sativa
atgacacatttatcactgccagccgacatattcaacaaaatgcataaaggaagtgcacttttattaattctcctgtactattcttaaaccgaacagtacaccatttattcaatacatgaagaacaaattaaaatgattttgcaaatcctcacatatgtatactatttattacatggaattcaaacatataaataaaacctcaatatttatcaggataatgttgccacaagtgctccactaggtcttcacgtagctgatagtgagtttcgtcgtcccttatttttttgtgcatctggataaaattatcaagatcaggtatttcatcgtgggacactctgacattttctcctccctctgggaaccgttcttcccaatcaacttctccctcatcttcaataatcatgttatgcatgataacacaagctttcatgatgtatcccagagtcttttcatcccaatgtcgagctggccctcgaacaatggcaaatcgagcttgcagaaccccaaaagctcgttcgacatccttcattactgcttcctgtgctttggcaaaatat

SEQ ID NO: 83726 - DNA, 1740 bp, Oryza sativa
gagagtttgagtaagctgtatcctgacctctttaccaaagtggacaagagtagacttgtttgtgatgcttgtgagtttggcaaacatacacggtctacatatgctggaattggtcttcgtagttgtgaaccttttatattaatacattctgatgtttggggaccatgcccagttacttctgtgagtggattcaaatggtttgttacctttattgattgttatactcgtatgacttggatttacatgcttagacataagaatgaggtccttcgttgctttcaagacttccacaaattggttaccaatcagtttgatgcaagggttcggattattcgaactgacaatgggacggagtatattaatagtgagtttgtgtcatatgtctcagatcatggaattattcatcaaaccacttgtcctggagccccccctcaaaatggtgtagctgagaggaagaatcggcatttgctagaggtggctcggtcattaatgtttcaaatgaacgtacctaagtatctgtggagtgaggcagtgatgacagccgcataccttatcaaccgcatgccatccaggatacttggtatgaaatcaccagctgaacttttacttgggaagcgagaatttaaagttcccccaaaggtatttggttgtgtttgttttgtgagagatcatcgaccttttgttggcaagttggatcctcatgcagtaaaatgtgtctttgttggctatgcatctaaccagaaaggttataagtgttgggaccctattgggaagaggttatttgttagtatggatgtaacatttcgagagtttgaaccttattacaggagtcgaggagaccttgatcaatttctagaggagttctcaactgtcatcgagatcgacagtcgagagggggagatagttgaggttgatgcacataagcaaggtgatgaggatgtggttattgggtcaattccgagttttgttggtgatactattgagaaggttgtggacattggtgagaaggtagtagacattagttgtgacaaggatgagggggtagttgtcgggacaatcccatgtcctctggagcgtgtggaagtacaacaaactgaaatgagagtatatcaaagaaggaacaagaaccaagttgataaggtgacagggaaggagcaagtgcaccagaggagccaaattcagaatcagggggagagaagtggtgagcctatgcaagagcaagacaaggagtcacaacagctgcaacagtttgagtacgcagtcccagattcctcctctagcctctctccaacaagttcctccctccttgagacaagtggtaacatttctcctacctttgaacaagtagagttacctcttgcacaacgtagagaaactagatctaatgctggaagacctcctatacgccttggttttgaacaccttagttctagacatgacattgcaaactatatctcatactctcatatttcacctgcatataaagcattcattgcatcattgcaaatagtgcctattccaaaggactagagatgtgcaaaacaagatccaagatggaaggatgcaatgaaggaggagttgcgtgcccttgaaaagaataagacatgggaacttgtgaaactaccaatggggaaaagagcagtgggatgtaaatgggtatttacagtgaagcaaacccctgaagggaaagtggatagatataaagcaagattagttgcaaaaggttatagtcaaacatat

SEQ ID NO: 83727 - DNA, 660 bp, Oryza sativa
ccatgataaaaaaaataaatcatagaccaattcttgttaactaggcatttccataacagaatcagctgattacttactgtttcgccatccgtgaccattacagaagcgcttgcttgcctccctatgtggcctgtctccaccagtatctgggaaacaaaaaaaaaaacaatagtctaattacaactattctcatgccgtatcaaacacctgaaccacagaaccagataagaagtgtaaccaagtttcagtcaaataagcatgacaatcagcacattgtttttgaagttttacggcatcctgagaaaccacatttcgaattgcgcacacagcgttgcattacagttcactgcgcagaaatgttggagctcacgatgacgcatttcaaattccaagcacgcaggcagagcagtgcgcctcgattggaacaggagaaggtgggtgggattactcgtggagggctcacgtacgtggcggtcgccgacgggaatcttcgtggagaacttggtcgggccgccggaggtgctcgcctcctcggtcaccacggggggcgcctcctcgcccacggaagccctaaccctagcccccgccgctctccttcgcgcgccaccgcgacgcgaggtggaggcgctcgctgctacacggcgggggcgggggagcggg

SEQ ID NO: 83728 - DNA, 933 bp, Oryza sativa
atcgatccatccaaaacggacggccgagatcgagcggtccacggcggctcacagcagacagaccctgatgacgtcagcggtgacgtcatctccggcggcggctcggcggctcgggcgcgcaagctcgccggcgaacgacggcgcttcggcacgaacggagggcaccaggacgtagagaacgttgcggcgaactcaccggtgaccaaagaagcggcggaagagcagcggacggcgacggcggcgcggcactagggtttcgggcggcggccgatgcgaggaagacgacgactccgacaggtgggccccacctgtcagcgggcggacgcgcgcgcgagcggcggctgttgctggactgggccgactgggccgagggagagagggagagaggtttttgggccgtctttcggcccaaagccaaaagagacttttaaaaacctttttcaatttaaattattcattaaatgcaattctatttattaaaaatactttcttagctcaaataaatcccagaaaaatctaggaattatagaattaagcaaagtatttaatgaaattttatctggcccattttatattggaatttattaattaaaatttgatcttctcttctaggcttttaaaataaaatctaataattccatttaagcaacaatttatatatttaggatttttagggtgtgacaaacctacccccttaaacagaatctcgtcctcgagattcggaagaactggcaaacagatgcggatgagctgacttcaattcatcttctcgttcccaagttgattcttcttccgagtgattactccattggactttgcaaaaacggataactcgatttctgggtcttctctcatctatttccaaaaaaccgattggtttctcaacataaggcaaatcctcttggacttctatctgtttaaaaataacttctt

SEQ ID NO: 83729 - DNA, 619 bp, Oryza sativa
ctactatagggcgaattcgagctcggtacccctcacaatttattatgtaaaaaagaacatatgtaaaacaacatttagaatctcaccagatcctgatacataagtaaaagatgaggagatatatagtctgaaacgagaacatattatttcacaatgggtactgcacttccagtgggaatcatagatagtgagttttgccaatacttttgagatttatgcaaacaggggacaagagatgcacggctaacactcacctcgtcaacacggatattgtagagtagaatcgaagagtcatccgttccaatagctatgatgttattgtcatgcgggtggaatgcgaggaaagttgcagagggtggaggtgctatgaaagtagtcatggtctgtgagtgattccacaaaatcagttaagtaaaaaaaaggccatgatcgatgcaactatgaaataaaaaatattttccggaagtagtcatgacctgtgagagatcaatcatgaaattaccagattattgtgttacatgactgaagaagacatacctttgaatttaacatgttgaacaacgaaactttggcaccagatgcaaaaattagatagcagtcatttttggatagtagactg

SEQ ID NO: 83730 - DNA, 582 bp, Oryza sativa
tagaggatcccccttgatatgatactcaacgtaagcactggaagacatgagttcagctgttaaactctataagcacagcgtgtcaatccttcgtaccttggaaatagcatccaaagaggagcaatgtgattatgtcagtgcatggtacagtatgcttctgtcctgtgcccaagaattgcagcatggtgcgatgatttggcaggaatcttgtcatgcaaatgttggcgaaacagtaatttctcaaggtgggactctgaataatgagcagagctgtataatttgttttttcggtaatcatttgcttgcagaaagatgatcaactaacatgccttctgttggttgcacaggtgctcattactttattgctcttggggagatctacagagttgcacagatcttacatatatccatgctatctttcaagccttgggttcttgcagatcctggaatgttgagtaaaatgttggtttgttggaacagctgcgttaattcatggactagtggtttaggaatggctcttacaatggttgtcgacagcaagaacttacatgcagggtaccgagctcgaattcgccctatagt

SEQ ID NO: 83731 - DNA, 931 bp, Oryza sativa
  unsure (1)..(931): unsure at all n locations
tttaggtgacactatagaatactcaagcttnnnncacatggagatgggccattcagggttttggagaaaatcactgacaatgcttacaagatagatcttcccggtgattacacagttagtaacacattcaatgtggttgatttgtcaccattctttggcacggaagaaacagattcaggacgatttaaatatgaattttagaagttttgagctatttaaatgaatttctagaattattaccgatttattacgcaataattatttattttcttaaaggaaaaataaggttattgcgtcaacagtgggacggttgtggatcgagtccaccaaatgcgggccccacgcatcagccaaaggggaggggcggtccaccgtggactaagtccatggcggcgatcggccacgcgggcacgcacccgatggcccagatcggccgagggcggctgggcggcgcggccgggcaggcgcacacggaaagcggccagcctgccgccggctagcggcgacctggcccaatagcgccggcggcgagcagcggcggcatgagcggggccgagagaaggcggttgaggcggggagggaggaaggggacgcatcgagcggaggtggcggctgtgtggcaaaggagagcgtcggcgttgaggggttggaggcggcacccgtgggtcgacggcactggcggagttccagcagtgatttccaagggcggaggggtggacggggcgcggcacaacgttgctacgccaacggagcaagcggcgcggtccggggtggtcgcggtcaatggcaatcgtcgatcggaggcgacgaatgcggcggcagcctctggttggcggcggaatcggcactacagcggtgtttcgcggcgagcgagggacggccgaggtagccctcggtgcggcgaggccggaggttgtggcggcacagcacg

SEQ ID NO: 83732 - DNA, 549 bp, Oryza sativa
ggatccccatagtctagcctgaaaaaaaatatagggttgactttcatacataggtaacaagttaaaagtctaggagaggggccggggagactcaatcggtgaatagtaccctctccgtattcgtaaaggaagtcagttatgacaatgtttaagttaaaccttgggagataaatcataaataactctcaagttgttgagtttgaaaacgtaaaaattatatgaatagatttgtcttgaaaaatacttttataaaatcatacacatatcactttttaataaatatttttatagaaacaagaagttaaagttgtgttttgaagaccatgtcactgtccaaaacggcttcctttacaagtacggaaagagtatctaggttaaaaaaaatattagggtagattttcagacttctatataagtaaaaagctaaaaggtctaggggaggggagaggggagagtcaatgggtgaatagtatctagtttgaaagaaatagttagggctgattttcagacttccataagaaaataagtgtggtggtagactatttcctg

SEQ ID NO: 83733 - DNA, 7374 bp, Oryza sativa
aatgagatgtttacctcctctatagtaactgctactcgaccacagctcgcatttgaaatacccgggggcacattccagcttttcagcctaatgggaatagggttggtggacatgcagactttgtccaaaatcgtgcaggagtgaggatgttggaccaacagaggaacatttatctgggtcaggcaggagaagggaatcagtacgctgaggctgtcctcaaggggccaagattagaaatccctctgttcagtggagaagatccaatagattggcttaagcagtgtgagaagttttttgagattacgggtacccctctggatcaatgggtgaatttagcggtggctcatttgaatggcagggcattgaaatggttcggaggaattggtctgccatggcaagtgatagcttggccacaatggtgcagcatggtctgtactcgattttctgctgcgagtgaacatgaggcaattgagttgttccaaaatgtgaaacaatttggaacaacagtggagcaatatattgacaagtttgaggattatgtggatttagtaaagagagaccacccttatctccaggagcaatatctgaccagctgtttcattgggggattgagagcagatattaaatacgatgtgtgtggtcagaaacctcaaggcttgcttgaaacttactggtatgcaaaaaaattatgaaagggctgctaatgccagaaaaatggtgggaaatttcaaccgaaacaggaatcagaatccacttggaggtaatcaggggcggaatgctaaccataggggacaaaacagaggtgagggagataggagagaggaaaagaagtgctggttctgtaaagaaccttggtttccaaggcaccagtgtaagattaaacaagcaattcacgctttgttagaagaagatgatgggcaagaagataaagaaacaagtaatactgggggtgatgagaagagaagaaagaaactgaagaatctgcaacttcagaaaatgagtccccaaccgaagagttgatgtacatttctcaaactgcagtacagggtacatccaggccagatacattctcagtattaatcaaaatcaatggccggacagctgtagggttggttaatagtgggagtccccccacattcatggatcaggattatgcccttaggaattcttatcccttgaaaaatactgacacaaagaaagtagtagttgctggtggtggagaacttaagactgatgtcatggtgccagacatcagctatgagattcaaggagaatgctttactaaccaatttaagttgcttcctctcaagggatatgatattatctggggtgctgattggatctataattatagccccatttcgctggatttgaagcaaagaattttgggaattacaaagggaaacaaagtaatactcttacaagatttcactaaaccaaataagcactttcagatcagtggtaaaagattggagaaaatgttaaagaagggggctcttggtatggtgatacaagtcaatgtcatgtctgaaactgtggaggaagaagggcatgttatacctgaagacattagtgacattatacaacaatttccagctgtgcttaaagaaccaaaggggctaccacctaagcgagaatgtgaccatgtgattaatttacagagtggggctgtaccacctaacatcaggccatacagagtgccacattatcagaaggaagcgatggaaaatattatcaatgagctgattgaatctaaggagattcaaactagtgatagtccctattcatctcctgctgtgatggttcgcaagaaagatggatcttggaggatgtgtgtcgattaccgacaattgaatgcacagactgttaagaacaaattcccaatgccaatcattgaagacttgttagatgaattaaatggagcaaggatattctctaaactagaccttcggtcagggtatcaccaaattaggatggctgagaaggatgttcataaaacagcatttagaacacatcttgggcattatgaatatcaagtaatgccattcggtttgacaaatgaccctgccactttccagtcacttatgaatcatgtcctagcaccattcttaagaagatttgtgttggtgtttttcgatgacatattaatctatagcaaaacaagggcagagcatctggagcatgtgaagttagtaatgcaagctttgcaagacaaccatcttgtaatcaagcttaaaaagtgtgcttttggacttgcaagtgtgtcttacctaggacatgtaatctctcaggatggggtggctacagatcccaagaaggtggggaaaattaaaaattggcccacacccaaggatgtcactgatgtaaggaaattcctggggatgacaggatactaccgaaggttcattcaaggctatggtaccatttgtagacctattcatgacatgctgaaaaagaatgggtttcaatggggagcagatcagaccacagcttttgagactctaaagcataagctgagaaccagccctgtcttggctttgccagactttgatcaagcattcaccatagaagcagatgcttgtggagtcggcattggggcagtactaatgcagggagggcgacccattgcatttttcagtaaggctttgggacccaaggcagctgggcaatccatatatgagaaggaggctatggctattcttgaagctcttaaaaagtggaggcactatgtgttgggcagtaaattgatcattaagactgaccagcaaagtttgaaattcatgatgggtcagagattggtagaggggatacaacacaaattgttgctaaaattgatggagtatgattataccatagagtataaatctggaaaagaaaatttagtggctgatgctctgtccaggctaccacaaaaggaagctgttgcagacaggtgtcacccaatgactgtggtgatacctgagtggattgtggatattcagaggagctatgaaaatgatgtacaagcacacaaaattctcagtttgattggtactgcagcagatccagatagagaatataagcttgaagcaggattgctaaaatacaaagggaggatctatgtgggagaagccacggatatcagaaggcaattgatcacaacctatcattcatcttcttttgggggtcactcaggtatgagagcaacccaccaccgaatcaaaatgttgttttattggcatgggatgagaggggaagttgaaagattcataagagagtgtcctacttgccagatcactaagtctgaacatgttcacattcctgggttgctcaatccattagaaataccagatatggcatggactcatattactatggactttatagaggggctaccaaaatcacaagggaaagatgttattctggtagtggtggatcgtctgaccaaatatgctcatttcatagcattagcccatccatatgatgtggagcaggtggtagaggcgttcatgaacaatattcacaaactgcatggtatgccgatggtcatcatcactgacagggaccggatttttactagcagtctgtttcaggagattttcaaagcaatgaaggtcaagctgagatttagtactgcttatcacccacaaatggatggacaaactgaaagagtcaatcaatgcctggagtcctaccttagaaatatgacgttccaagaacctcacaaatggtattcatggctggcactagctgagtggtggtataacaccactttccacaccgcaattcagatgactccgttcaaagcaatgtatggttattctcccccacaaatcaatgaattttcagtgccatgtaacatatcagaagaagctagggtgactattgaagaaaaggaagcaatactgaacaaactcaagaatagtttggctgatgctcaacaccgaatgaagtattttgcagataaaaatagaactgaaagaaacttagaagttggggatatggtatatttaaaattgaaaccctatagacagtctgcatttgggatcagagggtctctcaagctaagatccaagttttatggaccattcaaggttcttcagaagattggccaattagcttataagcttcagttacctgatgatgctcagatccaccctgtgttccatgttagtcagctcaagaagcatctggggaagcatgctattcccatgtccaatttaccctcagtaggaccagatgggcagattaaaacagaaccactagcagttctacagaggagaatggtacccaggaaaggagttgctgtgactcaatggttgatattatggcagaatttgtctcctgctgaagccacatgggaagacgcatcagtcattcaagcaatgtttccatcgtttaatccttgaggacaaggattgtcttgaggggaaggtaatgtcaggattgagaggaattctgagatttcagaaatattctaagtctgaaaacctgaagatgcagtttgaagtctgaagatgatgtgcgaacgggaggaagcagagttatgaagatccaacggtctgcagtgattccgaagaggtatcgcaggatcctaaccattcacatgttgtcggggaccactgtagtggtaaattgttgttttctctgaattggtgtgtgtgtgttcagtggcaaagaccactttggaatccttatgtactcctattaaaactattggcttgtggccaggagggagataagaaaaacctcattatcatttgttcttaggagtagggtaaagtagatctgggagaaacgagttcttgcggcgaccacctattttcttcccgatttactctgtttcgagcgaacaaaggagagagagaggcgtccatttccaggtgttttcagctctgatcctgacatcccccttcctccaccatccctgccccatcctaactcaactcccccttcctgctgttgggccagatttgcccgacgacgacgaagaggcggccatggcgatgagctcagcgcgcggtgacctcggggtgccatgtgcttatgtgtggatatcaatcactatgtttataacataattaattttgatgctgatagagtgataatgctatggtgtaaacaatgtggtctaatctaggttggcaggattaattggttagatcctgcgccacgaatttctgagttatatttctgacctgtaagcaatgggaagttttatttctgatctatacgcaatgaagttctatttctggcttgctatggtgtaagcaatgagggcaagttttatggtagatgtgactaccacatctaattttatacatgatatacatcattaaattaagaggtgccatatataataggttgtctctaccacacaatccccaatatatctaacactctcacatttttttttagataaaggatttatataaaacccggcttctacatccccaagaatgtacacagccaatcaagtccatacaagagcactaaggctcctcccattacatgggttacaaaaacatacttaaaagtaacataagaagtaccaagttcaactaacatgccagctaacaagacaaccaagcaaactcaacaaacaagcttaaacaacagtgtaagcttcaattctccctctgaaattccagccataattagagaagaattctaagaccctcatctctaacaccttgcaataatttttcaacatgttgccatcctcttccttaagcaacaaagaccaaagtcttgcccagtgtgtccctctgaaaattacctgcataaaagagtaagcacatgatccattaaaaaccacatcattcctacttaaccacaccgcctagcacaacgccgctatgcccacaaaaacttgattttttagcctaatgttaacaccacttagccaactaccaagtaaatgagacatattgtgcggtgggcagatgccaaaagtgaaatgtactacgctccacacatatcttaccatggggcaatcaaagaagaggtgttgtattatctcatgagacctacaaaagcaacatctaaggctacctttccacctcctcttagctaaattatccttggttaaaatgaccccctcttttaaataccacaagaagatctttattttcaacagaagtcttagcttccaaataaaagattgccttggtatcacatttccaaacatgagttttttatacatcgagttgactgtgaaagttccatttttactagcatcccaagtaaacctatccttttgccctctaaggtttatatcaaccacgttagctacaatctcatgccatgctttcaaattatctcctattatggctctcctaaaggagacgttcaaaggaaccctctccaacaccttagccaccaccacattcttatttcttacaagattgtacaacgatgggtatcttttctctaaagattggtttccaagccaacagtcttcccaaaatctgatttgtaaaccatcctgaagtttaaacgagccaaaagagctaaaggtatgaaccagttttgcacccaaagaggagagcatactctctttcaacctctatggctttgccaaaacacaacaattcgctcttatgaaaattaatcttcaagccagataaccttttgaaagcacttagtacaagtttaagatttttagcatcctctaggtcatgctccataaaatgtatcgtgtcatctgcgtattgaagaatggaaagaccatcgtctactaaatgtggaatcactccatgaatcttaccatgctcgcttgttctctgaattaacactgccagcatgtctgccaccaagttgaaaagtaaaggggagaggggatccccctgcctcagtcccttttttgtttgaaagaagtttcctatctcatcattaactttcaccgctacactgccacctcttaccacttgatcaatccacttacaccacctaggctcaaagcccttcattcttaaagtttgttgtagaaacttccaatcaaccttatcataggctttctcaaaatcaagcttaagaataacaccatccttctttcttttatgcatctcatgtaaggtctcatgtaaaattatagctccttccataatgttcctaccctttaaaaaagctgtctgagaaggctttatgattttttgggctaccaacacaatcctatttgccaagacttttgtgaatattttgaaacttacattcaacagacagattggtctatactattgaattttctttaacttccttttggtttggaagaagagtaattatcccaaagttcaaactatgaaggggaagcctacccagatggaattcgctaaagatggccattaagtcatccttgattacctcccaaaacacttgataaaactccgctggaaa

SEQ ID NO: 83734 - DNA, 784 bp, Oryza sativa
gatgtgcaatggtgcatagtggcggtaaatggggcagctcaagaagaatataaggagtcttttcttacagaacttgtgaatgcttgtagtagggattctttacctatggtaataggaggggattttaatatcataagaaacccacaagaaaagaataacgatagatataacgacaaatggcccttcttgtttaatgctgtcatagacagtctaaatttgagagagattgaactctcggttcgcaagtttacttgggctaacaacctacaaattccaacttatgagaagttggacagggtgttagttagtactgaatgggagttgaagaatccactagctacagtcaaacactgagtagagaactctcagaccatacaccattgctgctagactcgggataaggaacacatataaataaacaacctctgttcaaatttgagcttgggtggttgttaagggaagatttttatgggttagtggagaacatttggaaaaaggaggacagaggggtaacaaagatggaaaaatggcaaaataagatccgtagtctttgtcaattcctaagaggatgggcgaagaacgtaagtgggtcatacaagaaagaaaaggtgaagttgttagccttgactggggatttagataaaattgcggaaactagacttttgattagtgaggagttggatcgtaaaaatgctatgaaggatagattggcaaaactgctaagagaagaggaattgaagtggtatcaaagggctaacactaatagagtattagaaggcgatcg

SEQ ID NO: 83735 - DNA, 3566 bp, Oryza sativa
ggctccggccacggttgggtcgccgttggggaagtggggatggtgcggtggagattgggggaggggacggcgacacgtagaggagggggtcgatgacggcggcgggcgaggtcggaggccgcgcggtcgacgcgctccgcctccgtcttcaccgtcagtcgctcgagctcgccgcctccaccgcgaccacctgagctcgctccaccgcctgctctgccgctgccggtggcttcccaagctcgctccgcctccaccgccgctcgagctcgctccgccttgccgcccgcacgaacgaggtccacctccgtcgccggctgggccagctgagagagaacttccgtcgccagccagagcgcgcgcgcgtgcaaggggacttggagggatacgtatgacatgtgggcccagagaatattttttattttctttgctgactgtattgccatgttggcaccacgtgtacaaattcaagtaaaccgctaacagtacttaggggggttatttgtccggtatgaatacttgagggtgtaaaatatctggttttgttgtttagggggtaatttgatcgactgcgatagttcgtaggggtaaaacgtactttttcctccccaaatcgccaaccgtgtgtgcaaacatttgctgcgcagcagcttgatttcagttatatatgaagttagcaaatctctgtgagcttatttcgatgatatatctgttcctgtactcgtttttttttaccctgatatatatagctaccataacaaaagagcaccgaattggagttgcaaacaaaatattgataatatacctgctcaaggcatgtataaccaataaaggaaacaattcataaggcaaaactctaccaactactcttgcactcaccaagagcgatgcgttatgagcatcctcagtcctcgccatatgaattgcgaaactaatgcaaatattcggaatagggtttaatgcaggatttatgaacagccgtaccttctattttttcgcttgaacgccaaagcaattttttttttgtggaaccaagtataagtgatttgaataattatacaatctttttactttgaagtagctaactttatatttgttgtactttagatcatccccgactattttcactagccatgtccatcatatattttgttaaacgtatggtctgttcgtaggtgaaggattttgccagtgtaccagagctgacatcctcaaagttgttgatgtgctaaagaatggacatatattccggtaaaggtttgcttggtccataatcgggcagaaccaccacacatctagaccaatctaacgaggacagaggatagaaaacgggcgataccagcaggggaccacctatacatttgtcgacaaattttctcctaaaaatttaacatatgtaattatagttatgtaattatagtttaatcgtagtgtaattacactctaacttatatgtaattatactgtaatgtaagtttcacttaattttgaatcgttatatctgttacaatattaacatatgtgaaagaatttgttctcacgatcttcattttaccgaaataatatgttacggggagtttttgaaagttacatacaagttatattatagttacagtgtaattacatgtaagttacagtgtaatcacactataattgtactgtaattacatctgtcgataaatatatagcaaaattgatatctaatccacgagagatcacttgttgggtgggaacaccgtgaagtatgtctgtgtagcggctagagcgatgacgaatgtggcgacggcaacggagatggccgaccacgggctgggaaaataattgcgccggagcccagccatgtggctgtgccaccatgtcccacagtagcgcgtcacgtcgtcgtacagtccggagaaggcctgcgagtcgtagcccgccgggtggcagtcgtcgaggcggttgaagaaccgggccgcctcctcgtcgttgtccaacaggttcaccacgacgccgcgccggcggagcagctccacgtcgcgtgctgtcacgatgagctggctcatcagtgccacgtagctgctcaggagcccctcctcctcgccgcgctggctctgctcgaacgcgagcaggttcgcgagcagcggccgcctcgcgtcgtcgatcaggactgtgggtatctccattacgccccagcgggcgtcgaacgccacgtcgtacctcgtcccccctgcggcggccgctgggctctgcgcggcgacgaactgtacccccgcctctctcatctcggttgcgcatggtatcacccgtggcgtcctggtgatcgtccgtcggtcagaccgtgggcctcggcggcttcgcggcggtgttcggttgggaatgaagctctggtagtacagatggaggaggtggtggacctcccagtcgccggaaggccatctcattggctcttcgtcctcactgccgaggtacttgacgaaaaggtgaaggagggactccctgccgtgctgggcgccgccgccggtgactgcgccatagagcctctcgaggacgaagaacgggatctggttctccatgaggagcaggtcggcggccgcggggacaagcgtgaggccccttccagcgtcgcagagcgcgtcgggctccttggcgtgccactttaagaggaactcgaggatgaagcagccatcgagcaggagcatcacgatgaagtcgtcggaggcgaggccggcggggcgctcgctgtagcaggcgcgcgcctgggcctccagggttctcatctctgcgaccaaagtggacgcgctgaccgccgcgacactgccgtcgccggcgtggcgggacagcaggccctgtaggtagtgccacttgtggtcctccatggtgcgcagtgcggcgccgccgtggtaataggggccgatggacaccacgcgcggctcgtacgaggtgcgattgctctcgcggacgttggcgggaacgcggaagatggtaaatggctgccgcgccctccattgatctcctctgagggcatccaacgttgcctccaccgaagattccaacgacgccacatccatgagatcgatagcaaaacgagagaagtgatggtaggaagaagacacgcatgcaacttgcaaatgctcccgtaataaactgataatacactacagtactacaacatcatgaatggtcatcatcgaagcgcgtcgtcgttgacatttttgttttaatccaacgagcagaaatgaacgaccgccaacgcgttgattcgttgacatttaggtgagcgtcgctttcctgtaacttcctgttaggtacgcgcgcgaacatcttatttatgttttataaatttaactaaagatatcataattaggttttataattccaaccgatccatcacatattcacatgctcggggcactgagagcaagtttaatagtatagccaactactagctccaattcatccatagccaatctaatagctcatatatataatagttacatactatattattaatatctggtcccacctgtcatatacacgttacatcttggagaccgtgctacagctggctacaaatctgtagcccgctg

SEQ ID NO: 83736 - DNA, 2672 bp, Oryza sativa
  unsure (1)..(2672): unsure at all n locations
cttccacatcttttgatcccaccgatgatggggaggatagcctcgcctctgatcccaccgaagccggggaggataacctggcctcgctctgggaggacgccggggacgccgatgacatcttcgccgccgatgctatggtcgacgaggtgctggtcgaacgcgtctgcgctgttgtggagtccacccccgaggatcagatccccttcgccctcgctttcaaggtcgtggacttacaacgagccactcctcgccgccattctcgtgtccaccgccaagagctgctccggtaaaaagctactcctccagttcaaatctattaacttattaaaggaatagaaaaagaaacctccacgttcactctcaaggcctagagattctcacattaatcgggataagaagaaaagtagagtccatacaaacatacaatttaaaagtaacaaaaaattcagaattaaaatagggaatatagaaagaggagactagagtccatacaggtatacaacttagaactaattgatattcggaattaaagaaagaaaactaaaactacaagtcagagtccctatagaaatacaatttaaaaataactaaaattggaattaaaaaaaataaatattggaagaagcccatattgaatataatttagaaaaactgaaattcgtaattagtagaaaacaaatattgaaagatgagtttagagtccatatagaaatacaattagaaacaacagaaattcggaattaaaaaaaacaggaatattgcaagaagagtctagagtccatatataggaatttagaataaattgaaagatgaaattaagaaaaaaagataaaagtagagtttagagtccatatagaaatacaatttagaaataactaaaattcaaaataaaaaaaaagcaatattgggagaagagtctagagtccatataagaatataatttattttggaattaaaaaataaggaatattgaaaaaacatagagttcacataggaatacaatttataataacggaaattcggaattaaaaagaagaatattggaagaagaatatatggttcatataggaatttagaactaactgaaagtcagaataaaaaaaattaaaaaaataaaagtagaattttgagtccatatagaaatacaatttataaataacaaaaattcaaattttaaaaaaataagcaagattgggagaagagtctagagtccatatagtaatacaatttagaaataagtaaatttcgaaattagaaaataattaataactatcaatacaatacaaaattcaaaattgtgttgctatttttaatatattataataataaaatatggaaatatttaagctattatatgaggaaaaatataatgacgttagccgcgtaatctgcgcgggccatcatgctagtttgtcaaaaagcaagtgaaaaattcatccaagttttgaaagtgagggagataaaaaacgaccccttaaagagagatttgataatttaactcttcttaaacgagcgtcacttcgattatttaatatcttgattcactttcattcactcggatagacccacgtatcatgcttataagtgttaattaaagtaaattgaccataaaaaaagttaaattattaaatttatcctcagagtcatcagaaacgaaactagaccaatttaacggaggcctaacttgggcccaaatcaagcccatagataatgagatgggcctgtggggcccactaagcactaggagcggaggcaagagactctccgcgcacatgacgccttcgtgtgctttggactcctttcccccgccgccgctgcctcttgccctctcgtctccggccaccagtccactgcgactgcttgacatggcctcggcgccgtcggccttcatcggcaaccacaaggtcagttacctacctccggtcaatggcattgaggtctccgtagagcaagcggtgccgtcctcttctcacatttcggctggcgctgaaacctaacataacctggatccatggcagcggcgtgggcgtggtgccctgtggaataggagcttgtgtgtttgtgctcccagcaaagtggggtgagggatgtgtggtgttttggatttcggggggggggggggggtggnagggggagccgtcgcccatcaggttctcctcgtgggcgtgagctttcattcacatgtggtgtaccggtgtggtgtagccacagtcggagtgggtgatctccgagatagggtctgtttggttgtctgcggattgagaatgtgcatactgcagctggttgaatccgtcagataccagagcgacatgcgtgtttcagtgtttgtcttgcctttagggtttagcggttgatactgatgaaatgagagtctgatcctagagatagcatggcctgcaggaggtcatttgtagcgggttggacaccacgggcagtggacgagctgttagctttttgcaaacgtgtagtacatccgttcacggtagagccagttaggccagttaggtttagtatatagagattcacagcagtccttgatgagggctaacttcatgagttgtgaaattctacagttataataactaataaacagtggtgtgtgatggattaagatggcgtattgactggcaaatacaattatacaacagtagattatatgcctttgctatgaa

SEQ ID NO: 83737 - DNA, 1172 bp, Oryza sativa
gatcactgcatagatgcgcattcagattgtgttgtgtgggtgaggattgctacaaatctacctgttaatgtttttttaaaggatccatgtatcttttatttctttgacatgtagcctgctggattcagtagacggtagaatcatataacctggaaatgagcagctcaatctgaatgtctttttgtgtcttacagttagggatgaaaacggagcggatatggacggataatgctcataccatattcgttttcatattttttaccggatacgaaaacgaatacggatagctcgaatacggaaacaaatacggattatctcgaatacgaataagaatcgaatatgatcggacacaaatatggatacaattttttctcggaacataaaaaccaactcaacttctaatggaaagaaatatcagcatatataattagctcattttatataaaatgaggtataatttataaatattttttaaaatttaaataatatattaatagtatggactagtgttaagagataaactactattaaaatctataaaggtatattgaaggtcatagagttagaaagaaatggggtatgtctcatgggtcctacggatatccgaatagcactgttcaccggatatccgaattattatccgtatccgacggaaaccctggtaccatattcgtattcgtatccgggagaaaatatccgtattcgtatccgtatccgaactattcgagaattatccgatccgaaaggtatccgtatccgtttttgtccggagcggacggaaactatccgctccgtttttatccctacttacagtatgtaactcaaacctggtgttcagtacaagagtccataatatgctccatggaaacgctgaaaattccatctaagatttggattcaacttatctcgaaaatgaagctgatgttcgtggaaatgaggctaaagcttccttcagtactacgctttcccacttctactcgctctaacttctactcgatcgtttttcacgcgctccttaagctaaatatatccgtactcacgcttttttaaactatttaacggtgtattgtttagaaaaaaagttataggaaagttaatactttattaatcatacgctcatctcttgctccgtttgggaaaaaaaagagaaaagtttcataggggcccaaaaa

SEQ ID NO: 83738 - DNA, 510 bp, Oryza sativa
gcactggatctgctactgttgagccagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgataaacaatgcatcgaaggagatgggtttgagacccatgtgagttatactatggtggtaacccagtctatgtgatcggagatcccgtgaattagatcctgggaagaacaaaccattagtaaactagaggagagtatcaatatatataccctctccaagtgaagatacatgtactctcgtgagctgcaaggcaggttggctatgccttaatgagttctgttggctttaat

SEQ ID NO: 83739 - DNA, 714 bp, Oryza sativa
cggcccgcctgcaaagatcaatcttcgcaggcagaccgccccctccaccctgggtactttttttgccggcggggttttggctccgaattacatgcccgcctgcgaaaatcgatcccctacgacgccgaaaatgagttttctagtagtggcaaggaatcaagtagagagtttataatgcacctcagcgtaagcatcgatgctatggagggaagagtcgatgcggacgatgctcccgacggcgaccccacgtatccacacgggcgtgcccacgcagatcccgcaggcctgggtgaactcgaagacggggcctggtacttgccgaagcgggagcgcagctggaacccacggatccacgccaccgcgagcgcgagcagcgccgcgccggtgaccatgaagagcccaacgccgccttcccacacgccacagcgccccgggcacctcgacgagcgccgcgagcgggttccagccaccggtcgtcggcgtcggcggcggagcacgcgacggagctagcttgggctcggtggggcctgggcgcgcgggcggagaggtgggttggggagggaggaggaatggcttggtggtggccatggatgattggtggaggaatctagcgagagatgcggatcagttcttgggggattggactggggggaagcggcagtgcgggacacaaagaatggttttgaggaaatttgttcggaaaccggagaaagg

SEQ ID NO: 83740 - DNA, 604 bp, Oryza sativa
agggaagctcctacatgaagcatgccaagaagcttggtgagctcgacccactgatgaagccgaagcaagaccggtacgcgctccggacatccccacagtggctcggccctcaaattgaggttatccgcgccgccaccaagtccatcgagcgtgagatcaactccgtgaacgacaacccgctcatcgacgtctcccgcggcaaggcgctgcacggtggcaacttccagggcacgcccatcggcgtgtccatggacaacacccgcctcgccatcgctgccatcggcaagctcatgttcgcgcagttctcggagctcgtgaacgacttctacaacaacggcctgccatccaacctgtctggcggtcgcaacccgagcttggactacgggttcaagggcgccgagatcgccatggcctcctactgctccgagctgcagttcttgggcaacccagtgaccaaccacgtccagagcgccgagcagcacaaccaggacgtcaactctcttggactcatctcctccaggaagaccgacgaggcaatcgacatcctgaagctcctgtcctccacgttcttgatcgccctctgccaggccgtcggggctgcagg

SEQ ID NO: 83741 - DNA, 640 bp, Oryza sativa
gaagaagtccatatcggcaaagccggagaagcggcggcgcaggccggagagccactcggtgtggccgaccaactcctcctccagcaccgcccagtccatccaggtgatggcgttgtcctgacaataggcattgttgttgccctgctggctgcgcccagcctcgtcgcctgcggtcagcatgatcgtgccgcgtgtggcaaacagggtcgaaagcatggcttcgatatcggcgcggcgctcgttcaggatagactgattgtctgtctttccctcaacgccattgttccaggagtaattctcattgtggccgtcgcgattgttctcgccattggcctcattgtgcttgttctcgtaggaaacgagatccatcagcgtgaagccgtcatgggccgcgaggaagttgacactgcggctctgtgtgcgtccgtcgcggccgaagatggaagaggagccggcaagaatcgttgcgagctcgccgatccctgcgtcgccacgccagaagcggcgcaagtcgtcgcgggcgcgatcgttccattcgaggaagggtgccgggaagctccccagctggtaaccgcccggaccgatatcccaaggctcggctatcaggatgcgatcccgaagcacctcgtccgccaacagg

SEQ ID NO: 83742 - DNA, 648 bp, Oryza sativa
atcattacagataatggcacccaatttactggtggagtgtttaaagacttctgcgaagattttggtatcaagatttgttacacatctatagcacatcctatgagcaatggacaggttgaacacgccaatggtatggtacttcaaggcatcaaagcatgagtttttgactgactgcgtccctatgccagcaaatgggctgatcagctgccataagttctttggtctcttcgcactacacccagtcggcctatgggccaatcaccgtttttcttagtctatggtgcagaagcaatgttgccaagtgaggtggaatttgaatctctgtgatttcgtaatttcaaagaggagcgctacgaagacgaccgagtaaatgatctcaaccgactggaagaagcccgagaagcagcattaattcagtcggctcggtatttacaaggattgcggcgctatcacaatcgcaatgtcagatcacgcacatttttagtcggagatatggttttgaggaagattcaatctacgcgagataggcataagttatctgtatttcagaaaactgcaactatagtgataaaactatcagtttgctgtaatggagtgtacaaaccatggggattcaatttcgattttgctttatgacccgtggttcgc

SEQ ID NO: 83743 - DNA, 1586 bp, Oryza sativa
cccttatattatgggacggagggagttgtcattttcggctttctttttgcatatgcagtgaaagtagctaaatgagatgcattcttctgtcaggtcgaatgaggtgtctagcagccttggcccgttgggaagatttaagtgcattatgcagggagcaatggactggctcagaaccatctgcccgactagaaatggctccgatggttgtggatatatcttgttatcaatttactgtgtatctttaacttgtagttctgctaatttaagttctaatttccttttcttttttttttctaggctgccaatgctgcttggcatatgggtgagtgggcccacagggctgaaatgtttctcgtctggatgatggggatgaaaacaagctccggatattgggtacacaacagctagtggtacggaaccagcaatggtgcttctttagggctgttctttcagttcgttgcaaaaaggtatgcttgcatatttgttgatttctttttccatttcttcttgaaaatttggtcatgcttttggttacttggcatttgttttgcagtatgaagaagctcgtgtatatgttgagagagctcggcggtgtttggctacagaacttgcagcattggtataacattatagtcaaatatattctttacataatctccattattcgaattttcatattatggagacatttgtttttgttcatgtttagggatttgccattggtttttgggtattgtggggtggggccctaaatactagtagctcttactgtcataggcagtgggctgagttgtccaggccctaggggtagggatctgttctagaaggaaatttcggtgatcttttctgagacctagaacaaatatttggaaaacagacataatagtattcacgggtcaggtgctggttgagaatgctgtagaatggacattgaattgttagctgataggatgtaaaggctaaaaagatgaacttctgatttttaacagactgtatagatcgtttcgatggttggatgaatcatacaaccactgatcaaggggataaatggtgacaaagtaaatttgaatgtgaagcaattaggtgtaaaccttggaactcaatatttataagataatataacagttgaaatatctctcatgtgactggtttgaataaattggttaagtaattttctttagttctttttttacttagaaagcaaaggtgaatgtttatagtactgatgactaatatcccctcttagagttcagtaattgtaacagaacatccttgttttccctttcgtgatcctattcttgtgaccaggtacttgagagttatgagcgtgcttataataatatggtgcgggttcaacagctttctgagctggaagaggtatatcctcatttcggttactttctaaagaaacttattgtcttgctaaccaaatatatgacctggacttcaggtgattgattactgcactcttccaatggaaagtaccaatagctgacagccggagggaacttatccgtaatatgtggaatgagcgtattaaaggaacaaaacggaatgttgaggtcatattatgcttcttttaactg

SEQ ID NO: 83744 - DNA, 726 bp, Oryza sativa
cctgtaagctatcatcaacaccttttgtcgtggatgcgcaagcaatagagtagaaatacccagttactgctgcaacaacatattttcctgcaatatctggtcgaccacgcaaagtatagcgggacatgacttcagtgttgaacaaggcccataagtgccatgccttgccccagtccttggcattaagtgtggcatttttgtaagagaccaatatttctggataaagaaaaaaagtatatttacatcaaaacgggcaggcagacaaaaagtaaaataactattttttcaagtctcaatactttggtaggcaatcttgcccacccacccctcaagagggaaataaactgaagttattcagaccttgaatagaatcatcgtctaacccaggtgataatgctctcttccagctagcaagtgtcaaatagacgcgagcaataagtggtactccagcatttgatgtggcaacctggcttgctaatgttccagaataactatttgttgcggtagcaagctgcacagacaaatcctataccacaaaaccaaaaaggaagtataaaaaaccacttaaatgcagaataattctgcaacttggggtcaaagacgaaggacaataacaagctcacctgtagcctgcaaaacgcgtcccttcgtttaagctcatctccaacagcatactggtacttcagggatgccatgactacttgaggatgtccatgatacagcgtc

SEQ ID NO: 83745 - DNA, 1102 bp, Oryza sativa
acaaccgtcccactgttgacgcaataaccttatttttcctttaagaaaataaataattattgcgtaataaatcggtaataattctagaaattcatttaaatagctcaaaacttctaaaattcatatttaaatcgtcctcgaatctgtttcttccgtgccaaagaatggtgacaaatcaaccacattgaatgtgttactaactgtgtaatcaccgggaagatctatcttgtaagcattgtcagtgattttctccaaaaccctgaatggcccatctccatgtggcataagcttggacttccgcttctccggaaaacgatccttacgaaggtgcacccaaactaattcaccgggttgaaatagcatcttctttctgtctttgtttgcctttgcagcataggactgaattatcctctcaatggtctccttcgtcttctcatgcattttcttcacataatctgcacgctttgttgcttccatattggcacgttcttgaagtggcaggggcagcaaatcaagtggtgtgattgggttgaagccatacacgacctcaaacggactgagttgagtagtagaatgtaccaccctgttatatgcaaactccacatgtggcaaacaatcttcccattctttcaagttcttcttaatcatcattctcagcaacatagaaagtgttcgattcaccacctccatttgtccgtcaatttgggagtgacaagtcgttgaaaacaacaacttagtcccaagcttagcccacaaagtcttccaaaaataactcatgaacttgacatcacgatctgatacaatagtgcgaggtactccatgcaagcgtacaacctccctgaaaaacaagtcagctacatgcgacgcgtcgtcgcttttgttacagggaataaagtgtgccatttttgaaaatctatcaacagctacaaatattgaatccctccccctccttgtcctaggcaatcctagaacaaagtccatactaatatcctcccaaggtgcattaggaacaggtaatggagtgtacaaaccatggggattcaatttcgattttgctttatgactagtgacacacctttgcacatacctctcaacgtcatgc

SEQ ID NO: 83746 - DNA, 528 bp, Oryza sativa
gcacatgatacttctcccagcctttcccatccaaacacttagaatatggatctgaaaattcactatccttagagtacaattctttcaaactctctaaacttgaaactttcacgtctaattgagtcaaaagcacactcttgcgagataaagcatcagcaaccacattctcttttcctttcttatatcgcacaatgtatggaaaggactcaataaactcaacccacttagcatgcctacggttcagattagcttggcctcttaaatatttcaaagcttcatgattagaatgaataacaaactccttcggccaaagataatgttgccaagtttccaaagcacgtacaagagcatagagttctttatcataaacagggtaattcaattgtgcactaccaagcttctcactaaaatatgcaatgggcttaccttcctgcatcaaaacaccaccaataccgattccacttgcatcacattcaatctcaaaagttttagtgaaatcaggtaaaataagcaatggtgcttcagtta

SEQ ID NO: 83747 - DNA, 1647 bp, Oryza sativa
aatcaattgtgttaacatctctatttttaagaattgggatgatgagttggcatttggagtccaccgttacatgtgccttccttgggcaacttagtgcacatcatgacctccagaaatgtggtactgattatcataacagatattatagctccataaatcactttccatgagatgttggtgtcacttaactcaataccaagaacaatgttaatggctgccaagaaaatacaaatcctacctaaccaatggtggtactggttccaacatttccgcacctgagaatccttattaggatgaaggaaaaatgcaataacctgtaacatgtagtacatccaatggcttcagacataacagaaatgaatcaaatgataggcattagcagtcaggatggcaaaattagttgcatgatcatactaacctgaagagaaccgagagcaagaactgaaatgccaaggcttctatgcgtagtaaaatttgaataggtcctgttgtacaatgcaatgccagaaacaacacccgcaaacccaatgatgtaaccaagaaattgcacgaggacatgaaggtaataccaaagtgggtccttatgtctgagataacgagcagcaattgctcccagtggtaccagaacaccccagccaaaaattgcaaatgcaccatggttcctcttcaattggtatggataataagtactaacagaatcacctgcgtagaaaaaagttaggttcaggtagtattgaaaaaacattttctaaaagaaaatttacattgcagtaaaaaatgatgtgaaaaacagataaggcttgcacttgtactatcttttatgttgaacttttgctgatgtatggtgctaatattttattacttctacaaaatcagttgaatgtagaaagtgttttttaaatgtttatgttatgatgtggtatcaccatatagttgatctggtaaacattcttcttttacgagttctaacaaacattggctgaaccttattatttaatgagattgtctttgtgacaatcaggtaactgattcagctagatcgatcgatttttttcactgtatgcattgcataatgtattagctgggatgttttttcatgttatccaatacaaatgtcaacaatttttagagacttggttttatatccaataatcaccctcttctcaactgctcaatacataccctattcctttgctgtctgctatcaaacaccccaggaatttagccatttatgtgaaggccccatttattgcatgtaaaaattactccactcctgtagaacaacggtttcctgtgatggagttcaaattcctgcattccagatggagttcaagttcctgcaaatttcttgtgacattccaagtggggctaaaattgtctctgctaatttttctacttctatttttctggcgttatcttcaggtatcactgatcagattctgttcagcggtctcaaaagtctaatgcatattccccttaatacaaagatgcgctccctgtgtattcccaaaaaaaaagtctaatgcatccttctgagatcagaatttaaatcgtatttacatatgtaggtaatattcagaaatgcaaatgcccggtttttggttaacttttctaatattttctgttttggggggcgccagatacaca

SEQ ID NO: 83748 - DNA, 564 bp, Oryza sativa
agatgtcaaactgacatgttccaacattgaattgcaggagatggtctggctggcatgaagcaaggggatctgataatttggtatgttgagcagcagaatgcccaaggagcctatagttctacagcagaggtgaaggaagaagtgaagtgcatcaaggccatcatagaggtaaaagccttcattgatcttatcatctatgtatcaatttgcctgcattgatcctatcagttcaacagtatggtatggaaattaacctaacaagactacatttaaggcatttagctgcatcaatttgcctgcactgcaagctcaacattgaccatttatattgagcattacctcagctttccatgttgctaaaagttatcaatcgatttgcaaatgcagaggttaatacagagggatggccatctcatagtgatagacgaaggagcagccccagcggctgacgacggtgctgcacgaagaacatcagagagcagaatcctggcagttaatccgaactatgtcatcgattaaccatctgaattatgatacgcagctaacacaatccaatcgatgtgg

SEQ ID NO: 83749 - DNA, 700 bp, Oryza sativa
gcaaacgagcgcccaatgtcaactcccactagatatagaagcagaaattaacagaaaaatataattgcatgatataataaggatgttgcagctttgggatttaatacagcaaaaaaaaacatgttgggttcaaaaacagacactttttaacatgtgcgtactgtttttccaagtaaagatccacaagtaaggaaaaccagaatatatcacatcataatcactacaataaatggaatggtttacaaagttcacacttacagctttgttgtcaaataacttcggcatactcctatctattatatcctttaacatccttggtgctaagggtacagtatcagagatcattctcaaactctcatgcaactgagaatagatttccttcttccttgcaagccatctcggttggccgatgaaagcagtaagtgatccaggtggagtgaagttgttcacaagcatctgcaaacactctcttaagaactgatctgccactgcagcctggatggtaaatcgattgatcagaagcttatatacagatcatccagggcaatgtgcatgtggttgtagaaaataataccaatctggtgattaatgacaaaagagcatcccttgtatcgctgttcaagtaccagatagacatcgtaaatatctgaaaaatagtgccttcagtaagatccagttgattcagcaaaagacataaagt

SEQ ID NO: 83750 - DNA, 864 bp, Oryza sativa
tgatttttgtgactgttctgagttttgttcgtcttcgtctgtttccagttccacctcctgaagcagaggcagctgttgaagcaacaacgggagcagcagctcgccgcggcaacagcggcgacgtggggcacgcaccgcgccggcgtcggcccgccgcttggtctgaactcgtccggctggccaccgctgcagaagtcccaccagcaggcgtcgtccgcggccggcatgcgcgccgtgttcctcagccctccaggaggcaaaccggaacgcacgggcaccggcgtgttcatcccccaccagggcggcgcccccactgagcccaagaaaaagctaagtgcgcacctcctctgaagcaacgcaatgctcaccacccagaagcgggtgcagccgctgccgacgcatgccgctgcacgccgtcctcctcccggacgtaggactgcagctcggcgaggaagtcgccggtccgtgttaaggcgagcagagcggcggcgccctggaagatggcgatgaggacggcgggagcaggagcagcggagtacgacgaggacagagggagcggccgccgcggcgcttgcggtggaggacggcgaggacatagaagccggaaccctcgtgcggacggcggcggtgagttcggtcccctccttgaaggggacgcggcgcgcacggcatgggcgtgcgagcgaggccaagatctgctgccgcacgaggcccacccggtcggcgacgacgacccgcagtttgcggacgccgaggaagggctggacggtgacggtgccgaggtcgacggtttggtcgccgtcgacgaagacgacgggcagcacggccgtgggcggcggcggtccgcgtgctggtggttgagct

SEQ ID NO: 83751 - DNA, 721 bp, Oryza sativa
ggatccccctatgactatcttacccctcatcgccaaagtagaagtatttcagcatgccctagaaaacagtgaaggaaatgaccttgcaaaggtactgtgctgtttttgtcatgccaaattggtgctttctgagacaatgtttaacattaatctacctgaacaaacttgtgtcaggttctctggcttaaaagccgaacctctgaagtatggcttgagcggcgcacaaattatacgagaagtctggctgttatgagcatggtatgatttactgtcatgttctgtttttgtttttgaattaaatgttcttttccatgttaagatgcttcaatgttgattttctaggttggctatttgcttggtttaggagatcggcatccaagtaatcttatgttagatcgttataggtacatctacaaaacttctcttcctgttcatcattgggcaattgttttcattgcgtcttctttttttgttgcttcagtggaaaaatattacatattgactttggcgattgctttgaggcttcaatgaatcgtgaaaagtttcccgaaaaggtaaggatgtgttctggacattatctctctccaattaataatttattctgtagctcgatgatgtatcattttatggtcttcctttgacatcaaattatttttcatgtgaggttgtcattatctcgtacgcattgatccataagagtatggcatttcattattgtatg

SEQ ID NO: 83752 - DNA, 691 bp, Oryza sativa
ctcctcttcttcctgctcttctccaccaccgcgctctactcctccacctcgtcgtcctcctcctccgccgtgctccgcgccacgacgacgacgacgaccaccaccacaaccaccacgaccaccaccaacaccttcaccctctccttccaagccaacccaaaccctcccccatctaacctctccaaccacactgccctggacgcggcgggggcggccgggcacacgcagagccacgtggtggtggggcggcatgggatacggatccggccatggccgcaccctgaccccgtcgaggtgatgcgggcgcaccggatcatggagcgcgtgcaggaggagcagcggaggtggtatggcgtcaaggagccgcgccatgtcctggtcgtgacgcccacctactcccgcgcgttccaggcgctccacctcaccggcctcctccactccctccgcaacgtgccctacccgctcacctggatcgtggtcgaggcaggcggcaccaccaacgccaccgcgtccctccttgcacgctccgaccttaccatcgttcacatccccttccctgaccgcatgcctcatgactgggctgaccgtcacgcaaccgagaatcgtatgcgcctccacgcactgcggtatgtgtgctttacttcaatactttccgctttctcatagttagtaattttctttgttgaattcc
